United States Patent 11,931,406 (FLAVIVIRUS VACCINE) - sequence listing, part 61

SEQ ID NO: 21607 - RNA, 9879 nt, Artificial Sequence
  derived and/or modified CDS sequence (opt6) from DENV-1__FJ410279__SS-prME
uccgucacaaugcuacuuauguuaaugcccacugcacucgcguuucaucuaacaacaagagguggagaaccucacaugauagugaguaaacaagaaagagguaaaucguugcuguuuaaaacaagugccgguguaaauauguguacucuuaucgccauggauuugggcgaauuuugugaagauaccaugacauacaaauguccaaggaucacagaagcagaaccggacgauguggauuguuggugcaacgcaaccgauacuuggguaacuuacggaacuugcucccaaacaggcgaacacagacgagauaaacgaucaguagccuuagcuccgcauguaggcuugggauuagaaacgcgaacagaaacguggaugucaagugagggcgcuuggaaacagauccaacggguagaaacuugggcacuacgacacccuggcuuuacgguaauagcucuauuucuugcccaugcuauaggcacguccaucacucaaaaagggauaaucuuuauucuccucaugcucgucacaccaaguauggcgaugaggugcguaggaaucgguucaagagauuuuguagagggauuaagcggggccacguggguugacgugguacuggaacaugguaguuguguaacuacaauggcuaaagauaaaccaacacuggauaucgaacucuuaaaaacagaaguaacaaaucccgcgguucuccggaaauuaugcauugaagcuaaaauuaguaauacaacaaccgacagccgauguccuacacaaggugaggcaacacucguugaggaacaagaugcgaauuuuguuugcaggcgaaccuuuguggaucgcgggugggguaauggaugugguuuauucgggaaaggaucuuuaauaacaugcgcgaaauuuaaaugcguaacuaaguuagaaggaaagaucguacaauaugaaaaucucaaauauuccgugauuguaacuguccauacaggugaccaacaucaaguagggaaugaaucaacagaacauggaaccacagcgaccauaacgccucaagccccuucuaccgagauccaacucacagauuacggcgcauuaacccuggauuguagcccccgaacugguuuagauuuuaaugaaaugguacuccuuacaaugaaagaaaaaucuugguugguacacaagcaaugguuucuagaucucccucuuccauggacuucaggagcaucuacaucccaagaaacguggaauagacaggaucuucuaguaacuuuuaaaacagcacacgccaagaaacaagaaguagugguuuugggaucccaagaaggagcaaugcauaccgcacugacaggagcgacggaaauacaaacaucugguacaacuacgauuuuugcuggacauuugaagugcagacugaaaauggacaagcucacguuaaaaggaaugucauauguaauguguacuggaucauuuaaguuggaaaaggaaguagcugaaacacaacauggaaccguauuagugcaaaucaaauacgaaggaaccgaugcacccugcaaaaucccauuuuccacccaagaugaaaaaggcguuacacaaaauggcagacuuauaacagcgaauccaaucguaacagacaaagaaaaaccagucaauauugaagcagaaccacccuuuggugagucauacauaguuaucggugcuggagagaaggcuuuaaaauuaagcugguuuaagaaaggaucaucaauuggcaaaauguucgaagcaaccgcacggggcgcuagaaggauggcgauacucggggacaccgcaugggauuuuggaucaaucggcggaguuuucacaagugucggaaaauuaguacaccaaauauucggaacggcuuacggaguacuauuuagcggcguaagcuggacaaugaaaaucggaauaggaguacucuuaacguggcuuggucucaacaguagaucgacaucucuaagcaugacguguauagcuguaggucugguaacccucuaucuugggguuaugguccaggcagauaguggauguguuauuaauuggaaagguagagaauuaaaaugugggagugguauuuuuguuacuaacgaaguucacacauggaccgagcaguauaaauuccaggcggauucucccaaaagauugagcgccgccauaggcaaggccugggaggagggggucugcgggauaagaagcgcaacaagauuagagaauauaauguggaaacaaauauccaacgaguuaaaucauauacuucuagagaacgauaugaaauuuacugugguaguaggugaugucgcagguauucucgcacagggaaagaaaaugauccgcccucaaccuauggaauacaaauauuccuggaaauccuggggaaaagcaaaaauuauaggagccgacguacaaaauacgacuuuuauuauugacgguccaaauacaccagaauguccagaugaucagcgagcauggaauauaugggaggucgaagacuaugguuuugguauuuucacuacgaauauaugguuaaaauuacgugacucauauacucagguuugugaccacaggcucaugucagcugcuauaaaggacucaaaggcggugcaugccgacaugggauauuggauugagagcgagaaaaaugagaccuggaaacuagcgcgugcauccuuuauagaggucaaaaccuguauuuggccuaagagccauacucuauggucgaauggcguccucgagagcgaaaugauuauuccuaaaaucuacgguggaccaauaucgcagcacaacuaucgacccggcuauuuuacucaaacggccggaccauggcacuuaggaaagcuagaacuagauuuugacuuaugugaagguaccacgguagucguggaugaacacuguggaaauaggggacccucuuuaagaaccacaacuguaacgggcaagaucauucaugaaugguguuguagaucuuguacccuaccaccucuuagauuuaaaggagaagacgguuguugguacggaauggaaauccgacccguaaaagaaaaggaagaaaaccucguuaagaguauggucuccgcaggaagcggcgaagucgauucauucagucucggguuauuauguauuucaauuaugaucgaagaaguaaugagaaguagguggucccguaaaauguugaugacagggacgcuggcaguauucuuucuguuaauaauggggcagcuaacauggaacgaccugauuagacucuguaucaugguuggcgcgaaugcaucagacagaauggguaugggcaccacguauuuagcauugauggcuacauucaaaaugagacccauguuugccgucgggcugcuuuucaggcgacuaacuucaagggaaguuuuauuauugacgauaggguuauccuuaguagccucuguagaguuaccaaacucuuuagaagaacugggggauggauuggcaauggggauaaugauccucaaguuguuaaccgauuuucaaucucaccaacuaugggcaacguuauugucucuaacauucaucaaaacaacauucagucugcacuacgcauggaaaacaauggccaugguacuaucuaucgugagcuuauucccuuuauguuuaucaacuaccucccagaaaacuaccugguuaccgguuuuguuaggcucauuaggaugcaaaccgcugacaauguuccuaauugccgaaaauaaaauauggggaaggaaaaguuggccucucaaugaaggaauaauggcaguagguauagucagcauacuccuaucaaguuuauugaagaacgacguaccuuuagcaggaccccuuaucgccggugggaugcuuauugcauguuacguaauaucagggucaagugcagaccuaagccuggagaaagcugcugaaguaaguugggaagaagaagcggagcacucgggcgccucucacaacauacucguagaaguacaagaugaugguacaaugaaaaucaaagaugaagagagggacgauacucugacuauacucuugaaagcuacucuauuggcagucucuggaguuuacccuuuaucaauaccagcaacacuauuuuuaugguauuucuggcaaaagaagaaacaacgaaguggaguacuaugggauacaccauccccucccgagguggaaagggcgguauuggacgaugguauauauagaauaaugcaacguggauuguuaggaagaagucaggugggcguuggcguguuucaagaaaauguauuucauacaauguggcacgucacgagaggggcaguuuuaauguaccaaggaaaacgucuagagccaucaugggcaagcguaaagaaagaucuaauaucuuacgguggcgguuggcgauugcagggaagcuggaacacuggagaggagguacaggugauagcaguugagccuggcaaaaacccuaaaaauguucaaacagcaccagguacuuucaaaacaucugagggugagguaggugccauagcgcuagauuucaaaccgggaacaucugguucaccgauuguuaaucgagaagggaagauagugggacuauauggaaauggugucguaacgacaaguggcacuuauguaucagcaauagcacaggccaaagcaagucaggaagguccuuuaccagaaauagaagaugaaguuuucagaaagagaaaccuaacgauaauggaucuacaucccgggucugguaaaacgcguagguacuuaccagcaaucgucagagaagcaaucaaaagaaaauugaggacauugauccuagcacccacuagaguaguggccucggaaauggcagaagcccuuaaagggaugccuauucgauaucaaacaacggccguuaagagcgagcacacaggcaaagagauaguggaucucaugugucacgcaacguucaccaugagacuuuuaucaccuguucgcguaccuaacuacaacaugauaauaauggaugaagcccacuuuacagacccgucuucaauagcagcuagaggauacaucucaacgagagucgggaugggugaagcggcugcgaucuuuaugaccgcaaccccuccuggauccguugaagcguucccucagagcaaugcagucauccaagacgaagaacgggacauuccugaaagaucauggaacucgggguacgaguggauaacagauuuucccggaaagacgguaugguuugugccaaguauuaaaucaggaaaugacauagccaauuguuugaggaagaauggaaaacguguaauucaauuauccagaaaaacauuugacacugaauaucagaaaacgaaaaacaaugacugggauuauguagugaccaccgacauuagcgaaaugggagcuaauuucagagccgauagaguaauagacccgcggagauguuugaagccaguuauacuuaaagacggaccugaacgcguaauauuggcagggccgaugccuguaacaguugccagugcagcacaaagacgaggucgaaucggcagaaaccacaacaaagaaggcgaucaauauauauacaugggacaaccauuaaauaaugacgaagaccaugcacacuggacugaagcuaaaauguuacucgauaacaucaauacccccgaaggaauaauaccagcucuauuugaaccagaacgggaaaaaucagcagcuauagacggugaauaucgucuucgaggcgaagcacgaaaaacauucguagaguuaaugcguaggggagaucuuccugucugguuaagcuauaaaguagcgagugaagguuuucaauauucugauagaagguggugcuucgauggcgaacggaauaaucaaguucuagaagagaauauggacguggaaauuuggacaaaagaaggugaacggaagaaacuucgcccacgcuggcuugacgcuagaguauacagugauccacuagcgcuacgugaguucaaggaauuugcagcgggcagaagaucaguaaguggagacuuaauauuggaaauaggaaaauuaccgcagcauuuaacgcaaagagcgcaaaaugccuuagacaacuuaguuaugcuucauaauagcgaacaaggugggagggcauauagacaugcaauggaggaauuaccagauacaauagaaacgcuaauguuacuagcguuaaucgcgguauuaacugguggagucacauuauucuuuuuaaguggaagaggcuuagggaagacaucaauaggcuuacuaugcgucauggcuucuucuguacucuuauggauggcuucuguagagccacauuggauagccgcgaguauuauauuagaauuuuucuugaugguauuacuuaucccggaaccagaucgacaaagaacaccacaggacaaucagcuagcuuacguugugauugguuuauuauucaugauuuuaaccguagccgcaaaugagaugggauugcuagaaacaacuaagaaagaccucggaauuggacacguugcaguagaaaaccaucaccaugcagcgaugcuugauguugaccuacauccugccucggcauggacacucuaugccguagcaacaacaaucaucacuccaaugaugcgacauacaauagagaacacaaccgcaaauauaagucuaacugcaauagcuaaccaagcagcaauuuugaugggccuggacaaaggauggccuauaucaaagauggauauuggaguaccccuacuugcgcuuggauguuauagucaggucaauccauuaacucugacagcagcagugcuaaugcucgucgcacauuacgcgauuauaggccccggccuucaagccaaagcaacuagagaagcccagaaaagaacugcugccgguaucaugaagaauccaaccguugaugguauaguagcgauagacuuagauccagucguauacgacgcaaaauucgagaaacaauuaggccaaauaaugcugcuaauauuaugcacuucacaaauacuccuaaugcguacaacaugggcccugugugagucuauuacacuugcuacugguccuuuaacgacauuaugggaaggaucgccggggaaauucuggaacacaacgauagcagucuccauggcaaacaucuuuagagggucauaucuugcuggggccgguuuagcuuuuagucuaaugaaauccuugggugguggaaggagaggaacaggagcccaaggagaaacucuaggggagaaauggaaacgucaacuaaaucaacuuucaaaaucugaguucaauacauauaaacguaguggcaucauggaaguggacaggagcgaagcaaaggaagggcuuaaaaggggugaaacaacaaaacaugcuguaucuagagguacugcaaaauuacgcugguuuguagaacguaauuuagugaaaccagaagggaaggugauagaccucggaugcgggcgaggggguuggaguuacuauugugccggacugaagaaaguaaccgagguaaaagguuauacgaaaggcggucccggucacgaggagccuauaccaauggcgacauaugguuggaaucuaguaaaguuacacagcgggaaagacguauucuucauaccgccggaaaagugcgacacauuacuaugcgauauaggcgaaucuucgccaaauccuacaauugaagaaggaagaacguugagaguuuuaaaaaugguugaaccguggcuacgugggaaucaauucuguauaaagauauuaaaucccuacaugccaucaguaguggaaacacuugaacaaaugcagagaaagcaugggggaauguuaguacgaaauccguuaagucgaaacagcacacacgaaauguacuggguaucgugugggacggggaauauaguuuccgcugucaauaugacgagccgaaugcuauuaaacagguuuacaauggcgcaccggaaaccaacauacgaaagggauguugacuuaggagcuggaacacgucaugucgcuguagagccugaggucgcgaaucuugauaucaucggccaacgcauagaaaauaucaagcacgaacauaaaucgaccuggcacuacgaugaggacaauccuuauaagacaugggcauaccaugggaguuacgaagucaagccaucagggagugcuucaaguaugguaaacggggucgugaaauuguuaaccaaaccuugggacguaauaccgaugguuacacaaauugcaaugacugacacaacuccguucggacaacaaagaguauuuaaagaaaaaguugauaccagaacacccaaagccaaacguggcacagcucaaauuauggagguuacagccaaauggcucuggggcuuuuuaagcagaaauaagaaaccgcgaauuugcacgagagaagaauuuaccagaaagguccgaucaaacgcugccauaggggcgguauuuguugacgaaaaccaauggaacuccgcuaaagaagccguugaggaugagcgauuuugggauuuaguucaccgagaaagggaauuacauaaacaagguaaaugugcaacauguguguacaacaugaugggaaaaagagagaagaaacucggugaauuugguaaggcgaaagguaguagagcaauuugguauauguggcucggagcuagauuuuuagaguuugaagcccuuggauucaugaacgaggaucacugguuuagcagagaaaacucuuuaucaggaguagaaggagaaggauuacauaaauugggauauauuuuacgagauauuaguaaaauuccaggaggaaauauguaugcagacgauacugcuggcugggacaccagaauaacggaagaugauuuacaaaacgaagcaaaaauaacggauauuauggaaccggaacaugcgcuacuagcuaaaucaauuuuuaaacuaacuuaucagaacaaaguaguccguguccagaggccagcuaaaaacgguaccguaauggacguuauaagucgaagagaucaaagagguagcggacagguuggcacauacggauuaaauacauucaccaacauggaggcacaacuaauccgucaaauggagagcgaaggaauauucaguccgucagaauuagaaacgccaaaucucgcaggucgaguguuagacugguuggagaaacauggcguagaaagauuaaaaagaauggcgauaucuggagaugauugcgugguaaaaccaauugacgacagauuugcaaccgcccuuacugcucuaaacgacaugggaaagguucgaaaagauaucccgcagugggaacccagcaaagguuggaacgacuggcagcaagucccuuuuuguucacaccacuuccaucaguuaaucaugaaagacggacgagaaauuguaguaccguguagaaaucaagaugagcucguaggacgugcacgcguaucccaaggcgcagguuggucacuaagagaaacggcuugccugggaaaaucuuacgcacaaauguggcaauugauguacuuccacagaagagaucuaagacucgcggcaaaugcgauuuguucugcaguuccuguugauuggguaccaacaucuaggacaacguggaguauacaugcccaucaucaauggaugacuacagaagacaugcugaguguauggaacagagucuggaucgaagagaauccuuggauggaagacaaaacccauauaucgucauggggagacguaccauauuuggggaagcgugaagaucaauggugcggaucuuugaucggcuuaacggcgagagcuacgugggcaacaaauauccaggucgcaauuaaccaaguaagaagauuaauagggaacgaaaauuaucuggacuauaugacgucgaugaaacgauucaaaaacgaaagcgauccugaaggggcgcucugguaa

SEQ ID NO: 21608 - RNA, 9879 nt, Artificial Sequence
  derived and/or modified CDS sequence (opt6) from DENV-1__FJ410283__SS-prME
agcguaacuauguuacuaaugcugaugccaacagcauuagcauuucaccugacuacgagagggggugaaccucauaugauuguaaguaaacaagaaagaggaaaaagucuacuuuuuaaaacgucugcugguguuaauauguguacuuuaauugcaauggaucuaggugaauuaugcgaagacacaaugacauacaaaugcccacggaucacagaaaccgaacccgacgauguugacuguuggugcaacgcaacagacacuuggguuacauauggaacauguucacaaacaggagaacacagacgagacaaaagaucaguagcacuagcuccucacguaggguuaggacuugagacgcgaacugaaaccuggaugagcuccgaaggagcauggaaacagauccaacgaguugaaacgugggcacuacgccaccccggguuuacaguaaucgcguuguucuuagcacaugcuaucggcacaucuauaacccagaaaggaauaaucuuuaucuuauuaauguugguaaccccaucaauggcaaugcgaugcguaggaaucgguaguagggauuucguagaagguuugagcggugcaacuuggguggaugugguauuagaacaugggagcugugugacuacuauggcgaaagauaaaccaacuuuagauaucgaacuauuaaaaacggaaguuacaaacccugcuguauuaaggaaauuauguaucgaagcuaaaaucagcaauacgacaacagacucaagauguccuacgcaaggagaagcaacauuaguagaagaacaggaugcaaauuucguauguagacgaacuuucguagauaggggguggggcaaugguuguggacuauucggcaaagguucacuaaucacaugugcaaaauuuaaaugcguaacgaaauuagaagggaaaauaguucaauacgaaaaucugaaauauucgguuauaguaacuguccacaccggggaucaacaucagguuggcaacgaauccacggaacacggaacaacugccaccaucacuccacaagcacccacuacagaaauacaacuaacagauuacggggcccuuacguuagacugcaguccuagaacgggcuuagacuucaaugaaaugguacuacuaacgaugaaagagaaaaguuggcuaguccacaaacaaugguuucuagaccucccucucccguggacaagcggggcaagcacuagccaggagacuuggaauaggcaagauuuacucguaaccuuuaaaaccgcccacgcaaagaaacaggaggucgucguacucgguagccaagaaggagcgaugcauacugcacugacaggcgcaacugaaauucagacaucgggaacaacgacgauauuugcgggucauuuaaaauguagguuaaaaauggauaaauuaaccuuaaaaggaaugagcuacguuauguguaccggauccuucaaacuagagaaggaacuagccgaaacucaacacgguaccguauuaguacaaaucaaauaugagggaaccgaugcgccauguaaaaucccuuucaguacacaagaugaaaaaggcguaacacaaaacggucgccucaucacagcaaacccaaucgugacagacaaagagaaacccgugaauauagaagcagagcccccguuuggugaauccuacauuguuauaggggcuggcgagaaagcacucaaacuaucuugguucaagaaaggcucaucgauagguaagauguucgaagcaaccgcgcgaggagcacgaaggauggcgauccugggcgauacugcuugggauuucgguaguauaggugggguuuuuacaagugcagguaaguuaguucaccagauauucgguacagcguaugguguucuuuuuagcggaguauccuggacuaugaaaauaggaaucggaguacucuuaacauggcuagggcucaacagccgaucuacaaguuuaagcaugacuuguauagcuguaggucuaguuacccuuuaucuuggcguaaugguucaagcugacucagguugugucauaaauuggaagggucgugagcuaaaaugcggaaguggaauuuuuguuacgaaugaaguccacacauggacugagcaauauaaauuucaagcugauaguccgaaacguuugagugcagccauaggcaaagcaugggaagaaggaguguguggcauacgcuccgcuacaagauuggagaauauaauguggaagcaaauuaguaacgaauugaaccauauacucuuagaaaaugacaugaaguucacaguuguuguaggagauguagcagguauacuagcacaaggaaagaaaaugauucggccacaaccgauggaauacaaguauagcuggaaaaguugggguaaggccaagauaauuggugcagauguccaaaauacaacuuuuauuaucgauggaccaaacacaccugaauguccugacgaccagagggcauggaauauaugggaagucgaggacuauggguuuggaaucuucacaacuaacauauggcuaaaacuuagggauucauauacucaggucugcgaccauagacucaugagcgcggcuaucaaggauucaaaagcaguacaugccgauaugggauacuggauugaaagugagaaaaaugaaacauggaaauuagcuagagcaaguuuuaucgaaguuaaaacguguaucuggccgaaaucacacacgcuauggucuaauggcguucuagaaucagagaugaucaucccuaaaauauacggaggacccauaucgcagcauaauuacagaccagguuacuucacgcaaacugcugggccauggcacuuagguaagcuagagcucgauuucgacuuaugugaaggcaccacagugguuguagaugaacauugugguaaccgaggaccgucucuaaggacgacaacuguaacugguaagauaauucacgaauggugcuguagauccugcacacuaccgccucuaagauuccgcggggaggauggcugcugguacggaauggaaauacggccuguaaaagaaaaagaagagaaccuaguaaagagcaugguaucagcagguucgggugaaguagacagcuuuucacuaggcuuacuuugcauaucaauuaugauagaagaaguaaugcggucacgcuggucucgaaagaugcucaugacagggacacuagcaguauucuuucuucuuaucaugggacaacugacauggaaugauuuaauaagacuuuguauaauggugggugcuaaugcuucggaccguauggguauggggacgacauaucuugcacuaauggcaacuuucaaaaugaggcccauguucgccguuggauuacuuuuucguagacuaacgaguagagaaguauuguuauuaacaaucggacuuucguuaguggcuucagucgagcucccuaauucuuuagaggaguuaggcgauggauuagcuaugggaauaaugauacucaaacuucugacagauuuccaaucccaccaacucugggccacacucuugucacuaacguuuauaaagacgacauucucucuacacuacgccuggaaaacuauggcuaugguucuuucaaucgugucccuauuuccacugugccucaguacgacuagccagaaaacgacauggcuaccgguuuuacuagguucccugggaugcaaaccacuaacuauguuucuaaucgcagaaaacaagauuugggguagacgaaguuggccucuaaaugaggguauaauggcaguagguauaguaucaauccuauuaaguucccuucugaaaaaugauguaccuuuagcaggaccgcuaauugcaggaggaaugcuaauugccuguuauguaauaagugguucuagcgcagacuuaagccuagaaaaagccgcagagguuaguugggaggaagaagccgaacauucaggcgcuucacacaacauauuaguagaaguucaagaugaugguacgaugaagauaaaagacgaagaacgagaugacaccuuaacaauacuauugaaggcaacauuacuugccguaaguggcguguauccucuuucgauuccugcuacuuuauuuguaugguauuuuuggcagaagaagaaacaaagaagugguguauuaugggauacaccuucaccuccagaaguagaacgugcuguuuuggaugauggaaucuaucgcauaaugcaaagaggacuguuggggagaucacaaguaggaguugggguguuucaagaaaacguauuucacaccauguggcacguuacccgcggagcaguauuaauguaccaagguaagagacuagaaccgagcugggcaucugucaagaaagauuuaauuucauacgguggugguuggcgcuuacaaggauccuggaacacaggcgaagaaguacaaguuaucgcaguugagccugggaagaaccccaaaaauguucaaacugcuccaggaacauuuaaaacacccgagggagaagucggugcuauugcacuagauuuuaagcccggaaccaguggcucaccuauagucaaccgcgaaggaaaaauuguaggucucuauggaaaugggguaguaacgaccucugggacauacgugagugccauugcgcaggcaaaagcuagucaagaaggccccuuaccagaaaucgaagaugagguguuucguaaacgcaauuugacgauuauggauuuacaucccggauccggaaaaacacgucguuauuuacccgcaaucgucagagaagccauaaagcggaaacugcgaacucuaauacuagcccccacgcguguagucgcuucugaaauggcagaggcuuuaaaagguaugccuauuagauaccaaaccaccgcuguuaaaagugaacauaccggaaaagagauagucgaccuuaugugucaugcuacauuuacgaugcgacugcuuucacccguucgcguuccgaauuauaauaugauuauuauggaugaggcacauuucacggauccaagcagcaucgccgcgagaggauacauaucuacgagaguuggaaugggugaagcagcugcuaucuuuaugaccgcuaccccaccggguaguguugaagccuuuccccaaucaaacgcuguuauacaagaugaagaaagggacauaccggaacgaucauggaacaguggauaugaguggauuaccgacuuccccggcaagacaguaugguuugucccaagcauaaagagcggcaacgacaucgcuaacuguuugcgaaagaauggcaaaagaguuauacaacuaucacggaaaacguuugacaccgaauaucagaaaacuaaaaauaaugacugggacuaugugguaacuaccgauauaucagaaaugggugcaaacuuucgcgccgauagaguaauagauccacguagaugucuaaagccgguaauuuugaaggacggaccggagagagugauucuagccggaccaaugccaguuaccguggcaucagcggcacagcgaagagguaggauagguagaaaucauaauaaggaaggugaucaauauauuuauaugggccaaccacuaaacaaugacgaagaccaugcccauuggacggaagccaaaaugcuacuagauaacauaaauacaccugaagggauaauaccagccuuguucgaaccugaaagagagaaaucggcagcuauugacggagaauauaggcuacgaggggaagcgcgaaagaccuucguagaguuaaugagaagaggagaccugccgguauggcuaagcuauaaaguagcaagugaagguuuccaauauagugacagaagauggugcuuugacggugaacggaauaaucaggucuuagaagaaaauauggauguggagauuuggacaaaggagggggaaagaaagaaauuaaggccgagauggcucgaugcuagaacauauucggauccuuuagcgcuucgagaauuuaaggaauuugcagccggcaggaggaguguuucaggcgaucuuauauuagaaauagguaagcucccacaacaccuaacacaaagagcccaaaaugcguuagauaaucuagucauguuacacaacucugaacaaggcggucgagccuaucgacacgccauggaagaauuaccagauacgaucgaaacucuaaugcucuuagcuuuaaucgcaguauuaacagggggugugacucuauucuuucuuucugguagaggauuagguaaaacgucaaucggcuuguugugcguuauggcuaguucuguacuauuauggauggccagcguugagccgcauuggauugcagcuucaauaauccuugaauuuuuccuaaugguuuugcugauuccagaaccagacaggcagagaacaccucaagauaaucaguuagccuauguaguuaucggauuacucuuuaugauacuuaccguagcagcaaacgaaauggggcucuuagagacaacuaagaaagaucuggggauuggccauguggccgucgagaaccaucaucaugcggcaauguuagauguggacuuacauccagcaucagccuggacacuauacgcaguagccacaacgaucauaacuccaaugaugagacauacgaucgaaaauacgacagcuaauauaagucuuacugccauagcgaaccaagcugcgaucuugaugggacuugacaaagguuggccaauaucgaagauggacaucgguguuccauugcuugccuuaggcugcuacucacaagucaauccauuaaccuuaacagcagccguucucaugcugguagcacauuaugcuauuauugggccuggacuacaagcaaaagcgacuagagaagcucaaaagagaaccgcagcaggaaucaugaaaaauccuacaguggacgggaucguagcaaucgaucuagauccggucgucuacgaugcgaaauuugagaaacaacuugggcaaaucaugcuacuaauucucuguacaagccagauuuuauugaugcgaaccacaugggcauuaugugaaagcauaacauuagccaccggaccacuaacaacacucugggaagguaguccugguaaauuuuggaacacaacaauagcuguaaguauggcuaacaucuuccgaggaucguacuuagcuggcgccgguuuagcuuuuaguuuaaugaagaguuuagggggagguagacgugguacuggagcucaaggcgagacgcugggcgaaaaauggaaacgccaauuaaaucaacuaagcaagagcgaauuuaacacauacaaaagaucagguauuauggaaguagacagaucagaggcaaaagaaggauuaaagaggggugaaacaacaaaacaugcugucaguaggggaacagcgaaacugcgaugguuuguugaaaggaauuuaguuaaaccggaggguaaggugauugauuugggauguggcaggggcgguuggagcuauuauugcgcuggauuaaagaaaguuacggaaguuaaaggauacacaaaagggggacccggccacgaagaaccgauaccaauggccacauacgguuggaauuuggucaaacuccauuccggaaaagacguauucuuuaucccgccugaaaaaugcgacacccuuuuaugugauaucggagagucauccccaaacccaacaauagaggaagggagaacuuuaagaguguugaaaaugguugaaccauggcuaagaggaaaccaauuuuguaucaaaauacuuaauccauauaugcccaguguaguagaaacacuugaacaaaugcaaagaaaacacggagguauguugguaagaaauccacuuucaagaaauucaacacaugaaauguacuggguaaguugcgggacgggaaauauaguaagcgccguuaauaugaccucaagaaugcuacuuaauagauuuacuauggcacaucgcaaacccacauaugaaagagacgucgaucucggagcagguacaaggcacguagcaguggagccagaaguugcuaaccuagauauuauaggacagagaauagaaaacauuaaacaugaacauaaaagcacguggcacuaugaugaagacaaucccuauaaaacaugggcauaucacgguaguuacgaggucaaaccgucuggguccgccaguaguaugguuaacggugugguaaaacuacuuaccaaaccuugggacguaauaccaauggucacacaaauugccaugacugacacaacucccuuuggccaacaaaggguuuuuaaagaaaaaguagauacgcgcacaccaaaagcuaagagaggaaccgcccagauuauggagguuaccgcaaaauggcuauggggcuuucuuuccaggaacaagaaaccacgaauauguacucgugaggaguuuacaaggaagguucgcuccaaugcggcgaucggagcuguauuuguggaugaaaaucaguggaauagugcuaaagaggcaguugaagaugaaagauuuugggaucuaguucauagagaacgagaguuacacaagcaaggaaaaugugcaacaugcgucuauaacaugauggggaaacgagagaagaaacuaggcgaguucgguaaagccaaaggaucacgagcuauaugguauaugugguugggugcaagguuuuuagaguucgaagcgcuaggauuuaugaaugaggaucauugguuuucaagagagaacagucuaucuggaguagaaggugaaggacuacacaaacuaggguacauuuuacgagacauaucgaaaauuccaggaggaaauauguaugcugacgacacagcagguugggauacacgaaucaccgaagaugaucuucaaaaugaagcuaggaucacggauauaauggaaccugaacacgccuuacucgcaaagucaauauuuaaguuaacauaccaaaauaaaguuguuagaguacaaagaccagccaaaaaugguacaguuauggacguaauaaguaggagggaccaaaggggaaguggacaaguuggaacuuauggacucaauacguuuacgaauauggaagcccaacuaaucagacaaauggaaucggagggcauauuuucucccagcgaacuggaaacacccaaucuagcugaacgcguccuagauugguuaggaaaguauggggucgaacgauuaaagcguauggcaauauccggcgaugacugugucgugaaaccgauugaugaucgauucgcaacggcauugacagcauuaaaugacaugggaaaaguaagaaaagacauuccacaaugggaacccaguaaaggcuggaacgauuggcaacaagugcccuuuuguucacaucacuuucaucaauuaaucaugaaagacgguagagaaauagucgugccaugcagaaaccaagacgaauuaguaggaagggcucggguaucacagggcgcuggcuggucccugcgcgaaacagcaugccucggaaagagcuaugcacaaauguggcagcuaauguauuuucacaggcgagaccuaagauuagcagcuaaugcuauuugcucagcggugccagucgacuggaucccgacgucaagaacaacauggucuauccaugcacaucaucaauggaugaccacagaagauaugcuuucuguuuggaauaggguguggauagaagaaaauccauggauggaagauaagacacauauaagcucauggggagacguaccauacuuagggaaaagagaagaccaaugguguggaucguugaucggacuaacugcuagagcaaccugggcuacgaauauucaaguagcaaucaaccaaguacgacgacuaauagguaaugagaacuaccuugauuauaugacaagcaugaaacgauuuaagaacgaaucagacccagaaggagcucuaugguaa

SEQ ID NO: 21609 - RNA, 9879 nt, Artificial Sequence
  derived and/or modified CDS sequence (opt6) from DENV-1__FJ410284__SS-prME
ucgguuacuaugcuccuaaugcucaugcccacugcucuagcauuucacuuaacuacgagaggaggugaaccucauaugauugugacaaaacaagaaagaggaaaaaguuuacuauuuaaaacuucagcaggaguuaauauguguacuuuaauagcgauggacuuaggagaacuaugugaggacacuaugacauacaaauguccgcguauaacagaagcugaaccugacgaugucgauugcuggugcaaugcuacggacacuugggucacauacgggacauguucccagacuggggaacacagaagagauaaacgaucgguagcacuagcuccacacguuggucucggucuagaaacccgcacggaaaccuggaugucuagcgagggagccuggaaacaaauucaaagaguagaaacgugggcucuaaggcacccagguuucacuguaauugcauuauuuuuggcucaugccauaggaaccaguauaacacaaaaaggaauaauuuucaucuugcuuauguuaguaacaccaagcauggcgaugcgaugcguagguauaggaucaagagauuuuguugagggcuuaagcggagcuacaugggucgauguaguccuagaacacggaaguugcguaaccacgauggccaaagauaaaccuacacuagacauugaguuguuaaaaacagagguaacaaauccagccguccuaagaaaauuauguaucgaggccaaaauaaguaacaccacuacugacagcagauguccaacacaaggugaagcuacuuuaauggaagaacaagacgcaaacuucguuugcaggagaacauucguagacagaggaugggguaacggaugcggauuguuuggaaaaggaagucuuaucacuugugccaaauucaaaugcguaacaaaauuagaaggcaagauaguccaauaugaaaaucuuaaauacucagugaucguaacaguucauacgggcgaccagcaccaaguagguaacgaauccacagaacacgggacgaccgccacgauaacaccacaagcgccuacuagcgaaauccaauugacggauuauggagcucuaaccuuggauuguucaccgcguacgggauuggacuucaaugagaugguucugcuaacaaugaaagaaaagagcuggcuaguacacaagcaaugguuccuagacuuaccauuaccuuggacaaguggcgcauccacuucacaggaaacauggaauaggcaggaccuccucguuacauuuaaaacugcacacgcuaaaaagcaagaaguagucguuuuagggucacaagagggagcuaugcacacagcauuaacaggcgcgacagaaauacaaacaaguggaacaacuacuaucuuugcaggucauuuaaaaugcagacucaaaauggauaaacuaacguuaaaggguaugucuuauguaaugugcacuggaaguuuuaaauuagaaaaagaagucgcugaaacccagcacggaacuguuuuaguacaaaucaaauaugaagggaccgaugcaccuuguaaaauuccauuuaguacccaagacgagaaaggaguuauccaaaacggucgucucaucacagcaaaucccaucguaacagacaaagaaaaacccgucaauaucgaagccgaaccaccuuuuggagagucguacaucguaauaggaguaggggaaaaagcacuuaaguuaaguugguucaagaagggcagcaguauaggaaaaauguucgaagcuacagcuaggggagccagaagaauggccauacugggagauacggcgugggacuuuggcucaauugggggaguauuuacgagcgucgggaaguuaguacaccaaauauuuggcacagcauacggaguacucuuuuccggaguaucauggacuaugaaaauaggaauagggguacuacugacuugguugggguugaauagucgaucaacgucccugaguaugacuuguauagcagugggccuaguuacucuuuauuuagguguaaugguucaggcggauagugggugugucauaaauuggaaagggagagaacugaaauguggaucagggauauuuguuacuaacgaaguacacacguggacugaacaauacaaauuucaagcggauucaccaaaacgucuuagcgcagccaucgguaaagcaugggaagaaggggugugcggaauuagaucugcgacacggcucgaaaacauaauguggaaacagauuucgaaugaacuuaaucacauacuacuagaaaaugauaugaaauucacuguuguuguaggugauguugucggaauacuggcacaaggaaagaaaaugauaagaccacagccuauggaacauaaauauaguuggaaauccuggggaaaagcaaaaauaauaggugcagauguucagaauaccacguuuauaauagacgggcccaauacuccggagugcccagaugaucaacgagccuggaacauuugggaaguagaagauuacggauuugguauauucaccacaaacauuuggcuaaaacuacgagauucguauacacaggccugcgaucaucgauuaaugucugcagcaauaaaagauaguaaagcaguacaugcagauaugggcuacuggauagaauccgagaaaaaugaaacauggaaacuagcgagagcuagcuuuauugaagugaaaacaugcauuuggccaaagucccacacccucugguccaaugguguacuugaaucugaaaugguaauaccuaaaauuuacggagguccuauuagucaacacaacuaccgaccagguuauuuuacacagacugcgggaccauggcauuuaggaaaacuugaauuagacuuugauuuaugugagggaacaacaguagucguugaugaacauugugguaaccgugguccauccuuaagaacuacaacgguaacggggaagauuauacacgaaugguguuguaggaguugcacuuuaccuccacuccgauuuaaaggcgaagacggaugcugguacgguauggaaauccguccaguuaaagagaaagaagaaaaccuuguaaagaguaugguaucagccggaucuggagagguagauaguuuuagucucggguuguuguguauaucuaucaugauagaagaaguuaugcgaagccgauggagcaggaaaauguugaugacggggacucuugcaguguucuuacuacuuaucaugggccaacuuacguggaaugaucuaaucagguuauguauaaugguaggugcaaacgcauccgacaggaugggaauggggaccacguauuuagcacuaauggcaacuuuuaaaaugcgacccauguucgcugugggcuuacuguuucgacgauuaacaucaagagaaguuuuacuacuaacaaucggccuaucauuaguugcuuccguagaacuaccaaauucauuggaagaguuaggggauggacucgcaaugggaaucaugauuuuaaaacuacugacagacuuucaaucucaccaauugugggccacccuucuuucuuugacuuuuauaaaaacaacccucucacuccauuaugccuggaaaacaauggcaaugguucucucaauuguaucgcucuuuccacugugccuuuccaccacgucgcaaaagacaacauggcucccaguguuacuagggucccuagguugcaaaccuuugacaauguuucucauagccgaaaacaaaaucuggggccguaaaagcuggccccuuaacgaagguauaauggcugucggaguaguaaguauuuuacuuagcaguuuacuaaagaaugacguaccguuagcaggaccucugauugcagggggcaugcuaaucgccuguuauguaauaaguggaaguuccgccgaucuuagucucgaaaaagcagcagaaguaaguugggaagaagaagcagaacauucaggugcgagccauaauauccuaguugagguucaagacgacggaacaaugaaaauaaaagaugaggagaaagaugacacgcuaacgauuuuacuaaaggcaacgcuccuagcaguaucuggaguuuauccgcuuucaauacccgcaacgcuauuuguaugguacuucuggcagaagaagaaacagagaucagguguccuaugggacacuccaucuccaccggagguagaaagggcuguacuugacgaugggauuuaccguauuaugcagagagggcuuuuaggaagaucacaaguaggcguaggaguauuucaggagaauguauuccauacaauguggcaugugacccgaggagcaguauuaauguaucagggaaagagauuggagccauccugggcaucagugaagaaagacuugauaaguuacgggggaggguggcgucuucaaggaaguuggaauacaggggaagagguucaaguuauagcugucgagccgggcaaaaaucccaaaaauguacaaacagcaccugggaccuucaaaacuccagagggugaagugggcgcuauugcccuagacuucaaaccgggaacaagcggaucccccauuguaaauagagagggaaagauaguuggucuguacggaaauggcguugucacaacuucaggaacauauguaucugcgauugcacaagcuaaagccucucaagagggaccauuaccagaaaucgaggaugaaguuuuucguaaaagaaauuuaacuauaauggauuuacauccgggcagcggaaaaacuagaagauaccugccagcaaucguccgugaagcgacuaagcgaaaacugcguacuuuaauccuggcaccaacgcggguaguugcaucggagauggccgaagcauugaaaggcaugccgauacgauaccaaacaacagccguuaaauccgagcauacaggaaaagaaauaguugacuuaaugugucaugcaacuuuuacgaugaggcuacuaucuccuguacgaguacccaauuauaauaugauaauaauggacgaagcucacuuuacugauccaaguuccaucgcagcaagaggcuacauauccacaagaguaggaaugggugaagcagcagcuauuuuuaugacagcaacgccaccggggagcgucgaggcuuuuccccaaucuaaugcggucauucaggaugaagaacgggacauaccugaaaggucauggaacucaggauaugaguggauaacggauuuuccuggaaaaacaguuugguuuguuccuucgauuaaaagugguaacgauauagcgaacugcuuaaggaaaaacggcaaacgaguaauucaacuuagucggaaaaccuucgacacagaauaucaaaagacgaaaaacaaugauugggacuacguaguuacaacagauaucagcgaaaugggcgcaaauuuuagagcugaccggguuauugauccaagaagaugucuaaaaccuguaauauuaaaagacggcccugagcgcgugauacuagccggaccuaugccaguuacaguggcaucggcagcacaacgacgcggacggauagguagaaaccauaacaaagaaggagaccaauauauauauaugggacaaccgcuaaauaaugaugaggaccaugcgcauuggacagaggcuaaaaugcugcuagacaauauuaauacuccggaagguaucauucccgcacuguuugaacccgaaagggaaaagagugcugcuauagauggugaauacagauuacggggcgaagcaagaaagacguuuguggaacuaaugaggcgaggcgaucugccaguauggcucucauauaaaguugcaucggaaggauuccaauauagcgacagaagaugguguuucgacggagaacgaaauaaucaaguacuggaggaaaauauggaugucgaaauauggacaaaagaaggugagcgcaagaaacuacgaccucgaugguuggacgcucggacguauucugacccgcuugcacuucgagaauuuaaagaguucgcugcaggacgaagaagcguuucuggugaucuuauucuagaaaucggcaaauuaccacaacaucugacgcaacgugcccaaaaugcauuagauaaccuaguaaugcuucauaauucugaacagggcgguagagcauaucgacacgcgauggaagaauugccugacacgauugaaacccuaauguugcuggcgcuuauugcaguccugacgggagggguaacucucuucuuuuuaucagggcgaggauuagguaaaacaucgauuggccuauuaugcgucauggccucuaguguauugcuauggauggcuucgguagagccccacuggaucgcugccucgauaauacuggaauuuuuccuaaugguauuauuaauacccgaaccagacagacagcgaacuccgcaagacaaucaguuagcuuauguuguuauuggacuucuuuucaugaucuugacaguagcggcaaaugaaaugggguuguuagaaacaacuaagaaagauuuaggaaucggucauguagcgguugaaaaucaccaccaugccacaaugcuagaugucgacuuacacccggcgucugcguggaccuuguacgcaguugcaacgacaauuauuacuccuaugaugcgucauacaaucgagaauacaacugcuaauauaaguuuaacggcgaucgcaaaucaagcagcuauuuuaaugggccuugauaaagguuggccuauaucaaaaauggacauuggagucccguuacuggcacugggcuguuauucacagguuaacccuuugacauuaacagcugcgguacuaauguuaguagcccauuaugccauaaucggucccgguuuacaggcaaaagcgacucgagaagcgcaaaagagaaccgcugcugggauaaugaaaaaucccacagucgaugguauugucgcaauagaucucgacccaguugucuacgaugcgaaauuugaaaaacaacuuggacaaauaauguugcugauacuuugcacuucgcagauucuguuaaugcgaacaacgugggcucuuugugaaucuaucacacucgccacggguccguuaaccacguuaugggaagggucaccuggaaaauuuuggaacacgacaauagcagugucgauggcaaacauuuuccgcgguucguaucuggcaggagcaggcuuagcauucucccuaaugaaaucauuaggcgguggaagacgggguacaggugcacaaggugaaacgcucggagagaaauggaagagacaguuaaaucaguugagcaaaucugaauuuaauauauauaaaagaagcggaaucauggaaguagaccgaagugaagcaaaagaagguuugaaaaggggagagacuacgagacacgcuguuucaagagguacagccaaauuaagaugguucguagaacggaaccucguaaaaccugaaggaaaaguaaucgaucuuggcugcggaagaggagguuggucauauuauugugcgggucugaagaaaguaacugagguuaaaggauauacaaaaggagggccagggcacgaggaaccaauuccaauggcuacauauggauggaauuuaguaaaauugcauucggguaaggauguauucuuuacacccccggagaaaugugacacacucuuaugcgauauuggggaaaguucuccaaauccaacgaucgaagaaggaagaacacuuagggucuuaaagaugguugagcccugguugcgaggaaaucaauucugcauaaaaauucugaaucccuauaugccaagugugguggaaacacuagagcaaaugcaaaggaaacauggugggaugcuuguucgaaauccgcuaucaagaaauucaacccaugaaauguauuggguaagcugcggaacagggaauaucguuucggcagucaacaugacaucacgcaugcuccuaaauagauucacgauggcgcaucgcaagcccacuuaugaaagagacgucgacuuaggugcugguacucgacacguugcagucgaaccagaaguugcaaaucuugauauuauuggacaaagaauagaaaacauaaagcacgaacauaagaguacauggcauuacgacgaggacaacccauauaagacuugggcuuaccaugggagcuaugagguaaaaccgagcgguucagcgucaucgauggucaacgguguaguaaaauuacuaacgaagccgugggauguaauaccaaugguuacacagaucgcuaugacagauacaacaccuuucggacaacaaagaguguuuaaagagaaaguggauacccgaacaccaaaagcuaaaagagguacggcucaaaucauggaagugaccgcgcgcuggcuuuggggauuuuuaucgagaaacaagaaaccaaggauaugcacaagagaggaguuuacucgaaaagucagaucuaaugcagcaauaggggcaguauucguugacgagaaccaauggaauagugcaaaagaagcaguagaagacgaacgcuucugggaucuaguacaaaaggaacgagaguuacauaaacaagguaaaugugcaacuugcgucuauaacaugaugggaaagagagagaagaaacugggagaguucgguaaggccaaaggaagcagggcuaucugguacauguggcuaggggcaagguuucuagaguuugaagcgcucgguuuuaugaacgaagaccauugguucucaagagaaaauucacucucagggguugaaggagaaggauugcauaaacuaggcuauauccuaagagauaucaguaaaauuccuggagguaacauguaugccgaugacacugcagggugggauacgcgaaucacggaggaugacuuacaaaacgaagcaaaaauaacugauauaauggaacccgagcacgcuuuacuagccacaucaauuuuuaaauuaacuuaccaaaacaaaguagucagggugcaaagaccugcgaaaaacggaacggucauggauguuauuucacgccgagaucagagagguucaggucagguuggaacauauggucuuaauacuuuuacuaauauggaagcacaauuaauaagacaaauggagagcgaaggaauauuuuugccaagugaauuagaaaccccaaauuuagcggaaagaguccuugauuggcuagaaaaacauggaguagaacggcuaaagaggauggcgauaagcggagacgauugcguuguuaaaccaauugaugaucgguuugcuacugcucuaacagcacuaaacgacaugggaaaggucagaaaagauauaccgcaaugggagccuucaaaagguuggaacgauuggcagcaaguaccuuucuguucacaucacuuucaucaacuaaucaugaaagacgguagagaaaucguugucccaugccggaaccaagaugaauuaguaggacgugcaagagucagucaaggagcaggauggucacuuagagaaacagcuugcuuagggaagucauaugcacagauguggcaauuaauguauuuucacagaagagaucugcgccuagcagcaaacgcuaucugcuccgcaguaccagucgauuggguaccaacaucccguacaaccugguccauacaugcacaucaccaauggaugacuacugaggauaugcuauccguauggaauagaguauggauugaggagaacccauggauggaagauaaaacccauguuucaaguuggggagacguaccuuacuuaggaaaaagagaggaucaauggugcggcucuuuaauuggguuaacagcaagggcgacuugggcaucuaauauacaaguagcaauuaaccaaguaagaagauuaauagguaaugaaaauuacuuggauuacaugaccuccaugaagagauucaaaaaugaaggagauccagaaggugcacuaugguaa

SEQ ID NO: 21610 - RNA, 9879 nt, Artificial Sequence
  derived and/or modified CDS sequence (opt6) from DENV-1__FJ410285__SS-prME
ucagugacgaugcuucugauguuaaugccuacagcauuggcauuucaccuuacaacacgcggaggagaaccucauaugauagucagcaagcaagaaagagggaagucucucuuauuuaaaacaucggcuggaguaaacauguguacucuaauugcgauggaucucggagaauuaugcgaagacacaaugacuuauaaaugucccagaauuacagaaacagaaccagaugacguugacuguugguguaaugcuacggauacaugggucaccuaugguacauguucacaaaccggcgaacauagacgagauaagcgaucuguugccuuggcaccacauguuggucucggucuugaaacaagaacagaaacauggaugucaagcgaaggggcauggaagcaaauacagcguguggaaacgugggcacuacgacacccuggcuucacaguuaucgcgcuguuccuagcccaugucauaggaacuagcaucacacaaaaaggaauaauuuucaucuuacuaaugcuaguuacgcccaguauggccaugagguguguagguauaggcucgcgagacuuuguagaaggcuuaaguggugcaacguggguagacgugguguuagaacacggaucauguguuacaacgauggccaaggacaaaccuacccuugauauugaacuauuaaaaacugaaguuacaaaucccgcuguacuaagaaaauuauguaucgaagccaaaauaucgaacacuacaacugacagccgaugcccuacucaaggugaagcaacauuagucgaagaacaagacgcuaauuuuguaugucggcguacauucguggaccgggguugggguaacggaugcggacuauuuggaaaagggagucuaauaacaugugcaaaauuuaaaugcguaacaaaacuagaagguaagauaguacaacaugaaaaucugaaauacucgguuauaguaaccguccacacgggcgaccaacaucagguaggaaacgaaaguacggaacauggaacaacagcgaccaucacgccacaagcgccaacgacugaaauccagcugacggauuauggagcacucaguuuagacuguucgccuagaacaggauuagacuuuaaugaaauggugcuucuuacaaugaaagaaaaguccuggcuggugcauaaacaaugguuuuuagacuugccgcugcccuggacaaguggcgcaagcaccagccaggaaacuuggaacagacaggaccuucucguaaccuuuaaaaccgcucaugccaagaaacaagagguagucguccuaggaucucaagagggggcgaugcauacagcacugacaggcgcuacagaaauucaaacauccgguacgacgaccauauuugcgggacaucucaaaugucgauuaaaaauggauaaacuaacguuaaaagguaugucauauguaaugugcacagggagcuucaaacuagaaaaagaaguggcagaaacgcaacauggcacaguucuuguucaaaucaaauacgaaggcaccgaugcgccaugcaaaaucccguucuccacacaagaugagaaagggguaacacaaaauggaagacuuaucacagcaaacccgauuguaaccgauaaagaaaagccagucaauauagaagcagaaccacccuucggcgagagcuauauuauaauaggggcgggagaaaaagcauuaaaauuaagcugguuuaagaaaggaaguucuaucggcaaaauguucgaggcaacagcacgaggagcaagacgaauggcuauauuaggugacacagccugggauuucgguuccauaggagggguguucacaucgguggguaaguuaguccaccaaauauuuggcacagcauaugggguguuauuuuccggaguuaguuggacaaugaaaauagggauaggaguucuguugacuuggcuaggucuaaacucccgaaguaccaguuugaguaugacauguaucgcagugggccuaguuacgcuauaucuaggggucauggugcaagcggauagugggugugucauaaauuggaaaggaagagaacuaaaaugcgggucagggauauucguaacaaacgagguacauacauggacggaacaauauaaauuccaggccgacaguccuaaacgccuaagcgcggcaauagguaaggcaugggaggaaggaguuugugggauucguagugcaacaaggcucgagaacauaauguggaaacaaauaagcaacgaacuaaaucacauucuccuagaaaacgacaugaaauuuacugugguaguaggugauguagcaggcauauuagcccaagguaagaaaaugauaagaccacaaccaauggaauacaaauacucauggaaguccuggggcaaagcaaaaaucauaggugcugacguacagaacaccaccuuuauaauagauggcccgaauacuccagaaugucccgaugaucaacgugcguggaacauuugggagguagaagauuauggcuucggaauauucacgacaaauaucuggcucaaauugcgagacuccuacacccaagugugcgaccauagacuuaugucggcugcaauaaaagacaguaaagcaguucaugcagauauggguuauuggauagaauccgagaaaaaugaaacguggaagcuagcucgagcgucauuuauagaagucaaaacauguauauggccgaaaucucacacccuauggucgaacgguguacuggagucagaaaugauaauucccaaaauuuauggaggcccgauuucgcaacauaacuauagaccgggauauuuuacgcaaacugcaggucccuggcauuuaggaaaauuagaguuggacuucgacuugugcgaaggcacuaccguagugguugacgaacauugcggaaaucgaggaccuucuuuaagaacaacgaccguuaccggaaaaauuauacacgaaugguguuguagaucuuguacauugcccccucuuagauucagaggagaagauggcugcugguacggaauggaaauaagaccuguaaaagaaaaggaagaaaaucuugugaaaucaaugguaagugcagguccgggugaaguugauucuuuuucguuaggacuacuguguauaagcauaaugauugaagagguaaugagaaguagguggaguagaaaaaugcugaugacaggcacauuagccguauuuuuccugcuaauaaugggacaauuaacguggaacgacuuaauaaggcuguguauuauggugggagcaaaugcuagcgauagaaugggcaugggaacaacguaucuggcccuuauggcaacuuuuaaaaugcgaccuauguucgcaguaggcuuacuuuucagaagacuaacaucucgugaaguuuuguugcuaacaauuggauuaagccuagucgcaagcguagaacuacccaauaguuuggaagaacucggagauggacuagcuaugggcauaaugauacucaagcucuuagcagauuuccaaucacaucaacuaugggcaacacuacuuagccuuacuuuuaucaaaacaacuuucucauugcacuaugccuggaagacuauggcaaugguacuuaguaucgucucuuuauucccuuuauguuugagcacaaccucucagaaaacuacuugguuaccaguuuuauuaggcucauuaggauguaaaccuuuaacuauguuucuaauugccgagaacaaaauauggggacguagauccuggccauuaaacgaaggaauaauggcugucggcaucguguccauacuacuaucuagccuacuaaagaaugauguacccuuagcagggccucuaauagcgggugguauguugauugccuguuacguuauaucugggucauccgcagaucuaucgcuggaaaaagcugcugaaguaucgugggaggaagaggcugagcacaguggugcaagucacaauauacuuguagagguacaagaugauggcacaaugaaaauaaaagaugaagaaagagacgauacacugacuauacugcuaaaggcaacacuguuggccgucucgggaguauauccccucagcauuccggccacacucuuuguuugguacuuuuggcaaaagaagaaacaacgcagcggaguucuuugggacacuccaucgccuccagaagucgaacgcgcgguacuagacgacggcauuuaccgaaucaugcagcgagggcuccuuggcagaagucaaguagguguaggcguauuucaagagaacguguuccacacuauguggcaugucacuaggggagcaguucuaauguaccaagggaaaagauuagaaccuucgugggcaucugucaaaaaggaucuaauuuccuacggcggcggauggcgacuccaaggaaguuggaauacaggagaagaaguucaaguaauugcaguagaaccugguaaaaaucccaaaaauguucaaacagcgccagggacauucaaaacuccagaaggcgagguuggggcgauugcccuagacuuuaaaccugguacaucgggaagccccauugucaacagagaaggcaaaauagucggauuguaugguaacggggugguuacuacgucaggcacuuauguaagugcuauagcacaagcuaaggcuucccaagaggguccgcuaccagaaauagaagacgaagucuuuaggaaaaggaauuuaaccauuauggaccuccauccaggaaguggaaaaacacgaagauacuuacccgcaauagugagagaggcuauaaaaaggagacuacgaacauuaauuuuagcuccaacucgaguagucgccucugaaauggcggaggcuuuaaaaggaaugccuauucguuaccaaacaacugcugucaaaucagaacauacaggaaaagaaaucguggaucuaaugugccaugcaaccuuuacaaugaggcugcucucaccugugagaguaccgaauuacaauaugaucauuauggacgaggcucauuucacugaucccaguucaauagcagcuaggggguacauuaguacacguguuggaaugggagaagcugcagcgauuuuuaugacagcaacaccgccuggaucuguggaggcuuuuccccaaagcaacgcaguaauacaagacgaggaacgugacaucccggagagaaguuggaauaguggcuaugaauggauuacagacuuuccugggaaaacggucugguuuguaccaucaauuaaaucuggaaaugauauagccaauugccuuagaaagaaugggaaaagaguaauacaauuaucaaggaaaacuuucgacacugaguaucaaaagacuaaaaacaaugauugggacuaugugguaaccacagauauaucagaaaugggagcaaauuucagggcagauagaguuauagaccccagaaggugccuaaaaccgguuauccuaaaagaugguccagaacgcgugauuuuagcuggccccaugccggucacagucgcuagcgcagcacaacgaagagguagaauaggaagaaaccacaauaaagaaggagaccaauauaucuauauggggcaaccacuaaauaacgacgaggaccacgcacauuggacagaagcuaaaauguuauuagacaauauaaauacacccgaaggaaucauaccggcacuauucgaaccggagagggaaaaauccgcagcuauagauggcgaguaucggcuaaggggugaagcucgaaagaccuucguggagcuaaugagacgcggugauuugccuguauggcuuaguuauaaaguagcuagugaagguuuucaguacucagacagacgaugguguuuugacggagaaagaaauaaucaagugcuagaggaaaauauggauguagaaauuuggacuaaagaaggggaacggaagaaguuaagaccuagauggcucgaugcaagaacauauucagauccacuagcuuugagggaguuuaaagaguucgcggccggacgacguaguguuaguggagauuugauauuagaaauugggaagcuaccacaacauuuaacucagagggcucaaaaugcuuuagacaaccuugugaugcugcauaacucggaacaaggagggagagcguaccgucacgccauggaagaacugccagauacuauagaaacgcuuaugcuccuagccuugauagcgguauuaacagggggaguuacucuauucuuuuuauccggcaggggucugggcaaaaccucaauuggccuuuuguguguaauggcuucuaguguauugcuuuggauggcaagcguugaaccucauuggaucgcagccaguauuaucuuggaguucuuuuugaugguacucuuaauaccagaaccggacaggcaacgcacuccucaagauaaucaacuugcguauguggucauaggucuauuauuuaugauacuaacaguugcagcaaacgaaaugggcuugcucgaaaccacaaagaaagaccuagguauuggucauguggcuguggaaaaucaucaucaugcugccaugcuagauguagaccugcauccugcuagugcuuggacccucuaugccguagcuacgacaauaauaacaccaaugaugcgacauacuauugagaauacuacagcuaauaucucauuaacugcuauugccaaccaagcagcgauacugaugggacuagauaaaggauggccaauuucuaaaauggacauaggcguaccacuucuagccuuagguuguuauucccagguaaacccguuaacccucacugcagcaguacuuaugcuaguagcucauuacgcgauuauaggcccaggacuacaagcuaaagcuacaagagaagcccaaaaacgcacagcugcuggcauuaugaaaaauccaacuguagacggcauuguggcaaucgaccuggauccaguugucuaugacgccaaauucgaaaaacaacuaggacaaaucaugcuauugauccuaugcacaagccagauucuauuaaugagaaccacaugggcauuaugugaauccauuacucucgccaccggaccguugacgacacuuugggagggcagucccggaaaguuuuggaacaccacuauagcaguaucaauggcaaauauauuucgaggguccuaucuagcuggagcuggacuagcuuuuucccucaugaaaagccuuggaggcggcagaagagggacaggagcacaaggcgaaacacuaggugaaaaauggaaacgccagcugaaccaacucuccaaaucagaguucaauacguauaaacgcucugguaucauggaaguagacaggucggaagcuaaagaaggacuaaaaagaggagaaacaaccaaacaugcagucucacgaggcacggcaaagcuaaggugguuuguugagcgaaacuuaguaaagccggaaggaaaaguaauagaucuagguugcggaaggggagguugguccuauuauugugccggguugaaaaagguuacagaaguuaaaggguacaccaagggagggccaggccaugaagaaccaauucccauggcuacuuauggauggaacuuaguaaaauuacauagcggaaaagauguauuuuucauuccaccggaaaaaugugacacauuacugugcgauauuggagagucaucaccuaacccaacuauagaagaagggcguacacuucgaguauugaagaugguggaacccugguuacguggaaaucaguucuguauaaagauuuuaaacccauacaugccuaguguaguagaaacacuagaacaaaugcaaaggaaacacgggggaaugcuagugagaaaccccuuaucacgaaauagcacacaugaaauguauuggguuucaugcgguacugggaauauuguaucugcuguaaauaugacuagcagaauguuauuaaauagauuuacaauggcucacagaaagccaacauacgaacgugauguagauuugggggcaggcacuagacauguugcgguagaaccugaaguggcuaaccucgacaucauaggacaaagaauagaaaauauuaaacaugaacacaaaagcacauggcacuacgacgaagauaauccauacaaaaccugggccuaucaugguagcuaugaagucaaaccgucgggaucagcauccucaaugguuaaugguguggugaaauuacuaacuaagccaugggacguuaucccaaugguaacacaaauagcaaugacagacacuacuccuuucggacaacagagagucuucaaagagaaaguagacacaaggacucccaaggcaaagagggguacggcacaaauaauggaggugacagcgaaauggcucuggggguuucuuagcaggaacaagaaaccaagaauuuguacuagagaggaguucacaagaaaaguucguucgaaugcugcaauaggagcaguauuuguggaugaaaaccaguggaacucagcaaaagaggcaguggaggacgaaagauuuugggacuuaguacauagagaaagagaacuacauaaacaggggaagugcgcgacauguguuuacaauaugaugggaaaaagagaaaagaaacuuggugaguuugggaaggcaaaaggcucuagggccauaugguauauguggcucggagcacgauuccuugaauuugaggccuuaggcuuuaugaacgaagaccauugguucucucgagaaaauucacuuucaggagucgaaggcgaagggcuccauaaauugggguacauacuacgagauauaucaaagauaccagguggaaauauguaugcggacgauaccgccggaugggacacacguauaacugaagaugaccuacagaaugaagccagaauuacugauaucauggaaccagaacaugccuuguuggcuaaaaguauauucaaacuaacuuaucaaaauaaaguaguaagaguacaaagaccagccaaaaaugguacaguuauggauguuauuucaaggcgcgaucaacgcgggucgggacaaguugguacuuauggcuuaaauacauuuaccaacauggaagcccaacuuauucgccaaauggagucugaagggaucuuuuccccuucugaauuagaaacacccaacuuggcugagagagugcuagauuggcuggaaaaauacggcguugaaagauuaaaacgaauggccauaagcggagaugacugcguaguuaaaccuauagacgacagguuugcaacagcacucaccgcucuuaaugacaugggaaaaguaagaaaagauauaccacaaugggaaccuagcaaaggcuggaaugacuggcaacaaguaccauuuuguucccaccauuuucaucagcugaucaugaaagauggucgagaaauagucguuccaugcagaaaccaggaugaauuagucggacgugcucgagugagucaaggagcaggguggucacuccgagagacagcauguuuaggaaaaagcuaugcgcaaauguggcaguuaauguauuuucauagacgcgaccuaagguuggcagcuaacgcgauauguagugcgguacccguugauuggauacccacaaguagaacaaccuggucgauucaugcacaucaccaauggaugacuacugaagauaugcuaagugucuggaaucgcguauggauagaagagaauccguggauggaagauaaaacucauaucucauccuggggagacguacccuaucuagguaaaagagaagaccaaugguguggaaguuuaauugguuugacggcaagagcaacaugggcuaccaauauacagguggcaauaaaccagguaaggcgucuuauaggcaacgaaaacuauuuggacuauaugacauccaugaagagauuuaaaaacgagagcgacccugagggcgcauuaugguaa

SEQ ID NO: 21611 - RNA, 9879 nt, Artificial Sequence
  derived and/or modified CDS sequence (opt6) from DENV-1__FJ410286__SS-prME
agcgucacuaugcuauugaugcuaaugccgacggcacuagcuuuucauuugacgacacgaggaggggaaccgcacaugauaguaucaaaacaagaacgagguaaaagccucuuguucaaaacaagugcuggugugaauauguguacauuaauugcgauggaucugggagaauuaugugaggacacuaugacauauaaauguccgcggaucacagaagcugaaccagaugaugucgauuguugguguaaugcaacagauaccuggguuacuuacggaacaugcucacaaacaggggaacaccgccgagagaaaagaucuguugcauuagccccacaugucgggcucgggcuugaaacaagaacggagaccuggaugaguucugagggcgcuuggaaacaaauacaacggguggaaacaugggcuuuacggcauccaggcuuuacuguaauugcucucuuccuagcacacgcuauaggaacuucuauuacucaaaaaggcaucauauucauuuuacuaauguuagucacuccuagcauggcaaugcgaugcguggguauaggaucgagagauuuuguugaaggcuuaucaggggcgaccuggguugacguaguuuuagagcacgguucguguguaacuacaauggcgaaagacaaaccuacauuagauauagaacugcuaaaaaccgaagucacgaauccugcagugcucaggaaguuauguauagaagcaaaaauuagcaacacaacgacggauaguagaugcccgacacaaggcgaggcuacuuuagucgaggagcaagacgcaaacuucgugugcagacgaaccuucguagacaggggauggggaaauggauguggauuguuuggcaaagguagccuucuuacaugugcgaaauuuaaauguguaacgaaacucgaaggaaaaaucguacaauaugaaaaucuaaaauacucuguaauagugacaguacauacuggugaccaacaucaagucggcaacgagucgaccgaacauggaacgacugccacgaucacaccgcaagcgccaacuaccgaaauccaacuaacagacuauggggcccucacacucgacuguaguccgagaaccggauuagauuuuaaugaaaugguacuacucacaaugaaagagaaaaguuggcuaguccauaaacaaugguuucucgacuuaccguuaccuuggacuucaggagcgucaacaagucaggaaacauggaacagacaggaucuucuaguaacauuuaaaaccgcacaugcgaagaaacaagaagucguaguuuuggguucgcaagaaggggcuaugcacacggcuuuaacaggagcaaccgagauacagacauccggcacaacuacaauuuucgcgggccacuuaaaaugucguuugaagauggacaaauuaacguugaagggaaugucauacgugaugugcacagggagcuuuaaauuggagaaagagguagcagagacucaacacggaaccgugcucgugcaaaucaaauaugagggaacugaugcaccauguaaaaucccauucucaacccaagacgguaaaggaguaacccaaaauggacgacuuauaaccgcgaauccaauuguaaccgauaaagagaaaccuguuaacaucgaagcagagccuccuuucggugaaucguacauuguuauaggugccggggagaaagcccugaaguuaucuugguucaagaaaggaucaaguauagggaaaauguuugaggcuacugcgagaggugcaagacguauggcaauauuaggugauacggcaugggacuucgguucaauagggggaguauuuacaagcguugguaaacuuguccaucaaauuuucgguacugcauauggcguguuguuuagcggcgucagcuggacuaugaagauaggaauaggcguacuccugacuugguuaggccucaauucucgaagcaccucgcuaucuaugacuugcaucgcagucggauuagucacauuauauuuagggguuaugguccaggccgauucggguuguguuauaaacuggaaggggagggagcuaaagugugguucugguauuuucgucacuaacgagguccauacuuggacagaacaauauaaauuccaggcagauucaccaaaacguuugucagcagcuaucggcaaggcaugggaagagggaguguguggaauuagaucagcuacucguuuagagaacauuauguggaagcaaaucuccaacgaacuuaaucauauauuacuggaaaaugauaugaaauuuacugucguuguaggugauguagcuggaauauuagugcagggcaagaaaaugauacgaccacagccaauggaauauaaauacaguuggaaaucuuggggcaaagcaaaaauuaucggugccgauguacaaaauucgacauuuauuauugacggucccaauacaccagaauguccagaugaccagagagcguggaacauaugggaaguagaagacuacgguuucgggauuuucacuacaaauaucugguuaaaauugagagauucauauacgcaagugugcgaucaucgcuuaaugagcgcugccauuaaggauagcaaagcuguacaugcugauaugggcuauuggauagaaucagaaaagaaugaaacauggaaauuagcucgcgcgaguuuuauagaaguuaaaacuuguauuuggccaaaaagccauacucugugguccaaugguguucuugaaucugaaaugauaaucccgaaaauucauggcggaccaauuagccaacacaacuaccguccugguuauuuuacccagaccgcaggaccuuggcauuuagguaaacuggaacuagacuuugacuuaugugaaggaacgacugucguagucgaugagcauuguggcaaucgaggaccuagcuuacgaacgacaaccguaacugguaagauaauacaugaauggugcugucguaguuguaccuuaccgcccuugcgauucagaggagaagacggauguugguauggcauggaaaucagacccguaaaagaaaaagaagaaaaccuaguaaaaaguauggucuccgcugggucuggggaaguugacucuuuuucacuaggucuucuuugcauaucgaucaugauugaggaaguaaugcguaguagauggucaaggaagaugcuaaugacagggaccuuagcaguauucuuucuccuaauuaugggacagcuaacauggaaugaccucauaagacuuuguauaauggucggggcaaacgcaagugauagaaugggaaugggaacuacauacuuagcuuugauggcuacauuuaaaaugcgcccaauguuugcuguagguuuauuauuccggaggcuuacaagcagggaaguucuacuuuuaacaauugguuuaucuuuaguggccaguguugaacugcccaacucuuuagaagaauuaggagauggcuuagccaugggaauaaugauccuaaaguugcucacugauuuucaaaguuaucaacugugggcuacacuauugucguuaacuuucauaaaaacaacauuuaguuuacauuaugcuuggaaaacuauggcuaugguacuaagcauugucaguuuauuuccguugugucuuucuacuacuagccagaaaacuacauggcuaccgguacucuugggaucguuaggguguaaaccuuugaccauguuucucauagcugaaaauaaaaucugggggcgaaaaucauggccacucaacgagggaauuauggcuguaggcauuguaucuauauugcugaguucauuacucaaaaaugaugugccguuagcagggccauuaauagcaggaggaaugcugaucgcguguuacgugauuucaggcucgucagcugaucuuucucuggagaaagcagcggaaguaagcugggaggaagaagccgaacacucuggcgccagucauaauauuuugguagaaguacaggaugacggcacaaugaaaauaaaagacgaggaaagagaugacacacuuacaauccuauugaaagccacauugcuagcuguauccggcgucuacccuuuaucaauaccagcaacauuauucguuuggcauuucuggcagaagaagaaacagcgaucagguguacugugggacacccccuccccgccggagguagagagagcagucuuggacgaugguaucuauaggauuaugcaacguggucuacucgguagaucucaagucgguguaggaguuuuucaagaaaauguauuucauacuauguggcauguuacaagaggcgcaguucuaauguaccaagggaaacgacuagaacccucaugggcaaguguuaagaaagacuuaauaucauauggcggaggauggagguuccaaggcucauggaacacuggagaggagguucaagugauugcuguugagccugggaaaaacccuaagaauguucagacugcaccaggaacguucaaaacuccugaaggggaagugggagcaaucgcacuggauuucaaaccagguacauccgggucuccuauaguaaacagggagggaaaaauuguugggcuuuacggaaacgguguagugacuacaagcggaacuuacgucucggccaucgcucaagcaaaggcuucgcaagaagggccauuaccggaaauagaagaugaaguguuuaggaaaagaaaucuaacaauuauggauuuacauccagguaguggaaaaacgagaagguacuuaccagcaauugucagagaagcaaucaagcgaaaauuaaggacacuaauuuuagcaccaacucgaguaguugcgagcgaaauggccgaagcacucaaaggaaugccaauuagguaccaaacaacggccguaaaaagugaacauacagggaaagaaaucguagacuugaugugucaugccacauuuacaaugcgccuauugaguccugucagaguaccuaauuauaauaugauuauaauggaugaagcgcauuuuaccgauccuucuagcauugcagcuaggggguauauaucaacucgggugggaaugggagaagcugcagcaauauucaugacagcaacaccuccuggaucaauggaagcguucccucaaucuaaugcagugauacaagaugaggaacgagauauuccagagagaucauggaacucaggguacgaauggauuacggacuuucccgguaaaacuguaugguuuguaccaucuauuaaagcuggaaaugauauagccaauugccuuaggaaaaaugguaagagagugauucaauuaagcagaaaaacuuucgacacagaauaucagaaaaccaagaacaaugacugggacuacguggugacuacugauaucuccgagaugggugcuaacuuuagagcggaucguguuauugacccaagacgaugccuaaaaccgguaauauugaaagauggaccagagagaguaauauuagccgguccaaugccaguaacuguagcuagcgccgcgcagagacgaggccgcauagggaggaaucacaauaaagaaggcgaucaguacauuuacauggggcaaccuuuaaacaacgacgaagaucaugcacauuggacggaagcgaaaaugcuccuagauaauauaaauacaccggaagggauaauaccugcacucuuugagccggaacgagaaaaaucagcagcaauagauggugaauaucggcucaggggagaagcacguaaaacauucguagaacuuaugagacgcggagaccuacccgugugguuaagcuacaagguugcuagugagggcuuccaauauucugauaggcggugguguuuugauggggaacgaaacaaucaaguacuggaagagaauauggaugucgaaauauggacaaaagaaggugaaagaaagaaauuaagaccacggugguuggacgcucgaacuuacagugacccacuugcacuaagggaguucaaagaauuugcugcaggccgcagaagcgucuccggugaccucauacuagaaauagguaaauuaccacaacauuuaacccaaagagcacaaaaugcgcucgauaaccuuguaaugcuacauaacagugaacaaggcgggagagcuuacagacaugcaauggaggagcucccagacacaauagaaacucucaugcuuuuagccuugauugcuguacuaacagguggagucacccuauucuuucuaucggggaaaggacugggcaaaacaaguauuggccuuuuaugcgugauggcaucuuccgugcuauuauggauggccaguguugaaccucauuggauagcagcuuccauaauauuagaguucuuucucaugguacuacuaauuccugaaccggacagacagcgaaccccacaggauaaccaauuagcuuauguagucauaggucuucucuuuaugauccuaacaguagcagcuaaugaaauggggcuacuugaaacaacaaagaaagauuuggggaucggacacguagcaguugaaaaccaucaucaugcggcgaugcucgacguagauuuacaucccgcuucugcguggacccuauacgcuguagccacaacgauaaucacgccaaugaugaggcauacaauagaaaauacaacagcuaacauuagcuuaacugcuauugcaaaucaagcugcgauuuuaaugggccuagauaaaggauggccgauuucaaaaauggacauaggaguaccacuauuagcguuaggguguuauucccaaguaaauccauugacauugaccgcagcaguucuuauguuaguugcccacuaugcaauuaucgguccuggauuacaagcuaaagcaaccagagaagcccaaaaacgaaccgcggcugggauuaugaagaauccuacuauugauggaaucguagcaaucgauuuagauccuguuguuuacgacgcgaaauucgaaaaacaauugggacaaauaauguuacuuauucuuuguacaagucaaaucuuguuaaugaggacaaccugggcacuaugugaaucuauaacauuggccacaggaccauuaacuacgcucugggaaggcuccccaggaaaauuuuggaacacaacgauagcaguaucaauggcaaacauauucagaggaucuuaucuugcaggagccggucucgccuuuaguuuaaugaaaucucucggaggagggcguagaggaacgggagcgcaaggugaaacauuaggcgaaaaauggaaaaggcagcuaaaucaacuaucgaaaagcgaauuuaauaccuacaaacgauccgguauaauggaaguagaucguagugaagcuaaggaaggauuaaaaagaggcgaaacaaccaaacaugcaguaucuagagggacagcaaaacuccggugguuuguagaaagaaaccucgucaaaccugaaggcaaggugauagacuugggaugugguagaggcggauggaguuauuauugugcgggucuaaagaaaguaacagaaguaaaaggauacacaaagggaggcccuggucaugaagaaccuaucccuauggccacauauggcuggaacuugguaaaacuucacucgggaaaggacguuuucuucauacccccugaaaaaugcgauacacuccucugugacauuggugagucaucaccgaauccaacaaucgaagaagguagaacucuaagagucuuaaaaaugguagagcccugguuaaggggcaaccaauuuugcauuaaaauacuaaauccguacaugccaagcgucguggaaacgcuagaacaaaugcagagaaagcaugguggaaugcuaguuagaaacccacuaucgagaaacuccacucacgaaauguacuggguuucuugcgguacggguaauauugugagugcaguaaauaugacgucuaggauguuguugaauagauuuacaauggcccauagaaaaccaacguaugagagggacguagauuuaggugcggguacucggcauguagcaguagagccagaagucgcuaaccuagauauuauaggacaaagaauugagaacauaaaacacgagcauaaaucaacauggcauuaugaugaagacaacccguauaaaacuugggcauaucaugggucguaugaaguuaaacccucuggaucagcaagcaguauggucaacggugugguaaaacuguugaccaaaccaugggauguaauuccaaugguuacucaaauugcaaugacggacaccacaccguuuggucagcaaagaguauuuaaggaaaaagucgacacgagaacuccuaaagccaaacgugggacugcucaaauaauggagguuacagcuagaugguuguggggcuuucuaaguagaaauaagaaacccagaauuuguacuagagaagaauuuacacguaagguacgaaguaaugccgcaauuggagccguauuuguagaugaaaaccaauggaacucagcaaaagaagccgucgaggacgacagauucugggaucuaguucauagagaaagggaguuacauaaacaagguaaaugcgcaacauguguguauaauaugaugggcaaaagagagaagaaauuaggagaauuuggcaaagcgaaagguucuagagccaucugguacauguggcuuggagcuagauuccucgaguucgaagcacuaggauucaugaacgaggaccauugguucagcagagaaaauucccugagcggaguggaaggagaagguuugcacaaauuaggauauauccuaagggauaucagcaagauaccagggggaaauauguaugcagacgauacggcaggaugggauacaaggauuacagaagaugacuuacaaaaugaagcaaaaauaacagauaucauggaacccgagcacgcccuacuugcgaaaucgauauucaaacuaacauaccaaaauaaagucguucgaguccaaagaccugccaaaaacgguacgguuauggacgugauaucccgcagagaucaaagaggauccggacagguggguacuuacggacucaauaccuuuacuaacauggaggcacaacuuauaagacaaauggaaagcgaggguaucuuucuccccaacgaacucgaaacuccuaauuuagccgggcguguacuagacuggcuggagaaauaugguguggaacgccuuaaaagaauggcaauaaguggugaugauuguguagucaaaccaauagacgaccgguuugccacugcucuuacggcucucaacgacaugggcaaaguacgaaaagauauuccccaaugggagccaucaaaaggguggaacgacuggcagcaaguaccauuuuguucucaucauuuucaccaacuaauaaugaaggauggucgagagauaguggugcccugucguaaucaagacgaauuaguaggacgggcaagaguaucacaaggugcgggauggucccuucgcgaaacugccugucucggcaagaguuaugcacaaauguggcaauuaauguacuuucauagacgugacuuacguuuagccgcuaacgccauauguucugcagugccuguagauuggguaccgacuucacgaacaaccuggaguauacacgcacaucaucaauggaugacaacagaggauaugcuaaguguuuggaauagaguguggauugaagaaaauccuuggauggaagauaaaacgcgcauaagcucaugggaagacguuccuuaucuagguaaaagagaggaccaauggugugguucuuuaauaggucuaacagcucgugcaacuugggcaaccaauauucaaguugcuauaaaucaaguaagacgacuaauuggaaaugaaaacuacucagacuauaugacaucaaugaaaagauucaagaaugagucugaaccagaaggugcguugugguaa

SEQ ID NO: 21612 - RNA, 9879 nt, Artificial Sequence
  derived and/or modified CDS sequence (opt6) from DENV-1__FJ461339__SS-prME
ucggugacuaugcuccuaaugcuuaugccgacugcucuagcguuccaucuaacuacucgaggcggugaaccgcacaugaucguuaguaaacaagagcgugguaaaaguuuguuauucaaaaccucagcuggaguuaauaugugcacguuaaucgcaauggaucucggugaauuuugugaagacaccaugacauauaaauguccgagaaucacagaagcagaaccagaugacguggauugcugguguaaugccacugacaccugggucacauauggaacauguucacaaacaggugaacacagaagagacaaacguaguguagccuuggcuccacaugugggauugggccuugaaacucgaacugagacguggaugaguuccgaaggagccuggaaacaaauccaacgaguagaaacuugggccuuaaggcauccaggauuuacaguuauugcacuuuuccuagcccacgccauaggcacaagcaucacacaaaaagggauaauauucauauuacuuauguuaguaacaccuucgauggcgaugcgaugugugggaauaggaucucgggauuucguugagggcuuaucaggcgcgacauggguggaugugguguuagaacacggaaguuguguuacgacuauggccaaagauaaaccaacauuagacauagagcuuuugaaaacugaaguuacaaauccggcaguccuacggaaacuauguauugaggcuaagaucucuaacacgaccacugacagucgguguccuacccaaggagaggcaacuuuaguggaagaacaagacgcaaacuuuguuugccgacgaacuuucgucgauagaggauggggaaacggaugcggguuauuuggaaaagggucauugauaacuugugcgaaguuuaaaugcguuacgaaauuagaagguaagauuguacaauaugagaauuugaaguauucaguuauugucacuguccauacuggggaccaacaucaaguuggaaaugaaagcacggaacauggcacuacugcaacaauuacuccacaagcaccaagcacggaaauucaacuuacagauuacggugcccuaacacuggauuguaguccuaggacuggcuuggauuuuaacgaaaugguacuuuuaaccaugaaagagaagucuuggcuaguucacaaacaaugguuucucgaucucccucugccauggacgucaggagcaucaacaucccaagagacuuggaacaggcaagaucugcucguaacuuuuaaaacagcacaugccaagaaacaagaggucgucguacuagguucgcaagaaggagcgaugcacacggcguuaaccggcgcuacugaaauacaaacuagcggcacaacaacaauuuuugcaggucaucuaaaauguagacucaaaauggacaagcucacucugaaagggaugaguuaugugaugugcaccggaucauuuaaguuagagaaggaaguggcggaaacacaacacggaacaguccuaguacaaauaaaguacgaaggaacugacgcuccuugcaagauuccuuucucaacacaagacgaaaagggaguaacucaaaacggacgacuaauaacggcgaaccccauagucacugauaaagaaaaaccuguaaacauugaagcggaaccaccuuuuggcgaaucguauauaguaaucggagcuggugaaaaagcguuaaaauugagcugguuuaaaaaggguagcucgauaggaaaaauguucgaagccacagcaagaggcgcacgucggauggcuauuuugggcgauacagccugggacuuuggcucaaucgggggagucuuuacuucaguuggaaaguuagugcaucaaaucuucgguacugcguaugggguuuuguucaguggaguuuccuggacuaugaaaaucggaauuggcgucuuacuuacauggcuuggauuaaauaguagaucaaccucacuaucaaugacaugcauagccgugggguuaguaacuuuguauuuggggguaaugguucaggcugacucagguugcguuaucaauuggaaaggacgagagcuaaagugugggucugguaucuuuguaacgaacgaaguccacacauggacggagcaauauaaauuccaagcugauucccccaaaagauuaagcgcagccaucgggaaagccugggaagaaggagucuguggaauccgaucagcaacgcgucuagagaauaucauguggaagcagaucagcaacgaacuaaaucauauccuauuggaaaaugacaugaaauuaacaguaguaguuggggacguugcagggauucuugcacaaggaaagaaaaugauaagaccacagccaauggaauauaaauacaguuggaaaucgugggguaaggcuaagauaauaggcgcagacgugcaaaauacuaccuuuauaauagacggcccaaacacaccugaaugcccugacgaccaacgcgcauggaacaucugggagguagaggauuauggcuucggaauauuuacaacaaauauauggcucaaauuaagggauucgcauacacaaguaugcgaucacagauuaaugagugcugcuauaaaggauucgaaagcuguucacgcggauaugggcuacuggauagaaucagagaagaacgaaacuuggaaauuagcacgugccucauuuauagagguuaaaacaugcauauggccgaaaagucauacacuauggaguaauggcguauuggaaagugaaaugauaaucccaaaaauuuauggagggcccaucagucaacauaauuauagacccggcuauuuuacucaaacagcuggaccuuggcacuuagguaaacuagaacuagauuucgaccuaugcgaggggacgacaguaguuguagaugaacauugugguaauagagguccuucacugaggacuacgacaguaacuggaaaaauaauucacgaaugguguuguagaucauguacucugccgcccuuaagauucaaaggugaggauggauguugguacgguauggaaauaagaccaguaaaggaaaaagaagagaaccuagugaagaguaugguaucugcgggaucuggagaaguggauagcuuuagucugggacuccuauguauaaguauaaugauagaagaaguaaugaggucaagauggagucgaaaaaugcuaaugacugguacccucgcaguauuuuuccuacuaauaaugggacaauugacguggaaugacuuaauuagguugugcauaaugguaggggcaaacgcaucggauaggaugggcaugggcaccaccuacuuagcucuuauggcaaccuucaaaaugaggccaauguucgccguuggucuacuguuuaggagacucacuucucgagaaguuuugcuccugacaauaggcuugucacuuguugcaucuguugaacuucccaauagucucgaggaauuaggagacgguuuagccauggguauaaugauacuuaaauuacucaccgacuuccaaccucaucaguuaugggcaacauuacuuucacucacuuucaucagaacaacauuuucacuucacuacgcuuggaaaacgauggcaauggugcuaucaauagugagucuauuuccacuuugucuaagcacaaccucccagaaaacaacuugguuacccguucuucuagguucccuagguugcaaaccgcucacaauguuccucauagcagaaaacaagauuuggggaagaaaaaguuggccacuaaaugaaggaauaauggcaguaggaauuguauccauauuacucaguucucuuuugaaaaacgauguaccguuagccggaccacuaauagcuggaggcaugcuaaucgcaugcuaugucauaucaggaaguucagccgauuuaucacuggagaaagcggcugaagucaguugggaagaggaagcugaacauucgggagcaagccauaauauccuugucgaaguccaagacgauggaacuaugaagaucaaagaugaggaaagggacgauacauuaaccauccuacuaaaagcuacccugcuagcagugucaggggucuaucccuuaucaauaccagccacuuuauuuguuugguauuuuuggcagaagaagaaacaaagaagcgguguccucugggauacaccuucaccuccagaaguggagcgagcuguuuuagacgaugguauuuaucgaauuaugcaaaggggccuacucgguagaucacagguuggcgugggagucuuucaagaaaacguuuuucacaccauguggcaugugacacguggugccguauuaauguaucaggguaaacgacuagagcccucuugggcaucagucaagaaagaucugauuagcuauggaggcgguuggcgguuacaaggcucauggaacaccggcgaagaaguacaaguuauugcagucgaaccgggaaagaauccaaagaaugugcaaaccgcacccggcacauuuaagacaucagagggagaagugggcgccauugcuuuagacuuuaaaccaggaacgucggguagcccuaucguaaaccgugaaggcaaaaucgugggacuauacggaaacggggugguuacuaccagcggaacuuaugucucagcaauugcucaagcuaaagcgucccaagagggaccguuaccugaaauagaagacgaaguauuucgaaagaggaauuugacuauuauggaccuccaccccggaucugggaagaccagaagauauuuaccagcgauaguacgagaagcaaucaagagacgccucaggacccuaauuuuagcaccuacccgcguaguagcuucugaaauggcugaggcgcuuaaggguaugccgauucgauaucagacaacugcugugaaaucagagcacacggguaaggagauagucgauuuaaugugucacgcuacuuuuaccaugagauugcuaucaccaguacgcguacccaauuauaauaugauuauuauggacgaagcucauuuuacugauccaagcucaauagccgcacgcgguuauauuaguaccagaguaggaaugggcgaggcagcagcuauauucaugacugcgacuccaccuggaucgguugaggcauucccucagagcaacgcaguaauucaagaugaagagagagauauuccugagcgaucuuggaauaguggcuaugaauggauaaccgauuuuccaggcaaaacugugugguucguaccaucuauaaaaucgggaaaugauaucgcaaacugccuaaggaaaaaugggaaacgcguaauucaacugaguagaaagacauuugacaccgaauaccagaaaacuaaaaacaaugauugggauuaugugguuacaacagacaucucggaaaugggagccaauuucagagccgauagaguaaucgacccaagaagguguuuaaaaccaguaauauuaaaagauggaccugaaagaguaauuuuagcaggacccaugccgguuacaguagcaagugcugcucaacgacguggcaggaucggaaggaaucauaauaaggaaggcgaucaauauauauauauggggcaaccccuaaauaacgaugaagaucacgcccauuggacagaagccaaaaugcugcuugauaacauuaauacgccugaaggcauaauccccgcacuuuuugagcccgaacgggagaaaagugcagcgaucgauggagaauaucgguuaagaggagaagcuagaaaaacuuucguagagcugaugagaagaggggacuugccuguuuggcuaagcuauaaagucgcgucugaagguuuucaauauagugauaggagaugguguuuugauggugaaagaaacaaucaaguucuugaagagaauauggauguggaaauauggacaaaagagggagaacgcaaaaaguuacgaccacguugguuggaugccagaacuuauucagacccacuugcccuaagggaguucaaggaguucgcugcaggaagaagaagcguaucaggggaucuuaucuuagaaauaggcaaacuuccacaacaucuaacucagcgagcgcaaaacgcgcuagacaacuuaguaaugcugcauaacucggaacaaggcggacgagccuauagacaugcaauggaagaacuccccgacacuauugagacauuaaugcuacuagcgcuaauugcgguccucacugggggaguaaccuuauucuuuuuaucagggagaggauuaggaaaaaccucgauuggacuacugugcgucauugcaagcucaguucuccuuuggauggcaaguguugaaccucauuggauugcugcaucgauaauuuuagaguucuuuuuaaugguacugcugauuccagaaccugaccgucaacgaacuccucaggauaaccagcuugcuuacguagugauugguuugcuuuucaugauuuugacuguagcugcgaacgaaaugggguuacuggaaacaaccaagaaagacuuaggaaucggacaugucgcggucgaaaaucaccaucaugcugcgaugcuagacguagaucuacauccagcauccgcauggacauuauaugcaguugcaacuacuauuaucacucccaugaugaggcauacgauugaaaacacgacagcuaacauuagucuaacggccauagccaaucaggccgcaauauuaaugggcuuagauaaaggauggccuauuuccaagauggacauaggggucccauugcuugcuuuaggauguuauagccaaguaaauccuuuaaccuuaacggcagcgguuuuaaugcuaguggcucacuaugccauaauagggccaggucuacaagcaaaagcaacgagagaagcgcaaaagagaacugcggcaggaauuaugaaaaauccaacuguggauggcauaguagcaaucgaucucgauccgguaguuuaugaugcgaaauucgaaaagcagcucggccaaaucauguuauuaauucuuuguacaucucagauccuguugaugcguaccacaugggcgcuaugugaaucaaucaccuuagcuacuggaccauugacaacguuaugggaagguucuccaggaaaauuuuggaacacaacgauugcagucagcauggcaaauaucuuucgggggagcuacuuggcugguguaggauuagcauucuccuuaaugaaaagccuaggaggcggaaggagggguacaggugcucaaggagaaacgcuuggagaaaaguggaaaaggcaacuuaaucagcuaucgaaaucugaauuuaauacuuauaaacgaagugguauuauggaaguagaucguucggaggccaaggaaggauuaaaaagaggagaaacaaccaaacacgcaguaaguaggggaacugcgaaauugagaugguuugucgagagaaaccuaguuaaaccagaggggaaaguuauagaucuagguuguggaagagggggaugguccuauuacugugcgggacuaaagaagguaacugaaguuaaaggauauacuaaagguggaccgggacacgaagaaccaauaccaauggccacauaugguuggaauuuaguaaaacuucacucuggcaaagacguauucuuuauuccaccugaaaagugcgauacauugcuuugugauauaggcgaaaguucaccuaacccuacaaucgaagagggaagaacccuacgcguauuaaaaaugguagaaccuuggcugagaggaaaucaauuuuguauaaaaauccuuaaucccuacaugccaagcguaguagaaacacuagaacaaaugcaaagaaaacacgguggcauguuaguacgaaacccguuaagccgaaauucaacccacgaaauguauugggucagcugcgguacaggaaacaucguuagcgcagucaacaugacuucgcggaugcugcucaaucguuuuacaauggcacauagaaaacccacuuacgaaagggauguugaccuuggagcaggaacucgacauguggcaguugaaccugagguagcuaaucuugauauaauaggucaaaggaucgaaaauauaaaacaugaacauaagaguacguggcauuaugaugaagauaacccauacaaaacaugggcuuaucauggcucauacgagguaaaaccuuccggauccgccaguaguaugguaaaugggguagucaaauuauuaaccaaaccaugggacguuauaccuaugguaacgcagauagcaaugacugacaccacgccauucggacaacaaagaguguucaaagaaaaaguggauacaagaacacccaaagcaaagcgaggcacagcgcaaauaauggaaguaacggcaaaaugguuaugggguuuucuuagucgcaauaagaagccacgaauaugcaccagggaagaauuuaccagaaaaguacgaucaaacgcggcaauuggugcugucuucguagaugagaaccaauggaacucagcaaaggaagcgguugaagaugaacgguucugggaccuaguucaucgugaacgagaauugcauaaacaagguaaaugcgcgacaugcguauacaacaugauggguaaaagagagaagaaauugggugaauuugguaaggcgaaagggucacgugcaaucugguauaugugguuaggagcuagauuuuuagaauuugaggcucuagguuucaugaaugaggaccauugguuuucaagagaaaauucauuaaguggggucgaaggagaaggauuacauaaauuaggguacauacuaagagacaucucaaaaauaccagggggaaauauguacgcugacgacacagcgggcugggauacacguauuaccgaagaugauuuacaaaaugaagcgaaaauaacagauaucauggaaccggaacaugcucuacuagccaagagcauuuucaaauuaacuuaucagaauaaagugguaagaguacaacgcccugcuaaaaauggaaccguaauggaugugauaucaaggagagaccaaagaggaucagggcagguagggacauacggccuaaauaccuuuacuaacauggaggcacaacugauaaggcaaauggaauccgaaggaauauuuucuccgucggaacuugaaacaagcaaucuugcagggagaguccuagauugguuggaaaaacauggaguugagcgguuaaagagaauggccauaaguggagacgauuguguuguaaaaccgauagacgaccgcuucgcaacagcuuuaaccgcccugaaugauaugggaaaaguaagaaaagacauaccacagugggaacccaguaaaggcuggaacgacuggcaacaagucccauucugcucacaucauuuucaucaacuuauuaugaaggauggcagagaaaucgucgugccgugucggaaucaagaugagcuaguagggagggcacggguaagccagggagcagguuggaguuuacgagaaacagcuuguuugggaaaaagcuaugcucagauguggcaauuaauguauuuucacaggcgagacuuaagacuugcagccaacgcuaucugcucggcuguccccguagauugggucccgacaaguaggacaacauggucuauccaugcccaccaucaauggaugacgacagaggacaugcuaaguguguggaacagaguguggauagaagaaaaucccuggauggaagacaagacucacgugagcaguuggggagauguaccauauuugggaaaacgagaggaucaauggugcggaucauugaucggauugacggcgagagcuaccugggcaacgaacauacaaguugcgauaaaucaaguuagacgacuacuuggcaaugagaacuacuuagacuauaugacaaguaugaaacgguuuaaaaaugaaagcgauccugaaggagcacuaugguga

SEQ ID NO: 21613 - RNA, 9879 nt, Artificial Sequence
  derived and/or modified CDS sequence (opt6) from DENV-1__FJ882515__SS-prME
uccgugacaaugcuccuuaugcuaaugccaacagcacuugcauuccaucucaccaccagagguggagaaccacacaugaucguuacaaaacaagaaaggggcaaaucacuucucuuuaaaacaagugcaggggugaauaugugcacacuaauagcaauggaucuuggcgaguuaugugaagacacuaugacauacaaaugcccaagaaucacggaagcagaacccgacgauguugauuguugguguaaugcaacagauacauggguaacauacggaacuugcucacaaacaggugaacaucgaagagauaaaaggucuguagcacuagcuccacacguaggcuuaggauuggagacaaggacugagacguggaugagcuccgaaggugcuuggaaacaaauacagcgagucgaaacgugggcguuaagacauccaggcuucacggugauagcuuuguuucuugcucacgccaucgggacuucaauuacucagaaaggaauuaucuuuauucuauuaauguuagucacucccaguauggcaaugagaugcguugguauaggcucaagggacuucguggaaggacuuucgggcgcgacauggguagacgucguucucgaacacgggagcugcguaaccacgauggcaaaagauaaaccaacuuuagacauagaacuccugaaaacggaagugacgaauccggcugugcuacgcaaacuuuguauugaagcuaaaauaucuaauacaacaacugacucgcguuguccaacacagggcgaagcaacgcuaauggaagaacaagaugccaauuuuguuuguaggagaacuuucguagacagaggaugggguaaugguugcggccuauucggaaaagguucucuaaucacgugcgcaaaguuuaaauguguuaccaaguuagaagggaagauaguccaguacgaaaaucucaaguacucaguaauaguuacaguucauaccggugaccagcaccaaguaggaaacgaauccacugaacauggcacaacagcgacaauaacuccucaagcaccuacguccgaaauccaguugaccgauuacggugcauugacacuggauugcucuccacgaacuggacuagacuuuaacgaaauggugcuacugacaaugaaggagaaauccugguuaguccacaaacaaugguuuuuagaucuuccucuuccuuggacgucuggggcuucuaccucacaagaaaccuggaaucgucaagaucuauuagugacuuuuaaaacggcccaugccaagaaacaggaggucguaguauuggggagccaagaaggagcgaugcauacggcauuaacgggagcaacagaaauccagaccucaggaacaacgaccauuuuugcggggcauuugaagugcagauugaaaauggauaaacuaacuuugaaggggaugagcuaugucaugugcaccggaucauucaaacuagaaaaagagguggcagaaacucaacauggaacaguacuuguucaaauaaaguacgaagggaccgaugcaccguguaaaauaccguuuaguacacaagacgaaaaaggagugacgcagaauggaagguugauaacagcaaauccaauaguuacagacaaggaaaaacccgucaauauagaagccgagccaccguucggagaaaguuacauaguaauuggagcuggugaaaaagcauuaaaguugagcugguucaagaaagguucaaguauuggcaaaauguucgaagcaacagcccggggugcaaggagaauggcuauacuuggagauacugcgugggacuuuggaagcauuggcggaguauuuacaucaauagguaaguugguucaccaaauauuuggcacagccuacggaguguuauuuucaggugucucguggaccaugaaaaucggaauaggcguacuacuaacuuggcuaggccuuaacagcagauccacaucgcuaagcaugacaugcauagccgucggauuaguuacguuguaucuuggaguaaugguacaagcugauucgggguguguaauaaacuggaaaggcagagaauuaaaaugcgguucuggcauuuucgugacaaaugaggugcauacauggacagagcaauacaaguuccaagcagauucacccaagagguuaucggccgcaauugggaaagccugggaagagggaguuugugguauacgaucggccacaagacuugaaaacauuauguggaaacaaauuaguaaugaacuaaaccacauacuccucgagaacgauaugaaauucacuguagugguaggcgauguaguagggauucuagcccaagguaagaaaaugaucagaccacaaccaauggagcauaaguauucguggaaaucaugggggaaggcaaaaauaauaggagcugaugugcaaaauacuacuuucauaauugaugguccuaacacaccggaaugccccgaugaccaaagagcguggaacauaugggaaguagaagauuauggauuugguauuuuuacaacaaauauuugguuaaagaugcgagacuccuauacccaggugugcgaucauagacuaaugagugcugcaauaaaagacucuaaggcaguccaugcagauaugggauacuggauagaauccgagaaaaaugaaacuuggaagcuagcgcgcgcaucuuucauagaagucaaaacguguauauggccaaaaucgcacacucucuggaguaaugguguucuugaaucagaaaugauaauuccaaagauauaugguggaccaauuucgcaacauaauuauaggccuggauacuuuacccaaaccgcagguccuuggcaucucgguaaauuagaauuagauuuugaucuaugcgaaggaacaacuguaguaguugacgaacacuguggcaacagaggaccuucuuugcgaacaaccacaguuacuggcaaaauaauucaugaaugguguugcagaucaugcacuuugccaccgcugcguuucaaaggagaggacggaugcugguacgggauggagauaagaccugucaaagagaaggaagagaauuuaguaaaauccaugguauccgcaggaucgggagaggucgauagcuucagccucgguuuacuauguaucucuauaaugauugaggaaguaaugcguucuagauggagccgaaaaauguuaaugacugguacguuagcuguguuucuguuacucaucaugggccaacugacauggaaugaucuuauuaggcuuuguauuaugguaggcgccaacgcuucagaucgaaugggcaugggaacuacauaucucgcauuaauggcgacguucaaaaugcgaccaauguuugcaguaggguuacuuuuuagacguuuaacuucccgugaaguucuccuacuuacaauaggguuaucauuaguugcgagcguagaguuacccaacaguuuggaggaacuaggagauggucuugcaaugggcaucaugauucuaaaauuacuuacagauuuccaaucgcaccaacuuugggcaacgcuucuaucuuuaacuuuuauaaagacaaccuuaucguugcauuaugcauggaaaacaauggccaugguccuuagcauaguaucuuuaauaccgcuaugucugaguacaacaucccaaaagaccaccugguuaccaguauuacuaggcucauuagguuguaaacccuuaaccauguuucuuauagcagaaaauaaaaucuggggaagaaaaucuuggccuuugaacgaagguauaauggcgguggguguggugucuauccuguuaucuucuuuauuaaagaaugacgugccacuagcugggccacuaaucgcugguggcauguugauagcaugcuaugucauuucagguucaucugccgacuuaucacuagaaaaggccgcugaagugaguugggaagaagaagcugaacauucaggagccucucauaauauauuaguugaaguacaagacgacgguacgaugaaaauuaaagaugaagaaagagaugacacacucacaauauugcuuaaagcgacacuuuuagccguauccggaguuuauccacugagcauaccagcaacuuuauuuguaugguacuuuuggcagaaaaagaaacaacguaguggaguguuaugggauacacccaguccgccagaaguggaacgugcaguguuggaugacggcaucuacaggauaaugcagagaggacuuuuaggaagaucccaaguggggguggguguguuccaagagaaugucuuccauacuauguggcauguuacgagaggugcaguucuaauguaucagggaaaaagacuagagccaucuugggcaucagucaagaaggaucuaauaucauacggaggaggguggcgguuacaagggucguggaauacgggugaagaaguacaggugauugcuguggagcccggcaaaaauccgaagaacguacaaacggcgccugguaccuucaagacaccagagggagaaguaggugcgauagcacuagauuuuaaaccggggacaucaggcagcccuaucguaaaccgagaagggaaaauugucggguuauauggaaacggaguaguaacaacuucgggaacauauguaucagcgauugcccaagcuaaagcaagucaggagggcccacuaccagagauagaggaugagguuuucagaaaaagaaauuuaacaauuauggaucugcauccggguucaggaaaaacgcgaagauacuuaccagcaauagucagagaagcuauaaaaagaaaauugcguaccuuaauucuagcaccaacgagaguuguagcaucagaaauggccgaagcccucaaaggcaugccuauacguuaucaaacgacugcuguaaaaucugagcauaccggcaaagaaauuguagacuugaugugucacgcaacauucacaaugcgucuucuaagucccguaagaguaccuaacuauaauaugauuaucauggacgaagcgcauuucacagauccaucaaguauugcagccagaggauacauuaguacuagagugggaaugggagaagcugcugcuauauuuaugacugcgaccccgccagguagugucgaagcauucccacaaucuaaugcaguuauacaggaugaagaacgagauauuccugaacgguccuggaauagcggauacgaauggaucacugacuuuccuggcaagacuguuugguuugugccaucaauuaagucuggaaaugauauagcuaauugucuaaggaaaaaugggaagagagucauacaauugucccgaaagacauucgacacugaauaccagaaaacaaagaauaaugauugggauuacgucguaacgaccgauauaucugaaaugggagcaaacuucagagcagaccgagugauugauccgcguagaugccuaaaaccggucauccuuaaagauggaccagaacgugugaucuuagcagggccuaugccggugacuguugcaucugcagcucaacgaagaggacgcauagguagaaaucauaacaaagaaggcgaucaauauauuuauaugggccaaccacuaaacaaugacgaagaucaugcucacuggacugaagccaagaugcuucuagauaauauuaacacgccggaggguauaauaccagccuuauuugaacccgagagggagaaaagugccgccauagauggagaguauagauugcgaggagaagcaaggaagacauucguagaguugaugagaaggggcgacuuaccaguuugguuaucguauaaaguagccucugaaggguuccaguacucagauaggagguggugcuucgacggcgaaagaaauaaucaaguucuugaggaaaauauggaugucgaaauuuggacgaaagagggcgaacguaagaaacucaggccuagauggcuugaugcacguacauauucugacccauuggcguuaagggaauuuaaagaguucgcagcaggaagacgaaguguuucaggagaucuaaucuuagaaauagggaaauuaccccaacaccugacucaaagagcccaaaaugcauuagauaaucuaguuaugcuucauaauagugaacaaggaggaagggcauacagacacgcuauggaagaacuaccggacacaauugagacauuaaugcuccuugcauuaauagccguauuaacaggcgguguuacucucuucuucuuaaguggaagggggcuaggcaaaacaagcauagguuugcuguguguaauggcuucaucagucuuacuguggauggccucgguagaaccgcacuggaucgcagcuucaauaauuuuagaguucuuuuugaugguauuacugauaccagaacccgauaggcaacgcacuccucaagacaaucaauuagcauaugucguuaucggguuauuguuuaugauuuugacaguugcggcaaaugaaaugggauuauuggaaacuacuaagaaagacuuagggaucgggcauguugcaguugaaaaucaucaccacgccacgauguuagacguagacuuacauccagccucagcauggacguuauaugcaguagccacgacuaucauuacuccuaugaugcgccauacuauagaaaauaccacugccaauaucagcuuaacagcaauagccaaucaagcagcgauucuaaugggacucgauaaaggcuggccuauuuccaaaauggacauugguguaccuuuacuugcuuugggaugcuauucccaaguaaacccacuuacacucacugccgccgucuuaaugcuaguagcccauuacgcgauaauugguccaggauugcaagcgaaggccacacgugaagcgcagaaaagaaccgcagcugggauaaugaaaaauccgacaguugacgggaucgucgcaauugauuuagacccaguggucuacgaugcaaaguuugaaaagcaauuaggccaaaucaugcuguuaauacuguguacgagccaaauucuucuuaugaggacgacuugggcccugugugaauccaucacuuuggcaacaggaccguuaacuacacuaugggaaggcucaccgggaaaauucuggaacaccacuauugcagugucaauggcgaauaucuuuagaggcaguuaucuagccggugcaggccuugcauuuagccucaugaagaguuuggguggagguagacguggaacaggcgcgcaaggggaaacguugggagaaaaauggaaaagacaauuaaaucaacuaagcaaaagcgaauuuaauauauacaaacguaguggaauaauggaaguagauaggucggaggcgaaagaaggccucaaacgaggagaaacaacccgacacgcuguaaguagaggaacagcaaaguuaagaugguucgucgaacgaaaucuagucaaaccugaagguaagguaauagacuuagguugcggaagaggcggauggucauauuacugugccgggcuuaagaaaguuacagaaguaaaagguuacacuaaaggagguccgggccaugaagaacccauccccauggcuacuuacgguuggaaccuugugaaacuacauucaggaaaagauguauuuuucacaccacccgaaaaaugcgacacccugcuaugugauaucggagaaagcucuccaaacccaacaauagaagagggucgaacauuaagaguacugaaaaugguagaaccaugguugcgagggaaucaauuuuguaucaaaauacucaauccauacaugccgaguguggucgagacgcuagagcaaaugcagagaaaacacggcggaaugcucguucguaacccccuaucgagaaauucaacgcacgaaauguauugggugaguugugguacaggaaauaucguaucagcuguaaauaugaccagcaggaugcuuuuaaauagauuuacaauggcucaucgcaaaccaacauacgagaaggacguagauuuaggggccgguacaagacacgucgcaguugagccagaaguagcaaaucuugacauaaucggacaaaggauagagaauauuaaacaugaacacaagucgaccuggcauuacgaugaagauaaucccuacaaaacaugggcauaucauggcucguaugaagugaaaccaucgggaucagcauccagcaugguaaauggaguggucaaauuacuaacgaaaccgugggaugugaucccaaugguaacacaaauagccaugacagacacuacgccguuuggccaacaaagaguauuuaaggaaaaagucgacacuagaacgccuaaagcaaagagaggaacaguucaaaucauggaaguaacugcacgcuggcucuggggauuucuauccagaaauaagaaaccacggauaugcacucgggaagaguuuacuagaaaaguacgaaguaaugcggcaauaggcgcaguauuugucgaugaaaaucaauggaacucagccaaggaggcaguugaagacgaacgcuuuugggaucuuguacagaaagagcgagaauugcacaaacaaggaaaaugcgcgacuugcguauacaauaugaugggaaaacgugaaaagaaacuaggagaguuuggaaaggcuaagggcagcagggcgauuugguauaugugguuaggcgcaagguuccuagaguucgaggcauuaggauuuaugaaugaagaucauugguucucgagagaaaauucuuuaucugggguagaaggagagggacugcacaaacuagguuauauuuuaagggacauuuccaagauacccggagguaacauguacgcagacgauaccgcggggugggauacaaggauaacugaggacgacuuacaaaaugaggcaaagaucacugacauaauggaacccgaacaugcccuacuugcuacaucgauuuuuaaacucacuuaucaaaacaaaguagucaggguacagagaccugcuaaaaacggaacugucauggacguaauaaguagaagagaucaacgaggaucgggccaaguagggacauacggauuaaacacauuuacaaauauggaggcccaauuaauacgccagauggagucggaagguauuuucuuaccaagugaacucgaaacaccuaacuuggccgagaggguauuagauuggcuagagaaauacggaguagaaagacugaagcgcauggccaucucaggagacgacuguguuguaaaacccauagaugauagauuugcuacugcauuaacagcacuaaacgacaugggaaaaguucguaaagacauuccucaaugggaacccucaaaaggcuggaaugauuggccacaagucccacauuguucgcaucacuuccaucaacugauuaugaaagacggacgcgaaaucguaguuccaugucgcaaucaagaugaauuagugggacgagcaagaguaagucaaggcgcggguuggagcuuaagagaaacagccugccuaggaaaaucauacgcacaaauguggcagcucauguacuuccaccgaagagaccuuagacuagcagcaaaugccauauguucugcuguccccgucgauugggugccgacuucacgaacaacauggucuauccaugcucaucaucaauggaugacaaccgaagacauguuaucgguauggaaccgaguuuggaucgaagaaaauccauggauggaagacaaaacacaugucucaaguuggggugacguuccauauuuagguaaacgggaggaccaaugguguggaucuuuaaucggacuaaccgcacgagcaacuugggcaucgaauauucaggucgcaauuaaucaaguaagacgccucauagguaacgagaauuaucuagauuacaugacuucuaugaagagauuuaagaacgaagacgauccugaaggugcacucugguag

SEQ ID NO: 21614 - RNA, 9879 nt, Artificial Sequence
  derived and/or modified CDS sequence (opt6) from DENV-1__FJ882517__SS-prME
agcgugacuaugcuguuaauguuaaugccaacggcgcucgcuuuccaucuaacgacccgagggggagaaccccauaugauuguuucuaaacaagaaagagguaaauccuuacuguucaaaacgucugcagggguuaacauguguacauuaauugcuauggaccucggugaauuuugcgaagacacaaugacuuauaaauguccaaggaucaccgaagccgaaccagacgauguugauugcuggugcaaugcuaccgauaccuggguuaccuauggaacgugcagccaaacaggagagcauagaagagauaaaagaaguguggcguuagcaccacacguaggacuuggauuagaaaccagaacagaaaccuggauguccucugaaggugcuuggaaacaaauacaaagaguagagacaugggcacuucgacauccaggcuucacaguaauagcauuauuucuugcacacgcgauugguaccucaauaacacaaaaagguauaaucuucauauugcugaugcuaguuacgccaucgauggcaaugcgauguguugguauagggagccgugauuucguugaaggacuaagcggggcaacuuggguagacguuguuuuagaacaugguaguugcguuacaacgauggcaaaagacaaaccaacccuggauauagaauuguuaaagacagaaguuacgaacccagcuguacuaagaaagcuguguauugaagcaaaaauuucgaacacaacaacagauucacgguguccuacgcaaggugaagcaaccuuaguagaggagcaagaugcgaauuucguguguagaagaacuuuugucgaccgaggauggggaaacgguugcggguuguucggaaaagguucgcuuauaaccugcgccaaauuuaagugcguuacaaaacuugaagguaaaacgguucaguacgaaaacuuaaaguacucggugaucguuacggugcacacaggggaccaacaucaaguugggaacgagagcaccgaacaugguacuaccgcgacaauuacgccacaagcaccaaguaccgaaauucaauuaacggauuacggggcacuaacacuagacugcucccccagaacaggcuuggacuucaacgaaauggugcuacuuacaaugaaggagaaaagcuggcuaguucacaaacagugguuucuugacuugccauuaccguggacaaguggcgcgucuacaagucaagaaacuuggaacagaaaagaccuguuaguuacguuuaaaacagcucacgcuaaaaagcaggaaguuguaguacuuggaagucaagagggugcaaugcauaccgcacuuacgggagccacggagauccaaacaagcgggacuacgacgauauuugcaggacaucuuaaauguagauuaaaaauggacaaacugacguuaaaggggauguccuauguuaugugcacuggaucauuuaaguuagaaaaagaaguggcagaaacacagcaugguacaguacucguccaaauaaaauaugaagguacagaugcgccuuguaagauuccuuucaguacucaagacgaaaaggguguaacacaaaacgguagacuaauaacugcaaaccccauaguaacagacaaagaaaaaccaguaaauaucgaggcagaaccuccauuuggugaaagcuacaucguaaucggugcaggagaggaagcauuaaaacuauccugguuuaagaaaggcagcagcaucgguaaaauguuugaagcgacugcaagaggagcuagaagaauggcuaucuuaggagacacugccugggauuuuggaucaauaggagguguuuuuacaaguguuggaaagcugguacaccagauauucggcacugcguaugguguauuguuuucaggugucagcuggacuaugaagauaggaauuggagugcuacuuacuugguuaggauuaaauagucguucuacgucgcuguccaugaccuguauugcaguuggcuuaguuacauuguaccuagguguuaugguacaagccgauucugggugcgucauuaacuggaaaggaagagaacuaaaguguggcucaggaauauucgucacgaaugaagugcauacauggacggagcaauauaaguuucaagccgauucuccaaaacgcuuaagugcagccauaggaaaagcaugggaggaagguguguguggcauacggagugcgacaagauuggaaaauauaauguggaaacaaauaucuaacgaacuaaaucauauauugcuagaaaaugacaugaaguucaccgugguaguuggugauguagcaggaaucuuggcacaagguaagaaaaugauaagaccacaaccgauggaauauaaauacucauggaaaaguugggguaaagcuaaaauaauuggcgcugacguacaaaauacuacauucauuauagauggaccuaauacaccugaaugcccugaugaucaaagggccuggaacauuugggagguagaagacuaugguuucgguauuuuuaccacuaacauuuggcuaaaacuaagagauaguuauacacaagucugugaccauagauugaugagugccgcaauaaaggacucuaaggcaguucacgcggauauggguuauuggauagagagcgagaaaaaugaaacguggaaauuagcacgagcaucauuuauagagguaaaaacguguauauggccgaagucucauacacuauggucaaacgggguacuggaaucagaaaugauuauuccuaaaauauacgguggaccuaucucucaacauaauuaucgaccuggcuacuuuacacaaacugccgggccuuggcaucucggaaaacuugaacuugacuucgaucucugcgaggggacaacaguaguagucgaugaacauugcggaaaccgagguccuagucugcgcacaacaaccguuacuggaaagauaauacaugaaugguguugucgcaguugcacguuaccaccauuaagauuuaaaggcgaggaugguuguugguaugguauggaaauaagaccgguuaaagaaaaagaagaaaaucuaguuaaguccauggucucagccggaucaggagaaguagacaguuuuucucuaggucuguuguguauuucaauaaugauagaagaaguaaugcgaucucgcuggagccgcaaaaugcuaaugacuggcacgcuugcagucuucuuucuauuaaucauggggcaacuaacguggaaugaucucauuagguuaugcaucauggucggagcaaacgcuuccgaccggauggguaugggcacuacauacuuggcauuaaugguaaccuuuaaaaugagaccgauguucgcaguuggcuuauuauuuagacgauuaacaagucgugaaguacucuugcugaccaucgggcuaucacugguugcaucaguggaauugccaaacagcuuagaagaauugggggauggacuagcgaugggaaucaugauuuuaaagcuacucacugacuuucaaucgcaccagcucugggcaacuuugcugucauuaaccuucauaaagacuacguuuagcuuacauuaugcguggaaaaccauggcaaugguacuuagcauuguaucacucuuuccauuguguuuaaguacaacaagccagaaaaccaccuggcuuccuguguuauugggaucauuaggaugcaaaccacuaaccauguuuuugaucgcagagaauaaaauuuggggaagaaaaucuuggccucuuaaugaaggcauaauggccgucggaauagugucgauucuauuaaguaguuuauugaaaaaugaugugccccuagcaggaccgcuuauagcaggaggaaugcuaaucgcaugcuacguaauaucagguucaucagcugacuuaucccuugagaaggccgcggaagugucaugggaagaggaagcugaacauucaggagcaucucacaacauacuuguagagguacaagaugacgguacuaugaaaauaaaggacgaggaaagagacgauacuuugacgauacuucuuaaagcaacucuuuuagccgucucaggcguauauccacugucuauccccgcaacacuauuuguaugguacuuuuggcaaaagaagaaacaaagaucaggaguacuaugggacacccccaguccaccggagguagagagggcaguccuagaugacggcaucuacaggauuaugcagcggggguuacuagggcgaucacaaguuggaguaggaguauuccaagaaaacguauuccauaccauguggcacgugacacguggcgcaguucugauguaucagggaaaaagauuggagccuucaugggcuagcguaaagaaagaucuuauaaguuauggagggggcuggcgauuacaagggucauggaauacuggugaagaaguacaaguaauugcuguagaaccaggcaaaaaucccaaaaacgugcaaacagccccagguacauuuaaaacaagugaaggggaaguuggugcuauagcuuuggacuuuaaaccggguacaucuggaucacccauuguuaaucgggaaggaaaaauaguaggauuauacgguaauggcguaguaacuacgucaggaacauacguuagcgcgauagcacaggccaaggcuucucaagaagguccgcucccagaaauagaagacgaaguuuuccguaagcguaacuuaaccauaauggaucuccauccuggaagcggaaaaacccggcgauauuuaccagcaauuguacgggaagcaauuaaaagaaaguugcguacgcuaauauuagcuccgacgaggguuguggccagugagauggcagaggcuuugaagggcaugccgaucagauaucaaacaacagccguaaaaucugaacauacgggaaaggagauaguagacuuaaugugucaugcuacauuuacaaugagguuauuaucaccggugagaguaccuaauuauaauaugauuauuauggaugaagcacacuuuacagacccgucuaguauagccgcccgagguuacauaaguacacguguggguaugggagaggcugcagcgauauuuaugacugcuacaccaccuggguccguggaagccuuuccucaaagcaacgcgguaauccaagaugaggaacgggauauaccagaaagaagcuggaauagcggguaugaauggauaacggauuuuccagguaagaccguuugguuuguuccuaguauaaaaucaggaaacgauauagcaaacugccuuaggaaaaaugggaaaaggguaauucagcuuaguaggaaaacauuugauacagaauaccagaaaacgaagaauaaugacugggacuaugucgucacaacugauaucuccgagaugggggcgaauuucagagcagacagagugauugauccacggcgauguuugaaaccgguaauucucaaagauggucccgaaagaguaauacucgcagguccuaugccuguaacuguagcguccgcugcacagagacgcggacggauuggacgaaaccacaauaaagaaggugaucaauacauuuauaugggucaaccucuaaauaaugacgaagaccaugcacacuggacugaggcaaaaauguuacuagacaacauaaacacgccagaaggaauaaucccggcuuuauucgaaccugagagagagaaaagugcagcaauagauggcgaguacagauuaaggggagaggcaagaaagacauucguagaacuaaugaggcguggugaccuuccaguauggcuauccuauaagguugcuucugaaggguuucaauacagcgaccggagguggugcuuugacggugagcguaauaaccagguacucgaagaaaauauggauguagaaauauggacaaaagaaggugaaagaaagaaacuaagaccgaggugguuagacgcuagaacauacucagacccauuggcacuucgggaguuuaaagaauuugcagccggaaggagauccgucaguggagaccugauucuugaaaucggaaaauugccucaacaucuaacucaacgagcucaaaaugcgcuagauaacuugguaauguuacacaauucagagcaaggaggucgcgcuuauagacaugcuauggaagaacucccagauaccaucgaaacuuuaaugcuauuagcuuugaucgcaguucuaacaggaggugucacucuguucuuucugaguggaagaggauuaggcaaaacaucaauuggacuucuauguguaauggcauccucaguauuguuguggauggccuccgucgaaccacauuggauagcagcaucgaucauucuggaguucuuucuuaugguuuuacuaauaccugaaccugauagacagagaacaccacaggauaaccaacucgccuauguaguaaucggacuacuauucaugauauugacgguagcugcaaaugaaauggguuuacucgagacaacgaagaaagaucucgguauuggacauguugcggucgagaaucaccaccaugcagcaauguuagauguagacuuacacccagcaagugcuuggacccucuaugcugucgcgacuacuaucauaacuccaaugaugcgccauaccaucgaaaauacuacagcaaacauauccuuaaccgcaauugcuaaucaagcggcaaucuuaaugggccuagacaaagguuggccuauaucaaaaauggacauuggagucccacuuuuagccuuaggcuguuauagucaagugaauccucuuacuuuaacagcugcaguguugaugcuaguagcgcacuaugccauaauugguccgggacuccaagcuaaagccacuagagaagcacagaaaaggacagcagcaggaauaaugaaaaaccccacaguggaugguauagucgcuauagaucuggacccuguggucuaugauacaaaguucgagaaacaauuaggucaaauuauguuguuaauauuaugcacgucucaaauucuacuaaugaggacuacgugggcacuuugcgagucuaucacgcuggcgacuggacccuuaaccacguuaugggaggguucgccuggaaaauucuggaacacaacgauugccguaagcauggcaaauauauucagagguuccuauuuagcgggugcuggauuagcauuuucguuaaugaaaagucuagguggcgggagacggggaacuggagcgcaaggagaaacacuaggagaaaaauggaagcgucaguuaaaccaauugucuaagagugaauuuaauacauauaaacgaucaggcauaauggaaguagacaggagcgaagcuaaagaaggauuaaaaagaggagaaacuaccaaacacgcgguaucccguggaacugccaaacuucgaugguuuguagaaagaaacuuaguaaaaccugaaggaaaagucauugauuuaggaugcggaagagguggauggucuuacuauugcgccggauugaagaaaguaaccgaagugaaaggauauacaaaaggugguccagggcaugaagaaccuauuccaauggcaaccuauggguggaaccuaguaaaacuccauucugggaaagauguauucuuuauuccgccagagaaaugugauacacuacucugugauauaggugaguccucaccgaauccuacuaucgaagaggggaggacacuaagaguucucaaaaugguugaaccguggcugcgaggaaaucaauuuugcauaaagauacucaacccauacaugcccucugucguugaaacauuggaacaaaugcagcgaaagcacggaggaauguuaguuaggaacccauuaucaagaaacaguacucacgaaauguauuggguaucuugcggcacuggaaauauuguaagugccguuaauaugacguccagaaugcucuugaacagauucacgauggcacaccgcaagccgacauacgaaagagauguugaucuuggugcaggaacuaggcauguagccguagaaccagaaguugcuaaccuagauauaaucggucaacgaauugaaaacaucaaacaugagcacaagaguacauggcacuacgaugaagauaacccauauaagacuugggcguaucaugguucauacgaaguaaaaccuucggggagugcuaguucgauggugaaugguguggugaagcuauuaacaaaaccuugggauguuauaccaauggugacccaaauagcaaugacugauacuacacccuucggccaacaacggguauuuaaagaaaaagucgauacacgaacaccuaaggccaaaagaggaacugcucagauaauggaagugacugccaaauggcuauggggauucuugucucgaaauaagaaaccaaggauuuguacacgagaagaauuuacaagaaaaguacgauccaaugcagcuauaggugcaguauucgucgacgaaaaccaauggaacucagcgaaagaggcggucgaggaugaaagauuuugggacuuaguacauagggagcgcgagcugcacaaacagggaaagugugcuacuuguguuuauaacaugaugggcaaacgcgaaaagaaauuaggcgaauuuggaaaagcgaaagguagccgugccauuugguacauguggcuuggugccagguuucuugaguucgaggcacuuggauuuaugaaugaagaccauugguucaguagggaaaauucauugucaggugucgagggagagggacuucacaaauugggauauauuuugcgggacauuaguaaaauaccaggcggaaauauguacgcugaugauacagcagguugggauacacgaaucaccgaggacgauuuacaaaacgaagccaaaauaacugauauuauggaaccagaacaugcauuauuagcuaagagcauuuucaaacucacauaccaaaacaaaguagucagaguccaaagaccagcaaagaaugguacugugauggauguaaucaguagaagagaucaaagggggaguggucagguuggaacauacggucuuaauacuuucacgaacauggaagcucaauugauaaggcaaauggaauccgaaggaaucuuuucaccaagugaauuagaaacuccuaaucuugcggggagaguuuuagauugguuagagaagcaugggguggaaagauuaaaaaggauggcaauuucaggagaugauuguguagugaaaccaaucgaugauagauuugcaacugcauugacugcguuaaaugauaugggaaagguuaggaaggauauuccacagugggaaccgagcaagggauggaaugacuggcaacaaguuccauuuuguucucaccacuuccaccaauuaauuaugaaagauggucgagaaauaguuguacccugccgaaaucaggacgaguuaguaggcagagcuaggguaucacaaggagcaggauggucacucagagaaacagcauguuugggaaaaucguacgcucaaauguggcaacucauguacuuccacaggagagaccuaagacuagcggcaaaugcaauauguucugcaguaccaguggauuggguaccuacgagcagaacaacauggucaauacacgcacaucaucaguggaugaccaccgaagauauguuaagcguauggaauagagucuggauugaagaaaauccguggauggaagauaaaacccauauuucuagcuggggagacgucccauaccuaggcaaaagagaagaccaguggugcggcagccuaauaggccucacggccagagcuacgugggcaacgaacauacaaguggcaauaaaccaaguuagacgcuuaauugguaacgaaaauuaccuugauuacaugacgucaaugaagagguucaaaaaugagucggacccugagggggcauuaugguaa

SEQ ID NO: 21615 - RNA, 9879 nt, Artificial Sequence
  derived and/or modified CDS sequence (opt6) from DENV-1__JQ287661__SS-prME
agcguaacuaugcuacugauguuaaugccaacugcgcuggcauuccaucuuacuacgagggguggagaaccacacaugaucguuaccaaacaagaacggggcaaaucuuuacuauucaaaacaagugcggguguuaacaugugcacucuaauugccauggacuuaggagaauuaugugaggauacuaugacauacaaaugcccgaggauaacagaggcggagcccgacgauguugauugcuggugcaacgcgacugauacguggguuaccuauggcacuuguucgcaaaccggagaacaucgccgcgacaaaagaucggucgcuuuagcaccgcaugugggauuagguuuagagacaagaacagaaacguggaugagcucggaaggagcauggaaacaaauucaacgagucgaaacuugggcauuaaggcauccaggauuuacagucauagcucuguuuuuagcacacgcaauuggaacuagcauaacacaaaaaggcaucauauuuauuuuauuaaugcuuguuacaccaucaauggccaugcgauguguuggaaucgguagcagagauuucguugaaggccuaucaggagccaccuggguagacguuguauuggaacaugguaguugcguaacaacaauggcaaaagacaaaccaacgcuugauauagagcuacucaaaaccgaggucacuaauccugcuguucuacgaaaguuaugcauugaagcaaagauaucuaauacuacuaccgacucccgaugccccacacagggggaagcgacucuaauggaagaacaagaugcaaauuuuguaugucggaggacuuuuguugaccgugggugggguaacggaugcggauuguuugggaaaggguccuuaauuacuugcgcaaaauucaagugcguaaccaaacuugaaggaaaaauaguucaauacgaaaaccuaaaauacaguguaauagugacugugcauacaggagaucaacaucaaguaggcaaugaaucuacugaacacggcacuaccgcuacgauaacaccgcaagccccgacaucugaaauacaauugacugacuauggagcauuaacucuagauugcucuccuagaacgggguuagacuucaaugaaaugguuuuauugacaaugaaagaaaaaucauggcucguucauaagcaaugguuuuuggaccucccccuaccuuggacgucuggggcaucuacaagucaggagaccuggaauagacaagauuuauuaguuacuuuuaagacagcacacgcuaagaaacaagagguaguaguacuagguucucaagaaggcgcaaugcacaccgcauuaacaggcgccaccgagauucagacaaguggaaccacaacaauauuugcgggacaucuaaaauguagacuaaagauggacaaauugacgcucaaaggcaugucauaugucaugugcacagguucuuucaaacuagaaaaagaaguagcagaaacacaacacgguacgguauugguacaaaucaaauaugaaggcacagacgcgccaugcaaaauaccguucucuacucaagacgaaaaaggaguaacucaaaacggucgauugaucaccgcaaaucccauaguaacggauaaagaaaaaccaguaaacauugaagcagagccaccauucggcgaaucguauauuguaauaggagcgggcgaaaaagcccucaaauugucgugguuuaaaaagggcaguagcaucggaaagauguucgaagccacagcccggggugcaaggcgaauggccauacucggagauacagcuugggacuuuggaaguauaggcgguguauuuaccucaauugggaaguuaguccaccagauauuugggaccgccuauggugucuuauucuccggugugaguuggacuaugaagaucggaaucgggguuuuauuaacaugguuagggcugaacagccgaucaacuagcuugaguaugacaugcauagcaguaggcuuagugacguuauauuuaggggucaugguacaagcagacucuggaugcgucauaaacuggaaaggaagggagcuaaaguguggcagcggaauuuuuguaacuaaugaaguucacaccuggacugaacaguacaaauuccaggcagacucccccaaacgguuaucugcagcaauagguaaagcaugggaagagggcguaugcgguauucgaucagcaacgcgccuggaaaacguaauguggaaacaaauaucgaacgagcuuaaucauauucuguuagaaaaugacaugaaauucaccguagucguuggggacgucguagguauacuagcacaaggaaagaaaaugauucguccgcaaccuauggaacacaaguacucuuggaaaucaugggguaaagcaaagaucaucggagcagacguucaaaacacaacuuuuauaauugauggaccaaacacuccugaauguccagaugaucaaagggccuggaacaucugggagguagaggauuacggcuuugggauauucacgacaaacauaugguuaaagaugagagauucuuacacucaagucugcgaucaucgacuaaugagcgccgccaucaaagauucgaaagccguacacgcugacauggguuauuggauagaaucugagaaaaacgaaacguggaaacuggcgagggcguccuuuauagaagucaaaacauguauauggccaaaaucccauacuuuguggucuaauggaguacuagaaagcgaaaugauuauaccgaagauuuauggaggcccgauaucucaacauaacuaucgaccgggauacuuuacccaaacggcugguccguggcaccugggaaaauuagaguuggauuuugaucuaugugaagggacuacgguagugguagacgaacauugcgggaaccguggcccgaguuuacgcacgacaacggucacaggaaagaucauucaugagugguguugcagaaguuguacgcuuccaccacuccgguucaagggagaggaugguugcugguauggaauggaaauacggccaguaaaagaaaaagaagaaaaucuaguaaaaaguauggugucugcugguucaggagaaguagauucuuuuaguuugggauuacucuguauaucuauuaugauagaagaaguaaugaggaguagauggagcagaaaaaugcuuaugacaggaacacuagcaguauuuuuauuacuuauaauggggcaauuaacuuggaaugaucucauacgacuauguauaauggucggggccaaugcaagugacagaaugggaauggggacaacauauuuagcauuaauggcuacauucaagaugcguccuauguuugcagucggacuauuauuccgaagauuaaccucucgcgaaguauuacuccugacaaucggcuuaagccuaguggcuucugucgaacuaccuaauagucuagaagaguugggagacggacuagcaauggggauuaugaucuuaaaauuauuaacugauuuccaaucccaucaauuaugggcuacauuacucagccuuacauucauuaaaacgacacucagcuuacacuaugcauggaagacgauggccaugguauuaaguauuguaucucugauuccacuuuguuuaucaacaacaagucaaaagaccacuugguuaccaguuuugcuagguucacuagguuguaaaccauuaacuauguuccuuauugcggagaacaaaauauggggaagaaaauccuggccacuuaaugaaggaauuauggcugucgguguugucucuauccuauuaucaagucuucugaaaaaugacguaccgcuagcuggaccacuuauagccgguggcaugcuaauagccugcuacguaauuucaggaucgucagccgauuugucguuagaaaaagcugcggaaguguccugggaggaagaagcagaacacagcggugcaucucacaauauuuuaguugagguacaggaugacggcacuaugaaaauaaaagacgaggaacgcgaugauacacugacuauccuccuaaaagcaacauuguuggcggugagugggguuuauccccugucaauuccagcuacgcuuuuuguuugguauuuuuggcagaagaagaaacagcgaucuggaguucucugggauacaccaucuccucccgaaguagagcgugcaguauuggaugauggaauauauagaaucaugcaacggggacuuuugggcagaagccagguaggaguaggcguauuucaggaaaacguauuccauacuauguggcauguaacuaggggagcaguacugauguaccaagggaaaagauuagaaccuucgugggccagugugaagaaagauuuaauaucauacggcggggguuggcggcuucaaggaaguuggaauacuggagaagaaguucaaguaauugcuguagagccagguaagaauccgaaaaauguacaaaccgcaccggggacauuuaaaacaccagagggugagguuggggcaauugcauuagauuucaaaccagguacgucaggcaguccaauaguaaauagggaaggaaagauaguaggcuuguacgggaauggcguuguaacuacaaguggaacuuauguaagugcaauugcacaagcaaaagcuagucaggaaggaccgcugccugaaaucgaagacgaaguuuuucgcaaaagaaauuuaacaauuauggaucuccauccaggaagcggaaagacgagaagauaccuaccagcuauaguccgcgaagcuauuaaacgaaaauuaaggacacuuauuuuagcaccuaccagggugguagcaagugaaauggcagaggcuuuaaaagguaugccgaucagauaccaaacaacugcagucaaaagugagcacaccggaaaagaaauagucgaccuaaugugucaugcuacuuuuacaaugagguuacuuucacccgugagaguacccaauuauaauaugauuauuauggacgaagcacauuucacagauccaucaucaauugccgcgcgaggguauauaucaacccgcguuggaaugggagaagcugccgcaauuuuuaugacugcaacuccaccaggcagcguagaagccuucccacagucgaaugcaguuauacaagaugaggagagggauauaccggaaagguccuggaacucaggauaugaauggauaacagacuuuccagggaaaacggucugguuugucccuuccaucaaaagcggaaaugauauagcgaauugucuuaggaaaaauggaaaaagaguaauccaacuaucgcgcaagacauuugacaccgaguaucagaaaacuaagaauaacgauugggauuacguaguuacuacugacaucagcgaaaugggugcaaauuuccgagcugaucgagugauagacccaagaaggugccucaaaccagucaucuuaaaagauggcccggaaagaguuauucucgcgggaccaaugccggucacaguugcgagcgcggcacaacguagggggagaauaggcaggaaucauaauaaagaaggagaccaauacauauacauggggcaaccauugaacaacgaugaagaccaugcacauuggacugaagcuaaaaugcuacuugauaauauaaauacaccagaggggauaauuccagcucuuuuugagccggaaagggaaaaaucagccgcuauugacggugaguauaggcuccguggcgaagcgagaaagacuuuuguagaacuaaugaggagaggagacuuaccaguauggcucucuuauaaaguagccucugaaggauuucaguacucagauagaagaugguguuucgauggcgaaagaaauaaucaggucuuggaagaaaacauggauguagaaauuuggacgaaagagggugaacggaagaaauuaagaccuagauggcuggacgcaagaacuuauagugaucccuuggcauuaagagaguucaaagaguuugccgccgguagaagaucuguuagcggagacuugauccuagaaauagguaaauuaccccagcaucuaacccagcgugcccaaaacgcuuuagauaauuuaguuaugcuacauaacucagaacaaggaggucgagcuuauaggcacgcaauggaagaauuaccugacacaaucgaaacuuuaauguuacuugcucucauugcagugcuaaccggaggaguaacgcuauucuuuuuaagcggacguggacucgggaaaacgucaauugggcuguuaugcguuauggcaucuucagucuuacuguggauggcaagcguugaaccccacuggauagcggcaucgauaauccuggaauuuuuccuaaugguuuuauuaaucccagagccugaucgucagaggacaccucaagacaaucaauuagcuuauguagugauuggguuacuauuuaugaucuuaacggucgcugcaaacgaaauggguuuacuggaaacaacaaagaaagaccuaggcauaggacacguagccguagaaaaucaccaccacgcaaccaugcuagauguagaucuucauccggcaagugcauggacacuauaugcaguugcaaccacuaucauaaccccuaugaugcggcacacuauagaaaauacaacagcaaauaucucgcuuacugcaauagcaaaucaagcggcaauauugauggguuuggauaaaggauggccuauuagcaaaauggauauugguguaccauuguuagcacucggaugcuauucacaaguaaaccccuuaacucuaacugcagcaguacucauguuggucgcucauuacgccauaaucggaccuggacuacaagcgaaggcuacucgugaggcgcagaaaagaacagcugcagguaucaugaaaaacccgacugucgacggaauagucgcaaucgauuuagacccggugguauacgaugcaaaauuugaaaagcaauuaggccaaauuaugcuguuaauucuuugcacaagucaaauacugcuuaugcgaacuaccugggccuugugcgaguccauaacguuagcgacaggaccauuaacgacauuaugggaggguucccccggaaaauucuggaacacaacaauagcaguaucgauggcaaacaucuucagggguaguuaccuagccggugcaggucucgcguucucucuaaugaaaucccucggaggagggaggcggggaacaggcgcgcaaggagaaacacugggugaaaaauggaaacgccaacuaaaucaacuaaguaaaucugaauuuaauauuuacaagcgauccgguauuauggaaguggauagaucugaagcaaaggaaggguugaagagaggagaaaccacaagacacgcuguaagcagagggaccgccaaacucagaugguuugucgagcggaaucuuguuaaaccugagggcaaggugauagacuuaggauguggccgaggaggauggaguuauuauugugccgguuuaaagaaagugacagaaguaaagggcuauacuaaaggugguccaggacaugaggaaccaauaccgauggcgacuuauggauggaauuugguaaaacuacauaguggaaaagauguguucuucacaccaccugagaaaugugacacgcugcuaugcgauauaggagagagcucaccaaaucccacgauagaagagggacguacacugcguguccucaaaaugguagaaccauggcuaagaggaaaucaauuuuguauaaagaucuuaaauccuuauaugccuucuguuguagaaacccuagaacaaaugcaaagaaaacauggagguaugcuaguuagaaauccucugagucguaauuccacccaugaaauguacugggugucaugcggaacuggaaauauuguuucagcaguuaauaugacaaguagaauguuauuaaacagauucaccauggcacaucgaaaacccacauacgagaaagauguggaucuuggagcaggaacuagacacguagcuguagaacccgagguagcuaacuuggauauuauaggucaaagaaucgaaaacauuaaacaugaacacaaaucuacuuggcauuaugacgaagauaauccauacaaaacgugggcauaccacggaucauaugaaguaaagccaucaggaucagcaagcuccaugguuaacggcguaguaaaacuauuaacaaaaccaugggacguaaucccgaugguaacccaaauugcgaugacggacaccacgccauucgggcaacaacggguuuucaaagaaaaaguagacacgagaaccccaaaggcuaagagaggaaccguucaaaucauggagguaacugcuagauggcuguggggauuuuugucucgcaauaagaaaccacgaauuuguacacgggaggaguuuacaagaaaagugcgcaguaacgcagcgaucggugccguguuuguugacgaaaaccaauggaacucagcaaaggaagcuguugaggaugaacgguucugggaucuaguaaagaaggaacgcgaacuucacaagcaagggaaaugugcaacauguguauauaauaugauggggaaacgcgagaagaaguugggugaguucgguaaagccaaagggucgcgcgcaauaugguauauguggcuaggagcgagauucuuagaguucgaagcacugggauuuaugaaugaggaucacugguucagcagggaaaacucacuaucaggaguagaaggagaaggauuacauaaauuaggguacauucuaagagauauaucaaaaauaccggguggaaacauguaugccgacgauacugcagggugggauacacgaauaacugaggacgauuuacaaaaugaagccaaaauuacagauauuauggaaccugagcaugcccugcucgccacuucaauuuuuaaacugaccuaucagaauaaggucguaagaguucaacgccccgccaaaaauggaacgguaauggacguuaucucccguagagaccaacguggaucagggcaaguggggaccuacgggcugaauacauucacuaauauggaagcacaacuaauuagacaaauggaaagugagggaauuuuucuccccagcgaacuggaaacacccaauuuggcagaacggguucucgauuggcuagaaaaauaugggguugaaagauugaaaaggauggcuaucucuggagaugacugugugguaaagccaauugaugauagguuugcaaccgcuuugacggcacuaaacgacaugggcaaagucaggaaagacauaccucagugggaaccaucaaaaggauggaaugacuggcagcaaguaccauucugcagccaucauuuucaucaacugauaaugaaagauggcagagagaucguaguuccaugcaggaaucaagaugagcuaguugguagagcaagagugucccaaggggcaggauggucauuaagagaaacggccugucugggaaaaaguuacgcgcaaauguggcaauuaauguauuuucauagaagagaucuacgauuagcggcaaacgcaaucugcuccgcagugccgguugacuggguaccuacgucaagaacgaccuggaguauucaugcucaccaccaauggaugacaacugaagauauguugucaguuuggaauaggguauggauugaagagaacccuuggauggaagacaaaacucacguaaguaguuggggagaugugccuuauuuagguaagagagaagaccagugguguggaucacuuauuggcuugacggccagagcaacaugggcuucaaauauucagguagcuauaaaucaaguccggagauuaauagggaaugaaaauuaccuagauuacaugacaucaaugaaaagauuuaaaaacgagggggacccagaaggugcauuaugguaa

SEQ ID NO: 21616 - RNA, 9879 nt, Artificial Sequence
  derived and/or modified CDS sequence (opt6) from DENV-1__FJ882518__SS-prME
ucagugacgaugcuguuaaugcuuaugccuacagcacuggcauuucacuuaaccacacgcggaggggaaccgcauaugaucguuacaaaacaagaacgagguaaaagccuacuguuuaaaacuucagcgggagucaauauguguacccucauagcaauggacuugggggaauuaugugaagauacgaugaccuauaaauguccaagaauaacagaagcagaaccagacgauguagauugcugguguaaugcaaccgauacguggguaacuuacgguacuuguucacaaacuggagaacacagaagagauaaacgaucaguugcucucgcuccucauguuggacuuggauuagaaacgagaaccgagacuuggaugucgucagaaggugcguggaaacaaauucaaaggguugaaacuugggcauuaagacauccggguuucacuguuauugcgcuguucuuagcucaugcuauaggaacgucuauuacacaaaaaggaaucauauuuaucuuacuaauguuaguuacaccaaguauggccaugagaugugucgggauaggaucgcgggauuuuguagaaggccuuagcggggcuacuuggguagauguugucuuagaacaugggaguuguguaacaacaauggcaaaagacaaaccaacuuuagauauagagcuucugaaaacagaagucaccaauccagccguuuuaaggaaauuaugcaucgaagcaaaaaucucuaauacuacaacugauagucguugccccacucaaggagaagccacuuuaauggaagaacaagaugcaaacuuuguguguagaaggaccuuuguagauagaggguggggaaaugguugcggguuauuuggcaaaggcagcuugauuacuugcgccaaauuuaaauguguuacaaaacuugagggaaagaucguccaauaugaaaauuuaaaauacucaguuauaguaacuguucauacaggggaccaacaccaaguagguaaugaaaguacagaacacggaaccaccgcaacaauaaccccacaagcaccuacgucugaaauccagcuuacagauuauggcgcacugacucucgacuguucgccgagaaccggauuagacuuuaacgaaaugguacuccuaacuaugaaggagaaaucaugguuaguccacaaacaaugguuucuagaucuuccguuaccauggacaaguggugcaucaaccagucaggaaacauggaaccgacaagaccuuuuagucacguucaaaacagcacacgcuaagaaacaagaaguuguggucuuaggaagccaagagggcgcgaugcauacagcacuaaccggagcaacugagauacaaacauccggaaccacaacaauuuucgcgggccaccuaaaauguagauuaaagauggauaaauuaacacucaaaggcauguccuaugucauguguaccggcagcuucaaacuugaaaaagaaguugcggaaacccaacauggaacgguucucguacaaauuaaauacgaggguacagacgcuccuuguaaaauaccauuuuccacgcaagaugagaaagggguuacacaaaauggcagauuaaucacagcuaauccaaucguaacugauaaggaaaaaccaguuaauaucgaggcugaaccaccuuucggugagaguuauaucguaaucggugcaggagaaaaggcuuuaaaacuaucuugguucaagaaagguaguaguauugguaaaauguuugaagcgacugcacguggcgcucgucggauggcgauacucggcgauaccgcgugggauuuuggcaguguuggggguguuuuuacgagugugggaaaauuaguccaucagauauuugggacagcuuauggggugcuauuuucugguguaaguuggacgaugaaaauugguauaggugugcuccuuacgugguuaggguuaaauucuaggagcacaagccuaaguaugacaugcaucgcaguuggccuuguuacauuguauuuagguguaaugguacaagcggacuccgguuguguaauaaacuggaaggggagagaauuaaaauguggcaguggaauuuucguuaccaaugaaguccauacauggacagaacaauauaaauuccaagccgacucuccuaagagguuaagcgccgcgauaggcaaagcaugggaagaaggaguuugcggaauaagaucugccacacgauuagaaaauauaauguggaagcaaauuaguaaugaauuaaaccacauuuuacuugaaaaugacaugaaguuuacaguuguugucggugaugucguugggauacuagcccaggguaagaaaaugauucgaccucaaccgauggaacauaaauacucauggaaaucauggggcaaagcgaaaauuauuggggcagacguucaaaacacgacauucauaauugacggccccucaaccccggaaugcccugaugaucaaagagcauggaauauaugggaagucgaagauuauggauucggaauauucacaacaaacauuuggcuaaaauuacgcgauucauacacucaagugugcgaucauagacuuauguccgcggcaaucaaagauucuaaagcaguacacgccgauaugggguauuggauagagagugagaaaaaugaaacuuggaaauuagcaagagcuucuuuuauagaaguaaaaaccugcauauggccaaaaagccauacacuguggucaaauggaguuuuggaauccgaaaugauaauuccaaaaauauacggagguccuauuucacaacauaauuaucggccgggguauuuuacucaaacugcagggccuuggcaucuaggcaaacuggaauuggauuuugauuuaugcgaaggaacaacgguaguuguggaugaacacuguggcaauagaggcccgagccuacgcacaacgacuguaacggguaaaauuauccaugaaugguguugccgaagcuguacacuaccuccuuuacgauuuaaaggugaagacgguuguugguauggaauggaaaucaggccaguuaaggagaaagaagaaaauuugguuaaaaguaugguaagugcaggcucaggcgagguagacucguuuucucuaggacuccuuuguauuucaaucaugauagaggaaguuaugcguagucgauggucaaggaaaaugcuaaugaccgguacacuggcaguauuuuuacuucucauuaugggacaauugacauggaaugaccuaauuagauuguguauaaugguuggagcaaaugcaucugaccgcauggggaugggaaccaccuaucuugcauuaauggcgacuuucaaaaugagaccuauguuugcaguaggccugcucuuuaggcgacuuacuucucgcgaaguccugcuuuuaacaauaggccugaguuuagucgcuucaguagaacuacccaacucuuuggaagaauuaggagacggccuagcgaugggaauuaugauacucaaguugcuaacggauuuucaaagucaccaacugugggcaacacucuugagccuaacguucauaaaaacuacauuaagucuucauuacgcuuggaaaaccauggccaugguauugucuauugccagcuuguucccacucuguuuaaguacaaccucccagaaaaccacaugguuaccgguguugcuuggcucucuugggugcaaaccucuuacuauguuuuugauaacagagacuaaaaucugggggagaaaaucuuggccacugaacgagggaaucauggcaguagggguaguuucaauccuccugaguagcuugcuaaagaaugauguaccacuggcagggccgcuuauagcagggggcauguuaauagcguguuaugucauaaguggcaguucagcagaucuaucucuagaaaaggcugcagaagugucuugggaagaagaagcggaacauucuggugccagucacaacauucuaguugugguacaagaugacgguacuaugaaaaucaaagaugaagaacgagacgacacuuugaccauuuuguugaaggccacucuacuagcaguaucgggagucuaucccuuguccauuccagcuacacuguuuguaugguauuuuuggcaaaagaagaaacagagaagcggaguauuaugggacacaccgagcccgccggaaguagagcgggcaguauuggaugacggaauauaucgaauaaugcaacgagguuuacuagggaggucucagguuggcgugggaguauuucaagagaacguauuccacacaauguggcaugucacaagaggggcgguacuuauguaucagggaaaaagguuggaacccucuugggcuaguguaaagaaagaucuaauauccuauggcggcgguuggagauuacagggaucguggaauacaggugaagaaguucaaguaauagcaguagaacccgggaaaaaucccaaaaauguccaaaccgcuccuggaacauuuaaaacaccagaaggagaaguuggagcgaucgcgcuugacuuuaaaccaggaacuuccggaaguccuauuguuaaccgagaagguaagauagucggauuguauggcaacggaguagucacuacaucugguacauacguaagugccauagcacaagcuaaagcgucacaggaggguccacuaccagaaauagaagacgagguauuucgaaaacgaaaccuaacuauuauggaucuucauccuggcagcggaaaaacaagacgcuauuuacccgcgauaguucgggaggcaauaaaaagaaaguuacgcacucuaauccuagcaccgacuaggguugucgcuucggaaauggccgaggccuuaaaagggaugccaauacgcuaccaaaccacagcagugaaaagcgaacacacagguaaagagaucguugauuugaugugucacgcaaccuuuacaaugcgacuacuaagucccguacgugugccaaacuacaauaugauaauuauggaugaagcccauuucacagacccuucaagcauugcugcuagaggauacauuaguacacgaguagguaugggagaagcggcagcaauuuuuaugacggcaacaccgcccggaagcguugaagccuuuccacaaucaaacgcaguaauacaagacgaggagagagacauacccgaaagaucauggaauagugguuaugaguggaucaccgacuuuccaggaaaaacuguaugguuuguaccaagcauaaagaguggcaaugacaucgcaaacuguuuacguaaaaaugggaaacgaguaauacaauugagcaggaaaacguuugauacugaauaccagaaaaccaagaacaacgacugggauuaugucgucacaacagacauuucagaaaugggcgcgaacuuuagagccgauaggguaauugacccccguaggugccuuaaaccaguaauuuuaaaggaugggccagaaagaguuauccuagcugggccaaugccugucacuguagcgagugcugcacagcggagagguagaauaggaagaaaucacaauaaggaaggggaccaauacaucuauaugggucaaccucuuaauaaugaugaagaucaugcucacuggaccgaagcuaagauguugcuagauaacauaaacacaccagaagggauuauuccugcacuauucgagcccgaacgggagaaaagcgcagcaauugauggcgaguauagacuaagaggagaggccagaaaaacauucguugaacuuaugaggcguggcgaucuaccaguguggcuuagcuauaagguagccagcgagggauuucaguacucagaucgcagauggugcuucgacggagaaagaaauaaucagguauuagaggagaacauggacguggaaauuuggacuaaggaaggugagaggaagaaacuaaggccgagauggcuagaugcgagaaccuauagugauccccuagcuuugcgugaauuuaaggaauuugcugcagguaggagaucuguaaguggcgacuugauucucgaaauugguaaacuuccucaacaucuaacgcaaagagcacaaaaugcccuugauaaccuaguaaugcuccacaauagugagcaaggcggcagagcauauagacaugcuauggaggaacuaccugacacaauugaaacccugauguugcuagcuuuaauagccguacugacagguggcgucacucuuuucuuuuuaucuggcagaggacuagguaaaacaagcauaggauuacuaugugucauggcuagcaguguacuacuauggauggccucaguggaaccucacuggaucgccgcauccauuauuuuagaguucuuucuaauggucuuauugauaccagagccagacagacaacgaacaccgcaagacaaccaauuggcauacguagucaucggacuacucuuuaugauauuaaccguugccgcaaacgaaaugggacuucuggaaacaacuaagaaagauuugggcauugggcaugucgcugucgaaaaccaucaucacgcaacaauguuagacguggaucugcacccggcuucugcuuggacauuauaugccguggcuacaacaauuaucaccccuaugaugaggcacaccauugaaaauacuacagccaauaucagucucaccgccauugcuaaucaagcagcuauuuuaaugggacuugacaaaggauggccgaucaguaaaauggacauaggcgugccgcuucucgcuuugggauguuauagccaaguuaacccgcucacacugacagcagcaguauuaaugcuagucgcgcauuaugcgauuauaggaccuggacuacaagcuaaagcgacuagagaggcccagaaaaggacggcugcaggcauaaugaaaaauccaacaguagacgguaucguagccauugacuuagauccaguaguauacgacgccaaauuugaaaaacaacuugggcaaaucaugcuauuaauucuaugcacuagccagauauugcuuaugcguacuacuugggcccuaugcgaaaguauaacacuugcuacaggucccuuaacuacuuuaugggaaggaucuccugggaaauucuggaauaccacaauugcgguuuccauggcaaacauauuuagagguucauaucucgcaggcgcggguuuagcguucaguuuaaugaagaguuugggaggaggacgcaggggaacgggagcacaaggugaaacauuaggugaaaaauggaaaaggcaacuuaaccaacuaucuaagucagaauuuaauauauauaaacggucaggaauuauggaaguagaucggagugaagcgaaagaaggacuuaagcgcggggaaacaacgagacacgcaguaucuagaggaacagcaaaauuaaggugguucguagaaagaaauuuaguuaagccagaagguaaaguaauagacuugggauguggaagggguggguggucauauuauugugcgggacucaagaaaguaacagaagugaaaggauacacaaaaggaggaccaggacaugaggagcccaucccuauggcuacauacggguggaaucuuguaaaacuucauucaggaaaagauguauucuuuacaccgccagagaagugugauacucuucuaugcgacauuggagaaucauccccaaaccccacuaucgaagagggaagaaccuugagaguucugaaaaugguagaaccguggcuaagaggaaaucaguucugcauaaaaauccuaaacccguauaugccaagcguugucgaaacacuugagcaaaugcaaagaaagcacgggggcauguuaguacgaaaucccuugucacgcaauuccacacacgaaauguauuggguuucgugcggaacaggcaauauaguaagcgcuguaaacaugacaucucgaaugcuacuaaaucgauuuaccauggcucauagaaaaccuaccuaugaacgugauguugaccuaggggcuggaacaagacauguagccguggagccagaaguggcuaaccucgauauaaucggucaaagaauagaaaacauuaagcaugagcauaaguccacauggcauuaugaugaagacaacccauauaagacaugggcauaccaugggagcuaugaagucaaaccaaguggaucugcaaguucuauggugaaugguguuguuaaacugcuaacgaagccgugggacgucaucccaauggucacgcaaauagccaugaccgauacaacaccauucggccagcaaagaguuuuuaaagaaaaaguggauacaagaacuccaaaggcaaaaaggggcaccgcacaaauaauggaaguaacagcucguugguuauggggcuuuuuaucacgcaacaagaagccacgcauuuguacccgggaagaauuuacaaggaaaguuagaucaaaugcggcuauaggggccgucuucguugaugaaaaucaauggaacucagccaaagaagcgguagaagacgaaagguuuugggauuugguucagaaggaaagagaguugcauaaacaaggaaaaugcgcaacaugcguuuauaacaugauggguaaacgggagaagaaauuaggugaauuuggaaaagcuaaagggaguagagcaaucugguauaugugguuaggugcacgcuuucucgaauuugaagcauuaggauuuaugaacgaggaccauugguucucaagggaaaauucucuaagcggugucgaaggagagggguuacacaaacuagguuacauucuacgagauauaaguaagauaccagggggcaauauguaugcagaugauacagcaggaugggauacacgaauaacggaggaugacuuacaaaaugaagcuaaaaucaccgacaucauggaaccagaacaugcucugcuggcaaccucaaucuucaaacuaacuuaccaaaacaaaguaguacgaguacagcguccagccaagaauggcacuguaauggacgugaucagcagacgagaccaaagaggaucaggacaagucggaaccuauggcuugaauacauuuacaaacauggaggcacaauuaauaagacaaauggaaucugaaggcauauuuuuaccaagugaguuagaaacuccgaauuuagcggaacgggucuuagauugguuggaaaaauacggaguagagcgauugaaacguauggccauuucaggcgacgacuguguaguaaaaccuauugaugaucguuucgcaacugcuuuaacggcauugaaugacaugggaaagguuagaaaagacauuccacagugggaaccaucaaaaggguggaaugauuggcaacaaguaccuuuuuguucacaccauuuccaccagcuuauuaugaaagauggaagagaaauugucguaccuugucgaaaccaggaugaauuaguaggcagagcaagaguaucucaaggagcugguuggucccuaagagaaaccgccugucuugguaaaucuuaugcacagauguggcagcuaauguauuuucaccgccgggaccugcgcuuggcagcgaaugcaaucuguucugcgguccccguagauuggguccccaccucacgaaccacauggaguauccacgcacaucaucaguggaugacaacagaggacauguuaucagucuggaauaggguuuggauugaagaaaauccuuggauggaggauaaaacacauguauccuccuggggcgauguuccauaccuugguaagagagaagaccaaugguguggaucucugaucgguuugacagcuagagcuacgugggcgucuaauauacaggucgcaauaaaucaaguuaggaggcucauaggcaaugaaaacuacuuggacuacaugacaucaaugaaaagguucaaaaacgagggagauccagaaggugcucucugguaa

SEQ ID NO: 21617 - RNA, 9879 nt, Artificial Sequence
  derived and/or modified CDS sequence (opt6) from DENV-1__FJ882519__SS-prME
agcguuacaaugcuucuuauguuaaugccgacagcacucgcauuucaucugacaacaagagguggugaaccucacaugauugugaguaaacaagaaagagguaaaucacuucuuuuuaaaacgucugccgguguaaacaugugcacauuaauagcgauggauuugggugaauuuugugaagacacuaugacuuacaaauguccuagaauuacagaagcagaaccagacgacgucgacuguuggugcaaugcgacugauaccuggguaacauauggaacuuguucccaaacaggcgaacaccguagagacaaaagauccguagcacucgcuccacauguagguuuaggcuuagaaaccaggacggaaacuuggaugaguagugagggagccuggaaacaaauucaacgaguagaaacuugggcauuacgacauccaggguuuacuguuauugcauuauuucuggcacacgcuauuggaacguccauaacgcaaaaaggcauuauauuuauacuacucauguuagugacccccucaauggcaaugagauguguaggcauagguucgagagauuucguggaaggacuuucuggagcaaccuggguagauguaguacuagagcauggaucgugcguaacaacuauggcuaaagauaaaccgacauuggauauagaauuacuaaaaacggagguaaccaauccugcaguuuuacgaaaacuaugcaucgaagcgaaaauauccaauacaacgacggauagccguugcccuacacaaggugaagcaacauugguugaagaacaagacgcaaacuuugucugucgcaggacauuuguugaccgagguuggggaaacggaugcggucuauucggaaaaggaucccuaauuacaugcgcaaaauuuaaauguguaacuaaauuggagggaaaaauaguacaguacgagaauuuaaaauacagcguaaucguaacaguacacacuggugaccaacaucaaguagggaaugagucaacugaacacgggacaacagcaacaauuacaccacaagccccgaguacagaaauccaacuaacagauuauggagcacuuacacuggacugcucaccacggacgggacuggauuuuaacgagaugguguuauugacaaugaaagagaaaaguugguuagugcacaaacaaugguucuuagacuugcccuuaccauggacaucaggagcgucaacaucucaggaaacuuggaaucgcaaagacuugcuaguaacauuuaaaacugcucaugccaagaaacaggaaguaguuguauuagguucccaggagggggcuaugcacaccgcacuaacaggcgcuacagagauacaaacaucgggaacaacuaccauauucgccggucaccuuaaaugccgcuuaaaaauggauaaauuaacccuaaaagguaugaguuauguuaugugcacaggaucuuuuaaauuggaaaaagaaguggcagagacccagcaugggacaguucuaguucaaauuaaguacgaaggaacagacgcuccaugcaagauacccuuuucgacacaggacgaaaaggguguuacgcaaaacgggcgacuaauaacugcuaacccgauugugacugacaaggaaaaaccuguaaauauugaggcagaacccccuuucggggaaucauauauugucauuggagcgggagaaaaggcuuuaaaacucagcugguuuaagaaggguucuucuauugguaagauguucgaagcuacggcuagaggcgcuagacguauggcuauauugggagacaccgcgugggacuucggaucuauaggugggguguucacaagcgucggaaaauuaguacaccaaauauuuggaacagcauauggcguucuauuuucagguguuucguggacaaugaaaauagguauuggagugcuuuuaaccugguugggacucaacagccguagcacuucacuuucaaugacuuguauagcaguaggucuuguuacacucuauuuaggcguaauggugcaggcugauucggguugugucauuaauuggaaaggaagagaauuaaaaugcgggaguggaauauucgugacuaaugaagugcauacguggacggaacaguacaaauuucaagcugauucaccaaagcgauuaucagcagcaauaggaaaagcaugggaggaaggaguuugcgggauaagaagugcaacaagacucgagaauaucauguggaaacagauaaguaacgaacucaaccacauacuucucgaaaaugacaugaaauuuacagucguaguuggggacgucgcugggauacucgcccaagggaagaaaaugauaagaccccagcccauggaauauaaauauagcuggaagucgugggggaaagcaaagauuauuggugcugacguacagaacacuacauuuauaauagacggaccgaauacaccagaaugcccugacgaccaaagggcauggaauauaugggaagucgaagauuacgguuuugguauuuuuacaaccaauauuuggcugaaguuacgggacaguuauacccaaguaugugaucacaggcuuauguccgcugccauaaaagauagcaaagcuguucacgcagauaugggauacuggaucgaaucugaaaagaacgaaaccuggaaauuagcacgagcuucguucaucgaggucaagacuuguauuuggccaaaaagucauacucuauggucuaauggcguccuugaaagcgaaaugauaauacccaaaauuuacggaggaccgauuucccagcauaacuauaggccuggcuauuucacgcagacugcagguccuuggcacuuagggaagcucgaauuggacuucgauuuaugugaggggacuacaguaguugucgacgagcacugcggaaaucgaggcccaucgcuaagaacuacuacggucacggguaagauaauccaugaauggugcugcagaucguguacacucccaccucuaagguucaaaggugaagauggauguugguacgguauggagauaagacccguaaaagagaaggaggaaaauuuaguaaaaucuauggugagugcggguagcggagaaguugacagcuuuucucuaggauuauuaugcauaucgauaaugauagaagaagugaugagaucaagguggucucggaaaauguugaugaccggcacauuggcggucuuuuuccuauugauaaugggucagcucacuuggaaugauuuaauucguuuauguauaauggucggagcaaaugcuagcgaucguauggggauggguaccacuuacuuagccuugauggccacauuuaaaaugagaccuauguuugcagucggcuugcuauucagaagguuaacgagcagagaagugcugcuucugacgauuggacuuucccucguugcaaguguagaauugccaaacucgcuagaagaacuaggagacggguuagcaauggggaucaugauauugaaacuuuuaacggauuuucaaagucaccaacuaugggcuaccuuauuaaguuuaacauucauuaaaacgacauuuucucuacacuaugcuuggaaaaccauggcaauggucuuaucuauugucagcuuguucccgcugugccuaucaacaacaucucagaaaaccacguggcugccuguauuacuagggagcuuaggguguaaaccacuaacuauguuccucaucgcugaaaauaagauuuggggaagaaagucuuggccacugaacgaaggcauaauggcugugggaauuguuucuauacuguuaucgucuuuauugaaaaaugacguaccguuagcuggaccguuaaucgcuggugguaugcugauagcauguuauguaaucucaggaucuagcgcagaucuaucauuggaaaaagcugcagaagucucuugggaagaagaagcagagcacaguggagcgagucacaauauauuaguugagguacaggacgacggcacaaugaaaauaaaagaugaagagagagaugauacuuugacuaucuuacugaaggcaacacuuuuggccguuucugguguguauccauuaaguauaccugcaacacuauuuguaugguacuuuuggcagaagaagaaacaacgauccggaguucuaugggauaccccgagcccaccagaagucgaacgcgccgucuuagaugacgguauuuaccggaucaugcaaagaggacuucuaggaagaucgcaaguggggguuggaguauuucaggaaaauguauuccauaccauguggcaugugacaagaggagcaguauuaauguaucagggaaaacgccuugaaccgucaugggcaagcgugaagaaagaccucaucucuuaugggggaggguggagguuacaagguaguuggaauacgggcgaggaaguacaaguuauagcagucgaaccagguaaaaaucccaaaaauguccaaaccgcaccagggacuuuuaaaaccucugaaggugagguuggugcaauagcacuugauuucaagccggggacaucaggaagcccgauuguaaacagagaaggcaaaauugucggcuuguacgguaauggaguugucacaacgucgggaacuuacguaucagcuauugcacaagcuaaggcaucacaggaaggcccucuacccgaaauagaggaugaagucuuccguaaacggaaccuuacaauuauggaccuacauccagguucugguaaaacaaggcguuauuuaccggcaauagucagagaagcaauaaaaaggaaacuuaggacauuaaucuuagcacccacacgaguaguagcaucagaaauggccgaggcacucaaaggaaugccaauuagauaucaaacaacagcagugaaaagugagcauaccgguaaagaaauaguagauuuaaugugccacgcuacuuucacaaugaggcuuuugucacccgucagggugccaaauuauaacaugauuauaauggacgaagcccauuuuacagacccaucaaguauagcagcacgcggcuauauaaguacaagagucggaaugggcgaagcugcggccauauuuaugacugcgacuccaccggguaguguagaggccuuuccucaguccaaugcuguaauacaggaugaggaacgugauauuccugagagaucauggaauagcggauaugaauggauuacagauuuuccuggaaagacagugugguucguuccgaguaucaaaucaggcaacgauauagcuaauugucuuaggaaaaacggcaaacgugugauucagcuaaguagaaaaaccuuugacacagaauaccaaaagaccaaaaauaaugauugggauuacguaguaaccacugacauaagugagaugggugcgaacuuuagggcagauagaguuauagauccucgacggugcuugaaaccuguaauauuaaaagauggaccugagcguguaauauuagcggggccgaugcccguaacaguugccucggcagcacaacgacgagggaggauuggcaggaaccauaacaaggaaggggaucaguacauuuauaugggccagccauuaaauaaugaugaagaucaugcccacuggaccgaggccaaaauguugcuagacaauauaaacacgcccgaagggauuauaccagcauuauuugaaccugagcgugaaaaauccgcagcgauugacggagaauauagacucaggggagaagccagaaaaacauucguagaacucaugcgacggggagacuuaccggugugguuaucauauaaaguagcaucagagggguuccaauacucagaucgacgcuggugcuuugauggugaacgaaauaaucagguauuggaggagaauauggauguagagaucuggacuaaagagggugagaggaagaaauuaagaccacgcugguuagacgcccgaacuuauucugacccuuuggccuuacgagaauuuaaggaauuugccgcgggaagaaggagcguauccggcgaccuaaucuuagaaauaggaaaacugccccaacacuuaacacaacgagcacaaaaugcauuagauaaucuaguaauguugcauaacucggaacaaggugguagagccuaccgacaugcaauggaagaauuaccagauacaauagaaacauuaauguuguuagcacuaauagcggugcucacuggcgguguuacacucuucuuucuuucaggaagaggcuugggaaagacuucuauaggccuguuaugcguuauggcaaguaguguucugcuauggauggcaaguguagaaccacacuggauagccgcaaguauuauacuagaauuuuuccucaugguauuauuaauaccugaaccugauaggcaacgaacaccacaagauaaccaauuggccuaugugguaauaggguuacuauuuaugauuuuaacaguagcugcaaaugagauggguuugcuagaaacgacgaagaaagaccugggaauaggacacguggccguagagaaccaucaccaugcugccaugcuggaugucgaccuacacccggcauccgcuuggacacucuacgcggucgcuacgacaauaauuacacccaugaugaggcauacuauagagaauacaacagccaauauaucccugaccgcaauugcgaaucaagcagcuauucuaaugggauuagacaagggguggccuauuaguaaaauggauauaggaguuccguuauuagcacuaggauguuacagccaagucaauccauuaacuuuaacugcggcggugcucauguugguggcacauuacgcuauaaucggaccagguuugcaggcgaaggcaacacgugaggcucagaaaaggacggccgccggaauaaugaaaaacccuacuguagacgggauuguagcuauagaucuugauccaguaguauacgaugcaaaguucgaaaaacaauuaggacaaauuauguuauuaauacucugcaccagucaaauacuccuuaugcgcacaacaugggcucuaugugaaagcauuacucucgcuacugggccauugaccacucuaugggaagggucaccgggcaaauuuuggaauacaaccauagccguaucaauggcuaauauuuucagaggcagcuaucuugccggugcagguuuagcuuuuucucucaugaaaucacucggcggagggagaagaggcacuggggcccaaggagagacacugggagaaaaauggaaacggcaacuuaaucaauuaaguaaaucugaguucaacacauauaaacgcagugguaucauggagguggauagaucggaagcuaaagaagguuuaaaaaggggugaaacaacuaaacaugcuguaucaagaggaacagccaaauuaagaugguucgucgaaaggaaucuaguaaagccagaagggaaggucauugaucugggcugcgguagaggcggauggaguuauuauugugccggccuuaagaaaguuacugaggugaaagguuauaccaaaggaggcccaggucaugaagaaccaauacccauggcaacguacggauggaauuuagugaaacuucauucugguaaagauguuuucuuuaucccaccugaaaaaugcgacacgcuacucugugauauuggugaauccaguccaaauccaacaauagaagaaggucgaacgcugcgagugcucaaaaugguugaaccauggcuacgagguaaucaauuuugcaucaaaauacuuaacccuuauaugccaagugugguagagacacuggaacaaaugcaaagacgucaugggggcaugcugguaagaaacccacuaagucggaacagcacucaugaaauguauuggguaucaugugguacugguaacauaguaagcgcgguuaacaugacuucuaggaugcuccugaauagauucacaauggcacaccgcaaaccaacuuaugagcgugauguggauuuaggagcaggcacucgacacgucgcuguagaaccugagguagccaaucuagacauuauuggucagagaauagaaaauauaaaacacgagcauaagucuacuuggcacuacgacgaagauaauccuuauaaaaccugggcauaucacgguucauacgaaguuaaaccgucagggucggcuaguuccaugguaaauggaguagugaagcuacuuacgaaaccgugggacguaaucccaauggucacgcaaauugccaugacugauacuaccccauuuggucaacaaagaguauuuaaagaaaaaguggauacuaggacaccuaaggccaaacgaggaacugcacagauaauggagguaacggcuaaauggcuauggggauuccuaagcaggaauaagaaaccacgaauauguacaagagaagaguuuacaagaaaggugagaucgaaugcggcaauuggugcaguguuuguugaugagaaccaauggaacucugcuaaagaggcgguggaggacgaaagauuuugggauuugguccaccgagaacgagaauuacauaagcaaggaaaaugcgcgacuugugucuauaauaugauggguaaaagggagaagaaauuaggagaguuuggaaaagcuaaagggucgagagcgaucugguauaugugguuaggggcaagguuccuagaauuugaagcgcucggauucaugaacgaagaucacugguucucacgugaaaacagcuuaucagguguagaaggagaagggcuacauaaauuaggauacauacuuagagauauaaguaagauuccagggggcaauauguaugcagaugauacagcaggcugggauacaagaauaacggaagaugauuuacaaaaugaagcaaaaauuacagauauuauggaaccugaacaugcauugcuagccaaaagcauauucaaguuaacuuaccagaauaaaguaguucguguacaaagacccgcuaaaaauggaacugugauggacguaaucucaagaagagaucaaagagguucaggccaaguagguaccuacggauuaaauacauuuacgaacauggaagcgcaacuaauuagacagauggagagugaaggaauauuuaguccaucugaacucgaaacaccgaacuuggcgggcaggguucucgauuggcuagagaaacauggcguggaacgccuuaaaagaauggcaauaaguggagacgacuguguaguaaaaccuauagacgauagauucgcgacugccuuaaccgcuuuaaacgacaugggaaaaguaagaaaagacauaccacaaugggaacccaguaaaggauggaacgauuggcaacagguaccguuuuguucgcaucauuuccaucaacuaauaaugaaggauggucgcgaaauaguggugccgugcagaaaccaggaugaauuaguaggaagggcacgaguuagucaaggggccggauggagucuccgagaaacagcaugccuugggaaaaguuacgcacaaauguggcaacuuauguacuuucacagacgagaccuuagauuagccgcuaacgcaaucugcagugcagucccaguagauuggguaccaacuucuagaacgacuuggaguauacaugcacaccaccaauggaugacuacagaagacauguugagcguauggaaucgaguguggauagaagagaauccuuggauggaagauaagacgcauauaucuaguuggggugauguaccguauuuaggcaaaagagaggaccagugguguggcucucuuauuggucuaacagcccgugccacaugggcaacgaauauacaaguagcaauaaaucaaguucgaagauuaaucggaaacgaaaauuaccuugauuauaugacgucgaugaaaagauucaaaaaugaaucggaccccgaaggggcucuuugguga

SEQ ID NO: 21618 - RNA, 9879 nt, Artificial Sequence
  derived and/or modified CDS sequence (opt6) from DENV-1__FJ882520__SS-prME
agcguuacaaugcuacuaaugcuaaugccaacagccuuggccuuccaucucacuacacgaggaggggaaccccauaugauaguaucaaaacaagaacgagggaaaucacuuuuauucaagacaagugcggggguuaauaugugcacacuaauagcaauggaccuaggagaauuaugcgaagauacgaugacauauaaaugucccaggauuacugaagucgaaccggacgauguggauuguugguguaacaccacugauaccugggucacuuaugguacgugcagucaaaccggagaacauaggcgagacaagagaucgguugcauuggccccacacguaggucuuggguuagaaacgagagcugaaaccuggaugaguucggaaggagccuggaaacaaauacaaaaaguggaaacaugggccuuaagacauccaggguuuacgguuauugcucuguuuuuggcgcaugcaauagggacaucuauaacccaaaaagggaucauauucauacuucuuaugcugguuaccccaucaauggccaugcgguguguagggauagguaguagagauuuuguggaggguuuauccggagcaacguggguagauguaguuuuggaacacggaucuuguguaacaacaauggcaaaggacaaaccaacacuggauauagagcuacuuaagaccgagguuaccaauccagcuguacuaagaaaauuauguauugaagcaaaaauaaguaacacgacaacagauucaagaugccccacgcaaggugaggcgacucuuguagaggaacaagaugcaaauuuugucugcaggagaacauuuguugacagaggcuggggaaacgguuguggguuauucggaaaagggucacuaauaacaugcgcgaaauucaaaugcguuacgaaauuagaaggaaaaauaguacaguacgaaaaccugaaauacagcgugauuguaacaguucacacuggugaucaacaucaaguugguaacgaaaguacggaacacggcacaacugcgacgaucacuccacaggcaccaacaagcgaaauacagcuaacugauuauggggcacuaacauuagauuguuccccaagaacaggacucgauuuuaacgagaugguuuugcucacaaugaaggagaaaucauggcuaguacacaaacagugguuuuuggaucuaccacuaccauggacauccggggccucaaccucgcaagaaaccuggaaccgucaagaucuccuaguaacuuucaaaacagcacacgcuaagaaacaggaaguuguaguucuaggaucacaagaaggagccaugcacacugcauuaacuggagcuacagagauucaaacaaguggaacuacgacaauauucgcuggacaucucaaaugccgucuuaagauggauaaacugacacuaaaaggaauguccuaugucauguguacagguucauuuaaacuagaaaaagaggucgcagaaacacaacauggcacugugcuuguccagauuaaguacgaaggaaccgaugcucccuguaagauuccauucagcacgcaagacgagaagggaguaacacaaaaugggcgccuuaucaccgcuaauccgauuguuacugauaaagaaaaaccaguaaacauugaagcugaaccaccauuuggagaaagcuauauaguuaucggugcuggagagaaagcgcuaaaguugucaugguucaagaaaggaucaucuauaggaaaaauguuugaggcaacggcaagaggagcaaggagaauggcgauuuugggcgauacugcaugggacuuugggagcaucggugguguauuuaccucgguaggaaaauuaguccaucagaucuuuggaacagcuuauggaguuuuguuuaguggggucucauggaccaugaagauagggauaggaguacuccugacaugguuaggucuaaauucaagaaguaccucgcuuuccaugaccuguauugccgugggacuuguaacauuauaucuaggcguaaugguccaggcugacagcgguuguguaauaaacuggaaggguagagaacucaaaugcggaucuggaauuuucguaacuaacgagguacacacguggacugaacaguauaaauuucaagccgauucaccuaaaaggcucucagcugcgauaggaaaggcgugggaagaggguguaugugguauuagaagcgccacgagacuagagaauauuauguggagacagauaaguaacgaguuaaaucauauauuauuagaaaaugacaugaaauuuacagucgucguaggagaugugguagguauccuugcacaagguaagaagaugauucggccacaaccuauggagcauaaauacaguuggaaaucaugggguaaagcgaaaauuauaggggcagauguacaaaacacaacuuuuauuauugacgggccgaauaccccugaaugcccagacgaucagcgugcuuggaauaucugggagguagaggauuacggauuuggaaucuuuacuacaaacauauggcuaaaacuuagagacagcuacacucaggugugugaccaucgguuaaugucggcugcuauaaaggacagcaaagcaguacaugcggauaugggauauuggauagaaagugagaaaaacgaaaccuggaaacuggcacgagccagcuucauagaagugaaaaccuguauauggccaaaaucccauacacuuuggucaaauggagucuuagaauccgaaaugaucauaccuaaaauauacggcggaccgaucagucagcacaacuauagacccggcuauuucacacaaacggcuggaccauggcauuuaggaaaguuagaacuagauuuugaccuuugugaaggaacuaccguuguuguugacgaacacugcgggaaucgaggcccuucgcuucgaaccacgaccgugacgggaaaaauaauacaugaaugguguugucggaguuguacauuaccuccacuaagauuuaaaggagaagacgggugcugguacggaauggaaauuagaccgguaaaagaaaaagaagagaauuugguaaaauccauggugucagcaggaaguggggaagucgacagcuucucuuuaggauugcuuuguauaucaauaaugauagaagagguuaugcgaaguagauggucgaggaagaugcuaaugacuggaacucucgccguauucuuucuccugauaaugggacagcucacuuggaacgaccugauucgaucgugcauaauggucggggcgaaugccagugaucgaaugggcauggggacgacguaccuagcuuuaauggcuacuuucaaaaugcguccaauguucgcaguaggguuacucuuuaggcgauuaaccucccgcgagguauuauuauugacaauaggucuaucgcuggucgccaguguugaauuaccuaacagucuugaagaguuaggugacggacuggcgauggguauaaugauacuaaaauuacuaacugauuuccagagcuaucaauuaugggcuacccuguuaucgcugacuuuuauuaaaaccacauucagucuacacuacgcguggaaaacuauggcgaugguauuaucaaucguaucuuuacugcccuuaugucuuagcaccaccagucagaaaacuacaugguuaccaguauuacuuggauccuuaggguguaaaccacucacaauguuucugauugcugaaaacaaaauuugggguaggaagucuuggcccuugaaugaaggaauaauggcaguagggauaguaucaauauuauuaagcucucuucuuaagaaugaugugccacuugcaggcccucuuauagcaggaggaauguuaauagcuuguuauguaauuuccgggucuucagcugaucuuagucuagaaaaagcggccgaagucaguugggaagaagaggccgaacauucgggagcaagccacaauaucuuaguagaaguacaagaugacggaacuaugaaaauuaaagacgaagaacgcgacgauacgcuuacgauauuguugaaggcgacacuacuagcgguaucugggguuuauccucuaaguauaccugcuacgcuguucguaugguauuuuuggcaaaagaagaaacagcgaagcggaguucucugggauacaccaagucccccagaaguagaaagagccguccuugaugacggcauauaucgaauaaugcaaagaggauuguugggaagaucacaaguagguguaggaguauuccaagagaacguauuucauacuauguggcacgugacaagaggugccgugcuaauguaccaagguaaaagauuagagccaaguugggccagcgugaagaaagauuuaauuucauaugguggugguuggcgucuacaagggucauggaauacaggagaagaggugcagguuauugcaguagaaccaggcaaaaauccuaaaaacgugcaaacggcuccuggaacuuuuaaaacaccugaaggggaaguaggugcaauugcgcuugauuuuaaaccaggaaccucaggcagucccaucgucaacagggagggaaagaucguggguuuguaugguaaugggguggucacaacuucugguaccuacguaagugcuauugcgcaggcaaaagcgagucaagagggucccuuaccagagauugaagaugaggucuuuaggaaaagaaacuugacaauaauggacuuacacccaggaaguggaaaaacacguagauacuuaccugcgauuguucgugaagcuauaaagcggaaauuacguaccuuaauacuugcaccaacgagaguugucgccucugaaauggcagaagcacucaaaggaaugccgauucgauaucaaacuaccgcuguaaaaucugaacacacaggccgcgaaauaguagaccugaugugccacgccaccuuuaccaugaggcuuuugucgcccguuagaguaccuaauuauaacaugauuauaauggaugaagcacacuuuacggauccauccaguauagcagcuagaggauacauuuccacgagaguugguaugggggaggcagcagcuauuuuuaugaccgccacaccaccggggaguguggaagcguuuccacaaaguaaugcagugauucaagacgaggaaagggacauaccggaacgauccuggaacuccggguaugaguggauaacugauuucccuggcaagaccguuugguuuguaccaaguauaaaaagcgguaaugacauagcuaacugucuacgaaagaacggcaaaagaguuauacaacugucaagaaaaacauucgauaccgaguaucagaagacgaaaaauaacgacugggauuaugucgucaccacagacauaucggaaaugggugcuaauuuccgggcugaccgagucauagacccccgucgaugccucaagccaguaauucuuaaagauggacccgaaaggguaauacuagcagggccuaugccagugacuguugccucggcugcccaacgaaggggcagaaucggcagaaaccauaauaaagaaggcgaccaauauauuuauaugggacaaccacugaacaacgacgaagaccaugcacauuggacugaagcaaaaaugcuccuggauaauauuaauacacccgaagguaucaucccagcguuauuugaacccgagagagaaaaaucggcagccaucgacggagaauacaggcugcguggggaagcacgaaaaacauucguugaacuaaugagaaggggagauuugcccgucugguuaaguuacaagguagcaagugagggguuucaguauucugacagaaggugguguuucgauggcgaaaggaauaaccagguacuugaggagaauauggauguagagaucuggaccaaagaaggagaacgaaagaaacuacgcccaagguggcuagaugcucguacauauucggauccccuggcacuacgggaauuuaaagaauuugcagccgguagacgaucagugucaggugacuuaauccuagaaauugggaaacuuccacaacacuugacucagagagcucaaaacgcauuagacaaccugguuauguugcauaacagugaacaaggaggacgcgcguaucgacacgcaauggaagaacucccagauacuaucgagacuuuaaugcuauuggcacuaauagcaguuuuaacaggagggguuacucuauucuuucugucugguaggggcuuaggaaaaacaagcauagggcuccugugcguaauggcgaguucugcauuguuauggauggcauccguagagccacacuggauagcggcuuccauaauauuggaguuuuuccuaaugguacuuuuaauaccagagccagauagacaacgaaccccgcaagauaaccaauuagcguauguaguuauaggcuuauuauuuaugauauuaacuguagcugcaaaugaaauggguuugcuugaaacuacuaaaaaggaucuuggaauuggacauguggccguagagaaccaucaucaugcaacuauguuagacguagaucuucauccggcgagugcauggacguuauaugcaguugcuacaacuauuauaacucccaugaugagacauaccauugaaaacacgacagcgaacauaucacuuaccgcaauagcaaaucaagcagcaauuuugauggguuuagauaaaggcuggccuauuucaaaaauggauauaggaguuccuuuauuagcucuaggauguuacucacagguaaacccguuaaccuuaaccgccgcaguacucauguuaguugcacauuaugccauuaucggaccaggucuacaagcaaaagcuacccgugaggcccagaagagaacggcagcaggaauuaugaaaaacccgacaguugacgggauugucgcaaucgaucuagauccuguuguauacgaugcaaaguucgaaaaacaauuaggucagauaaugcuauugauauuauguacaagccaaauacuacugaugagaacgacaugggcuuuaugugaaucaauuacacuugcuacagguccuuugacuacuuuaugggaagguagcccugguaaauuuuggaacacaacaauagcaguaucuauggcaaacauauucagggguaguuaucucgccggagcagguuuagcguucucauugaugaaaucccuaggcgggggacggcgaggcacgggagcacaaggggaaacauuaggggagaaauggaaaagacaauuaaaucaacuaagcaagucagaauuuaacacauauaaacguucaggaauuauggaagucgaucguagcgaagcaaaagaagggcuuagacgaggugaaacaacgaaacacgcgguaucgagagguacagccaaauugcgaugguuuguugagagaaaucuugucaaaccagaaggaaaagucauagauuuaggcugugguagaggaggcuggaguuauuauugugcugggcugaaaaagguaacugaaguuaaagguuauacgaaaggagguccaggacaugaagaacccauaccgauggcuacguaugguuggaauuuagugaaacuacauucuggaaaagacguuuucuuuauuccuccugaaaaaugcgacacucuucuaugugacauaggagagaguagucccaaccccacuauugaagaaggccgaacuuuacgcguucugaaaaugguagaaccuugguuacgaggcaaucaguucugcaucaaaauucuaaaccccuauaugccgucaguagucgaaaccuuagaacaaaugcaaagaaagcacggagggauguuaguucguaacccauuaucacggaacaguacacacgaaauguauuggguuucaugcggaacaggaaacauaguuagcgcagucaacaugacuucacggaugcuacuaaaccguuucaccauggcacacagaaagccaacguacgaaagagauguggaucuaggagcuggaacucgucauguugccguagaaccagaaguagcaaauuuagacauaauuggucaaagaauagaaaauauaaaacaugagcauaagaguacguggcacuacgaugaagauaacccauacaaaaccugggccuaucacgguucguacgaagugaaaccgagugggucugcuucauccaugguuaacgggguagucaaacuacucacuaagccaugggauguaauaccaaugguuacgcagauugcuaugacagauacaacaccguuuggacaacaacguguuuuuaaagaaaaagucgauacgagaacucccaaagcuaaacgaggcacugcgcaaauaauggagguaacagcucgauggcuguggggcuuucuaagcagaaauaagaaaccgagaauaugcaccagagaagaauuuacgagaaaaguaagaucgaacgcagcaauaggugcagucuuuguugacgagaaucaauggaacagcgccaaagaagcaguagaagaugagcgcuucugggacuuaguucaccgagaaagggaacuucacaaacaagggaaaugugcaaccuguguauauaacaugaugggaaagagggagaagaaacuaggagaguucgggaaagcaaagggcagucgagcgaucugguacauguggcuuggagcucguuuccuugaguucgaagcauuaggauucaugaacgaagaucacugguuuagccgugaaaauagucuauccggugucgaaggugagggccugcauaaguuagguuauauccuacgcgauauaucaaagauaccgggaggcaacauguacgccgaugacacagcgggaugggauacaagaauaacugaggacgacuuacaaaaugaggccaaaauuacagauauaauggaaccggaacacgcgcuauuagcaaccagcauauuuaaauuaaccuaccaaaacaagguagucagagugcaacgcccagcuaggaacgguacuguaauggauguaauuaguagacgugaccagcgcggaaguggacaaguagguacauauggguuaaacacauuuaccaacauggaagcacaguuaauaagacaaauggaaagugaagggauuuucagucccucugaauuagagacaccaaauuuggccgaaaggguuuuagauugguuagaaaaacauggaguagaacgauuaaaaaggauggccauuaguggagaugauugcgucguaaaacccaucgacgaucguuuugcaacugcguuaucagccuuaaaugauaugggaaaagugagaaaagacauaccacagugggaaccaaguaagggauggaaugauuggcaacaaguacccuucugcagucaccacuuucaccagcucauaaugaaagauggccgugagauuguaguacccugcaggaaccaagaugaauuaguuggcagagcuagggugagucagggagcaggauggaguuugagagagacagcaugucuugggaaaaguuacgcccaaauguggcaauuaauguauuuccaccgaagagauuuacgacuagccgcgaacgcgauaugcagugcgguccccguagacuggguaccaacaagucguacuacuuggucaauccaugcucaucaucaauggaugacaacagaagacauguugucuguuuggaauagaguauggauugaagaaaauccauggauggaagauaagacacauaucucuaguuggggagauguaccguaccuagguaaacgugaagaucaauggugcggaucucucaucgggcuuacugcucgcgcaacgugggcaacaaacauucaaguagcaauaaaccagguaagaagacugauuggcaacgaaaauuaucuagauuacaugacuucuaugaagcguuucaaaaacgaaagugauccggaaggggcacuaugguga

SEQ ID NO: 21619 - RNA, 9879 nt, Artificial Sequence
  derived and/or modified CDS sequence (opt6) from DENV-1__FJ882523__SS-prME
ucagugacaauguuguuaaugcuaaugccuacggcacucgcauuccaucuuacaacaagagggggugaaccgcauaugauaguuacaaaacaagaacgagguaaaagucuacuauucaaaacaagcgcaggaguuaacauguguacgcuaauagcaauggauuuaggcgaauuaugcgaagacaccaugacguauaagugcccaaggauuacugaagcagaaccagaugacguggacugcugguguaacgccacagacacauggguaacguacgguacguguagucaaacgggcgaacauagacgagacaaaaggagcguggcuuuggcgccucauguggguuugggacuggaaacacgaacagaaacuuggaugucaagugaaggagcuuggaaacaaauacaaagagucgagacgugggcacugagacaucccgguuucacgguaauagcuuuauuuuuagcacacgcgauagguacaucuauaacccaaaaaggaaucaucuuuauuuuacuaaugcuaguuacaccgucuauggcaaugagauguguuggcauaggaagccgcgacuuuguagaaggcuuaaguggagccacguggguagauguuguacuugagcaugguagcuguguuacuacuauggcuaaagauaaaccuacuuuagacaucgagcuauuaaaaacagagguaacgaauccagcgguauugcguaaauuauguauagaagcgaaaaucucuaacacuacuacagauucgcgaugucccacacaaggugaagccacauugauggaagaacaagaugcgaauuucguuugucguaggacuuucguugacagggguuggggaaaugguugugggcuguuuggaaaaggaucucuuauuaccugcgcuaaauucaaaugcgucacgaaacuggagggaaaaauaguacaauacgaaaauuugaaauauucggucauuguaacaguacacacaggagaccaacaucaaguagggaaugagucaacugaacauggcacuacggcuacaauaacaccccaagcuccaacuucagagauacaacugaccgauuacggagcuuuaacauuagauuguucaccaagaacaggauuggacuucaaugaaaugguguugcugacaaugaaagaaaaauccuggcuaguucauaagcaaugguuuuuggacuugccccugcccuggacgaguggugcgagcacaagucaggagacauggaaccgccaagauuugcuuguaaccuucaaaacggcucaugcaaagaaacaggaaguuguggugcuagguucacaagagggugcaaugcacacagcuuuaacuggagcaacugaaauacaaacgucuggaacuaccacgauuuucgccggccauuugaagugcaggcuuaaaauggacaaacuaacgcuuaaagguaugucuuaugugauguguacuggaaguuuuaaacucgaaaaggaaguagcggagacacagcauggcacgguccuaguucaaauaaaauaugaagggacugaugccccauguaagauuccauuuagcacccaagaugaaaaaggaguuacccaaaauggacgacuuauaacugcaaaucccauaguaacggacgaagaaaagccuguuaauaucgaagccgaaccgccuuucggggagaguuauauaguuauuggcgcaggggaaaaagcauuaaaauuaucaugguuuaagaaaggaucuucuauuggaaaaauguucgaggcuacggcgagaggggcuagacggauggcaauuuugggugacacugcuugggauuuuggaagcauaggagggguauuuaccucaguagggaaauuaguucaccagaucuucgguacagcauaugguguuuuauucaguggagucucuuggacuaugaaaauugguauaggaguacuucuaacauggcucggacuuaauucgcgaaguacaaguuuaucaaugacuugcauagcagucgguuuggugacgcuuuauuuggguguaaugguacaagcagacaguggaugcguaauaaauuggaagggacgagaacucaaauguggcucuggaaucuuugugacuaacgaagugcauacauggacagagcaauacaaauuucaggcagauucuccgaaaagguuaucugcagccauaggaaaagcaugggaagaagggguuuguggcauaagaucugcaacaagacuggaaaauauaauguggaaacaaauaucuaaugaacucaaucacauuuuacuagagaaugauaugaaauucacuguuguaguaggcgauguagucggcauacuagcacaggggaagaaaaugaucaggccucaaccaauggaacauaaauauucauggaaaucauggggaaaggcaaaaauaauaggcgcggacguacaaaacacgacauucauuauugacgguccuaauacuccggaaugcccagacgaucaaagagccuggaauauaugggagguugaagacuacgguuuugguauauuuacaacuaauauuugguuaaaacuucgagacucuuauacacaaguaugcgaccaccgucuuaugagcgcagcaauaaaagauagcaaagcaguccacgccgauaugggguacuggauugagagcgagaaaaaugaaaccuggaaacucgcacgggcaaguuuuaucgaaguuaaaacaugcaucuggccaaaaucccauacuuuauggucuaauggggugcuugaaagugaaaugauuauuccaaagauuuacggagguccaaucucacaacauaauuauagaccgggguauuucacccaaacagcgggaccguggcaucuggguaaacuugaauuagauuuugaucuaugugagggaacaacgguuguaguagaugaacauuguggaaacagaggcccaucccuuagaacuacaacgguuacgggaaaaauuauacacgaaugguguugucgaagcuguacucugccgccguugcgauuuaagggggaggauggauguugguauggcauggaaauucgaccaguaaaagaaaaagaagagaacuuaguaaagucgaugguaucugcggggucaggagagguagacuccuuuagucuuggacuauugugcauaucaauuaugaucgaggaagugaugagaagccgcuggagucgaaagauguuaaugacaggaacucuugcuguguuuuuacugcuaaucauggggcaacugacauggaacgaccuuauucgauuaugcauaauggucggagcuaaugcaucugauagaauggggaugggaacuaccuaccuugcauuaauggcaacauucaaaaugagaccgauguuugcaguaggcuuauuguucagacgacuaaccucuagagagguauugcucuuaacaauaggguuaucacugguagcaucuguagaguugccaaauucauuagaggaauugggagauggacucgcaauggguauaaugauccuaaaacugcugacagauuuucaaucucaucaguuaugggcgacucuauugucucugacuuuuauaaagacuaccuugaguuugcauuaugcauggaaaacuauggcuauggugcuaagcauagugucucuauuuccccuauguuuaucuacaacgagccagaaaacaaccugguuaccuguacuuuuagguaguuugggaugcaaaccacugaccauguuuuuaaucgccgaaaacaaaauuuggggaagaaagucuuggccacugaacgagggaauuauggcaguuggcguaguuucuauacuccuuaguucauuacugaaaaacgacgugccuuuggcaggaccucucaucgcuggcggaauguugauagcaugcuacguuaucagugguucuucugccgauuugagccuagagaaagcugcagaagugucuugggaggaggaagcggaacauucuggugcuucacauaacauccuaguagaagugcaagaugacggaacaaugaaaauuaaggaugaggaaagggaugacacgcuaacaauacuacuaaaagcgacauugcuggccgucuccggcguuuauccgcuauccaucccugcgacacuauuuguuugguauuuuuggcagaaaaagaaacaaagaucagggguucugugggacacuccaucuccaccugaaguggaacgagccguauuagaugauggaauuuauagaauuaugcagaggggauuguuggggcgcucucaaguaggaguggggguuuuucaagaaaauguguuccauaccauguggcauguaacccguggggccguacugauguaucaaggaaaacguuuggagccaaguugggcuagugucaagaaagaccuaauaucguaugggggaggcuggagacuucaaggaucuuggaacacgggggaagaaguacaaguaauagcagucgaaccuggcaaaaaucccaaaaacguucaaacugcucccgguaccuucaaaacgccagagggcgaaguuggagcaauugcacuagauuucaaaccugguacgucaggcagcccaaucgugaauagggaagguaaaauuguaggauuguacgggaacggagugguaacuacaagcggaaccuacguaucagcaaucgcucaggcaaaagccucucaggagggaccguuaccggaaauagaggaugaaguauuuagaaaaaggaaucucacaaucauggaucuacaccccgggagcggaaaaacacguagauaucucccggcuauaguaagggaggcaauuaaacgcaagcuaagaacgcuaauuuuagcuccuacuaggguuguagcaagugaaauggcugaagcacuuaaagguaugccaaucagauaucaaacuacagccguaaaaagcgaacacacuggcaaggaaaucguagaccuaaugugucaugccacauucacgaugcgucuucuauccccugugcgugucccgaauuauaauaugauuauuauggacgaagcucacuucaccgauccuuccuccauagcagcgagaggcuauauaaguacgcgaguaggaaugggcgaagccgcagcgauuuuuaugacugcgacacccccuggaagcguagaggcauuuccacaaagcaacgcagucauucaagaugaagagagagauauuccagaacgaucuuggaacuccggguacgaauggauaacugacuuuccagguaaaaccguaugguuuguaccgaguauaaaaagugggaaugauauagcuaauuguuugcgcaaaaauggcaagagagugauacaacuuagcaggaagaccuuugauacagaguaccaaaagaccaaaaacaaugacugggauuauguaguuacgacugacaucucagaaaugggagcgaauuuuagagcggaucgagucauugauccaagacguuguuuaaaacccguaauacuaaaagaugggccagaacgcguuauacuggcuggucccaugccuguaacgguugcgucagcagcacagcggcgaggcaggauaggccgaaaucauaauaaggaaggugaccaauauauuuacaugggacagccgcugaacaacgacgaggaucacgcccauuggacugaggcaaaaaugcuacuagacaauauaaauacuccagagggaauaauuccagcucuauucgagccggaacgugagaaaucggccgcaauagacggagaauaccguuuacguggagaagcuagaaagacauucguagagcuuaugagacgaggagaucugccugucuggcuaucuuauaagguagcaucagaaggauuccaauacucagaccgacguugguguuuugauggagagaggaauaaccaaguauuagaagaaaacauggauguagagauuuggacuaaagaaggcgagcgcaaaaagcuaagaccgagaugguuagaugcccguacuuauagugauccccuagcauuacgggaauuuaaggaauuugcagcugguagaagaucaguuucuggagaccugauccuugaaauaggaaaguugccgcaacaccuuacgcagcgcgcacaaaaugcauuagauaaucucgugaugcugcauaauucagaacagggaggacgugcauauaggcacgcgauggaagaauuacccgauacaauugaaacccucauguuacucgcacucaucgcaguguuaacaggagggguuacucuauucuuuuuaucgggaagaggacuaggcaagacaucuauaggauugcuauguguuauggccucuucaguacuauuguggauggccaguguagaaccacacuggaucgcagcgucuauaauacuggaauuuuuccucaugguacuacuuauuccugaaccugaccgacaaagaacaccgcaagacaaucagcuagcuuauguugugaucggacugcuuuuuaugauucuaacaguugcugccaaugagaugggacuguuagaaacaacuaagaaagaucucggaauaggacacguagcugucgaaaaucaucaucacgcuaccaugcuagauguagacuuacauccagcaucggcguggacuuuauaugcaguagcuacgacuaucauaacgccaaugaugagacacacaauagaaaauacaacagccaacaucucauugacagcaaucgcgaaucaggcagcuauucuuaugggauuagacaaaggauggccaauaucuaaaauggacauaggaguuccucugcuagcucucgguuguuauucacaaguaaauccccuuacacugacagcagcaguccuaaugcucguugcccauuaugcaaucaucggacccggauugcaagccaaagccacucgagaagcacagaaaagaaccgcagcuggcaucaugaaaaacccaacugucgauggaauugucgcgauugaucuugacccggucguauaugacgcaaaauucgaaaagcaauuaggucaaaucauguugcuaauuuuauguacuucacaaauuuuacugaugcgcaccaccugggcuuugugugaaucuauaacucuggcaacuggaccuuuaacuacgcuaugggaggguucgccuggaaaauuuuggaauaccacaaucgcuguaucaauggcaaauaucuuuagggguucauaucuugcuggagcagguuuagcauucucacuaaugaaaucguugggaggugggagacgaggaacaggagcacagggagaaacacuaggcgagaaauggaagcgccaguuaaaccaacuuucuaagucagaauuuaacaucuauaaacguaguggaaucauggagguagacagaucagaggcaaaagaagggcuaaaacgaggugaaacaacacgacaugcagugucgagggguacugccaaacucagaugguuuguagaaagaaaccuugugaaaccggagggaaaggucauagacuuggguuguggacguggcggauggaguuauuauugugcaggauugaagaagguaacagaagugaaagguuauacaaaaggugguccaggacaugaagaacccauaccaauggcaacuuacgguuggaaucuagugaaauugcauagcggaaaagacguguucuucacuccaccugaaaagugcgauacauuacuaugcgacauuggugaaucgucucccaacccaacaauagaagaagggcgaacacugaggguacuaaaaaugguagaaccuugguuaagagguaaucaguucuguauaaagauucuuaacccuuacaugccaagugucguagaaacauuggaacaaaugcaaagaaaacacgggggaauguuggucagaaauccauuaucgagaaacagcacacaugaaauguauuggguaaguugugguacggguaauauuguaucagcaguuaacaugacaagucgaaugcuccuaaaucgauucacaauggcgcauagaaaaccaacauaugaaagagauguagacuuaggcgcaggaacgagacauguagcaguugagccggaaguagcaaaucuggacaucaucggucaaaggauagagaauauaaagcacgaacauaaaucaacauggcauuaugaugaagauaaccccuacaagacaugggccuaucacgguucauaugagguuaaacccaguggguccgcaucgaguauggucaaugguguuguaaaauuguuaacgaagccgugggauguuauuccuauggugacacagauugcaaugacugauacgacucccuucgggcaacaacgaguuuuuaaggaaaaaguugauaccagaacacccaaagcgaagagaggaaccgcucagauaauggagguaacagcucgguggcuauggggauucuugucuagaaacaagaagccacgaauuugcacgagggaggaguucacacgaaaaguacguucuaaugcagcuauuggggcuguuuucguugaugaaaaccaauggaacuccgcuaaagaagcagucgaagacgagagguuuugggaucuuguucagaaagaacgagaacuucauaaacaagguaagugcgcuacguguguauauaacaugaugggaaaacgagagaagaaauuaggcgaauuuggcaaagcaaaaggcagcagagcuauuugguacaugugguuaggagccagauuccuggaauuugaggcuuuaggguucaugaaugaagaccacugguuuucuagagaaaacucguuaaguggaguugaaggggaaggguuacauaaacuaggauacauauuaagagauauaucuaagauuccuggagggaacauguaugcagacgauacagcaggaugggauacaagaauuaccgaggaugaccuacaaaacgaagcgaaaaucaccgacaucauggaaccugaacaugcccuacuagcgaccucaauuuucaagcuaacuuaccaaaacaaaguagucaggguccagagaccagccaaaaaugggacaguuauggauguuauaagucgacgagaccagcgaggcagcggucaaguaggaacuuacgguuuaaacacuuucacuaacauggaagcacaacuaauacgccaaauggaaucugagggaauuuucucaccaagcgaacuagaaauaccaaaccuagccgaacguguauuagauugguuagaaaaauauggcguugaaaggcuuaagcgcauggcaauaucuggcgaugauugcguuguaaaaccuauagaugaucguuucgcaacagcucuuacagcacugaaugacauggggaagguacgaaaggacgugccacagugggagccaaguaaaggauggaaugauuggcaacaaguuccuuuuugcucucaucauuuccaucaacuuaucaugaaagacgguagggagauuguaguacccugucgaaaccaggaugagcugguagguagagcacgaguuucucaaggagccggauggagucuaagagaaacugcuugucuaggaaaaagcuaugcacaaauguggcaacucauguauuuccacagacgagaccugagacuagcugcaaaugcuauuugcagugcaguaccaguagauuggguuccaacuuccagaacuacuuggucgauacaugcgcaucaucaguggaugacgacugaagacauguuaucuguauggaauagaguuuggauugaggagaaucccuggauggaggauaaaacucaugugucaucuuggggcgauguaccauacuugggaaagagggaagaucaauggugcggaaguuugauaggccucacagcacgagcuacuugggcaucaaauauccaaguagcaauuaaccaaguacgaagguuaaucgguaaugaaaauuaccuugacuauaugaccuccaugaaacgcuuuaaaaaugaaggugauccugaaggagcccuaugguga

SEQ ID NO: 21620 - RNA, 9879 nt, Artificial Sequence
  derived and/or modified CDS sequence (opt6) from DENV-1__FJ882524__SS-prME
agcguaacaauguuacucauguuaaugccgacagcuuuagcguuccacuugacuacaagagggggcgaaccucauaugauagugacaaaacaagaacggggaaaaagucuacuuuuuaaaacaagugcaggagugaauauguguacucuaauagcaauggauuuaggcgaacuaugcgaagacacaaugaccuacaaaugcccacgaaucacagaagcugaaccagaugauguagauuguuggugcaacgcaacagauacauggguaacuuauggcacguguagucaaacaggugaacaucggagagacaaacguucuguugcguuagcaccacauguaggauuagguuuagaaacacgaacugaaacuuggaugucaucagaaggcgcuuggaaacaaauccaaagaguagaaacaugggcauuacgacaucccgguuucacuguuaucgcacuuuuccuugcgcaugcuauugguacauccauaacccagaaaggaauaaucuuuaucuuguugauguuaguaacuccaucaauggcgaugagauguguugggauaggcucucgugauuuuguggaaggauuaaguggugcaacauggguggacguaguauuagaacauggaaguuguguuacaaccauggcaaaagauaaaccuacucuggauauagaauugcuaaaaaccgaagugacaaaucccgcaguguuacguaaauuauguauagaagcuaaaaucaguaacacuacaacagauucaaggugucccacucagggugaagcuacuuuaauggaagaacaagaugcaaauuauguaugccgacguacauucguagacagaggguggggaaauggcugugguuuauuugguaaaggcucuuuaauaacuugugcaaaauucaaaugcguuacaaaauuggaagggaaaauaguacaguaugaaaauuuaaaauauucugugaucguuacaguccauacuggcgaccaacaucagguaggaaacgaaaguacagaacaugguacuacugccacaauuacaccacaggcuccgacaucugaaauacaacucacagauuauggggcucuaacauuggacugcucaccacgcaccgguuuagauuuuaacgaaaugguacuguuaacgaugaaagaaaaaucauggcuaguccauaaacagugguuuuuggaccuuccuuuaccauggacaaguggcgccaguacaucacaagaaacuuggaauagacaggaucuacucguuacguucaagacggcacaugcuaaaaagcaagaaguaguuguacuagguucgcaagaaggcgcgaugcacaccgcucuuacaggagcuacagaaauacaaaccucaggaacaacaaccauauucgcaggacaccuaaaguguagauugaaaauggauaaacuaacacuaaaaggcaugucguauguaauguguacagggaguuuuaaacuugaaaaagagguugcagagacucaacaugguacuguucucguucaaauaaaauaugaaggaacugaugcgccaugcaaaauaccguuuucuacgcaagacgaaaagggaguuacucaaaacggccgauuaauuacagcaaacccgauaguaacagauaaagaaaaaccaguaaauauagaagcugaaccaccauuuggagagagcuauauagugauuggcgccggugaaaaggccuuaaaauuaaguugguucaagaaaggaucuuccaucggaaagauguuugaggcgacggcccgcggagcacgacgaauggccauucuuggagauacugccugggauuuugggucaauuggcgggguauucacaaguguaggaaagcucguacaucagauauuugggacugcauaugguguguuguuuaguggcguaagcuggacaaugaagaucgggaucgggguccuccuaacuuggcuagggcuaaacagccgcucaacaucucuuagcaugaccugcaucgcgguuggacuuguaacauuauaucucgguguaaugguucaagcggauucuggcugugucauaaacuggaaaggaagggagcuaaaauguggaucaggcauauuuguuacaaacgagguucacacauggacagaacaauauaaauuccaggcggauucaccgaaaagacuuagugcggccauaggaaaggcaugggaagaagggguuuguggcauuaggagcgcaaccagguuagaaaauauaauguggaagcaaauaucaaacgaacuaaaccacauauuguuagaaaaugauaugaaauuuaccgucgucguuggagaugugguagggauauuagcccaagggaagaaaaugauccguccacagccgauggaacauaaauacaguuggaaaucauggggcaaagcuaaaaucauuggggcugauguucaaaacacgacuuuuauuauagacggaccaaacacgccggaauguccagaugaccagcgcgcauggaauauaugggaaguugaggauuacggauuuggaauauucacuacuaauauauggcucaagcuacgugauucauauacacaaguuugcgaucaucgacugaugagugcugcaauaaaagacucaaaggccguacacgcggauaugggguauuggauagaaagcgagaaaaaugaaacauggaaacuggcaagagccucauuuaucgaaguaaaaacauguauauggccuaaaagucauacacuauggucuaauggaguacuggaaagcgaaaugauaaucccaaagauuuauggagggcccaucucucaacacaacuauagaccugguuacuucacucaaacagcuggcccauggcaucuagguaaguuagaauuagauuuugacuuaugugaagggacaacggugguuguagaugaacauugugggaacaggggaccaucguuacguacaacaacgguaacggguaaaauaauucaugaaugguguuguaggucuugcacucugccuccgcucagauuuaagggagaagaugguugcugguacggaauggaaauccgcccaguaaaagagaaagaagaaaaucugguaaaauccaugguuagcgcagguagcggagaaguagacucauucagucuaggauuguuguguauuucaauuaugauagaagaagugaugagaucaagauggucaaggaaaauguugaugacagguacacuugcaguauuucucuuacugauuauggggcaacuaacuuggaacgaccuaauccgacuaugcaucaugguaggugcaaaugcuucagaccgaaugggaaugggaacaacauaucuugccuugauggcuacauucaaaaugcgcccgauguucgcaguaggccuucuguucaggagguugacuucaagagaaguauuauuacuaacuauagggcugucauuaguggcuuccgucgagcucccaaacagccucgaagaauuaggcgaugguuuggcaaugggaauaaugaucuugaaauuacuuacugacuuucagucccaucaauugugggcgacuuuacuaagucuaacauuuauaaaaacaacuuuaagccuacacuaugcuuggaagaccauggcaaugguacugaguaucgucucacuuuuuccguuaugcuuaucgacgacaucacagaaaaccacaugguuaccugugcuucuuggaucuuuagguuguaagccucuuacaauguuccugaucgcagaaaacaaaauaugggggagaaaaucauggccacuaaaugaagggaucauggcugucgguguuguuucaauauuacucucuuccuuacucaaaaaugacguuccacuagcaggaccacuaaucgcaggagggaugcuaaucgcauguuauguaaucagugggaguagcgcugaucuuagccuugaaaaagcagcagaaguaucaugggaagaggaggcugagcacaguggcgcaucucauaacauuuuaguugaaguacaagaugacgguacaaugaaaauaaaagaugaggaaagagacgacacccuaacuauauuacuaaaagcaacauuguuagcaguuuccggaguauauccacuuuccaucccugcgacgcuuuuugugugguacuuuuggcagaagaagaaacaacgaucgggaguauuaugggacacuccaaguccaccugagguugagagggccgucuuagacgauggaauauaucguauuaugcagcguggauuacuaggacgaucacaagucgguguaggcguuuuucaagaaaauguauuucacacaauguggcaugucacaagaggggcagugcuaauguaucaagggaaacgccuagagccaucaugggcaucugucaagaaagaucuaauuucauauggugguggauggcgccuacaaggaucuuggaauacuggagaagaaguucaaguaauugcgguagaaccagguaaaaauccgaaaaacguacagacugcaccuggaacauuuaaaacgccggaaggcgaggugggagcuauagcacuugacuucaaacccggaacuucugguagcccgaucguaaauagagaaggaaaaauaguuggacuuuauggaaaugguguaguaacaacaagcgguacauacguuagcgcuaucgcacaggcaaaggcaagucaagagggaccauuaccggaaaucgaagaugaaguauucaggaaaagaaacuugaccauuauggacuuacacccagguaguggcaaaacuagaagauaccugccagcaauuguuagagaagcaauuaagaggaaacugcguacccuaauuuuggcaccuacuagagucguugccucggaaauggcggaagcacuuaaagguaugccaauuagauaccagaccacugccguuaaaagugaacacacagguaaagaaauuguagauuuaaugugucacgcaacuuuuacuaugagauuguuaaguccugucagaguuccaaacuauaauaugauuauaauggaugaagcucauuuuacagauccaagcucgauugcagcuagaggguacauuaguacgcguguugguaugggcgaagcugcagccauauucaugacagcaaccccaccugggucggucgaagcguucccacaaagcaaugcgguaauucaagacgaagaacgcgauauccccgaacgaagcuggaacucaggauaugaauggauuacagauuuuccgggaaagaccgucugguucguuccaagcauuaaaagugggaacgauauagcuaauugcuuaaggaaaaauggaaaacgaguaauacaacucucucggaaaacauuugacacggaauaccagaaaacgaaaaacaaugacugggauuacguuguaaccacggauauuuccgaaaugggugcuaauuucagagcagauaggguuauagauccgagaagaugucuaaaaccgguuauucucaaggauggaccagaacguguuauacucgcaggcccaaugccaguuacuguggcaucagcggcacaaagaagggggcggauaggaagaaaccacaacaaagaaggagaucaauauauauauaugggccagccucuaaacaacgaugaagaccacgcccauuggacagaggcaaaaauguuacuggauaauauaaacacccccgagggaauaauaccagcacucuucgaaccugagagagagaagagugcagcaauagauggugaauaccgauuacguggagaggcgcgaaaaacuuucgucgaacugaugcguagaggcgaucuaccuguuugguugucuuauaaaguagcaagugagggcuuucaauacucugauagaagaugguguuuugacggugaacguaacaaucagguccuugaggaaaacauggauguagaaauauggaccaaagaaggugaacggaagaaacuaagaccacguuggcuagaugcgcggacuuauuccgacccucucgcguugagagaguucaaagaguucgcugcaggucguaggucaguuaguggugaccuaaucuuagaaauuggaaaauuaccacaacaccuaacacaacgugcgcaaaaugcacuugauaaccucguuaugcuacauaacuccgaacaaggaggacgggcauacagacaugcuauggaagaacuaccagacacuauagagacauugaugcuauuagcucuaauagccguucucacugggggagucacuuuauucuuucuuucggguagaggcuuagggaaaacgucaauuggacucuuaugugucacugcgaguucugugcugcuguggauggcaaguguugagccccauuggauugcggcuucuauaauauuagaguucuuucuaaugguuuuauuaauuccagaacccgauagacaaagaacuccgcaagacaaucaauuggccuauguugugauagggcuacuuuuuaugauucuuacugucgcagcuaaugagaugggauuacuagaaaccaccaagaaagaucuaggaaucggucaugucgcgguugaaaaucaccaccaugcuacaaugcuagauguugacuuacacccagcaucagcauggacucucuaugcaguagccacaacaauaauaacuccuaugaugcgucacaccauagaaaacacaacugcaaauauuagcuuaacagcuauagcaaaucaagccgcaauauuaaugggucuugauaaaggauggccaaucucaaaaauggacauugggguaccauuacuagccuuagguuguuauagucaagugaauccacuuacccucacagcugcgguucuaaugcuaguugcucacuaugcaauuaucggaccuggucuucaagccaaagcuacuagagaagcgcagaaaagaaccgccgcagggauaaugaaaaauccgacuguugacggaauuguagcuauugaucuggauccuguaguuuacgacgcgaaauucgaaaaacaacuaggccagauaaugcuauuaauacucuguacaagucaaauacuacugaugcgaacaaccugggcuuuaugcgaauccauuacucucgcaaccggcccccuuaccacccuuugggaaggguccccggggaaauucuggaauacuacgauagccgugagcauggcuaauauauuccgugguaguuauuuagcgggugcgggguuggccuucucauuaaugaagaguuuaggagggggacgucgagguaccggugcgcaaggggagaccuuaggagaaaaauggaaacgacaauugaaccaauugaguaaaagcgaguuuaauauauauaaacgaagcggaauaauggaaguggacagaagugaggcgaaggagggguuaaaacgaggagaaaccacaagacacgcagucucccguggcacugcaaaacuacguugguucgucgaaagaaaucuaguuaaacccgaagggaaaguaauugacuuggggugugguagagggggauggucauauuacugugcagggcuuaagaaggugacagaaguaaaaggauacacgaaaggagguccaggacaugaggaaccuauaccaauggcaacauacggauggaaucuaguuaaacuucacucaggaaaagacguauuuuucacuccaccugagaaaugugauacucuauuaugcgauauuggcgaaucaagcccaaacccaacgaucgaagaaggacguacauuacggguacucaaaaugguugaaccuugguuaagaggcaaucaguuuugcauaaaaauauugaauccauauaugccaaguguagucgagacguuagagcagaugcaacggaaacauggaggaaugcuaguaagaaauccauugucaagaaacucaacgcacgagauguauuggguauccugcgguacugggaauaucguuucagcggucaacaugaccagccgaauguuacuaaacagauuuacaauggcgcaucggaaaccaacguacgagcgagauguagaucuuggagcaggaacacgacauguugcaguggaacccgaaguagcaaaucuugauauuauaggacaaagaauugaaaacauuaaacacgaacacaagagcacguggcacuaugacgaagauaauccguacaaaacuugggccuaucacggaagcuacgaagucaaaccauccggcucagccucuagcauggugaauggugucguuaaauuacuaacuaaaccaugggauguaauaccaaugguuacacagauugccaugacggauaccacuccauucggucaacagagaguuuucaaagaaaaaguugacacuagaacuccgaaagcgaaacguggcacugcucaaauuauggaagucacugcacgcugguugugggguuuccuaagucggaauaagaaaccucggauuugcacuagggaggaguucacacgcaagguacgaucaaacgcggcuauaggagcgguguuugucgacgaaaaccaauggaauagugcuaaagaagcaguugaggacgaaagauuuugggaucucguacaaaaggaaagggagcuucacaagcaaggaaaaugcgcgacuugugucuacaacaugaugggaaaaagagagaagaaacuuggugaguucggaaaagcaaaagggucaagagcgauaugguauauguggcuuggggccagguuucuagaauuugaagcucucggcuuuaugaaugaggaccauugguuuucaagagaaaauucuuuaucuggaguggagggugagggucugcauaaauuaggauacauacuaagggauauaagcaaaauuccaggaggcaacauguaugcggacgauacagcagggugggacaccaggaucacagaagacgaccuucaaaaugaagcaaaaauuaccgauaucauggagcccgaacacgccuuacucgccaccaguauauuuaaacuuacauaccaaaacaaaguuguuaggguacaacguccugccaaaaauggaacggugauggauguuaucucaagacgagaccaaagaggcucggggcagguaggaacauauggucugaauacuuucaccaacauggaagcccaguugauacgacaaauggaauccgaagguauauuuaguccgucagaacucgaaauaccuaauuuagcggaaaggguacucgauuggcuagaaaaguacggaguugagcgacucaagagaauggcuauaucuggggaugauuguguagugaagccuaucgaugacagauuugccacugcacuaacagcauuaaacgacaugggaaaaguccgaaaagaugucccacagugggagccaucgaaaggguggaaugauuggcaacaagucccauuuuguucgcaucacuuucaucagcuuauaaugaaagacggucgagagaucgugguuccaugucgaaaccaagacgaguuagucgguagagcucgaguaagccaaggggcugguuggucacuaagagaaacugcuuguuuggggaaauccuacgcgcagauguggcaacuuauguauuuucacaggcgagacuuaagacuagccgcuaaugcaaucugcucggccguuccaguagauugggugccaacaagcagaacaacguggucaauacaugcucaucaccaauggaugacuaccgaagauaugcuaucaguguggaauagaguauggauugaagagaacccauggauggaagacaagacucauguaucuucguggggugaugucccauaucuaggcaaaagagaagaucaauggugugggagcuuaauaggcuugacugcaagagcaacuugggccagcaacauucaaguagcuauaaaucaaguucgccgauugauuggaaacgaaaacuacuuagauuauaugacauccaugaaaagguuuaaaaaugagggugacccagaaggugcacugugguaa

SEQ ID NO: 21621 - RNA, 9879 nt, Artificial Sequence
  derived and/or modified CDS sequence (opt6) from DENV-1__FJ882525__SS-prME
ucgguuaccauguuguuaauguuaaugcccacugcacuugccuuucaccugacuaccagaggaggagaaccacauaugauuguuucgaaacaagaaaggggcaaaagccuucuuuucaaaacgagugcuggugugaauauguguacucuugucgccauggacuuaggagaguucugugaagacacuaugaccuauaaauguccccgaauaacugaagccgaacccgaugacguugauuguuggugcaacgcuacugauacguggguuacguaugguacgugcagccaaacuggagaacauagaagagauaaaagaagugucgcguuggcaccgcacguaggacuaggauuagaaacaagaacggaaacauggaugucgucagaaggcgcauggaaacaaauacaacgcguggaaacaugggcauuaagacauccagguuucacagugauagcacuauuccuagcacaugcaauagggacgaguauaacgcagaaagguauuauauuuauauuauuaaugcuaguaacucccaguauggcaaugagaugcguugguauagguucucgggauuuuguagaggguuugucgggcgcuacguggguagacgugguauuagaacacgggaguuguguaacaacgauggcaaaagauaaaccaacgcuagacauugaguuacugaaaacagaagucacaaacccagcaguucuuaggaaacuaugcauugaggcaaaaaucagcaauacaaccacggauucacgaugcccuacgcaaggagaggcaaccuuaguggaggaacaagacgcgaacuuuguaugucgccgcaccuucguugaccgcggcugggguaaugguugcggguuauuuggaaaagguaguuuaauaacaugugcuaaauuuaaauguguaacuaaacuagaagguaaaaccgugcaauacgagaacuugaaauauagcgugauuguaacuguucauacgggagaucaacaccaaguuggcaacgagucaacugaacauggcacuacugcgacaauaacuccgcaagcuccgaguacagaaauacaauuaacggauuauggagcauugacucuugauuguucaccaaggacagggcuggacuuuaaugaaauggucuuacuaacaaugaaagagaaaagcuggcugguacauaaacagugguucuuagacuuaccucuuccguggaccagcggagcaagcaccucacaagaaacuuggaaucgaaaagaucuccuaguaacguucaaaacagcacaugccaagaaacaagaaguaguaguauuagggucgcaggaaggagcaaugcauacugcacuaacgggugcaacagaaauccagacaucuggaaccacaacgauauuugccggacacuuaaaaugccgucuuaaaauggauaaauugacauuaaaaggcaugucguauguaaugugcacgggauccuucaaauuagagaaagaagucgcagagacucaacacgggaccguuuuaguacagauaagauacgaaggaaccgaugcgccauguaaaauaccauucaguacgcaagaugagaaagguguaacucaaaacggcagacuaauuacagcuaaucccauaguuacugauaaagaaaaaccaguaaacauugaggcagaaccucccuuuggugaaucauauauugucauaggcgccggugaaaaagcacuaaaauuaaguugguuuaagaaaggaaguagcaucggaaaaauguucgaagccacggcgcgaggugcucgucgcauggcaauucuuggagacacagcaugggauuuuggcucuauugguggagucuuuacgagugucgguaaauuaguacaccaaauauucggaacugcauauggaguucuuuucaguggagugagcuggacaaugaaaauugguaucggaguacuauuaacaugguuaggcuuaaacagccgaucuacuucucuuaguaugacuugcauagcuguaggccuaguuacacuauaucuugguguaaugguucaagcugacuccgggugcgugauaaauuggaaaggcagagagcuaaaaugcggaucgggaauauuuguaaccaaugaaguccauacguggacagaacaguauaaauuccaggcagacagcccuaaacgcuuaucugccgcuaucggaaaagccugggaagaaggaguaugugguauaagaagugcuacaaggcucgaaaacauuauguggaagcaaauauccaaugaauugaaucacauucuauuagaaaaugauaugaaauuuacagugguuguaggggauguagcagguauccuugcucaggggaaaaagaugauacgaccgcaacccauggaauauaaguacucauggaagucguggggcaaagcaaagauuauaggugcggauguacaaaauacaacauuuauuauugauggccccaacacccccgagugcccagacgaccaaagggccuggaauaucugggagguugaagauuacggcuucggcauauuuacuacaaacauuugguugaaacuuagagacagcuauacgcagguuugugaccauagacucaugucagcugcgauuaaagacagcaaagccguacaugccgauaugggauauuggauagagagugaaaagaacgagacuuggaaguuggcaagagcaucauucauagaaguaaagacauguauauggccaaagagccauacauuauggucgaacgguguucuugaaucugaaaugauuaucccgaaaauauacggcgggccuauaucgcaacauaauuauagacccggauauuucacucaaacagcaggaccauggcauuugggcaaacuagaauuagacuuugaccuaugcgaaggaacuacgguaguuguagaugagcauuguggcaaucguggucccagccuuagaacuacaacugucacagggaaaauaauacaugagugguguuguagaagcuguacucucccuccacuaagauuuaagggugaagacggcugcugguauggaauggaaauaaggccaguuaaagaaaaagaggaaaacuugguaaaaucuaugguuucggcuggaucaggagaaguagauucguucagccuuggcuuauuguguauaucaaucaugauugaagaggugaugagaagucgcuggucuaggaaaauguuaaugacggguaccuuggcuguguucuuccucuuaauaauuggacaacuuacauggaaugaucuaauccggcuauguauaaugguaggggcgaaugcaucggauagaaugggaaugggaacaacuuaccuagcauuaauggccaccuuuaagaugcggccaauguucgcggucggucuccuuuuuagaagacucacaagucgugaagugcuucuacuaacgaucggcuuaucucuuguagcaaguguugaguuacccaauagcuuagaagaacuuggagacggcuuggcaaugggcaucaugauauuaaaauuguuaacggauuuucaaucgcaccaacuaugggcgacauugcuaucuuuaaccuucaucaagacgaccuuuaguuuacauuacgcauggaaaacaauggcaaugguccuaucaauuguaucuuuauuuccuuuaugccuaaguacuacgagucagaaaacaacauggcugcccguacuguuggggucacuggguuguaagccuuuaaccauguuccugauugcagaaaauaaaauauggggacgccggucuuggccgcuaaaugaaggaauuauggcaguaggcauaguaaguauacuauuaaguagucuucuuaaaaaugaugucccacucgcaggucccuugauagcgggcgguaugcugauagcguguuacguaauuucugguucuucggcagaucugagucuggaaaaagcagcagaaguaagcugggaagaggaagccgaacacucaggugcgucgcacaauauacuuguggaagugcaggaugaugggacgaugaaaauaaaggaugaagagagagacgauacuuuaaccauauuauuaaaagccaccuuauuagcaguuucuggaguauauccauugucaauaccagcaacauuauuuguuugguacuuuuggcagaagaagaaacaacgguccgguguccuaugggacacuccuucaccuccugaaguggaaagagcaguacuagacgauggcaucuacagaauuaugcagcguggccuucucggaagaucccagguagguguaggcguauuccaagagaauguguuucauacaauguggcacguaacucgaggugcaguuuugauguaccaaggaaaacgacucgaacccuccugggcaagugugaagaaagauuuaauaagcuauggagggggauggagacugcaagggaguuggaauaccggagaagaaguacaaguuauagcagucgagccgggaaagaacccgaaaaauguacaaacugcaccaggcacuuuuaagacaucagaaggcgaagugggugcuauagcccuagacuucaaaccagguacaucgggaagcccaauaguaaauagagaggggaagauugugggucuauacggcaacggcguagucacaacaaguggaacauacguaucagcaaucgcacaggcaaaggcuucucaagaagguccacuuccggagauugaagacgaaguauucagaaaaaggaaccuuacaauaauggacuuacacccuggcaguggaaaaacaagaagauaccuuccggcaauaguccgagaagccauaaaaagaaaacugagaacccuuauauuagcaccgacucgaguuguggcuagugaaauggcugaagccuugaagggaaugccuauucgauaccaaacuacagcugucaaauccgagcauaccggcaaagagaucguggaucugaugugccaugcgacauuuacgaugaggcugcuaucucccguacgaguaccaaacuacaauaugaucauuauggacgaggcgcacuuuaccgauccuucuagcauagcugccagaggauauauaaguacaagaguugguaugggugaggcagcggcaauauuuaugacugcgacuccgccggguaguguugaggcuuuuccacagucuaaugcagugauacaagacgaagaaagggacauucccgagaggagcuggaacucgggauaugaguggaucacagauuuuccaggaaaaacaguaugguuuguuccaucaauaaaauccggaaaugauauugcuaauugcuuaagaaagaauggaaagcgaguuauccaauuaucaagaaaaaccuucgacacagaguaucagaaaacuaaaaacaaugauugggauuauguuguuacaacggauauuagugaaaugggggcuaacuuucgggcugauagggucauugauccaaggagaugccuaaagcccgugauacuuaaggauggaccagagaggguaauccuugcugggccaaugccaguaacaguugccagugcagcccaacguagagguagaauuggaagaaaccacaauaaagaaggggaucaguauaucuacaugggacagccacuaaacaacgaugaagaucaugcacauuggacagaagcaaagauguuacuggauaauauaaacacccccgaaggcauuauuccugccuuguuugagccugagagagagaaauccgccgcuauugacggugaauauagacuuagaggugaagccagaaagacauucguagaacuaaugcgaagaggugauuuacccguuugguugucguauaaaguagcgagcgaggguuuucaguacuccgauagaagauggugcuuugauggagagcgaaacaaucagguuuuagaagaaaauauggauguagagauuuggacuaaagagggugagagaaagaaauuaaggccccggugguuagacgccaggaccuauucggacccauuagcacuuagagaguucaaagaauuugcagcuggacgucgcucgguuucgggagauuuaauauuagagauuggaaagcugccccaacaccugacgcagagggcccaaaaugcgcucgauaaccuugugauguugcauaauagcgaacaaggggguagggcauauagacaugccauggaagaauugccggauaccauugaaacguuaaugcuucuagcccuuauugcuguucuuacuggagggguaacgcuauuuuuccuuucgggaaggggacucggaaaaacaaguaucggucuguuguguguaauggcuucaucaguucugcuuuggauggcuucgguagaaccacacuggauagccgcgaguauaauauuagaguucuucuuaaugguauuauuaauuccagaaccugauagacaacgaacuccucaggacaaucagcuugccuacguugucaucgggcugcuauuuaugauuuugacugucgcugcgaaugaaaugggacuauuagaaaccacgaagaaagaccucgguauuggucauguagcaguagaaaaucaucaccacgcugccauguuagauguagauuuacaucccgcaucggcuuggacauuauaugcgguagccaccaccauuauaacaccaaugaugagacacacaauagaaaacacaacggcaaauauaagucuaaccgccauagcaaaucaagcugcaauccuaaugggauuagauaaaggcuggccaauaucaaagauggacauaggcgugccuuuacucgcuuuaggguguuauagccaagucaauccccugaccuuaacagcugcaguauuaauguugguagcacacuaugcaauaauaggcccaggguuacaagcgaaagcaacacgugaagcacaaaaacgaacagcggcaggaauaaugaaaaacccgacgguagauggaauuguagccaucgacuuagauccagucguauacgacgcuaaauuugaaaaacaacuuggacagauaauguugcuaauccuguguacaagucaaauuuuauugaugcgaacaacaugggcauuaugcgaaucaauaacuuuagcaacagguccgcuuacuacgcuaugggaaggcagccccggaaaauuuuggaauacgaccauagcuguuaguauggcuaacauauuucgaggaucauaucucgcuggcgcaggacuagcguuuucucuuaugaagucgcuaggcggaggccguagagguaccggagcucaaggagaaacuuuaggugaaaaguggaagaggcagcuuaaccaacucaguaaaucggaguucaacacguauaagagaucgggcauuauggaaguugauagauccgaagcuaaagagggccuaaaacgaggcgagacaacaaaacacgccguaagcagagguacagcaaaauugaggugguuuguugagcgaaauuuuguuaagccagagggaaagguaauagauuuagguuguggucgagggggauggucuuacuauugugcuggauugaagaaaguaacagagguuaaggguuacacuaaagggggacccggucacgaagaaccgauuccaauggcaacuuauggguggaauuuaguaaaacuucacuccgguaaagacguauucuuuauaccaccagaaaagugugauacccuacuaugugauauaggcgaaaguaguccaaacccuacgauagaagaaggacgcaccuuaagaguauuaaaaaugguugaaccuuggcuaagaggaaaucaauuuugcauaaaaauauugaauccguacaugccuucaguuguagaaacacuagagcgaaugcaaaggaaacacggcgggaugcuaguuaggaacccauuaagucgcaauucaacgcacgaaauguacugggugucaugcgguacaggaaauauaguuuccgcaguaaauaugacaucuaggaugcuguuaaauagauucacaauggcccacagaaaaccaacauaugagcgggacguagauuuaggugcugggacaagacaugucgcaguagaaccugaagucgcaaaucuagauauuauugggcaacgaauugaaaauauaaaacacgaacacaaaaguaccuggcauuacgaugaagauaacccuuauaaaacaugggcauaucaugguagcuaugaaguaaaaccauccgguucagccaguucuaugguuaauggcguagucaaguuguuaacuaaaccuugggaugucaucccgauggucacccagauugcaaugacagauaccacuccguucggccagcagagaguauucaaagaaaaggucgauacacguaccccuaaagccaaaaggggaacggcacaaaucauggaagugacggcaaaauggcuauggggauuuuugucgcgaaauaagaaaccccgaaucuguacgagagaagaguucacacgcaaaguuaggucaaaugcagcuauaggugcaguuuucguugacgaaaaccaauggaauagugcaaaagaggcuguagaagaugaaagauuuugggauuuaguccaucgggaaagagaacuccauaaacaaggaaaaugugcaacgugcguuuacaacaugaugggcaagagagagaagaaacuaggagaauuuggaaaggccaaaggaaguagagcaauaugguauauguggcucggagccagauucuuagaauuugaggcuuugggcuuuaugaacgaagaucauugguucucacgcgagaacagccucucagguguagaaggcgaaggcuugcauaaacucggauauaucuuacgagacaucucuaaaauaccuggugggaauauguaugccgaugauacagcaggaugggauacgcggauuacugaagaugaucuucaaaaugaagcgaaaauuacagacauaauggagccggaacacgcuuuauuagcgaaaaguauauuuaaguuaacauaccaaaauaaagugguucgagugcagcgaccugccaaaaacggaacaguuauggacgugauuucuagacgagaucaacgcgguaguggacaaguggguacguauggauugaauacauucacaaauauggaagcacaguuaauuagacagauggaaucagaagggauauucucaccuagugaauuggagaccccuaauuuggcagggcgaguauuggauuggcuugaaaagcacgguguugaacgauuaaaacgaauggcaauauccggcgaugauuguguaguuaaaccaaucgaugacagauuugcaacugcauuaacugcauuaaacgauauggguaaaguuaggaaagacauuccucaaugggaaccaagcaaaggauggaaugacuggcaacaaguaccauuuuguucucaucacuuccaccaacuaauuaugaaagacggacgggaaaucguuguaccaugucggaaucaagacgaacuggucgggagggcacgagucucucaaggcgcuggauggagccuacgagagacugcaugucucgggaaaucuuacgcacaaauguggcaguuaauguacuuccaccgacgggauuuacgucuagccgcuaacgcuauauguucggcugucccgguagacuggguucccaccucgcgaacuacuuggucaauccaugcacaccaucaauggaugacuacagaagacaugcuaagcguauggaauagagucuggauugaggaaaauccuuggauggaagauaagacccauauuucgucauggggugauguaccguauuuagguaaacgagaggaucaauggugcgguucucuaauaggacuuacggcccgcgcaacaugggcuacaaacauucaaguggcgaucaaucagguacgucgacuaauaggaaaugaaaacuaucuagacuacaugacaaguaugaaaagauuuaaaaacgaaucggaucccgagggugcucuaugguaa

SEQ ID NO: 21622 - RNA, 9879 nt, Artificial Sequence
  derived and/or modified CDS sequence (opt6) from DENV-1__FJ882526__SS-prME
aguguaacuauguuacucauguuaaugccaacugcauuagcauuccacuuaacgacucgcgggggagaaccgcauaugauaguuucaaaacaagaacgcggaaaauccuuguuauuuaaaacaagugcgggugucaauauguguacauuaauagcgauggauuuaggagaauuuugugaagacacaaugacauauaaaugcccgcgaaucacggaagcagaaccugacgacguagacuguugguguaaugcaacagauacguggguuacuuaugguaccuguucucaaacgggagagcaccgacgcgacaaacguagcgucgcauuggcgccacaugucggucugggauuagaaacgcgaacagaaacuuggaugaguagcgaaggagcguggaaacaaauccaaaggguagaaacaugggcuuugcgacacccaggcuuuacugugaucgcuuuauucuuagcgcacgccauagggacuuccauaacacagaaaggcauaauuuuuauccuuuuaaugcuugugacaccaucaauggcaaugaggugcgugggaauaggcuccagagauuuuguagaaggacugagcggagcuacuuggguugauguaguacucgaacaugguagcugugugacuacaauggccaaagacaaaccaaccuuagauauagaauugcugaaaacagaaguuacaaacccagcaguacugcgaaaauuguguauugaagcaaaaauaucgaauacgacgaccgacucgaggugucccacgcaaggagaagcaacgcucguagaagaacaggaugccaauuuugucugucgaaggacuuucguagaucgagguugggggaaugguugcgguuuauuuggaaaagguucuuuaauaacuugcgcaaaauucaagugugucacgaaauuagaagggaagauuguacaguaugaaaacuuaaaguacucagucauugucaccguccauacuggugaccaacaucagguagggaaugaauccaccgaacacgggacuaccgcaacgauuacgccucaagccccgucaacagagauacaacugacagacuacggcgcgcucacuuuagauuguucuccucgcacaggacuggauuucaacgaaaugguacucuugacaaugaaagagaaaaguuggcuagugcacaaacaaugguuuuuagaucuuccacuaccauggacgaguggugcaucaacaagucaggaaacauggaauaggaaagaucuuuugguaacuuuuaaaacugcccaugcuaagaaacaagaagucguuguauuaggaucccaagaaggugccaugcacacagcccuuacaggcgcaacugagauacagaccagcggaacuacaacgauuuucgcaggacaccuaaaaugucgauuaaaaauggacaaacuuacauugaaaggaaugaguuauguuaugugcacagggucuuuuaaauuggaaaaggaaguagcagaaacucaacauggcaccguacucguucaaauuaaauaugaaggaacagaugcgccguguaagaucccauuuucaacucaagaugaaaaagggguaacucagaacgggcguuuaauuacagccaauccaauagugacagauaaagaaaagccuguuaacauagaagccgaacccccuuucggugaaucauauauuguaaucggagcaggggaaagggcgcuuaaacuuucaugguuuaagaagggaagcagcaucgggaaaauguuugaggcaacagcuaggggagcacgaagaauggccauacuaggugauacggcaugggacuuugguuccauagggggcgucuuuacuucugucggaaaauuaguucaccaaauauucgguacagcauauggcguacuauuuaguggagugagcuggacaaugaagaucgguauaggcguccuucuaacuugguuaggacuaaauucuagaucaacaagucuaaguaugacauguaucgcuguagguuuaguaacgcuguacuuggguguaaugguacaagcagacuccggcuguguuauuaauuggaaagggagagaacuaaaauguggaucgggaauauucgugacuaaugaaguacacacguggacagaacaauauaaauuucaagcagacagcccgaaacgucuaagcgccgcaauagggaaggcaugggaagaaggcgucugcggaauaaggagcgccacaagauuagaaaacauaauguggaagcaaauaucaaaugaauugaaccauauauuauuagaaaaugacaugaaguucacugugguggucggagauguugcugguauacuagcacaagguaagaaaaugauccgaccucagccuauggaauauaaauauucuuggaaaaguuggggcaaagcaaaaauuauaggagcagacguucagaacaccacauucauuauagaugggccuaauacacccgagugcccagaugaccaacgagcuuggaacauaugggaaguagaagauuacggauuugggaucuuuacaacuaauauuuggcugaaacucagagauucauacacccaaguaugugaucauagauuaaugucagcagcaauaaaagauaguaaagcuguacaugcagauaugggauacuggauugaaucggaaaagaaugaaacauggaaacuggcgagggccagcuuuaucgaggugaagacguguauuuggccgaaaucacacacccuauggucgaaugguguguuagaaucugaaaugauaauuccaaagauuuaugguggaccuaucucucaacacaauuauagaccuggcuauuuuacacaaacggcaggccccuggcaccuaggaaaauuggaauuagacuuugaucucugugaagggacgacaguuguaguagaugagcauugcggcaacaggggacccucuuugagaacuacgacagugacaggaaaaauaauacaugaauggugcugcagaagcuguacgcuuccaccacugagauuuaaaggugaggauggcuguugguauggaauggagauacgaccaguuaaggagaaagaagaaaacuugguaaaaucuaugguaucugcaggaucaggcgaaguugacagcuuuucuuuaggcuugcuauguauaagcaucaugauugaagaagugaugagaucgagauggucucgcaaaaugcuuaugaccgguacacuggcggucuuuuucuuguuaaucaugggacaauuaacguggaaugaucuaauaagguuauguauaaugguaggagcaaaugcuucugauagaauggguaugggaacuaccuaccuggcuuuaauggcaacuuucaaaaugagaccaauguucgcagugggucuucuguuccgaagacugacaaguagagaaguccuccuguuaaccauaggacuuagucugguugcuucuguggagcuaccuaauaguuuagaagaacuuggugaugguuuagcuaugggcauuaugaucuugaaacuucugacggauuuucagucacaucaauuaugggcaacacucuuaucauuaacguucauaaaaacaacauuuucucuucauuaugcauggaagacuauggcgaugguuuuaucaauaguaucccuuuuuccacucugccucaguacgacaucccagaaaacuacguggcuuccuguccuuuuaggaucauugggauguaaaccccucacgauguuuuuaaucgcagagaauaaaauuugggggagaaaaagcuggccccuaaaugaaggcaucauggcaguugguaucguuucaauauuacuuagcgcacuguugaaaaaugaugucccccuagcagguccacuuauugcaggagguauguuaauugcuugcuaugugaucagugguucaucagcggacuugucgcuagaaaaggcagcagaaguauccugggaagaagaggcagagcacucaggggcuagccauaacauucucgucgagguccaggacgacggcacuaugaagauaaaggacgaggaacgggacgacacacuuacaauuuugcuaaaagcaacccuccucgcaguaucuggaguauacccacuaucaauuccagcaacauuauucgugugguacuuuuggcagaagaagaaacagaggagcggcguguugugggacaccccaucaccgccugaaguugaaagggcuguuuuggaugacgguauauaucgaauuaugcagcgaggauuacuaggccggucacaagucgguguuggcguuuuccaagaaaaugucuuccauaccauguggcaugucacaagaggggcuguguuaauguaucaaggaaaaagauuagaaccaaguugggcaaguguuaaaaaggauuuaaucagcuaugggggaggauggagauuacaaggaucguggaauacuggugaagaaguucaaguaauagccguagaacccggcaaaaauccuaagaacgugcaaacugcacccggaacguucaaaacauccgaaggcgagguaggagcgauugcacuagauuuuaaaccagguacgagcgguucuccgauaguaaauagagaagguaaaauagucggccuguacggaaacggcgucguuacaacgucggggacuuacguuucugcaaucgcacaagcuaaagcgagccaagaggggccuuuaccagaaauugaagaugagguuuuuagaaaacgaaaucucacgauuauggacuuacauccaggaucagguaagacaagacguuacuuaccggcgauaguaagagaggcaauaaagagaaaacuuagaacauuaauucuugcuccuacacgaguuguagcuucagaaauggcugaagcucugaaaggcaugcccaucagauaccaaacuacagcugugaaaucggaacacacagguaaagaaauaguagaccugaugugucaugcaaccuuuaccaugagauuauuaucuccaguaaggguaccuaauuauaacaugauaauaauggacgaagcacauuuuacggauccaaguaguauagccgcaagaggauauauaucgacaagaguaggaaugggggaagcugcugcaauauuuaugaccgccacgcccccaggaucaguagaggcuuuuccacaaaguaacgcugucauccaagacgaagaaagggauauaccagaacggucguggaacucuggguaugaguggauuaccgauuuuccaggaaagacgguaugguuuguacccucuauuaagagugggaaugacaucgcuaauugucuucguaaaaauggaaaaagaguuauccagcuaucgcgcaaaacuuuugacacagaguaucagaaaacuaaaaacaacgacugggacuacguuguaacuaccgacauuucagaaaugggagcaaacuuuagggcagacaggguaauagaucccagaaggugcuuaaaaccuguuauucugaaagauggaccagagcgagugauuuuagcgggaccaaugccgguaaccgucgcaucggcagcacaacgacgcggacgaauaggcagaaaucauaauaaggaaggagaccaauauauauacaugggucaaccacuuaacaacgaugaagaccaugcacacuggacagaagcaaaaauguugcuugacaacauaaacaccccagaagguaucauuccagcacucuuugaaccugaaagggagaaaagugcagcuauugauggugaauacagguuacgaggcgaagcucgaaaaacauucgucgaauuaaugcguagaggagauuuaccuguuuggcucagcuacaagguagcgucugaaggguuucaauauucugaccgaagaugguguuuugauggcgagcguaauaaccaaguucuggaagagaacauggauguagaaauuuggaccaaggagggcgaacggaaaaagcuaaggccacgcuggcuggacgcaaggacauauuccgaucccuuagcauuacgugaauuuaaagaauuugcggcugguagacggaguguaucaggagauuuaauuuuggagauaggaaaacuaccccaacaucuaacucaaagagcccaaaacgcucuagauaaucucgugauguuacacaacucagagcaaggagguagagcauaccgucacgcaauggaagaauuaccugacacgauagaaacacucauguuacuugcucuaauugccguuuuaacagguggcguaacguuauuuuucuuaagcgggagggggcuaggaaagacaucaauaggcuuauugugcguaauggcaucgagcguguugcuuuggauggcgucugucgagccacacuggauagcagcuagcaucauccucgaauuuuuccuaaugguauuauuaaucccagaaccugaucgacaaagaacaccccaggauaaccagcuugcuuaugugguuauugggcuauuauuuaugauauuaacaguagcagcuaacgaaaugggccuccuagagacaacuaaaaaggacuuagguauuggccauguggccguagaaaaccaccaucacgcagcaauguuagacguagaucuacacccagcuagugcauggacacuauaugcuguugcaacgacaauaauaacucccaugaugcgccauaccauagaaaacacuaccgcaaauauuucacuuacugcuaucgcgaaucaagcagccaucuuaaugggauuggacaaagguuggccaauaaguaagauggacauugguguucccuuauuagccuuagggugcuacucacaagugaauccguuaacacuaacugcagccguccucauguuagucgcacacuaugccauaauaggccccggcuuacaagcgaaagcuacacgagaagcgcaaaaacgaacagcagcgggaauaaugaaaaaucccacggucgaugguauagucgcgauagaucuggauccggugguguaugaugcaaaguucgaaaaacaauugggucagaucauguuguuaauccuauguacaagccagauauuauuaaugagaaccaccugggcacuuugugaaucuaucacucuugccacaggaccacucacuacuuugugggaaggcucuccugggaaauuuuggaauaccacaauagcaguuucuauggcaaauauauuuagaggcagcuacuuagcuggggcgggacuagcauuuuccuuaaugaagaguuugggaggaggaagacgaggaacaggugcacaaggggaaacauuaggugagaaauggaaaagacaacucaaccaacuuucgaaaucagaauuuaacacauacaaaaggucaggaauaauggaggucgaucgcucagaagccaaagaagggcuuaaaagaggugagacaacuaaacaugcgguuucucggggaaccgcuaaguuacguugguuugucgagagaaauuugguuaaaccugaagguaaggucauugacuuagggugugggcgaggagguuggucguacuacugugcuggacucaagaaagucacagaaguuaaagguuauacaaaaggaggacccgggcaugaggaaccaauaccaauggcuacguauggauggaacuuaguaaaacuucauagcggaaaagacgucuuuuucauaccaccggaaaagugcgauacauuauuaugcgacaucggggaaucaagcccaaacccaacaauagaagaaggaagaacacuacgcguguuaaaaaugguugagccgugguugagggggaaccaguucugcauuaagauacuaaaccccuauaugccgagugugguagaaacauuagaacaaaugcaaagaaaacauggagguaugcuugugcggaauccccuuucaagaaauucuacucaugagauguacuggguuucauguggaacugggaacaucguaagugcagugaacaugacaucuaggaugcuuuuaaauagauuuacuauggcgcaucgaaaacccacauaugagagggacguugacuuaggugcggggacacgucauguggcugucgaaccggaaguagcaaaucuugauauuaucggucagcgcauagaaaacauaaaacaugagcauaaaucaacauggcacuacgacgaagacaacccuuauaaaacuugggccuaucauggaucguaugagguaaagccuaguggcucagcaaguaguauggucaaugguguaguaaaacuuuugacaaagccaugggauguaauaccaauggucacacaaauagcuaugacugauacaacuccauuuggccaacaacgaguauucaaagaaaagguggacacuaggaccccaaaagcaaaaagagguacagcgcaaauuauggaagugacugcaaagugguuguggggguucuuaaguaggaauaagaaaccaagaaucuguacaagagaggaauuuacgaggaaaguaagaagcaaugcagcgauaggugcaguuuuuguagacgagaaucaguggaacucagcuaaggaagcaguugaggaugaaagauucugggacuuaguacaccgcgaacgugaauuacacaaacaagguaaaugcgcuacaugugucuacaacaugauggguaaacgagagaagaaauuaggugaguuuggaaaggcuaaaggaaguagggcaauaugguauaugugguuaggugcgcgauuucuugaguuugaagcacuugguuuuaugaaugaagaucacugguuuucacgagaaaacagccuuucaggagucgagggagaaggucugcauaaguugggcuauauccucagagauauaucaaaaauaccagggggaaacauguacgcagaugauaccgcuggaugggacacgcgaauaacagaagacgauuuacaaaacgaagcaaagaucaccgacauaauggaaccggagcacgcauuacuggcuaaauccauauucaaguuaacauaucaaaauaaaguuguacgcgugcaacgacccgccaaaaacggaaccgugauggacguaaucagcagacgagaucagagagguagugggcaaguagguacauauggauugaauaccuucacaaacauggaggcccaauuaauaagacaaauggaaucagaaggcauauuuagcccuagugaacuagaaacgccuaaccuagcuggccgaguccuugauugguuagagaaacacggcguugaacgccuaaaacgcauggcuauuucuggagacgauuguguuguaaaaccaauagaugaccgauuugccaccgcguuaacagcgcuuaaugauaugggaaaaguacgaaaagauauaccccaaugggaaccaucuaagggguggaaugauuggcaacaaguucccuuuuguucucaucauuuucaucaacuaauaaugaaagacgguagagaaauaguaguuccaugccguaaucaagacgaacucguagggcgcgcacggguuucgcaaggagcugguuggagucuacgagaaacggcaugccuugguaaaaguuacgcccaaauguggcaauuaauguacuuucauagaagagauuugagauuggcugcaaacgcaauauguuccgcagucccgguagauuggguaccaaccucgagaacaacauggucuauucaugcacaucaucaauggaugacgacagaagauauguugucgguauggaaccgcguguggauagaggaaaauccuuggauggaagauaaaacacacauaucaucguggggagaugucccguauuuagguaaacgugaagaccaaugguguggaagucuaauaggcuugacggcucgagcuacuugggcgaccaauauucaaguagcaaucaaucagguaaggcgcuuaauuggaaaugaaaauuaccuggauuauaugacaaguaugaaacguuuuaagaaugaaucagacccggaaggagcacugugguaa

SEQ ID NO: 21623 - RNA, 9879 nt, Artificial Sequence
  derived and/or modified CDS sequence (opt6) from DENV-1__FJ882527__SS-prME
uccgucacgauguuauuaauguugaugcccacggcuuuagcguuucaucuuacuacuagaggaggagaaccccacaugauugugagcaaacaagaacgagguaaaucguuacuguuuaaaacaucggcagggguaaacauguguacuuugauagcaauggacuuaggcgaauuuugugaagacacgaugacguauaaaugcccuagaauuaccgaagcggaaccggacgauguagauuguuggugcaacgcaaccgauaccuggguuacauacgguacauguucacaaacgggagaacaucgacgagauaaaaggagcguugcauuagcaccacauguuggacuagguuuagaaacuagaacugaaacauggaugagcucggaaggggcuuggaaacaaauacaacgaguagaaacuugggcgcuucgucacccgggauuuacuguuauugcucuauuuuuagcgcaugcgaucgguaccucaauaacgcaaaaaggaauaaucuuuauccuauuaaugcuagucaccccgucaauggcaaugagauguguaggaauagggucuagagauuuuguagaaggacucagcggagcaacuuggguugauguaguauuggaacacgguaguugcguaacaacaauggcuaaagauaaacccacgcucgacauugaacuuuuaaaaacugaagucacgaauccggccguacuaagaaaacuuugcauagaagcgaaaaucaguaauacaacaaccgacagucguuguccaacccaaggggaagcaacauuaguggaagaacaagacgcgaauuuugugugcagacgaacauuuguugacaggggauggggaaauggcuguggauuauuuggaaaggggucacuaauuacuugugcaaaguuuaaaugcguaacuaaacucgaagguaagacaguucaauacgaaaaucuuaaauauucugucauagucacaguucauacaggagaucaacaucaaguugguaaugaaucaacggaacacggcacuacugcaacgauaacaccucaagcaccuaguacagaaauucaauugaccgauuauggggcguuaacauuagacuguucuccaagaacuggauuagacuucaaugaaauggugcuacuuacgaugaaggaaaaaucauggcuaguucacaaacaaugguuuuuagaccucccuuuaccauggacaucuggggcgucaacgucacaagaaacguggaauagaaaagacuuguugguaacauuuaagacugcucaugcuaagaaacaagaaguuguaguauuagggucacaagaaggugcuaugcacacagcccugacuggagcuacagaaauucaaaccagugggacgacuacgauauuugcaggacauuuaaaaugcagauuaaaaauggauaaacugaccuuaaagggaauguccuacgucauguguacaggauccuuuaagcuagaaaaagaaguagcugaaacucaacacggcacaguguuaguucaaauuaaguacgaaggcacagaugcaccguguaaaauaccuuucaguacacaggacgaaaaaggcguaacccaaaacggacgucuaauuacagcuaauccaauagugacagacaaagaaaaacccguuaacauagaagcggaaccuccauuuggugaaaguuauauaguuaucggcgccggugaaaaagcacucaagcuaagcugguucaagaaaggaagcucaauugggaaaauguuugaagcaacagcucggggagcaagacgaauggcaauucuaggcgauacugcaugggauuucggaucgauuggugggguauuuacguccgugggaaaauuagugcaccaaauauuugguacagcauacgguguguuauuuucugguguuaguuggacaaugaaaauagguauaggcguauuauuaacuugguuaggacuaaauagcagaaguacaucuuuaagcaugacaugcauugcagugggauugguaacucucuaucuaggaguuaugguccaagccgauucaggaugugucaucaauuggaagggcagggaauuaaagugcggcuccggaauauuuguaacgaaugaaguccauacuuggacugagcaguacaaauuucaagcugacaguccuaaaagacucagcgcugccauugguaaggcuugggaagaaggaguaugcgggauucgaucagcgacaagacucgaaaauauaauguggaagcaaauaaguaaugagcucaaccacauuuuacucgagaaugacaugaaauuuacugugguaguaggggauguagcuggcauucuugcucaaggcaagaaaaugauccgaccacaaccuauggaauauaaguacucuuggaagucaugggggaaagcuaagauaauuggagcagacguacaaaacacaacguuuaucauagauggaccaaacacgccggaauguccagaugaucaacgcgcguggaauauaugggaaguggaagauuauggauucggaauuuuuacaaccaauauaugguuaaaacuuagagauuccuauacucagguuugugaccauaggcuaaugucagcugcuauuaaagauagcaaagcuguccaugcugacauggguuauuggauagaaagcgagaaaaaugagaccuggaaacuagcaagagcuaguuuuauagaaguaaaaacuugcauuuggccaaagucgcacacguuauggaguaauggaguacuagagagugaaaugauuauuccaaaaauauaugguggaccaauaucacaacauaauuaccggccaggauauuucacucagacagcagguccauggcauuuagggaaacuagagcuagacuuugauuuaugugaagguaccacaguagugguagaugagcauuguggcaauagaggaccuucacuaagaaccacgacagucaccggcaagauaauccaugagugguguuguaggucuuguacacugccaccuuuacguuuuaagggagaagacggauguugguaugguauggaaauaagaccaguaaaagaaaaagaagaaaaccuuguaaaaagcauggugucugcuggauccggggaaguggacaguuucaguuuaggucuacuaugcauaucaauaaugaucgaagagguuaugagaaguagauggucacgaaaaaugcuaaugacaggaacucuggcugucuucuuucuucucauaaugggacaauugacauggaacgauuuaauaaggcuguguauuauggucggugcaaacgcaagugaucgcaugggaaugggaaccacauauuuggcucucauggcuaccuuuaaaaugagaccaaugcuagcgguggggcucuuauuuagaagacugacuucucgagagguuuuauuacuaacgauaggauuaucguuaguagcaucuguugaauuacccaauucacuagaagaauuaggggaugguuuggcgauggguaucaugauacuaaaauugcuaacagauuuucaaagucaucaauugugggcuacguuacuuagucuuacguuuaucaaaaccacauucagccuccauuaugcauggaaaacaauggcuaugguacuaucaauuguaucacuauuuccuuuaugucucucgaccaccagucagaaaaccacgugguugccgguguuauuaggaagccuaggguguaaaccccuagcaauguuuuuaauugcugagaacaaaaucuggggcagaaaauccuggccuuuaaacgaagguauaauggcgguaggaauaguuucgauccuguuaagcucucuccuaaagaacgacgucccacuagcaggaccacuaauugcaggagguaugcuaauagcaugcuacgucaucuccggaaguucagcugaucucucccucgaaaaggcagcugaaguaaguugggaagaggaggcugaacauucuggugcaagccacaacauacucguugaaguccaagaugaugguaccaugaaaauaaaagaugaagagagggacgacaccuuaaccauauuacucaaagcaacuuugcuagccguauccgggguauauccacugucaauaccagcaacauuguuuguuugguacuuuuggcaaaagaagaagcaaagaagcggaguacucugggauacgccuuccccuccagagguagagcgcgcaguucuugaugaugggauuuacagaauaaugcagagaggguuacuaggucgaagucaagugggcguuggaguauuucaagaaaauguauuucacacaauguggcacguaacgagaggggccguacucauguaccaagggaaacgacuggagccuaguugggcaagcguuaagaaagauuuaauaaguuauggcggaggguggcgauuacaggguuccuggaauaccggugaagaaguacagguaaucgcuguagagccugguaaaaauccuaaaaauguacaaacagcgccagggacguuuaaaacaagugaaggagagguuggcgcuauagcucuugacuucaagccggggacuucaggaucuccaaucguaaaucgugaagggaagauagugggccuauacggaaacggagugguuacgaccaguggaaccuauguguccgcuauagcacaggcuaaagcuagucaagaagggccuuuaccugagauagaagacgaaguguuccgaaaaaggaaucucacgauuauggaucugcaccccgggagcggcaaaacuagacgcuaccuaccagcaaucguaagggaggcaauaaaacguaaauugagaacccuaauauuggcaccaacccguguuguugcgucagaaauggcagaggcuuuaaaaggaaugccgaucagauaccaaacaacugccguuaaaucugaacauacaggaaaggagauuguggauuugaugugccaugcaacuuuuacaaugcgauuacuaaguccagugaggguaccuaauuauaacaugauaauaauggacgaagcucacuuuaccgacccaucuucuauagccgcaagaggauauauuucaacacgcguagggaugggagaagcagcagcaauauucaugacagcaacaccaccaggcagcguggaagccuucccacagaguaacgcaguuauucaagacgaggaaagagacauuccagaacguucauggaauaguggauaugaguggauuacugacuuuccuggaaaaacagucugguuuguaccaucuauaaagucaggaaacgauauugcgaacugucuucguaaaaauggaaaacgaguuauacaacuaucucguaaaacuuucgauacugaauaccagaaaaccaaaaauaacgauugggacuauguuguuacaacagauauuagcgaaaugggagcgaauuuccgagcugauagagucauagacccacgucgauguuuaaagccaguuauuuuaaaggauggucccgaaaggguaauuuuagcuggaccaaugccuguaacaguagccuccgcagcacagcgucgcggacguauaggaagaaaccauaauaaagaaggagaucaguauauuuacaugggacaaccucucaauaaugacgaagaccacgcucauuggacagaggcaaaaaugcuuuuggauaacauaaauacuccagaggguaucauuccagcauuauucgaaccagaaagagaaaagucagcugcaauagauggggaguaccgccuaagaggcgaagccaggaaaacuuuuguagaacuaaugagacguggagaccucccggucuggcuaaguuacaaaguggcuucugaaggauuucaguauucugaccgcagaugguguuuugauggugaacgaaauaaccaaguucuagaagaaaauauggauguagagauauggacgaaagaaggggagaggaagaaauugaggccuagaugguuagaugcgagaacguacucagauccauuggcguuacgggaauuuaaagaauuugcagcaggaagaagaucagugucuggagaucuuauccuagaaauuggcaaauuaccccaacauuuaacacagcgcgcacaaaacgcccuugauaaccuuguaauguuacacaacuccgagcaagguggacgugcauauagacacgccauggaggaauuaccagacacuauagagacgcucauguugcuagcgcucauagcaguacuuaccgguggagugacauuauucuuuuuaaguggccgaggacuggggaaaacgaguauuggguugcuuugugucauggcaaguagcguauuauuauggauggcaucaguugagccucauuggauagcugcuucaauaauauuagaguucuucuuaaugguguugcugauuccagaaccagacaggcaacgaacuccucaagauaaucaauuagccuacguagucauaggacuguuauuuaugaucuugacgguggcagccaacgaaauggggcuauuagaaacuacgaagaaggaccuuggaauagggcaugucgcgguagaaaaucaccaucaugcagcaaugcuggacgucgauuugcauccagcaucagcauggacguuauaugccgucgccacaacgauuauuacacccaugaugaggcacacaauagaaaacacgacagcaaauauaucucuaacugcaaucgcaaaucaggcagcaauauuaauggggcuagauaaaggauggccgauaaguaagauggauaucggaguuccucuacuagcucucggaugcuacucacaaguuaacccucuaacacuuacggcagcgguacuaaugcuaguugcacauuaugcaauaauaggcccaggccugcaggcuaaagcaacaagggaagcacagaaacgaacggccgcaggaauuaugaaaaacccaacagucgacggaauuguugcgaucgaccucgauccuguaguauaugaugccaaauuugagaaacaacuugggcaaauuauguuacuaauacuaugcaccucgcaaauacuauugaugcggacuacuugggcucuuugugagaguauaacccuugccacagggccauuaacuacauuaugggaaggaucaccgggaaaguucuggaacacaacgauagcgguaucaauggcuaauauuuuucgagguucauauuuggccggugcaggcuuagcguucagucugaugaagaguuugggaggaggacgacgcggaacaggugcacaaggcgaaacauugggagaaaaauggaaacgacagcucaaucaauugaguaaaucggaauuuaacaccuauaaacguucagguauaauggagguugacagaucggaggcaaaggaagguuuaaaacguggagagacuacuaaacacgcgguuagucgcggaaccgcaaaacuaagaugguucguugaaagaaauuuaguaaaaccagagggaaaagucauagaucuugguuguggaagaggaggaugguccuauuauugcgccggacucaagaagguaacagaagucaaagguuauacgaaaggcggacccggucacgaggaaccaauucccauggcaaccuacggcuggaacuuaguaaaauuacauagugguaaagaugucuucuuuauuccuccugagaaaugugacacauuauugugugauauaggugaaaguaguccaaauccgacuaucgaggaggguaggacuuugaggguucuaaagaugguagaacccuggcuuagaggaaaccaauuuuguauaaaaauccuuaacccuuacaugccuuccguaguggaaacacucgaacaaaugcagcgaaaacacggagggaugcugguacgcaauccauuaucacgaaacaguacacacgagauguauugggugagcugcggaaccgguaauauagucagugcaguaaacaugacaucccguauguuacugaaucguuuuacaauggcccauaggaaaccaacuuaugaaagagacguagacuugggagcggguacuagacauguagccguugaaccagaaguagcuaacuuagauauuauuggacaacgaauagaaaauaucaaacacgaacauaagaguacuuggcacuacgaugaagauaaccccuacaaaacuugggcauaccaugggaguuaugaggugaaaccaucagguagcgcauccucaauggugaauggcgucgucaaacuauugacaaaaccaugggauguaauaccaaugguuacacaaauagcaaugacagauacgaccccauucggucagcaacgcguguucaaggaaaaaguugauacccgaacgccaaaggcaaaaagggguacagcccaaauaauggaaguaacugcaaaaugguuauggggauucuugucuagaaauaagaaaccuagaauaugcacucgcgaagaguuuacgcgaaagguaagaucaaacgcugccaucggugcaguauuugucgaugaaaaucaauggaacucggcaaaggaggccguagaggaugaaagauucugggacuuaguucauagagaaagggagcuccauaagcaaggaaaaugcgccacaugcguuuacaacaugaugggaaagcgggagaagaaacucggagaauuugguaaagcuaagggaucaagagccaucugguacauguggcuaggcgcacgauuuuuagaguucgaagcauuggguuucaugaaugaagaucauugguucucucgagaaaacucuuuaucugguguugaaggggagggacuacacaaguuaggguauauauuaagagauauaucgaaaaucccagguggcaacauguacgccgaugauacugcuggcugggauacccggaucacagaggacgauuuacaaaacgaggcuaagauaacggauauaauggagccggaacacgcauuguuggcgaaaucaaucuuuaaacuuacuuaucaaaauaagguggugagaguucaacgaccagccaaaaacggcaccguuauggaugucauaucgaggagggaucaaagaggaucuggucaggucgguacuuacggacugaacacauuuacgaauauggaagcacaacuaauuagacaaauggagucagagggaaucuucucuccaucagaacuagaaaccccuaauuuagcagggagaguacuugauugguuggaaaaacaugguguugaacgcuuaaaaaggauggcgaucaguggagacgauugcguuguaaaaccaauagacgaucguuuugcuacagcacuuacagcacucaacgacauggggaagguuagaaaggacauuccacagugggaaccaucuaaaggcuggaaugauuggcaacaagucccuuucugcagucaucauuuucaccaacucauuaugaaagacgguagagaaauuguagugcccugccgaaaucaagaugaauugguuggacgagcucgaguaagucaaggcgcuggauggagucuuagagaaacagcuugucuagguaaaaguuaugcgcaaauguggcaauugauguacuuucaccgcagagaucuaagauuggcagcuaaugcuauaugcucagcugucccaguugacuggguaccgacaaguagaacgacguggaguauacaugcacaccaccaauggaugaccacagaggacaugcugaguguguggaaccgaguauggauagaagaaaacccauggauggaggauaaaacgcacauuucuucuuggggagacguuccauaccuagguaaaagagaagaucaguggugugguucauugaucgguuuaaccgcaagagcuacgugggcuaccaauauacagguggcaauaaaucaggugcguagauuaaucggcaacgaaaauuaccucgacuacaugacgucuaugaaaagguuuaagaaugagagcgauccagagggagcuuuaugguaa

SEQ ID NO: 21624 - RNA, 9879 nt, Artificial Sequence
  derived and/or modified CDS sequence (opt6) from DENV-1__FJ882529__SS-prME
aguguuacuauguuguuaaugcugaugccaacugcacuugcauuucacuugacaaccagggguggagaaccacacaugauuguuucaaaacaagaacgcggcaagagcuuacuuuucaaaacaucugcgggagugaauaugugcacucuaauagcuauggaucuuggagaauuuugugaagauacaaugacauacaaaugcccaaggauaacggaagcugaaccagacgacguagauugcugguguaacgccaccgauacuuggguaacauacgggacuugcucccaaaccggggaacaucgccgugacaaaagaucuguugcguuagcuccgcauguagggcuaggacucgaaaccagaacugaaaccuggaugaguucugaaggagcuuggaaacaaauacaaagaguagaaacuugggcucuacgucacccaggguucacugucauagcucuauuucucgcgcaugcuauuggaacuagcaucacacaaaaagggaucauauuuauauugcuuauguuaguaacuccaaguauggcaaugaggugcguugggauuggauccagagacuuugucgaaggacuuuccggugcuacauggguagacguagucuuggaacacggcucaugugugacaacuauggcgaaagauaaaccuacauuagauaucgaacuacucaaaacggaagucacaaacccugccguauugaggaaauuguguauugaagcaaaaauuucaaauacaacaacagauagucgauguccuacgcaaggggaagccacuuugguagaagaacaagaugcuaacuuuguuugucgaagaacuuuugucgauagagguuggggaaacggcugcggucuuuuugguaaaggaaguuuaaucacaugugccaaauucaaaugugucaccaaauuggaaggaaaaauaguucaauacgaaaauuugaaguacuccguaauugugacaguacacacgggcgaucagcaccaaguuggaaacgaguccacagaacacggaacuacagccacuauaacgccacaagcacccagcacagaaauacaacugacugacuacggggcacuuacccuagauuguuccccaagaacuggacuggauuuuaaugagaugguucuauuaaccaugaaagagaaaucauggcuaguccacaaacaaugguuccuagacuugccucuucccuggacgucaggagccaguacaucucaggaaaccuggaacaggcaagaucuauugguuacauucaaaacagcacacgccaagaaacaagaaguagucguacugggaucacaagagggagcaaugcauaccgcacuuaccggugcuacugaaauacaaacaagugggacuacuacaaucuuugcgggacacuugaaaugcagacuuaaaauggacaaauuaacccuaaagggaauguccuaugucaugugcacugguucuuucaaacuagaaaaagaaguggcagagacucaacauggaacuguguugguacaaauaaaauaugagggaacagaugcacccuguaaaauaccguuuucaacccaagaugaaaaaggagucacacagaaugggcguuuaauuacggcuaaucccauaguaacggauaaggaaaaacccguuaauauagaggcugaacccccauucggagagaguuauauagucaucggcgccggggaaaaggccuuaaaacuuucuugguucaagaaagggaguuccaucgguaagauguuugaggcaaccgcuagaggugcacguagaauggcuauauuaggcgauaccgcaugggauuucggguccauuggaggagucuuuaccagugucgguaaauugguacaccagaucuuuggaacagcauauggcguucuguuuaguggcguaucuuggacaaugaaaauuggaauugguguccuacuuacuugguugggccugaauagcaggaguacaagucuaucgaugacgugcaucgcgguuggcuuagugacgcuuuauuuaggaguaaugguacaagcagauaguggaugugucauuaauuggaaagggcgagaguuaaaaugcggauccggcauauuuguaacaaaugaaguacauacuuggacagaacaauauaaguuucaagcugauuccccgaaaaggcucucagccgcaauagguaaggcuugggaggaagguguauguggaauacgcagcgccaccagauuggaaaacauaauguggaaacaaauaucaaacgaacugaaucauauuuuacuagagaaugauguuaaauuuacaguggucguaggggauguagcaggcauacuagcucaaggcaagaaaaugauaaggccgcaaccaauggaauacaaauauagcuggaaaagcuggggcaaagcaaagauaauaggggcagacguacaaaauacaacuuucauaaucgauggcccgaacacuccugaauguccagaugaccaaagagcuuggaacauuugggaaguagaagauuacgguuuuggaauauucacgacuaauauuuggcucaaacuucgagauagcuacacacagguuugcgaucaccguuuaaugagugcggccaucaaggauaguaaggcuguucaugccgacaugggauauuggauagaaucagagaaaaaugagacauggaaacuugcaagagcaaguuuuaucgaagucaagacgugcauuuggcccaaaagucauacacucuggagcaauggcgucuuagaaagcgaaaugauaauaccaaaaauauacggcggcccaauaucucagcauaauuauagaccuggauauuucacccaaacagcgggccccuggcaucuaggcaaauuggagcuugauuuugaccucugcgaaggcacuacgguaguaguugacgaacauugcggaaacagagggccaagucuucgaacgacaacaguaacagggaaaauaauucacgaauggugcugccgauccuguacguuaccaccacuucgauucaaaggagaagauggcugcugguacgggauggaaauaaggcccguaaaagaaaaagaagaaaauuuagugaaaucuaugguaucagcaggaucuggcgagguggacaguuuuaguuuaggguuacucugcaucucuauaaugauugaagagguaaugagaucaagauggaguagaaaaauguugaugacagggacccuggcaguauuuuucuuacugauaaugggucaauugacuuggaacgaucuaauacguuuauguauuauggugggagcuaaugcuucagacagaaugggaaugggaacuacauacuuagcauuaauggcaaccuuuaaaaugagaccaauguucgcaguaggauuacuuuucaggcgguuaacuucucgggaaguauuauugcuuacaauuggacuaucauugguugcaucaguagaacugccaaauaguuuagaagaacucggggaugggcuagcuaugggcauaaugauauuaaaacuacuaacagauuuccaaagccaucaguugugggcgacauugcuaucauuaacauucauaaagacgaccuucagccugcacuaugcuuggaaaacaauggcaaugguuuuaucgauagucaguuuauuuccacucugucuaucgacaacuucacagaaaacaacauggcuaccgguuuuauuagguaguuuaggauguaaaccauuaacaauguuccuaauagcugaaaacaaaauauggggaaggaagaguuggccacuaaaugagggaauaauggcagucggcaucguaagcauuuuguuaaguucgcugcucaaaaaugaugucccguuagcaggccccuugauugcggguggaauguuaauugcaugcuacguaauuaguggauccagugcugauuugucuuuagagaaagcggcugaaguaucgugggaagaagaggcagaacauaguggagcuucgcacaacauacucguugaagugcaggaugauggaaccaugaaaauuaaagaugaagaacgcgacgauacucugacgauccuacucaaagcuacucuauuagcaguuagcgguguauacccacuuaguauaccugcaacucuuuucguaugguauuucuggcagaaaaagaaacaaagaucugggguccuaugggacacgccuagcccaccagaggucgaaagggcagucuuagaugacgggauauaucgaauuaugcaaaggggauugcucggaagaucacaaguuggaguaggcgucuuccaagagaauguuuuccacaccauguggcacguaacacguggagcuguacugauguaccaagggaaaagacuggagccaagcugggcaucuguaaagaaagaucugauaucauacgguggcggcuggcgacuacaagguucauggaacacaggugaagagguacaggucaucgcugucgaaccugguaaaaaucccaaaaauguacaaacagcaccgggaaccuucaaaacaucagaaggugaaguuggagcaauagcucuagacuuuaaaccaggcacauccggaaguccgauaguuaaucgcgaaggaaagauaguaggucuguacgggaacggagucguuacgacaucggguacauacgucucggcgauugcucaagccaaagcgagccaggaggguccccugccugaaaucgaagaugaaguuuucagaaaacgaaaucuuacaaucauggauuugcauccaggaagugguaaaaccagacgauaucugccagcgauuguucgugaggcaaucaaacgaaaauuacguacccugauuuuagcucccacccgcguagucgcaucugaaauggcagaagcauuaaaaggaaugccuauaagauaccaaacaacugcaguuaaaucagaacacacagguaaagagauaguugaccuaaugugccaugcgaccuucacaaugagacuacuguccccugugcgugucccaaauuacaauaugauuauuauggacgaggcacauuuuaccgaucccucgucuauagccgcccguggcuauauuucaacuaggguggggaugggugaggcggcagccauuuuuaugacugcuacuccacccggaucaguagaagcauucccccaaucgaaugcaguuauacaagacgaagaaagagauauaccggaaagaucguggaacucagguuaugaauggaucacggauuuuccgggaaaaacagucugguuuguuccgaguauaaaaucaggaaaugacauugccaauuguuuaagaaagaauggcaaaagaguuauucaauuaucucgaaaaacuuucgauacagaguaccagaaaaccaaaaacaacgacugggauuauguagucacaaccgauauuagugagaugggugcuaacuuucgcgccgacagggucauugauccaagaagaugccuaaagccaguaaucuuaaaagauggaccagaaagaguaauacuagcuggaccaaugccagucacuguugcuagugcagcacaaagaagaggacgaauuggcaggaaucacaacaaggaaggggaccaauacauuuacaugggccaaccuuugaauaaugaugaggaucacgcccauuggaccgaagcaaaaaugcuacuugacaacauaaauacgccagagggaaucauuccagcucuuuuugagccugaaagagaaaaauccgcagcaauugacggagaauauagauuaagaggagaagcaagaaaaacuuucguggaauuaaugagacgaggcgacuuaccuguaugguuaaguuacaaaguagcaagugaaggauuucaauacucagauagaagaugguguuucgauggagagagaaacaaucagguacuugaagaaaauauggacguagaaauauggacaaaggaaggcgaacgcaagaaauuacgcccacgauggcuagaugcaaggacuuauagcgauccgcuugcauuaagggaauuuaaagaauuugcugcagggcgacguucaguuaguggcgaucuuauucuagagauaggaaaacugccacagcauuugacacagcgagcucaaaaugcauuagauaaucuugugaugcugcauaauucagaacaagguggucgagcauacagacacgcuauggaagaguuaccugauacuauagaaacgcugaugcuuuuagcgcugauugcaguauuaacugguggggucacauuguucuuccugucaggacgaggccuaggcaagacaagcauaggacuacuguguguuauggcaucaaguguauuauuauggauggcuagcguagagccccauuggauagcagcuagcauaaucuuagaguucuuuuugaugguauuguuaauaccugagccagauagacagagaacuccucaagacaaccaacuggcauauguggucaucggauuacuuuuuaugauacuuacaguugcggcgaaugaaaugggacuucuugaaacaacaaagaaggauuuagggauaggccauguugcaguagagaaucaucaccacgcggcaaugcuagacguagaccuacauccagcgagugccuggacgcuauacgcuguagcaacuacuaucaucacgccaaugaugcgacacacaaucgaaaacacaacagcgaauauaucguuaacugcuauagcuaaccaggcagcaauacuuaugggucuagacaaaggguggccuauaucaaaaauggauauaggugugccacuacuggcguuaggguguuacagucagguuaauccauugacauuaacggccgcuguccuuauguugguagcucacuacgcaauuauuggaccuggacuucaggcaaaggccacucgugaagcccagaaaagaacagccgccgguauaaugaaaaacccaaccgucgacgggauugucgcuaucgaccuugaucccguuguauaugaugcgaaauuugaaaaacaacucggccagaucauguuacucauacugugcacaagccaaauauuauuaaugaggacgacuugggcucuaugugaaagcauuacucuagcaacggguccauugacaacacuuugggaaggaucaccuggaaaauuuuggaacacuacaauagcagucaguauggcgaauauuuucagagguucuuaucuugcuggagcaggauuagcuuuuagucuaaugaaaucacuaggcggcggaagacggggaacuggagcgcagggagaaacacucggugaaaaauggaaacgccaacucaaucagcuuagcaagagcgaguucaacacauacaaacgcagcgguauuauggagguagauagaucagaagcaaaagaaggccuaaaaaggggagaaacuacuaaacaugcaguuucaagggguacagcuaaacugcguugguuuguggagcgaaaucucguuaagccugagggcaaaguuauagacuuagguuguggucgcggaggcuggaguuauuauugugcgggauugaagaaaguuacagagguaaaaggcuacacuaaggguggcccuggacacgaggagccaauaccgauggccacguacggauggaaucuagugaagcugcauucgggaaaagauguguucuucauacccccggaaaaaugugauacacuacugugugauauaggugagagcagcccaaaccccaccauagaggagggacgcacacugaggguauugaaaaugguagagccuuggcugagagguaaccaguucuguauaaagauccuuaacccauauaugccuagcguaguagaaacacuagaacaaaugcaaagaaagcacggcgggaugcuaguucggaauccuuuaucacgaaacagcacgcaugaaauguauuggguaucaugcgguacaggaaacauaguuuccgccguaaacaugacaagucgaauguugcucaauagguuuaccaugguacaucggaaaccaacauacgaaagagauguggauuuaggagcgggcacacgucauguugcagucgaaccggaaguagcaaauuuggauauuaucggacagagaauugaaaauaucaaacaugaacauaaaagcacauggcauuaugaugaagauaauccauacaagacuugggcauaucauggcaguuaugagguaaaaccaagcggcucagccucgucgaugguuaacgggguuguaaaacuguuaacuaaaccaugggacguuauccccaugguaacucaaauugcuaugaccgauacaacgccauucggacaacagagagucuucaaagaaaagguugacacaaggacaccaaaagccaaacgugggaccgcacaaauaauggaaguaacagcaaaaugguuauggggauuuuuaucaaggaauaagaaaccuaggauaugcacacgagaagaguucacaagaaaaguuagaucaaaugccgcgauaggagcaguauuuguagaugaaaaccaauggaacucagccaaggaagcaguggaggacgaaagauuuugggaucuuguacacagagaaagagaacuacacaaacaagguaaaugugcaacaugcguguacaacaugauggggaaaagagaaaagaaacuuggugaauuuggaaaagcgaaagguucuagagcaauaugguacaugugguugggcgcaagguuccuagaguucgaggcacuagguuucaugaaugaagaucauugguucaguagagaaaacucauuaucagggguagaaggagaaggauuacauaagcuaggauauauucuuagagauauuucaaaaauaccagguggaaauauguacgcggacgacacugccggcugggacaccaggauaacggaggaugaccugcaaaaugaagcuaaaauaacagauauaauggaaccagaacaugcuuuguuagcgaaaucuauuuucaaguugaccuaccaaaauaaaguaguaagggugcaaaggccagcgaagaauggaaccguaauggauguaauuagcagaagagaccaaagaggaagcggacagguagguaccuacggcuuaaacaccuucacuaacauggaggcccaacucauaagacaaauggaaucagaagguauauuuucgcccuccgaauuggagacuccuaacuuagcgggacgcguacuugauuggcuugaaaaacacggagucgaaaggcugaaaagaauggcaauaucaggcgaugacugugugguuaaaccaaucgaugacagguuugcaacagcauugaccgcacuaaaugauauggguaagguacgaaaggacaucccacaaugggagccgaguaaagguuggaaugauuggcagcaaguuccuuuuugcucucaucacuuucaccaacuaauaaugaaagacggcagagaaauaguuguaccuuguagaaaccaagacgagcuaguugggagagcacgaguaucccaaggugcuggcuggucacuaagggaaacggccugucuggguaaaucuuaugcacaaauguggcaacucauguauuuucauagacgcgaccuaaggcuagccgcaaaugcuauuuguucugccguaccaguggauuggguuccuaccagccgaaccacauggaguauucaugcacaucaucaguggaugacuaccgaagauauguugucgguuuggaaccgcguauggauagaagagaauccuuggauggaagacaagacacacauaagcucauggggcgauguuccuuaccuggggaaaagagaagaccaauggugcgguucacugauaggauugacugcccgggccacaugggcuacaaauauacaaguggccauaaaucaaguuagaagauugauaggcaacgaaaauuaucuggauuacaugacuucuaugaaaagguuuaaaaacgagagugacccagagggagcauuaugguaa

SEQ ID NO: 21625 - RNA, 9879 nt, Artificial Sequence
  derived and/or modified CDS sequence (opt6) from DENV-1__FJ882530__SS-prME
ucagugacgaugcuuuuaaugcuaaugccaacggcauuggcguuucaucucacuacuagaggaggugaaccccauaugaucguaaguaaacaagaacgagguaaaucucuacuauuuaaaacuucagcggggguaaauauguguacccucauugcuauggauuugggggaauuuugugaagacacgaugacuuacaaaugcccacgaauaacugaagcggaaccagaugauguagauugcugguguaacgcgacagauacauggguaacguacggaaccuguucgcaaacuggcgaacaucgcagggacaaacgauccguagcucuagcaccucauguagguuugggguuagaaacaaggacagaaacguggaugucuucggaaggugcauggaaacaaauccaacgcguugagaccugggcauuacgacauccggguuuuacuguaauagcacuguuccuggcucacgcaauagggacuagcauuacccagaaagggauuauauucauacuucucaugcuaguaacuccaagcauggcgaugagauguguugggauaggaucuagagauuucguugaggguuuauccggagcaacauggguagauguugugcucgaacacggaucgugcguuacuacgauggcaaaagacaaaccuacgcuugauauagaguuacuuaaaaccgaaguaacaaaccccgcgguguuacggaaacuuuguauagaagccaaaauaucuaacacuacaaccgacaguagauguccaacucaaggcgaagcgacucuugucgaagaacaagaugcuaauuucguaugucgucgaacauucguagaccguggauggggcaacggauguggacuuuucgguaaaggaucccugauaacuugcgcuaaauuuaaauguguaaccaaauuagaagguaaaacaguacaauacgagaauuuaaaauauagugugauuguaacaguacauacuggggaccaacaucaaguggguaaugaaucgacagagcacggaacaacugcaacuaucacaccucaagccccuucuacagagauucaacucacagauuacggcgcccuaacucuggauuguucgccuagaacaggucuggauuuuaaugaaaugguauuacuuacaaugaaagaaaaaucaugguuaguucauaaacaaugguucuuggaucuuccacuaccauggacaucgggcgcaagcacaagucaagaaacguggaaucggaaagacuugcuagugaccuuuaaaacugcucaugccaagaaacaagaagucgucgugcuuggaagucaggaaggugccaugcauacagcuuuaacgggcgcaacagagauacaaacaagugguacaacuacuauauuugcggggcauuuaaaaugucgacucaaaauggacaaauuaacacuaaaagggaugagcuauguuauguguacgggaucauucaaauuagaaaaagaaguggcagagacacaacauggaacaguccuaguucaaauuaaauacgaagguacggaugcaccauguaaaauacccuucucaacccaagacgaaaaaggaguaacucagaacggcagacucauaacagcgaaccccauuguaacagauaaagagaaaccaguuaacaucgaggcugaaccaccauucggagaaaguuacaucguuauaggggcaggagaaaaagcacuaaaguuaucgugguucaagaagggaagcucaaucggcaagauguucgaagcaacagcacgaggagcgcgaaggauggccauacucggcgacacagcgugggauuuuggaaguauaggagggguuuucaccaguguugggaaauuaguucaccaaauuuuugguacggcuuacgggguauuguucagugguguaucuuggaccaugaaaauagggauaggggugcuauuaacguggcuuggucugaacucacggagcacauccuuaucaaugaccuguauugccguaggccuaguaacccucuacuuagguguuaugguucaagcagauagcggcugcguuauaaacuggaaaggcagggaacuaaagugcgggaguggcauuuuuguuacaaacgagguucauacauggacagaacaauauaaauuucaagcagacagcccaaaacgauuaucugcagcuauugguaaggcaugggaagaaggcgucuguggcauucgaagugccacgcgccuagaaaacauaauguggaaacagauaucgaacgaacuaaaccauauauuacuggaaaaugacaugaaauuuacaguuguaguaggagaugucgcagguauauuggcccagggcaagaaaaugauacgaccacagccuauggaguauaaguauaguuggaagaguuggggaaaggcaaagauuauaggagcagauguacaaaacacgacuuucaucauugacgggccaaauacuccagaaugcccugaugaccaaagagcuuggaacauuugggaggucgaagauuacgguuucggaauauucaccacaaacauuugguuaaaacugagagauucccauacucaaguaugugaucaucguuuaaugucugccgccauuaaagauagcaaagcaguucaugccgauaugggcuacuggauagaaagcgagaaaaaugaaacuuggaaauuagcacgugcuaguuuuauugaaguuaaaacauguauuuggccaaaaucucacaccuuauggagcaauggaguauuagaaucugaaaugauaaucccuaaaaucuaugggggaccuauaagccaacauaacuaccguccaggcuacuucacucagaccgcagguccauggcacuuaggaaaauuagaacuagauuuugacuuaugugaaggaacaacuguugucguugacgaacauuguggaaacagggguccgucguugaggacaacgaccgugacugguaagaucauacaugaguggugcuguaggucaugcacauuaccuccucuucguuucaaaggcgaagauggauguugguauggcauggaaaucaggcccguaaaagagaaagaggaaaacuuaguaaaaagcauggucagcgcugguagcggugaaguugauagcuuuucacuaggguugcucuguauaucgauuaugauagaagaagugaugagguccagauggucucguaagauguuaaugacugggacacuagcagucuucuuuuuauuaauuaugggucagcugacauggaaugaccucauccgacuuuguaucaugguaggagcaaaugccagcgaucggaugggaauggguacgaccuaccucgcguuaauggccacauucaaaaugaggccaauguuugcaguugguuuauuauuccggagacuaacaagcagggaaguauuauuauugaccauuggauuaucgcuuguagcaaguguagaacuaccaaacaguuuagaagaguuaggcgauggcuuagcuaugggaauaaugauauuaaagcuacuuacagauuuucaaucacaccaguuaugggcaacguuacugagccuuacguuuauuaagacgaccuuuucucuacauuacgcguggaaaacaauggcuaugguucuaucuauaguaucucuuuuuccguugugucugucuacaacaagucaaaagacaacaugguuaccuguucuucucggaucucuaggauguaagccacucacuauguuuuuaauagcggagaacaagauauggggacguaaaucauggccauuaaacgaaggaaucauggcgguuggcauaguaaguauacuguuaaguucgcuuuugaaaaaugauguacccuuagcaggcccucucaucgcaggaggaaugcuuauagcuugcuacguaaucucaggcuccagugcggaucucucacuagaaaaagcagcagaaguaagcugggaagaggaggcagaacauagcggagcgagucacaauauauuagucgaaguucaggacgaugggaccaugaagauuaaagaugaagaaagggacgauacgcucacuauacuacuaaaagcaacguuacuagcaguuaguggaguauauccauuaaguauacccgcgacgcuuuucguaugguauuuuuggcaaaagaagaaacaacguagugguguccuuugggauaccccuagcccaccagaaguugaaagagcuguauuagaugauggaauuuacaggauaaugcagcguggccuacuaggaagaucccaaguaggugucggaguuuuucaagaaaauguuuuccauacaauguggcaugucacuagaggcgcaguuuuaauguaucaaggaaaacguuuagaaccgucaugggcaucgguuaagaaagaccuaaucucauauggaggcgguuggcguuuacaagguaguuggaauacgggugaggaaguacaaguuauugcuguugaaccaggcaaaaaucccaaaaaugugcagacagcaccugggacuuuuaaaaccucggaaggagagguaggagcaauagcacuagacuuuaaaccaggaaccagcggaucaccaauagugaacagagaagguaaaaucgucggauuguaugguaaugguguaguuaccacuucugggacauauguuucagcaaucgcucaagcaaaagcaucacaagaaggaccccuucccgaaauugaagaugaaguauuucgaaaacguaaucugacgauaauggaucugcacccugguagcgguaaaacccgacgcuaucuuccagccauugugagagaggcgaucaagagaaaacuaagaacauuaauucuagcaccaacacguguaguagcuucagaaauggccgaggcauuaaaggguaugccgauaagauaucaaacuacugccguaaaauccgaacacacggguaaagagauuguugacuugaugugucacgccaccuuuacaaugagacuacucuccccgguaagaguacccaacuacaauaugauaauaauggaugaagcgcauuucacugacccuucaucaauagcagcaagaggauacauuucgacuagaguagggaugggugaagcagcugcuauuuucaugacugcgacgccuccuggaucagucgaagcauuuccgcaaagcaacgcugucauccaagacgaagaaagagauauaccagaacgaagcuggaacucaggauacgaguggauuaccgacuuucccggaaaaaccguaugguuuguuccuaguauuaaaucagggaaugacauugcgaacugccuucguaagaacggaaagagggugauacagcuaaguaggaagacauuugauacugaauaucagaaaaccaaaaauaacgauugggauuauguuguaacaaccgacauuucggagaugggagcgaacuucagagccgaccgaguaauagacccacgaagaugcuuaaaaccggugauccuaaaggacggaccugagagaguuauauuggcgggaccuaugccugucacgguagcgucugcggcacaaagaagagguagaauugggcguaaucacaauaaagagggagaccaauauauuuauaugggccaaccauuaaacaacgaugaagaucaugcucacuggacugaagcgaagauguuacuugacaauauuaacaccccagagggaauaauaccagcacuguuugagccagaacgcgagaagagugcagcuauugauggcgaguacaggcugaggggagaagcaagaaaaacguucgucgaacuuaugcgaaggggcgacuuaccgguaugguuaucuuauaaaguagccucugaaggauuucaguacucagaccgaagguggugcuuugauggcgaaagaaauaaccaagugcucgaagagaauauggauguggagauauggacuaaagaaggcgaacguaagaaacuacgacccagauggcuagaugcucgaacauacucggauccguuagcucuaagagaguuuaaagaguucgccgccggaaggaggagcguuaguggcgaccuuauucuagaaauaggcaaauuaccacaacaucuaacacagcgggcccaaaaugcucuugauaaucuaguaaugcuucacaauagugaacaagguggacgugcuuaccgacaugcuauggaagaacugccagacacaaucgaaacauuaaugcuacuugcacuaaucgccguacuaacgggaggcgugacacuuuucuuucuuucggggcgugguuuagggaaaaccucuauuggacuuuuauguguaauggcaucaagcguacuccucuggauggcgaguguagagccacauuggaucgcugcaucaauaauacuagaguucuuucuaaugguacuucuaauccccgaacccgaccgccagcguaccccacaagacaaucaacuagcuuacguuguuaucgguuuacuuuucaugaucuuaacaguagcugcuaaugaaaugggcuuguuggaaacaaccaagaaagauuuaggcauugggcauguagcugucgaaaaucaucaucacgcagccaugcucgacguugauuuacauccagcaagugcauggacacucuaugcaguggcuacaacuaucauaacgccuaugaugcgucauacaauagagaauacgacugcaaauauaagccuaacagcaaucgccaaucaagcggcuauuuuaauggguuuagauaaagguuggccuauaucaaagauggacauaggcguaccucuucuagccuuggguuguuauucacaggucaauccauugacguuaacagccgcgguguuaaugcuagucgcccauuaugcuaucauagggccgggacuacaagcgaaggcaacucgugaagcacaaaagcgcaccgcggcuggcaucaugaagaauccaacgguagauggaaucguagcaaucgacuuggaucccgucgucuaugacgcaaaguuugagaaacaacuaggacagaucaugcucuuaauacuguguacaagucagauacuguuaaugcgcacuacaugggccuugugugaaucaauaacucuagcaacgggcccucucacaacccuaugggaggguucgccugguaaauucuggaauacaacgauagcuguaucaauggcgaauauauuccgaggaucuuauuuagcaggagcagguuuagcauucucacugaugaaaucucucggaggugggagaaggggcaccggcgcacaaggggagaccuuaggagaaaaauggaaaagacagcuaaaucaauuaucaaaaucagaauuuaauacuuauaaaagaaguggaaucauggaaguagauagaagugaggcaaaggagggcuuaaaacggggugaaacaacuaaacacgcaguaucccgaggaacagcaaaacugcgcugguucguggagcgaaaucucguuaaaccagagggaaaagugaucgauuuaggaugcggaagaggaggguggaguuauuacugugcaggacuuaagaaaguaacagaaguaaaaggcuacacuaaaggaggaccaggacacgaggaaccaauuccgauggcaaccuacggcuggaaucugguaaaauuacauagugguaaagacguauuuuucauaccuccugaaaaaugcgauacacuccuaugugacauaggugaauccucacccaauccaacaaucgaagaaggaagaacauuaagaguccuaaaaauggucgaacccuggcuucgugguaaucaauuuuguauaaaaauacugaacccuuauaugccuucgguuguagaaacuuuagaacaaaugcaacgcaaacacgguggaaugcuuguacguaacccguugagucgaaauagcacacaugaaauguauuggguuucauguggaacugguaauaucgugagugcaguaaauaugacaucacggaugcuccuaaaccgguuuacaauggcgcacagaaaaccuacuuacgagcgcgauguugaucucggcgcagguacgcgucauguggcaguggaaccugaaguagcuaauuuagacaucauaggccaacguauugaaaauauuaagcaugagcacaaaucuacguggcauuacgaugaggauaacccuuacaaaaccugggcauaucacggaucauaugaagucaagccaucaggaagugcaaguaguauggugaauggagugguuaagcuccuaacaaaaccuugggaugucauaccaaugguaacacaaaucgcgaugacagacaccacaccauuuggucagcagcguguuuuuaaagagaaaguagauacgcgaacaccaaaggcgaaaaggggaaccgcucaaaucauggagguaacagccaagugguuaugggguuuucucagcagaaauaaaaagccaagaauauguacgagagaagaauuuacuagaaaaguaagauccaaugcugcaauaggugcggucuuuguugaugagaaccaguggaacagcgcgaaagaagcaguugaagacgaaagauuuugggacuugguucaucgcgaaagagaacuacauaaacagggaaagugugcgacuugcguauauaacaugaugggaaaaagagagaagaaacucggggaauuuggaaaggcaaaagguaguagagcuauuugguauauguggcuaggcgcacgauucuuagaauuugaagcccuaggcuucaugaacgaagaucauugguucagucgagaaaauagucuaaguggaguggagggggaaggacuucauaaauuaggauacauacuuagagacauuucaaaaauuccgggaggaaauauguacgccgaugauaccgcugguugggauacgagaauaacagaagacgacuuacaaaaugaagcuaaaauuacugacauaauggagccggagcaugcauuacuagcaaaaaguauauucaagcuaacguaucaaaacaaaguugucaggguccagagaccagcuaaaaacggcacuguaauggauguaauuaguaggagagaucaacggggaaguggucaagugggaacauacggauuaaacacauucacaaauauggaagcucaauuaauccgucaaauggaaagugaggggauauuuucuccaucagaauuggaaacuccuaauuuagccggcagaguauuagauuggcuagagaaacauggaguagaaagauugaaaagaauggcuauaucgggcgacgauugugucguuaaacccauugaugaucgauuugcgacggcuuuaaccgcacuuaaugacauggguaaaguuagaaaggacaucccccaaugggaaccaaguaaaggcuggaacgacuggcaacaagugccauuuuguucccaccauuuucaccaacuuaucaugaaagaugguagggagauaguaguaccuuguagaaaccaagacgaguuggugggucgggcgaggguaucacaaggagcaggauggaguuuaagagagacagccugccuuggaaagucauaugcucaaauguggcaauuaauguauuuccacagaagggauuugaggcuagccgccaacgcaauauguagcgcgguuccaguagacuggguaccuacuucaaggacaacuuggucuauccaugcucaucaccaauggaugacuacagaagacauguuaucuguuuggaacagaguuuggauugaagaaaacccuuggauggaggacaaaacacauauaucauccuggggcgacgucccauaccuugggaaacgagaagaucaauggugcggaucauugauaggauuaaccgcgcgugcaacuugggcaaccaacauacaggucgcuauaaaccaaguacggcguuuaauuggaaacgaaaauuauuuggauuacaugacaucaaugaaaagauuuaagaaugagagugacccggagggagcuuuaugguaa

SEQ ID NO: 21626 - RNA, 9879 nt, Artificial Sequence
  derived and/or modified CDS sequence (opt6) from DENV-1__GQ868605__SS-prME
ucugugacuauguuguuaaugcugaugccaacugcucuugcauuucaucugacuacucgaggaggagaaccccacaugauaguaacaaaacaagaacgaggaaaaucgcuauuguucaaaaccuccguaggugugaauaugugcacgcuaauugcuauggaccugggugaacuuugcgaagacacaaugaccuacaaauguccacggauaaccgaagccgaaccugaugacguagauugcuggugcaaugccacugauacgugggucaccuacgguacguguucucaaacuggugaacacagacgagauaaacgaagugucgcucuagcaccgcauguuggucuaggucuggaaacacgaaccgaaacguggaugucuucggaaggugcuuggaaacaaauccaaagaguugaaacaugggcauuaagacacccggguuuuacagucauugcucuguuccuagcucacgccaucggaaccucaauuacacaaaaaggaaucauauuuauuuuauuaaugcuaguuacuccaucaauggccaugcgaugcguaggaauugguucgagagauuuuguagaaggcuuaaguggcgcuacguggguugauguaguccuagaacauggguccugcgugacaaccauggcaaaagacaaaccaaccuuagacaucgaacuucuaaaaacugaagucaccaacccagcaguauuacgaaaauuauguaucgaagcuaaaauaucaaauaccaccacugacagucguuguccaacacaaggggaagcuacacuuauggaagaacaagacgcuaacuuuguuugucgccgcacuuucguagauagaggauggggcaauggcuguggcuuguuugguaaagggucauuaauaacaugcgcuaaauuuaaauguguaacaaaacuugaaggaaaaaucguucaauaugaaaaucuaaaauauagugugauaguuacaguacacaccggcgaccagcaucaaguugguaaugagucuacugaacacgguacaaccgcaacgauaacuccccaagccccuacuuccgaaauacaauugacagauuauggagcacucaccuuagacugcucgccaagaacaggauuagacuuuaaugagaugguuuuacuaaccaugaaagagaaaucguggcucguacacaaacagugguuccuugaucuuccucuacccuggacgucgggagcgucaaccucacaagaaaccuggaauagacaagaccuacugguaaccuuuaaaacagcacacgcuaagaaacaagaaguuguaguauuaggcucccaagagggggccaugcacaccgcacucacgggggcaacagaaauccaaaccucagguacaaccacgauauucgccggucaucuaaaauguagacuaaaaauggauaaauuaacgcuaaaagguauguccuauguuauguguacaggcucguuuaaguuagaaaaagagguugcagaaacacaacauggaacuguuuuaguacagauaaaauaugaaggaacugaugcgccuuguaaaauaccauuuucuacgcaagaugagaagggagucacucagaauggacgacuaauuacagccaauccgauaguuacagacaaagaaaaaccuguaaauauagaagcagaaccgccauucggggagucauacauagugaucggaguuggcgagaaagcauuaaaacuuuccugguuuaagaaaggauccaguauagggaaaauguucgaagcuacagcuagaggagcuaggaggauggcuauacuuggugacaccgcuugggauuuugggagcauuggaggaguuuuuacuucaguaggcaaauuaguacaucaaaucuucggaacagcuuacggcguacuguucucugguguuaguuggacaaugaaaauaggaauaggaguccuuuuaacauggcuuggauugaacaguagaucaacaucucuaucaaugacauguauagcagugggauuaguuacuuuguaucuaggggucaugguucaagcugauaguggaugcguaauaaacuggaaggggagagaacugaaguguggaucugggaucuuugucacuaaugaaguacacacauggaccgaacaguacaaauuucaagcggacucuccaaaacgguuauccgccgcgauaggaaaagcgugggaggagggcguaugugggauucgcuccgcaacacgucuugaaaauauuauguggaagcagauuaguaaugaacucaaucauauucuucuggagaaugacaugaaauucaccguuguugugggagacguuguuggaauccucgcccaagggaagaaaaugauuagaccacagccuauggaacacaaauauagcuggaaaucguggggaaaagccaaaauaauaggcgccgauguacagaacacuacguucauaaucgaugggcccaauacacccgaauguccagacgaucaaagggcuuggaauauaugggaagucgaggauuaugguuuuggaauuuuuacgaccaauauuuggcuaaaguugagggauagcuauacccaagugugugaccacaggcuaaugucagcggcaauaaaggauuccaaagcggugcacgcagauaugggauacuggauagaaagugagaaaaaugauacuuggaaacucgcgagagcaaguuucaucgaaguuaaaacauguauauggccgaaaucacauacgcuguggucaaacggaguuuuagaauccgaaaugaucauuccaaagauauacggagguccuauuagucagcacaauuauagaccugguuacuucacgcaaacagcgggccccuggcaucucggaaaacuugaacucgauuuugaccuuugcgaaggaacgacaguggugguagacgagcauugcggcaaccgaggccccucacuccgaacgaccacuguaacaggaaaaauaauccacgaauggugcugccggagcugcacacuuccgccguuaagauuuaagggugaagaugguugcugguauggcauggagaucaggccaguuaaggaaaaagaagaaaaucuggucaaaaguaugguuucugcagggucuggggaaguugacucuuuuucccuuggucuacuguccauuuccauuaugaucgaagagguaaugcggagcagauggucacgaaaaauguugaugacaggaacguuagcaguguucuuauugcuaauaguaggccaacucaccuggaacgaucuaauuagguuaugcaucaugguaggugcuaaugccuccgaucgaauggguauggguacgacauaucuugcauugauggcgacauuuaagaugagaccaauguucgcuguaggauuacucuuccggcggcuuacgagucgagagguauuacuccugacgauuggcuuaagccuaguagcaucgguagaauugccaaacagucuugaggaacuuggagauggccuggcuaugggaauaaugauuuuaaaacuacuaacagauuuccagagucaucaguuaugggcaacucucuuaucacugaccuuuauaaagacagcccuaucauuacauuaugcuuggaaaacaauggcuaugguauugucaauagucagccuuuuuccacuaugucuaucaaccacaagucagaaaacuacguggcucccaguucuccuagguucccuaggcuguaagccccuaacaauguuucuaaucgcagaaaauaaaauuuggggaaggaaaaguuggccucucaacgaaggaauuauggcaguuggagucguaagcauauuacucagcagccugcucaaaaaugacguacccuuggcaggacccuuaauugcuggggguauguuaauagcauguuauguaauauccggcaguagcgcugaucuuagccuggaaaaagcggcagagguaucaugggaagaagaagcagaacauaguggagcuagccauaauauuuugguagaaguacaggacgaugggacaaugaaaauuaaagaugaagaacgagacgauacucuaacaauucucuuaaaagcgacacuccuagccguaucagggguauaucccuugucuauaccggcgacguuauuuguaugguauuucuggcagaagaagaaacaaagaagcggaguauugugggacacccccucaccgcccgaagucgagagagcgguucucgacgacggaauauaucguauaaugcaaagaggguugcuaggaagaagucagguuggaguuggcgucuuucaagaaaauguauuccacacgauguggcacguuacaagaggugcuguucuaauguaccaaggaaaaagacuugaaccuucgugggcuuccguuaagaaagauuugaucaguuaugggggcggcuggagacugcaagguucauggaauacaggugaggaaguacaaguuauugcaguagaaccaggaaagaauccaaagaauguucagacagccccuggcacguucaaaacuccugaaggagaaguuggagcuauagcucuagauuucaagcccgguaccucaggaucuccaaucguaaauagagaagguaaaauaguuggauuauauggcaauggaguagugaccaccucagggaccuauguaagcgcaaucgcucaagcaaaagcaagccaagagggcccgcuuccagaaauagaagacgaagucuuccggaagcgaaauuugacaauaauggaucuucacccaggcuccggaaagacacgcagguaucuaccagcaauuguaagagaagcaaucaagagaaaacuaagaacguuaauucucgcuccaacaagggugguugcuagugaaauggcagaagcacuaaagggaaugccaauaagauaccaaacaacugcagucaaaucugagcacacaggaaaagaaaucguugaccuaaugugucacgcaacuuuuacaaugagauuauuaaguccagugagaguucccaauuacaauaugauaauuauggaugaagcucacuucacagauccaaguucuauagcagcgaggggguacauaaguacccgaguaggcaugggagaagcggccgcaauauucaugacugcaacaccaccugggagugucgaagcauuuccgcaaagcaaugcgguaauacaagaugaagaaagagacauuccugaacgcagcuggaacucaggauacgaauggauaacagacuuuccuggaaaaacggucugguucguaccaucuaucaaaucuggaaaugacaucgcuaauugucuaaggaaaaauggaaagcgaguaauacaacuuaguagaaaaacauucgagaccgaauaucagaagacaaagaacaaugacugggauuaugucguuacaacugacauaagugaaaugggugcaaacuucagagcagaccgaguaauagauccgcgaagauguuuaaaaccuguaauucuuaaagauggcagugagagaguaauacuagcuggaccaaugccgguaaccguugcuagugcagcacagagacgaggcagaauugguaggaaucacaauaaagagggugaucaguauauauauaugggacaaccauuaaauaaugacgaggaccaugcacauuggacagaagccaaaauguuacuagauaacauuaauacaccggaaggaauuauaccagcccuuuucgaaccagaaagagaaaaaucagcagcuauagauggugaguacagauuacguggagaagcacgcaaaacauuugucgagcuaaugagaagaggugaucuaccaguaugguuaagcuacaaaguggcuucugaaggauuucaauacagugaccgcagauggugcuuugacggagaacgcaauaaucaaguacuagaagaaaauauggacguggaaaucuggacgaaagagggagaacguaagaaauugaggccacgauggcuagaugcacgaacuuacagcgauccucuagcuuuacgagaauuuaaggaauuugcggcuggacguaggagugucucuggagaccucauuaucgaaauaggaaaguugccacagcaucuuacacaaaaagcacagaacgcuuuagacaaccugguaaugcuccacaauucugagcaaggaggucgugcuuacagacaugcaauggaagaguuaccagacacuauagagacauuaaugcucuuagcccucauagcuguucucacaggggguguaacccuauucuuucucucagggagaggucuaggaaaaacaaguauaggccuauuauguguaauggcgucuaguguacuacuuuggauggccaguguagaaccccacuggauugcagcuucuauaauucucgaauuuuuccuaaugguauuguuaauaccugagccagauagacaaagaacaccgcaggacaaucaacuugccuacgucguaauuggacuauuguuuaugauucuuacaguagcugcaaacgagaugggcuuacuugagacuaccaagaaagacuuagggauaggacacguggcagucgaaaaccaccaccacgcuacaauguuggacguagauuuacauccagcgucggcuuggacguuauacgccguggcaaccaccauuauuaccccaaugaugcgacauacgauagaaaauacaacagcaaacaucuccuugacugccauugcgaaucaagcggcgauauugaugggacucgacaagggcuggccuauuagcaagauggacauaggcguuccguuacuagcauuagguugcuacucacaaguuaauccucuaacacucacagcugcagucuuaauguuggucgcgcacuaugcaauaauagguccuggccuacaagcuaaagccacaagagaagcgcagaaaagaacggcugcgggaauuaugaaaaacccaacuguagauggaauagucgcuauagauuuagauccuguaguguacgacgcaaaauuugaaaaacaauugggacaaaucauguuacuaauacuuuguacaagucaaauauuauugaugcgaacaacuugggcgcucugugagucaauaacacucgcaacaggaccacuuaccacauuaugggaagguagcccaggaaaguuuuggaauacaacaauagcugugaguauggccaacaucuuucgaggaucguaccuggccggggcaggauuagcguuuucauugaugaaaagccuuggcggaggacgacgcgguacuggggcacagggcgagacauuaggcgaaaaauggaagcgacaauugaaucaacuaaguaaaagugaguucaauauauacaaacgaucgggaauaauggaaguugauaggagcgaagcgaaggaaggccuaaaaagaggggaaacaacccgccacgccgugucaagagguacggcgaaacuaagaugguuuguagagagaaaucucguaaaaccugaggggaaagucaucgauuuagguugugggagagguggauggaguuauuacugugcugggcucaagaaaguaacugaagucaaaggcuacacuaaaggugguccaggucacgaggaaccaauaccuauggccacuuaugguuggaauuuaguuaaauuacauagugguaaagacguguucuuuacgcccccagaaaaaugugauacccuacuuugcgauauuggagaaucgagcccaaacccaacuauagaagaagggaggaccuugcgagucuuaaaaaugguagagccauggcuacgagguaaucaauucugcaucaaaauauuaaacccauauaugcccuccgucguugaaacacuugaacagaugcagcggaagcacggcggaauguuggugaggaaucccuugucaagaaacagcacucacgaaauguauugggugaguuguggaaccgguaacaucguaucugcaguaaauaugaccucacguauguuacuaaauagauuuacgauggcucaccgcaagccgaccuacgagagggauguagauuugggggcuggaaccagacauguagcaguagaaccagaaguagcaaauuuagacauaauaggacaaaggaucgaaaacauaaaacaugaacacaaaaguacauggcacuacgacgaagacaauccuuacaagacaugggcauaccauggcuccuacgaagucaaaccgaguggaagugcuaguucgaugguaaauggugucguuaaacugcuaacuaaaccuugggauguuauucccaugguaacgcaaauugcaaugaccgacacaacaccauucggacaacagagagucuuuaaagaaaaaguagacacucguacaccgaaagcaaaaagaggcacagcacaaauaauggaaguaacagcccgguggcuauggucauuucugaguagaaauaagaaaccuagaauauguacgagagaagaguucacaagaaaaguuaggucaaaugcagcuaucggugcgguguucguagaugaaaaucaauggaacagugcaaaagaagcuguugaagaugaaagauuuugggaccugguacagaaagaacgggaacuacacaaacaaggaaagugugcaacaugcguguacaauaugaugggaaagagagagaagaaacuaggugaauuuggaaaagcaaaagguucaagggccaucugguauaugugguugggugcucguuuccuugaguucgaggcuuuagguuuuaugaaugaggaucacugguuuucacgggaaaacaguuuauccggaguagaaggggagggauuacacaaacuuggauauauacuaagagauaucucuaaaauacccggagguaauauguaugcggaugacaccgcggggugggacacuaggauaacagaagacgaucuucagaaugaagcuaaaauaacugauauaauggaaccagagcacgcacuccuagccacgucaauuuucaaacuuacauaucagaauaaaguggugcgcgugcagagaccagcaaagaauggaacgguuauggaugucauaucccgaagagaccagcgaggauccggacaaguagguacauauggacuuaacacauucacaaauauggaagcgcaacucauaagacaaauggagucagaaggaauauucuuaccaagugaacuagagaccccgaaucuugccgaacggguauuagacugguuagagaagcauggcguugagcgauugaaaagaauggcuauaaguggugacgauuguguuguaaaaccaauugaugaucgcuucgcaacggcguugacugcccuaaaugacaugggcaaagugcguaaagauauuccucaaugggaaccaucgaaaggguggaaugauuggcaacaagugccauucuguucacaucauuuucaucaauugauuaugaaagacggccgggaaauaguagucccaugcagaaaccaggaugaacucguaggcagagcuagaguuagccaaggagcaggguggaguuuacgggaaaccgcguguuuaggaaagaguuacgcucaaauguggcaacucauguauuuucacagacgggacuugagauuggcagcuaaugccaucuguucugccgugccugucgacuggguaccaacaaguaggacaaccuggucaauccaugcacaucaucaauggaugacaacggaagauaugcucagcguuuggaacagaguauggauugaggagaaucccuggauggaagauaaaacacauguaaguucuuggggugacguacccuaccucgguaaacgagaagaucaaugguguggcagucugaucgguuuaacagcucgagccacaugggcaaguaauauucaaguggccauuaaucagguaagaagacuaauaggcaacgaaaacuaccuagauuauaugaccagcaugaaacgguuuaaaaaugaaggugauccggaaggagcauuaugguag

SEQ ID NO: 21627 - RNA, 9879 nt, Artificial Sequence
  derived and/or modified CDS sequence (opt6) from DENV-1__FJ882534__SS-prME
aguguuacuaugcugcuuauguugaugccuacugcguuagcuuuucauuuaacaacaagagguggagaaccgcauaugauugucucaaaacaagaacguggaaaaucucuauuauuuaaaacgagugcaggagucaauauguguacucucauugcuauggauuugggagaauuaugugaagauacaaugacauacaaaugcccucgaauuacagaagcagaaccagaugauguggacugcugguguaaugcgaccgauacaugggugacauauggaacguguucacaaaccggggaacaucguagggauaaaagaucaguagcauuggcaccacaugucggccuagguuuagaaacaagaaccgaaacauggaugaguuccgaaggugcuuggaaacaaauacaacgcguagaaacgugggcacuucgacauccgggauuuacagucauagcucuauuccucgcgcaugccauagguacguccauaacccaaaaaggaaucauauucauauuacucauguuaguuacuccaagcauggcgaugcgcuguguaggcaucgguagucgcgacuucguagagggauuaucaggcgcaacauggguagauguuguacuagagcauggaagcugugugaccacgauggcaaaagacaaaccaacucuagacauagaguuauugaaaacagagguuacgaacccggccguuuuacggaaauuauguauagaagccaaaauuaguaacacuaccacugauagcagaugcccaacgcaaggagaagcuaccuugguagaggaacaagaugcgaauuucgucugcaggcgaacauuuguugauaggggauggggaaauggcuguggacuauuugguaaaggaucgcucauaacgugugcaaaauucaaaugcgucacaaaauuagaagguaaaauaguacaauaugaaaaucuaaaauauucagugauagucacuguucauacuggcgaucaacaccaaguugguaaugaaucaaccgaacaugguaccacagcaaccauuacgccucaagcaccaacaacagaaauucaacugacagauuacggugcauuaacacuugauugcucaccgcgaaccggauuggauuucaacgaaaugguauuauugaccaugaaagaaaaaucauggcugguccacaaacaaugguuuuuagaccuaccauugccuuggaccagcggagcgucaacuagccaggagaccuggaaucgacaagaccuauuaguuacguuuaaaacugcacaugccaagaaacaagagguaguagucuuaggaccucaagaaggagcuaugcauaccgcguuaaccggagcaacugagauccagaccucaggaacaacaacaauauuugcuggacaccuaaaaugccgacugaaaauggacaaacuaacucuaaaagguaugagcuaugucauguguacaggaucauucaaacuggaaaaagaaguggcagaaacacaacauggaaccguacucgugcaaauaaaauacgaagggacagaugcuccuugcaaaauacccuucucuacacaggaugaaaaagguguaacccaaaauggccgccuaauaacagcuaauccaaucgucacugauaaagaaaaaccuguaaauauugaagccgaaccgccauuuggagaaucuuacaucguaauaggugcuggugaaaaagcacucaaacuuucaugguucaagaaagguucaucuauugggaaaauguucgaggcaacggcucguggagcaagacgaauggcaauauuaggagauacagcgugggauuucgguagcauugggggaguauucacaucaguagggaagcuagugcaucaaauuuuugguaccgcauacgguguucuauuuucaggcgugagcuggacuaugaaaauuggaauuggugucuuacucacaugguuaggucuaaauucaagaucuacaucucuaucaaugacauguauugcaguuggccuaguuacucuauaucuuggagugaugguacaagcggacaguggcugcguaauaaauuggaaaggccgagaauugaaaugugguaguggcauauuugucacaaaugaaguccacacauggacagagcaauacaaauuucaggcggauaguccgaagcgauuguccgcagcaauuggcaaggcuugggaagaaggagucuguggcauaaggucagcaacacgauuagaaaauauaauguggaaacaaauuucgaaugaguuaaaucauaucuuguuggaaaacgacaugaaauugacuguaguugucggugacguggcaggcaucuuaggucaagguaagaaaaugauuagaccacaaccgauggaguacaaauauucuuggaaaaguugggguaaagcuaaaaucaucggugcagaugcacaaaauacgacguucauaauagauggaccaaauaccccugaauguccugaugaccagagggcuuggaauauaugggaaguugaagauuauggauuuggaauuuuuacgacuaacauuuggcuaaaacuaagagauuccuacacucaaguuugugaccacaggcuaauguccgcagccauaaaggauucaaaggcggugcaugccgauaugggauacuggauagaaagcgagaaaaacgagacuuggaagcuggcaagggccucuuucauagaagugaagaccuguaucuggccgaaaucccauacuuuguggucaaacggaguauuagaguccgaaaugauaaucccgaagauuuacggagggcccaucucacaacacaauuaucgaccaggauauuuuacacaaaccgccgguccuuggcauuugggaaaauuagaacuagauuuugaucugugcgaaggaaccacuguaguuguagaugaacauugcgguaaccgagguccuucguuacgcacaacgacagucacugggaagauaauucaugaaugguguuguaggaguugcacacucccaccgcugcgauucaggggugaagauggguguugguaugguauggagauucggccagucaaagaaaaggaagaaaauuuaguaaaaaguaugguaagugcaggaucaggcgaaguagacucuuuuagucuuggucucuuauguaucaguauuaugauugaagaaguuaugagaucgagguggucgcguaaaaugcuaaugacaggcacacucgcaguuuucuuccuuuuaauaaugggacaacuuaccuggaacgauuugauccgcuuaugcauuauggucggcgcgaacgccucggaccgcaugggaauggguacaacauacuuagcauuaauggcuaccuucaagaugagaccaauguucgcggucggacuguuauuuagaagguuaacaucucgagagguucuccuccuuacaauuggacucucccucguagcauccguagaauuaccaaacucucuagaagaacuuggugauggacuagcgaugggcauaaugauucuuaaacuauuaacagauuuucaaucccaucaauuaugggcuacacuuuuaucgcucacguuuaucaagacuacuuuuagccuacauuacgcuuggaagacgauggcgaugguuuuguccauagucucguuauucccguugugucuuucaacgacaucacagaaaacuacguggcuccccguacuauuagguucguugggaugcaaaccccucaccauguuuuuaauuguugaaaauaagauauggggcagaaaguccuggccacuaaacgaaggaauuauggcaguagguauuguaaguauucuucuaagcagucugcucaaaaaugacgucccccuagcagggccgcugauagcugguggaauguuaauugcuugcuauguuaucaguggaucuagugcagaucuaagccuagagaaggcagcggagguuagcugggaagaagaggcugaacauagcggugcaucacauaauauccuaguugaaguacaagaugaugguaccaugaaaaucaaagaugaagagagagacgauacccucacaauauugcucaaggcaacucuacuagccguuucagguguguauccgcuaaguauaccagcaacguuguuuguaugguauuuuuggcagaagaagaaacaaagaaguggggugcuaugggauacucccucaccuccagaagucgaaagagcaguuuuggaugauggaauauaucggauaaugcagagagggcugcucggacguucucaaguagguguaggagucuuccaggagaauguauuccauacuauguggcaugugacaagaggcgcuguauuaauguaccaggggaaacggcucgaacccucgugggcaaguguaaagaaagauuuaauaaguuauggaggugguuggagacucagggguucauggaauacaggagaagaaguucaaguaauugccguagagccagggaaaaacccuaaaaacguacaaacugcaccaggaacuuuuaaaacaccggagggagaagugggugccaucgcauuggacuucaagccagguacuucaggaagucccauuguuaauagagagggaaaaauaguuggucuauaugggaauggcgucgugaccacaaguggaacguacguauccgccauagcccaagcuaaggcaucucaagaaggaccacugccugagaucgaagacgaaguauuuagaaagcgaaauuuaacuauaauggaucuacauccuggcucugggaaaaccagacgauacuuaccagcuaucguaagagaagcgaucaagcggaagcuacgaacacuaauacuggcaccgacacgaguaguugcuagugaaauggccgaagcgcuuaaggggaugccaauaagauaucagacgacagccguaaaaagugaacacacagguaaagaaaucguagaccuuaugugccacgcaaccuuuacaaugcgccucuuaaguccgguuagaguucccaacuauaacaugauaauaauggaugaagcgcacuuuacagacccgaguucuauagcugccagaggguacauaucaacccgagugggaaugggcgaagcagcagccauuuuuaugacugcaacgccgccuggaucaguugaggcuuuuccccagaguaaugcugugauucaagaugaagaacgagauaucccugaacgauccuggaauaguggauaugaauggauaacagacuuuccaggaaagacaguaugguucgugccaucuaucaaaucggggaaugauauagcgaacugcuugcgcaagaauggcaaacgaguaauucaacuauccaggaaaacauucgacacagaauaucagaaaacgaaaaacaaugacugggauuacgugguuacaacagauauuagugaaaugggggcaaauuuccgggccgauagaguaauugauccuagacguugccuaaagccggucauauugaaggaugggccugaacgggugauccucgccgggccgaugccaguaacaguugcuucugcagcacagagacgcggccgcauaggaagaaaccauaacaaagaaggggaucaauacauauauaugggccaaccguuaaacaaugaugaggaucacgcucacuggacagaggcuaaaaugcuacuugacaacauuaacacacccgaagggaucauuccagcucuauucgaaccugagagagagaaaagugcagcuguugauggugaauacagauuaagaggagaggccagaaaaaccuucgucgaacuaaugcggagaggagaccugccaguuugguuaucuuauaaaguagcuagugagggcuuucaguacucagaucggaggugguguuuugacggugaaagaaauaaccagguacuugaagaaaacauggauguagaaauauggaccaaagaaggagaacggaagaaacugcgacccagauggcuugaugcaagaacguauuccgaccccuuagcauugcgagaauuuaaggaguucgcagcaggaagacgcagcguuuccggggaucuuauauuagagauaggcaaauuaccacaacauuuaacacaacgagcccaaaaugcacuugauaaucuuguuauguugcacaacagcgagcaaggagggagagcauaucggcacgccauggaagaacucccagauacgauagaaaccuuaaugcugcuagcuuuaauugccgugcuuaccggaggcguuacauuauucuuuuugucuggccgcggccuaggcaaaacaagcaucggauuauuaugcguuauggcaucaucaguucuucuauggauggcuagcguugaaccacacuggauagcagcuucuauaauuuuagaauuuuuccuaaugguauuacucauccccgagccugacagacaaagaacaccacaagacaaucagcuggcauaugucgucauaggucuucuauuuaugauccucacaguagcggcuaaugagauggggcuucuugaaacaacaaagaaagauuuagguauagggcacguagcgguagaaaaucaucaucacgcagcaauguuagauguugauuuacauccugcuagcgcuuggacuuuguacgcaguugcaacaacaauaauuaccccuaugaugcgucacacaauagaaaauacaacagccaauauuagucuaacagcaauagcuaaucaagcggcaauuuuaaugggccuagacaaagguuggccaaucucaaagauggacaucggagucccguuauuagcuuuagguuguuauagucaaguaaaucccuugacccuuacugcagcuguccucauguuagucgcacacuaugccaucauugggcccggauuacaagcgaaagcuacgcgugaagcgcaaaaacgaacagcggcagggauaaugaagaacccuacaguagaugguaucguagcuauagaccuugacccuguaguauaugaugcuaaauucgaaaaacaacuagggcagauaaugcuucugauacucugcacaucucaaauucuauuaaugaggacaacgugggcauuaugcgaaucaaucacauuagccacugguccgcugacaacauugugggaaggcucuccgggaaaguuuuggaauaccacaauagcuguaaguauggcaaacauuuuucgcggcucuuaucuggccggugcaggccuugcauucucguugaugaaaagccuaggaggagguagaagagggacaggcgcacaaggagaaacauugggagaaaaguggaaacgccaacuuaaucaguuguccaaaucugaauuuaauacauauaaaagauccggaauuauggaaguugaucgaagcgaagcaaaggaaggcuuaaaacgaggggaaacuacaaaacaugcagucucaagagggacggcuaaguuaagaugguuuguggagcggaacuuaguuaagcccgagggcaaaguuauagauuuagggugcggaagagguggauggucauauuauugugcuggauugaagaaaguaacagaaguaaagggauauacaaagggaggaccaggacaugaagaacccauaccaauggcuacauauggcuggaaccuagugaaauuacacaguggaaaggauguauucuuuauaccaccagagaaaugcgauacccuucugugugauaucggagaaucuaguccuaaccccacuauugaagaagggcgaacacuuagaguauuaaaaaugguagaaccauggcuaagaggaaaucaauucugcauaaaaaucuuaaauccauauaugccuucuguagucgaaacauuagagcaaaugcaacgaaaacauggaggaauguugguaaggaauccucuaaguagaaacagcacgcacgaaauguacuggguaaguuguggaacgggaaauauuguuagugccguuaauaugacaagucgaauguuguuaaacagauucacaauggcucaucgcaaacccacauacgagcgggacgucgauuuagguacaggaacccgacacguagcaguugagccagaaguagcuaauuuggauaucauuggacaaagaauagagaacaucaaacacgaacauaaaucuacauggcauuaugaugaggauaacccauacaaaacaugggcauaucauggaucauaugaaguuaaacccagcgggucagcauccagcauggugaaugguguuguaaaguuacuaacaaaaccaugggacgucauaccuauggugacacagauugccaugaccgauaccacccccuucggucaacaacggguguuuaaggaaaagguugacacgcgcaccccaaaagccaaacguggaacagcccaaauaauggaaguaacagcacgcuggcuauggggauuucuaagcagaaauaagaaaccacguauuugcacccgcgaagaauuuacacgcaaaguacgaaguaaugcagcuaucggugccguauuuguagaugaaaaucaauggaauagugcaaaggaagcuguagaagaugagagguucugggaucugguacaucgcgaacgcgaacuccacaaacaaggcaaaugcgcgacauguguauacaacaugaugggaaaacgagagaagaaauuaggagaguucgggaaagcaaaaggaaguagggcaauaugguacauguggcuuggagcgagguuucuugaguucgaagcucuagguuucaugaacgaggaccauugguuuucacgagaaaauaguuugucgggcguagaaggcgaaggacuucacaaauuaggauacaucuuacgagacaucucuaaaauucccggcgggaauauguaugccgacgauacagccggaugggauacucgcauaacugaagacgauuugcagaaugaagcgaaaauuacagacauaauggagccugaacacgcacuucuagcgaaagccauauuuaaauuaaccuaccaaaacaaaguagugagagugcaaagacccgcaaagaauggaacaguaauggacguaauaucacgccgugaccaacggggaucgggucaaguaggaacuuauggguugaacacuuuuacaaacauggaagcccaacuaauaagacaaauggaaagcgagggaauauuuagcccuagugaauuagaaacaccgaaccuagcggaacgggcucuagauuggcuggaaaaauacggcguggaaagauuaaaacgaauggcaauaaguggagacgauugcgucgucaaaccgauugacgauagauuugccacagcucuaacagcccucaaugacauggggaagguucggaaggauauuccacaaugggaacccucgaaaggcuggaaugacuggcagcaaguaccuuucugcagccaucauuuccaccaacuaauaaugaaagacggucgagagauaguuguucccuguagaaaccaagaugagcuagucgggagggcuagggucucacagggugccggauggucucuaagagaaaccgcaugccucggaaaaucuuaugcccaaauguggcagcucauguacuuucacagacgugacuuaagacuagcagcuaaugccauuugcucagcaguuccgguugauugggucccuacaagucgaacaacuuggucaauucaugcucaccaucaguggaugacaacagaagauauguuaucgguauggaaucguguguggauagaggaaaauccauggauggaggauaaaacacacauuucaaguugggaagacguaccguaccucggaaagcgcgaagaccaaugguguggaagucucauuggacuaacagccagagcaacaugggcaacuaacauacagguagccauuaaucaagugagacgccugaucgguaacgaaaauuaccuagauuauaugaccucaaugaaacgguucaagaacgaaucagauccugagggagcauugugguag

SEQ ID NO: 21628 - RNA, 9879 nt, Artificial Sequence
  derived and/or modified CDS sequence (opt6) from DENV-1__FJ882536__SS-prME
agcguuacgauguuacugaugcuuaugccaaccgcucuugcauuccaccuaacuaccagaggcggagaaccucauaugauaguuucgaaacaagaacguggcaaaagccuuuuauuuaaaacauccgcaggaguaaacaugugcacacuaauagcaauggaucuaggagaauuaugugaagauacaaugacauauaaauguccaagaaucaccgaagcagaaccugaugaugucgacuguuggugcaaugcuacagacacaugggucaccuacggcaccuguagucaaacaggugaacacagaagagauaaaagaucaguggcguuggcuccgcauguaggacuuggguuggaaacgcggacagaaacuuggaugucaucagaaggagcauggaaacaaauacaaagaguagaaaccugggcacuacgacacccagguuucacagucaucgcguuauuccuugcucaugcuaucggcacaucaaucacgcaaaagggaauuaucuucauacuauuaauguuaguaaccccgucaauggcaaugagaugcguugggaucgguagccgugacuuuguugaaggucucuccggagcaacguggguagacgucguuuuagaacacgguagcugcguaaccacgauggcgaaagauaaaccgacccucgacauugaauuacucaaaacagaaguaacaaauccugcaguacuaagaaagcuauguauagaagcaaaaauaaguaauacgaccacggauucgagguguccaacacaaggugaagcaacauuggucgaagaacaagacgccaacuuugugugucgaaggacauuuguagauagaggauggggaaauggaugcggucuauuuggaaagggaucguuaauaacgugcgccaaguuuaaauguguaaccaaacuagaagggaagauaguacaauacgaaaaucuaaaauauuccgugauuguaacuguucauacuggugaccaacaucaaguuggcaaugagucaaccgaacaugguaccacagccacuauaacuccacaagcgccaacuacagagauucaacuaacagauuauggugcacuuaccuuagauugcagcccccgaaccgggcuugauuuuaaugaaaugguauuauugacuaugaaggagaaaucauggcucguacauaaacaaugguuuuuagaccuaccauuaccuuggaccuccggggcgucuacuucacaagaaacauggaaucgacaagauuuacuuguaaccuucaaaacugcccacgccaaaaagcaagaagugguaguacuuggaagucaagaaggugcuaugcauacagcccuuaccggagcaacugagauccaaacuucagggacuacaacgauuuucgcgggucaucugaaguguagguuaaaaauggauaagcuaacccuuaaaggaaugucguaugucaugugcacagguaguuuuaaacuugaaaaggaaguagcagaaacucaacacggaacaguauuaguucaaauuaaauaugaagguacugacgcaccaugcaagauaccguuuagcacgcaagacgaaaaaggcgucacacagaaugggcgcuuaauuacggccaauccuauagucacagauaaagagaagccagugaacauagaagcugaaccacccuucggggagucuuacaucgugaucggugccggugaaaaagcacuaaaauuaucgugguucaagaaaggaagcucgauagggaagauguucgaagcaacugcaaggggagcgaggagaauggcuauuuuaggcgauacagcaugggacuuuggaagcaucgguggaguauucacaagcguggguaagcuaguacaucaaauauuugguaccgcauacggaguacuguuuucaggagugaguuggaccaugaaaauagguauaggaguacugcucacauggcuaggccuuaauaguagaaguacaagccuaucaaugacuuguaucgcugugggccuaguaacauuauacuuaggaguuaugguacaagcagacagugguugcgucauuaacuggaagggacgcgaauuaaaguguggaagcggaauauuuguaacgaacgaaguucauacuuggacggaacaauacaaguuucaggccgauucacccaagagacucagcgcagcgauaggaaaggcuugggaggaaggggucugugguauaagaucagcaacaagauuggaaaauauaauguggaagcaaauaucuaacgaacuuaaucacauauuauuagagaaugauaugaaauuaacaguaguagucggagauguagcugguauacuaggucaaggaaagaaaaugauacguccucagccuauggaguauaaauacaguuggaaaaguuggggaaaagcaaaaauaaucggugcggacgcucaaaauacuacguuuauuauagauggacccaacacaccagagugccccgaugaucaaagagcauggaacauaugggagguugaagacuacgguuuugggaucuuuaccaccaauauuugguuaaaacuuagggacaguuacacacagguuugcgaucacaggcucaugucagcugcaauaaaggauuccaaggcagugcaugcggacaugggcuauuggauugaaagugagaaaaacgaaacauggaaacuagcgagagcuaguuucauugaaguaaaaacaugcauuuggccaaaaucacauacauuauggaguaaugguguucuugaaagcgagaugauuauacccaagauauauggcggacccauuagucaacauaauuaucgacccggauacuucacucaaaccgccgguccguggcaccuggggaagcucgaauuagauuuugacuuaugugaaggcacgacugucgugguagaugaacacugugggaaucgggguccaagucuaagaacaacaacgguaacuggaaaaaucauucaugaauggugcugcagguccuguaccuuaccaccauugcgauuuagaggcgaagauggcugcugguaugguauggaaauaagaccuguaaaagaaaaagaggagaauuuaguaaaaucaaugguaagugccgguucgggagaaguagacaguuuuuccuuaggguugcuguguauaaguauaaugauagaggaaguaaugagaagccgauggucacgcaagauguugaugacuggcacucuugcaguauucuuuuuguugauaaugggacagcucaccuggaaugaucuaauacgauuaugcauaaugguaggagcaaaugcuagcgauagaauggguaugggaacaacguaucuagcccuuauggcuacauuuaaaaugaggccuauguucgcuguaggacuucucuuucguagauuaacuucucgcgagguucuguuacucaccauaggauuaucacugguugcuucaguugaacuccccaauagccucgaagaacuuggugauggucucgcaaugggcauaaugauucucaaacuuuuaacugacuuucagucucaccaacuuugggcgacucuauugagucuaacguucauaaaaacgaccuuuucuuuacacuacgcguggaaaacuauggcaaugguacuaagcaucgucagccuauuuccgcuguguuugucaacaacgagccagaaaaccacauggcugccagugcuuuuaggaucucugggaugcaaaccguuaacuauguuuuuaauagcugaaaacaagauuugggguagaaaaucauggcccuugaaugaaggaauaauggcagugggaaucguaaguauacuacuuucuucgcuacugaaaaaugaugugccccuagcugggccauuaauagcaggggguaugcucauugcaugcuaugugauuagugguucuagugcggaccucagcuuagaaaaagcagcagaaguaucaugggaagaagaagcugaacauaguggagcaagccauaauaucuuaguggaaguacaagaugacggaacuaugaaaaucaaggaugaagaacgugacgauacauuaacuauacuauugaaagcaacauuacuugcagucucugggguuuacccguuaucgauuccagcaacauuauucguaugguauuuuuggcaaaagaagaaacaaaggucaggaguuuuaugggauacgccaucgccaccugaagucgagcgagcuguucucgaugaugguauauacagaauaaugcagcguggacuauuagguagaucgcaaguuggugucggagucuuucaggaaaauguuuuucauacaauguggcaugugacaagaggcgcaguacuuauguaucaagguaaaagauuagaaccgaguugggcaagugugaagaaagauuugauaaguuauggaggugguuggcgauuaaggggauccuggaauacaggagaagaaguacaaguaauagcaguagagccagguaaaaauccuaaaaauguacagacggcaccuggaacauuuaaaacuccagagggggaagugggagcaauagcacuugauuuuaaaccagggacaucaggauccccaauugucaacagagaagguaaaaucguuggacuauauggcaaugggguuguuacuaccucaggaacuuacguaucagcaauugcacaggccaaggcaagucaggaagggccuuuaccggaaauagaagacgagguuuucaggaagagaaaccuuacaauuauggauuugcacccuggcagcggcaaaacacguagauaccuccccgcgauuguuagagaagcaauaaaacgaaaacuaaggacacuuaucuuagcuccuaccagagucgucgcuagugaaauggccgaagcauuaaaaggcaugccgaucagguaccaaacaacggcugucaaaucugaacacaccggaaaagaaauuguagaucucaugugucaugcgacauuuaccaugagauuauuaucuccuguaaggguccccaacuacaacaugauuauaauggaugaagcacacuuuacggauccgaguagcaucgcagcuagaggauacaucucuacccguguaggcaugggugaagcagcugcuauauuuaugacagcaacuccucccggcaguguagaggcuuuuccucaaagcaaugcgguaauucaagaugaagaaagggauauaccggaacgcucguggaacucgggauaugaauggauaacagauuuucccggcaaaacaguuugguucgugccaucuauaaagagcggaaaugacauagcgaauuguuuaaggaaaaauggcaaacgaguaauccaacuuaguaggaaaacuuuugacacagaguaucagaaaacgaaaaauaacgauugggauuaugugguaacaacugauauuucagaaaugggagcaaauuuuagagcugacagaguaaucgauccgcguagaugucuuaaaccggugauacucaaagacggaccagaaagggucauacuagcuggaccaaugccuguaacgguagcaucggccgcucagagacgaggaagaauaggcaggaaucauaacaaagagggagaucaguauauauacauggggcaaccauuaaacaaugaugaggaucaugcacacuggacagaagcaaaaaugcuucuggauaauaucaauaccccugaaggaauaauaccugcacucuuugagccugaacgagagaaaagcgcggcgguagacggggaauaccgguuaagaggagaagcgagaaaaacguucguagaacuaaugagacguggcgauuugccuguauggcugucguacaaaguugcaucagagggcuuccaauauagugauagaagaugguguuucgacggugaacgcaacaaucaaguacuagaggagaacauggauguugagauauggacgaaggagggagagaggaagaaauugagaccaaggugguuggacgcucguacauauucugacccacuugcauugcgagaguucaaagaguucgcagcgggccgaagaucgguuucaggugaccuuauacuagaaauugggaaauuaccccaacaucuuacgcagcgagcacaaaaugccuuagacaauuuggugaugcuucauaacagcgaacaaggaggccgagcguacaggcacgcaauggaagaacugccagacacuauagaaacguuaaugcuacucgcucuaauagcagugcugacagguggaguaacuuuguucuuuuuaucagggcgaggccucgguaagacaaguaucggacugcuaugcguuauggcuagcaguguauuauuauggauggcuucggucgagccgcauuggauagcagcuucuauuauacucgaguucuuucugauggucuugcuuauuccugaacccgaucgccaacgaacgccacaagacaaccaacucgcauacgucgugauaggacuucuauuuaugauacuaacgguagcugcuaaugaaaugggguuacuagaaacaacuaagaaagauuuagguaucggccacguggccguagaaaaucaccaucacgcugcuauguuagauguggauuugcauccggcaucagcuuggacacucuacgcagucgcaaccacuauaauuaccccaaugaugaggcauacgaucgaaaauacgacagcaaacauuucgcuuacagccauagccaaccaagccgccauucugauggggcuagauaaaggguggccgauauccaaaauggacauuggaguaccacucuuagcguuagguugcuauucgcaaguuaacccgcugacauugacugcugcaguacuaauguuaguugcacacuacgcgaucauugguccaggauuacaagccaaagcaacuagggaggcucagaaaagaacugcagcuggaauaaugaaaaacccaacaguugacgguauaguugcgaucgacuuagauccuguaguauacgaugcaaaauuugagaaacagcucgggcaaauaaugcuacugauauuauguacgucacaaauuuuauugaugcggacgacuugggccuugugcgaguccauaacuuuagcaaccggaccauuaacuacucuuugggaaggaagcccuggaaaguuuuggaauacaacaaucgcaguuuccauggcaaauauauuccgaggauccuauuuggcuggagcaggauuagcauucucguuaaugaagucccuaggcggaggacgcagaggaacuggcgcccaaggcgaaacguuaggcgagaaauggaagcgucagcuuaaucaacuaucuaagagugaguuuaacacuuacaagcggucaggcauaauggaagucgaucgaagugaagcaaaagaaggacuuaagaggggcgaaacaacaaaacaugcuguuagccguggaacagcuaagcuacgcugguuugucgaaagaaauuuaguaaagcccgaggguaaagucauugaccuugggugugguagaggagguuggucguacuauugcgcgggucuaaagaaaguaacugaagucaaaggauauacaaaagguggaccugggcaugaggagccuauaccaauggccacguaugguuggaaccuaguuaaauuacauaguggcaaagauguguucuuuauuccgccagagaaaugugacacucuguuaugugacauuggggaaucuuccccuaauccaacaauugaagaaggacgaacauuaaggguacucaaaaugguggaaccauggcugagggguaaccaauuuuguaucaaaauacuaaacccguauaugccaucaguugucgaaacacuggaacagaugcaaagaaaacauggagggauguuagugagaaauccccuaucgagaaauaguacacacgagauguacuggguaucaugugguacagguaauaucgucuccgcugugaauaugacaaguagaauguuacucaauagguuuaccauggcccauagaaaaccaacauacgaacgagacguagaucucgguacaggcacaaggcaugucgcagucgaaccugaaguagcgaacuuagauaucaucggucagagaauagagaauauaaaacaugaacacaagagcacauggcacuaugaugaagauaacccuuauaaaacaugggccuaccaugggaguuaugaaguuaaaccuuccggaucagcuuccucaaugguaaauggugugguaaaacuucuaacaaagccgugggaugucauucccaugguaacacaaauagcaaugacggacacaacuccuuucggacaacaacgaguuuuuaaagaaaaggucgacacgcgcacuccaaaagcaaaacgggguacugcccagauuauggaagucacagcacgcuggcuuuggggauucuugagccggaacaagaaaccgcguauauguacaagagaagaguucacgcgcaagguacgaagcaacgcagcaauuggugcaguauuuguagacgaaaaccaauggaacagugcaaaagaagcagucgaagacgaaagguuuugggauuugguccauagagaacgggaacugcauaagcagggcaaaugugcuacguguguuuacaauaugaugggaaagagagaaaagaaacuuggagaguucggaaaggcgaaaggcaguagagcgaucugguauauguggcugggagcucgauuccuagaauuugaagcccuuggauucaugaaugaggaucacugguucucccgagaaaauaguuuaucuggcguggagggagaaggguuacauaaacugggcuauauacuccgcgauauaucaaaaauuccaggcggcaauauguaugcagaugauacugccggaugggauacaagaaucacggaggaugaccuacaaaacgaagcgaaaauuacugauauaauggaaccagagcaugcccuuuuggcgaaagcaauauuuaaauugacuuaucaaaacaagguagugagagugcaaaggccagccaaaaauggcaccguuauggauguuauaucccgacgagaccaaaggggcagcggacaaguugggacauacgguuuaaauacuuucacuaacauggaagcucaauuaauuagacaaauggaaucagaagguauauucagccccuccgaacuugaaacaccuaaucuugccgaacgagcccuugauuggcuagaaaaauaugguguggaaagguugaaaagaauggcuauuucaggagaugauugugucguuaagccaauugaugaucgcuuugcaacugccuuaacugcuuuaaacgauaugggaaaggugagaaaggacauaccccaaugggaaccuagcaaagguuggaacgauuggcaacaaguuccauuuuguucucaucauuuccaccaacucauuaugaaagacgguagagagauaguuguaccguguagaaaucaagaugaacuuguaggacgcgcccguguaagucaaggggcgggcuggucacuccgagaaacggcgugcuuagggaaaucauaugcucagauguggcagcuaauguacuuucaccgucgugaucuacgucuagcagccaaugcaauuuguucggcugugccuguggacugggucccuacguccagaacuaccuggaguauccacgcacaucaucaguggaugacaacugaagauauguuaucgguauggaauaggguauggauagaagaaaauccuuggauggaggauaagacgcacauaagcucaugggaagacgugccauaccucggaaaaagagaagaccaauggugugggucucucaucggauugacagcaagagcaacgugggcgaccaauauccaaguugcuauaaaccaaguacguagacucauagggaacgaaaauuaucuggacuacaugacuagcaugaagagauucaagaaugagucagacccagaaggagccuuaugguaa

SEQ ID NO: 21629 - RNA, 9879 nt, Artificial Sequence
  derived and/or modified CDS sequence (opt6) from DENV-1__FJ882537__SS-prME
ucaguuacaaugcuucucaugcuuaugccaacagcauuagccuuccaucuuacgacacgugguggggaaccgcauaugauaguuucaaaacaagaacgaggaaaaucuuuguuauuuaaaacgucugcaggcgugaauauguguacgcuuauagcuauggaccuaggagaacugugcgaagauacaaugacguauaaaugcccaaggauaacagaagucgaaccagacgauguugauugcugguguaauacaaccgauacaugggugacauacggaacuuguagccaaacaggugaacaucgucgagauaaacgauccguagcccuagccccacauguaggucugggacuagaaacgcgcgcugaaacauggauguccagugaaggagcuuggaaacaaauacaaaaaguagaaacuugggcauuacgucaucccggcuuuacaguuauagcgcuauuucuagcacacgcaauaggaaccucaauuacucaaaaagguauaauuuuuauauuauuaauguuaguuacuccgaguauggccaugaggugcgucggaauuggaagucgugauuucguagaaggccuaagcggugccacauggguagauguaguauuagaacauggaagcuguguaacaacaauggcaaaagacaaaccaacacuugauauagaacuguuaaaaacagaaguaacgaaccccgcaguccuuaggaaauuguguaucgaagcgaaaauuagcaacacaaccacagauuccagaugucccacucaaggugaagccacccuagucgaagaacaagacgccaauuuugucugccgccgaacguuuguagacagggguuggggaaaugguugcggacuguuuggaaaagguaguuugauaacaugcgccaaauuuaaauguguuacgaaacucgaagggaaaauuguacaauacgaaaacuugaaauacagcgugauugucaccguucacacaggcgaucagcaucaaguugggaacgaaucaaccgaacauggaacaauugcaacuauuacaccgcaagcuccaaccagugaaauacaacucacggacuacggugcguugacgcuugauuguagucccagaacaggccucgacuucaacgaaaugguauugcugacaaugaaagaaaaaucuugguugguucacaaacaaugguuccucgaucuaccacuaccauggacaaguggcgcuaguacuagccaagaaacauggaauagacaggaucuauuagucacauuuaaaaccgcucaugcgaagaaacaagaaguuguaguauuaggaucucaggagggugcaaugcauacugcucuaacuggagcaacugagauccagacuacugguacuacgacuauauuugcuggccauuuaaagugucgacucaagauggacaaacuaacauuaaaaggaaugaguuauguaauguguacagggucauuuaaauuagaaaaagaaguugcugagacccaacauggcaccgucuugguucagauuaaauaugaaggaacagacgcaccgugcaaaauaccguuuuccacacaagaugaaaaaggaguaacgcaaaacggacgauuaauaacagcaaacccuauagucacugauaaggaaaaacccguaaacauagaagccgaaccaccauucggugaaucuuauauaguaauuggagcaggggaaaaggcauugaaguuaagcugguucaagaaaggaaguucaauuggaaagauguuugaagcaaccgcgcgaggggcaaggagaauggcaauacuaggugacacagcaugggauuucgguagcaucggagguguuuucaccagugucggcaagcuaguccaucaaauauucggaacugcuuacgguguacuguuuaguggugugagcuggacaaugaaaaucggaauuggagugcuccuaacuuggcuggguuugaacucacguaguacaagucugagcaugacaugcauagccguaggguuaauaacucuuuaccuugguguaaugguccaggcugauucgggaugugucauaaacuggaagggaagagaauuaaagugugggucugguauauuuguuacuaaugaggugcacacauggaccgaacaguauaaguuucaagcggacucucccaaacgccuaucagccgcaauuggcaaggcuugggaggaagguguuugcgguauacgaagugcuaccagacuagagaacauuauguggcggcaaauaucgaaugaauugaaucauauucuccuagagaaugacaugaaguuuacaguuguagugggggaugucguaggaauacuagcacaaggaaagaaaaugguaagaccacagccaauggaacacaaauauuccuggaaaucauggggcaaagcuaaaauaaucggcgcagauguacaaaacaccacauuuauuauugacggucccaauacaccugaaugcccagaugaucaaagagcauggaacaucugggaaguugaggacuacgguuucgguauuuuuacuacuaauauauggcucaaacuuagagauucauacacucaagugugugaccacagauuaaugucagcggcaauaaaagauucaaaggcaguacaugcugauaugggauauuggaucgaaucugagaaaaaugaaacauggaaauuagcgagagcaucuuuuauagaggucaagacaugcauuuggcccaaaucacauacacugugguccaacgguguauuagaaagcgaaaugaucauaccaaaaauuuauggcgggccgauuucccaacacaauuacaggcccgguuacuuuacucaaacagcugggccguggcaucuaggaaaauuagaauuagauuucgaccuaugcgaaggcacgacuguuguggucgacgagcauugcggcaacagggggccuaguuugagaacgacaacaguaacuggcaagauuauucaugaguggugcugccggaguuguacauuacccccucuuagauucaaaggggaggaugguuguugguacggaauggagauaaggccuguuaaagaaaaagaggaaaaucuuguaaaaucaaugguaucugcagguucaggugagguagauaguuucagcuuaggucuauuauguauaucaauuaugauagaagagguaaugcguucgcgcuggucaagaaaaaugcugaugacugguacucucgcaguguucuuucuacucauaaugggccaacuaaccuggaaugaucuaauucgaucauguauuauggucggggcuaacgcaucugaucguauggggaugggaacuacuuaccucgcucuaauggcuaccuuuaagaugaggccaauguuugcgguaggacucuuauuuagaaggcuuaccaguagagagguacuauuauuaacaaucggucuaucccuaguagcuagcguugaauuaccaaauucauuagaagaacucggugauggauuagccaugggaauaaugauucuaaaacucuuaacagauuuccaguccuaucaacugugggcaaccuugcuaucacuuacuuuuauuaaaacaacauucucuuuacauuaugcauggaaaaccauggccaugguccucucuauugugagucuguuaccacugugccuuucgacuacaucucagaaaacaacaugguuaccggugcuccuaggaucacuaggguguaaaccauuaacuauguuuuugauugcagaaaacaaaauauggggaagaaaaagcuggccgcuaaaugaagggauaauggccguaggaaucgucucuauuuuauuaucaaguuuacugaaaaacgauguuccauuagcgggaccacucaucgcagggggaauguuaauagcgugcuauguaauaucuggaaguagugcagaucugucacuagaaaaagcugcagaaguuucgugggaagaagaagcagaacacucuggugcuagucacaacaucuugguagaaguacaagacgaugguacgaugaaaauaaaagaugaagaaagggaugacacccucacuauucuacuaaaagcuacccuacuugccguaaguggagucuauccguugaguauaccggccacccuauucguaugguauuuuuggcaaaagaagaagcagaggucaggggucuuaugggacacgccuaguccaccagaaguagaaagagcagugcuugaugauggaaucuaccgaaucaugcagcgaggauuauuagggagaagucaaguaggggucggcguauuucaggagaauguauuucauacgauguggcauguaaccagaggagcaguacuaauguaucaagggaaaagauuagaaccguccugggcauccguaaagaaagacuuaaucucuuacgguggugguuggaggcuacaggggaguuggaauacaggagaagaaguacaaguuauagcuguagaaccggggaaaaauccgaaaaacguucaaacugcacccgguacauucaaaacaccugaaggagagguaggagcgaucgcguuagauuucaaaccaggaacaucggggaguccuauaguuaauagagagggaaaaauaguaggccuguauggaaaugguguuguuacaacaucaggcacauaugugagugcaauugcacaagcaaaggcuucccaagaaggaccucuacccgaaaucgaggacgaaguuuuuaggaaaagaaaucuaacuauaauggaucuacauccuggauccgguaaaacaaggcgauaccuuccggccauugugcgagaagcaaucaaacggaaauugagaacccuaauacuagcaccuacaagagugguugccucagagauggccgaagcguugaaaggaaugccaauacgguaccagacuacagcaguaaaaucggagcacaccggucgugaaauuguggauuuaaugugccacgcgacauucacaaugagauuacuaucacccgugcgcguuccaaacuacaacaugauaauaauggacgaggcacauuuuacugacccaucuagcauagcugcgcgaggguacauaucaaccagggucgggaugggcgaggcugcagccauuuuuaugacagcaacacccccaggaucaguagaggcuuuuccucagucaaaugcaguuauacaagaugaagaaagggauauuccugagaggucauggaacucuggauaugaguggauaacggacuuccccggaaaaacgguaugguucgugccaucaauuaaguccgguaacgauauugcgaauugucuucggaaaaaugggaaaagaguaauacaauuaagccguaaaacguuugacacagaguaccaaaagacuaaaaauaaugacugggacuacguagucacaacagacauaucugaaaugggagcaaacuucagggcugacagagugaucgacccaagaagaugucucaagcccgucauauuaaaagauggacccgaacgcguaauacuagcuggucccaugccugugacaguagcaucugcugcacaaagaaggggaagaauugggaggaaucacaacaaggaaggagaccaauacaucuauauggggcaaccccugaacaacgacgaagaccaugcacacuggacugaagcgaaaaugcuucuugauaauauuaauacgccagaggggauaauaccagcccuauucgaaccagaacgcgaaaaaucagcugcuauugauggcgaauaucguuuacguggggaggcgcguaaaacguuugucgaacucaugagaagaggggacuuaccuguuuggcuuagcuacaagguagcaucggaaggauuccaguauucugacagacgauggugcuuugacggagaaagaaauaaucaaguccuggaggaaaacauggacguugaaauauggaccaaggaaggugaacguaaaaagcuccgcccaagauggcuagacgcgagaacuuauucagacccacuagcacuucgagaguuuaaagaguuugcggccggaagaagaaguguaucaggugacuuaauacuagagauaggaaaacugccucaacaucuuacccagcgugcccaaaaugcguuagauaaucucgugaugcuacauaauucagaacaagguggacgagcauauagacacgcaauggaagaacuaccggacacaauagaaacacugaugcugcuagcacuaauagccgugcuaacagguggugucacacuauuuuuccuuucagggaggggucuaggaaaaaccaguauagguuuguugugcguaauggcaaguucagcacuacuauggauggcuaguguggagccucacuggaucgcagcaucuauaauucuggaguucuuuuuaaugguacuccuaauuccggaaccugauagacagaggacaccgcaagauaaccaacuggcauaugugguaauaggucuccuguucaugauuuuaacuguagcugcuaaugaaaugggauuauuggagaccaccaagaaagacuuaggaaucggacauguagcagucgagaaucaucaccaugcaacuaugcuggacguagaucuacacccagcuucggcauggaccuuauaugcgguggcgaccacgauaauuacuccuaugaugagacacaccauugaaaauacaacugcgaacauaagucuuacagcuauagcaaaucaagcggcuauacuuaugggccuggauaagggauggccaauuaguaaaauggauauugguguaccuuuacuagcacuugggugcuauucacaaguaaacccuuuaacauuaacggcagcaguucugauguuggucgcacauuaugcuaucauuggaccagggcuacaagccaaagcuacacgugaagcgcagaaaaggacagcagcagggaucaugaaaaauccaacaguagauggaauugucgccaucgacuuggauccgguuguuuacgacgcuaaauucgagaagcaguugggacaaauaaugcucuuaauucuauguacaucacagauccuguugaugcgcacaaccugggcucugugcgaaagcauaacuuuggcgacggguccacuaacuacccuaugggagggaagcccagggaaguuuuggaacacgacuauugcggugaguauggccaauauauuccgaggaagcuacuuagccggcgcuggauuggcauuuagcuuaaugaagucucucggaggugguagaagagguacaggcgcccagggagagacacuaggagaaaaauggaaaaggcaacugaaccaacuuucuaagucugaguuuaacaccuauaaacgaagugggauaauggaagucgaucgcucagaagccaaagaaggacugagaagaggcgagaccaccaagcacgcagucaguagaggaacggcaaaacucagaugguuuguagaaagaaauuugguaaaacccgaggggaaaguuauagaucuaggaugcggaagaggaggcuggaguuauuacugcgccggguugaagaaagucacggaaguaaaaggauauaccaaaggaggucccggacaugaagaaccgauuccgauggcuacuuauggauggaacuuagugaaauuacauucagguaaagacguauuuuucauaccuccagaaaaaugugauacacuacuuugcgauaucggagaaaguucgcccaacccuacaauagaagaagguagaaccuuacgagugcuaaagaugguagaaccuuggcuuagagggaaucaauucuguauaaaaauauuaaaucccuacaugccuaguguagucgaaacucuugaacacaugcaacgaaaacacggugggaugcugguuagaaacccauuaucaagaaauucgacucacgagauguauugggugaguugcgguaccggcaacaucgugagcgcggugaauaugaccucuaggauguuauuaaauagauuuacaauggcacauagaaaaccaaccuacgaacgagauguagaccuaggcgcagguacgagacacguagccguggaaccugagguugcuaaucuagauauaaucggacagaggaucgaaaauauaaaacaugaacacaaaucgacauggcauuaugaugaggauaaucccuauaaaacgugggccuaucaugggucauaugaaguuaagccaucagguucagcuaguucuaugguuaauggugugguuaaauuguuaacaaaaccaugggauguuaucccaaugguaacgcaaauagccaugacugauacgaccccuuuuggucaacagagaguauuuaaagagaaagucgacacccgaaccccaaaagccaagagaggaacagcacaaauaauggaaguaacugccagguggcugugggguuuccuuagccgaaacaaaaagccacgaauaugcacuagggaagaauuuacaagaaaaguaagaucaaacgcagcaaucggcgcuguauucguggaugaaaaucaauggaauagcgcuaaagaagccgucgaagacgaacgguucugggauuuaguacacagggaaagggaauuacauaaacagggaaaaugugcuacauguguuuauaacaugaugggcaaacgagaaaagaagcuaggagaauuugggaaagccaagggauccagagcaauuugguauauguggcuuggagcgcgcuucuuagaguucgaggcuuuaggauucaugaacgaagaucauugguuuucccgugagaacucauuaaguggugucgaaggggaagguuuacauaaacucggauacaucuuaagagacauaaguaaaauuccaggaggcaacauguacgcagaugacaccgcagguugggauacacgcauaacugaagaugauuugcagaaugaagccaaaauaaccgauauaauggaacccgaacaugcacuuuuagcaacuucgauuuuuaaacuaaccuaccaaaauaagguugugaggguccaaagaccugccaagaacggaacuguuauggacguuauuagccgccgugaccaaagggggucuggucaggucgguacuuauggcuuaaacaccuuuacaaauauggaagcucaauuaauuagacagauggaaucugaaggaaucuucucuccgucagaacuggagacaccaaaccuagccgaaagaguuuuagauuggcuagaaaaauacggagucgagcgcuuaaagagaauggccauauccggagacgauugcguaguuaaaccuauugaugacagguucgcuacagcguugacagcauugaaugacaugggcaaagugaggaaagacauaccucaaugggagccuagcaaaggguggaacgauuggcaacagguaccguuuuguucacaucacuuucaccagcuaauaaugaaagauggaagggagauaguagugccuuguagaaaccaagacgaacucguagguagagcaagagugagucaaggggccgguuggagucuucgagaaacagcuugcuuagguaaaucuuaugcacaaauguggcagcuuauguauuuucauagaagagaucuuagauuagcugccaaugcaaucuguagugccgucccgguugauuggguacccacgucucggacaacgugguccauucaugcucaucaccaauggaugacuacagaagauaugcuaucggucuggaauaggguuuggauagaggaaaauccauggauggaagacaaaacucacauaucuuccuggggugacguaccauauuuaggcaagcgagaagaucaaugguguggcucgcuaauaggacuuacagcgagggcaacuugggcuacuaauauacagguagcgaucaaucaaguaagaagacuuauaggcaaugaaaauuaccuagauuacaugacgaguaugaagcgauuuaaaaaugaguccgauccagagggggccuuaugguaa

SEQ ID NO: 21630 - RNA, 9879 nt, Artificial Sequence
  derived and/or modified CDS sequence (opt6) from DENV-1__GQ868606__SS-prME
agcguaacaauguuauuaauguuaaugccgacggccuuagcauuucaucuaacaaccagagguggggaaccacacaugauaguaaguaaacaagaaagagggaaaucuuuauuauuuaaaacuucagccggcguaaauaugugcacauugauagccauggauuugggagaguucugcgaagacacgaugaccuauaaauguccucggauaacggaagcugaaccugaugauguugauuguugguguaaugcuaccgacacuuggguuacauacgggacaugcucucaaaccggagaacauagaagggacaaaagaucaguagcacuagcaccacacgucggucuagguuuagaaaccaggacagagacguggaugucaagugaaggagcauggaaacaaauccaacgaguugaaacuugggcccugagacauccaggauucaccguuauugcacuauuuuuagcgcacgcgauaggaacgucuauuacacaaaagggcaucauauuuauauuacuaauguuaguaacccccucuauggcaaugagaugcguuggcauuggaucaagagauuucguggaaggacucaguggugcaacauggguagauguuguucuugaacaugguagcuguguaaccacuauggcaaaagacaaaccuacuuuggauaucgaauuacuaaaaacagaaguaaccaaucccgcaguacugcgcaaauuaugcauagaagcuaaaauaucaaacacgacuaccgauuccaggugcccaacacaaggugaagcaacauuagucgaagaacaagacgcaaauuucguauguaggaggaccuuuguagauagaggauggggaaauggguguggucuguucggaaaaggaucgcuaaucacaugcgcuaaauuuaaaugcguaacaaaacuagaaggaaaaacaguucaauaugaaaacuugaaauauaguguaauaguaacgguacacaccggagaucaacaucaaguagggaaugaauccacagaacaugggacaacagcgaccauuacuccacaggccccaaguacugagauccaauuaacagacuauggggcuuuaacauuggacugcagcccaagaaccggacuugacuuuaacgagaugguacuccucacuaugaaagaaaaauccugguuaguacacaaacaaugguuuuuagaucuuccgcuaccguggacaaguggagcuuccacuucacaggaaacauggaaccgaaaagaucuucuaguaacuuucaaaaccgcgcacgccaagaaacaagaaguuguuguauugggaagucaagagggcgcuaugcauacagcacuaacuggagccacugaaauucaaacgucugggacaacgacgaucuucgcaggacaccuaaaauguaggcucaaaauggauaaguuaacccucaaaggcaugucguauguuauguguacuggaaguuuuaagcuggaaaaagaagucgccgagacgcaacauggaacuguucucguucagauaaaauaugaaggcacugaugcuccgugcaaaauaccguuuucaacgcaagaugaaaagggagucacccaaaacggaagacucauuacugcgaacccaaucgugacagacaaagagaagccgguaaauauugaggccgaaccacccuucggugaaucguacauuguuauaggagcuggagaaaaggcucucaaacuauccugguuuaaaaagggaagcucaaucgggaaaauguuugaagcaacugcaagaggagcgagaaggauggcgauacuaggcgauacugcaugggauuuuggcucuauagguggaguauuuacauccguuggcaagcuagugcaccaaauauuuggaacagcauacgggguccuauuuucugguguaucguggacaaugaaaauaggcauaggugugcuguugaccugguuggggcuuaacucuaggaguacgagucuaaguaugacaugcauagcaguuggccuagucacccuauauuuagggguaaugguucaggcagacucuggauguguuaucaauuggaaaggucgggaauuaaagugcgguucgggaaucuucgucacaaaugaaguacacacauggacugagcaauacaaauuccaagcggauucuccaaaacgguugagugcugcuauagggaaagcaugggaggaaggcguaugcgguauucgaucagcuacacgauuggagaacauaauguggaaacaaaucaguaaugaauuaaaccauauucugcucgaaaacgacaugaaauuuacuguagucguaggcgauguagcuggaauccuugcacaaggcaagaaaaugauccguccacaaccaauggaauauaaauacucauggaaaucaugggguaaagcgaaaauaauaggugcugauguacagaacacgacauucauuauagauggaccaaauacaccagaaugccccgaugaucagagagcauggaauauaugggaaguggaagauuacggguuugguauauuuacaacaaauauuuggcuuaaauugagagacaguuauacccaggugugugaucaucgucuaaugucagccgcaaucaaagacuccaaagcgguacaugcggacaugggcuauuggauugaaucggagaaaaaugaaacauggaaauuagcuagagcaaguuucauugaaguuaaaacuugcaucuggccaaagucccauacgcuauggucaaauggaguuuuagaaagugaaaugauaaucccuaaaauauauggaggaccaauuagccaacauaaucacaggccaggcuauuucacgcaaacugcaggaccauggcauuugggaaaacuagaauuggacuucgacuugugugaagguacuacgguugugguagaugaacauuguggaaauagagggccuucauuaaggacaacaacugugacagguaagauaauccacgaaugguguugcagaucguguacucuuccgccuuuacguuuuaaaggugaagacgguugcugguaugguauggaaauacgaccuguaaaagaaaaagaagaaaaucuaguuaaauccaugguaucggcaggaagcggggaaguagacucauuuucuuuaggucucuuauguauuaguauuaugauugaagaagucaugcgaaguagauggagccgcaagauguuaaugacugguacauuagcaguguucuuuuuauugaucaugggacaauuaacuuggaacgacuuaauuagauuauguauuauggucggagcgaacgcaagugauaggauggguauggguacgacauauuuggcccuaauggcgacauuuaagaugcggccgauguuugcugucgguuuacuuuuuagacguuuaacuagcagagagguguuacuguugacaauuggauuaagccuugucgcgucaguagaacucccaaauuccuuagaggagcuuggugauggccucgcaauggggaucaugauuuuaaagcuguuaacugauuuucaaucacaucaacuaugggcaacacuucuaucuuuaacauucauaaagacuacauuuucucuccacuaugcauggaaaacuauggcaaugguguuaucaauuguaaguuuauuuccgcugugucuaucgacaaccagucagaaaacaaccuggcuaccaguauuacuagguucauuagguuguaaacccuugacaauguuucucaucgcggagaauaaaauuuggggacgaaaaaguuggccccuuaaugaaggaauaauggcaguagguauagugucgauccuucuauccucacuucuaaagaaugacguuccauuagcaggcccguuaauugcaggggguaugcuaauagcguguuacguaauaagugguucuucugcagaucuaagucuagaaaaagcugcugaaguauccugggaggaagaagccgagcacucuggugcuucgcauaacauuuuaguagagguucaggacgaugguacuaugaaaauuaaagacgaagaaagagaugauacuuuaacuauacucuugaaagccacccuacuagcagucucuggaguuuacccacuuucgauuccugccacuuuauucgucugguacuucuggcagaaaaagaaacagaggucuggaguacuuugggauacaccuucaccuccagagguugaaagggcaguucuagacgacggaauuuauagaaucaugcaaagggguuuacuagggcggucacaagucggggugggugucuuucaagaaaacguguuccauacaauguggcauguaacaagaggagccgucuuaauguaccaagguaaacgauuagaaccgucaugggcuucugucaagaaagauuuaauaucauacggugguggauggaggcuucaagguaguuggaacacgggagaggagguucaggugauagccguggaaccagguaaaaaccccaaaaauguacagacagcaccuggcacguuuaaaacaagugaaggggaagugggagcaauugcccuagauuuuaaaccaggcacaucugguucaccaauuguaaauagagaaggaaaaauuguggguuuauacggaaauggcguuguuacgacuagcggaacauacguuucagcgauugcacaagcuaaagcaagccaagaaggaccgcuaccagagauagaagaugaaguauuccgaaaacggaaucuuacaaucauggaucuacacccuggaagcgguaaaacucggagauaucuaccugccauagugagagaagcuauuaaaaggaaauuacgaacucuaauauuagcaccaacgagaguaguugccucagaaauggcagaagcauugaaagggaugccaauaagguaucaaacuacagcagucaaaucugaacauacaggaaaggagaucguggaccuuaugugccacgcuacuuucaccaugagauugcucucaccuguacgagugccuaacuacaacaugauaauaauggacgaagcgcauuucacagacccgucgucuauugccgcucguggauacauuagcaccagaguuggaaugggagaagcagcagccauauuuaugacagcaaccccgccggguaguguagaagcauucccucagucaaaugcaguuauccaagaugaggagcgggauauuccugaaagaagcuggaacucagguuacgaauggauaacagacuucccugguaaaacagugugguuuguuccaucaauaaaaagcggcaacgacauagcaaacugucucaggaagaacgguaaacgcguuauucaacucucaagaaaaacguuugauacggaauaucaaaagacuaagaacaacgacugggauuauguagugaccacagauauauccgaaaugggugcaaacuuucgcgccgaucguguaauugacccacgccgaugucuuaaacccgucauauuaaaggaugguccagaacgaguaauucucgcaggaccaaugcccguuacaguugccagcgcagcacaacggagaggacggauagggaggaaccacaauaaagagggggaucaauauaucuacaugggucaaccacuaaacaacgacgaagaucaugcacauuggacugaagcuaagaugcuacuugauaauauuaauacaccugagggcauaauaccugccuuauucgaaccggaacgagaaaagagcgcugcaauagacggagaguaucggcugagaggggaagcaaggaaaacauuuguugaauuaaugaggcgaggagauuuacccgucuggcuaucauacaaaguagcaucugaagguuuucaauauucagaucgccguuggugcuucgauggagagcguaauaaccaaguuuuggaagaaaauauggacguagaaauauggacuaaagaaggagagaggaagaaauuaagaccaagguggcuggaugccaggacguacagugaucccuuagcauuacgggaguuuaaagaauuugcagcagggcggaggagcguaucaggcgacuuaauuuuggaaaucggaaaacuaccucaacaccuuacacaaagggcacagaaugcacuggauaaccuuguuaugcuucacaacagcgaacaagguggaagggcuuacaggcaugccauggaagaacuuccugauacgauagaaacgcuaaugcuacucgcgcuaauagcuguacuuacggguggaguaacuuuauucuuuuugagugggagaggcuuaggaaaaacuagcauaggacuuuuaugugucauggcuucauccguacuucuauggauggcuucuguggaaccgcacuggaucgcugcuaguauuauuuuggaguuuuucuuaaugguauuauugauuccugaaccggaucgacaaagaacaccacaagauaaucaacuagcguacguaguaauuggguuauuguuuaugauacugacaguugccgcgaacgaaaugggacuguuggaaaccaccaagaaagaucucggaaucggacacguagcgguugaaaaucaucaccaugcugcaaugcuugauguugauuuacacccugccagcgcuuggacccucuacgcuguagcaacuaccaucauuacuccuaugaugcgccacaccauagagaauaccacggcgaauauuagccugacugcuauugcaaaucaagcagccaucuuaauggguuuagauaagggcuggccgauaucgaaaauggauauaggugucccauuguuagcacucggauguuacucucaaguaaacccauuaacucugaccgcugccgugcuaaugcucguugcacacuaugcaaucauugggccaggucuacaagcuaaggcgaccagagaggcacagaaaaggacugcugcugguauaaugaaaaauccaacagucgacggaauuguagcuaucgauuuagauccgguaguauaugacgcaaaguuugagaaacaauugggacaaauaaugcuguugauccucuguacaucacaaauccuucuaaugcgcaccacaugggcacuaugugaauccauaacccuagcaacagggccgcucacaacacucugggaagguucaccuggaaaguuuuggaauacaacaaucgcuguaucaauggcgaauaucuucagagggaguuaucuugcuggugcuggcuuagcguuuucucuaaugaaaucauuagggggaggacgaagagguacgggggcgcagggugaaacauuaggagagaaguggaagcgacaacuaaaucaacucucaaagucugaauuuaauacauacaagcggucaggaauaauggaaguugaccgaucagaagcaaaggaaggauuaaaaagaggagagacaacaaaacacgcaguaagucguggaacugcaaaauugagaugguuugucgaacgcaaucuggugaaaccugaaggaaaaguaauugacuugggaugugggcgaggugguuggaguuacuauugugcaggucugaagaaaguuaccgagguaaaaggauauaccaagggaggcccgggccacgaagaaccaauaccaauggcgaccuauggcuggaaucucguuaaauuacauucagguaaagauguuuucuuuauuccaccagagaaaugcgauacguuacugugcgacauaggagaaagcucaccuaauccgaccauagaagaaggaagaacacuacgcgugcugaaaaugguagaaccauggcuacggggcaaccaauuuugcauaaagauacuaaauccuuauaugccuucuguaguagaaacgcucgaacagaugcagcgaaaacauggagguaugcuggucagaaacccccucaguagaaauucuacucacgaaauguauuggguaaguugcggaacaggaaacauaguuagcgcagucaauaugacuucaagaaugcugcuaaacagauuuacaauggcucauagaaagccaacauaugaaagagacguugacuugggugcgggaacgcgccauguagcaguugagccagaaguugcuaaucuagauaucauaggacaaaggaucgaaaacauuaaacacgaacacaaaucaacauggcacuacgacgaagacaauccauacaagaccugggcauaccaugguucguacgaaguuaaaccaagcggaucugcaucaucaaugguaaauggaguagucaaauuauuaacaaaaccgugggacgugauaccaaugguaacgcaaauagcaaugacugauaccaccccauuuggucaacagcgcguuuuuaaagaaaaaguagacacacguacgccuaaagcaaaacgaggcaccgcacaaauuauggaaguaacagcuaaauggcuauggggauuuuuguccagaaauaagaaaccccguaucuguacacgugaagaguucaccagaaaaguaagaucuaacgccgccauuggagcaguguuugucgacgaaaaccaguggaacagugcaaaggaagccguugaagacgaacgcuuuugggauuuagugcauagagagagagaacugcauaaacagggcaaaugugcaacgugcgucuauaauaugaugggaaaaagggagaagaaauuaggugaguucgggaaggcaaaagggucccgggcuaucugguacaugugguuaggagcaagauuucuugaauuugaggccuuaggauucaugaaugaggaucauugguuuagucgcgaaaauucacugucggggguggaaggugaaggauuacauaaacuaggguacauucuacgcgauauaagcaaaauaccagguggaaauauguacgcagacgauaccgcuggaugggacacgcggauaaccgaagaugauuugcaaaaugaagccaaaauaacagauauaauggaacccgagcaugcgcuauuggcgaaaucaauuuucaaacucacuuaucagaauaaaguaguuagagugcagcguccggcgagaaauggcacaguaauggacguaauaucacgacgcgaccaacgugggucaggacaaguaggcacuuauggcuugaacacauucacaaacauggaagcucaacuaauaagacaaauggaguccgaagguauauucagucccucagaacuugaaacgccaaaucuagccgguaggguguuagauugguuagaaaaacacgggguggaacggcugaaacgaauggcuauuaguggugaugauuguguaguaaaacccauagacgaccgcuuugcgacagcucugacagcccucaacgauauggggaaaguucgcaaagauauaccccaaugggaaccauccaaggguuggaaugauuggcaacagguaccauuuugcagucaucauuuucaucagcuaauaaugaaggauggucgagaaauuguaguacccugcaggaaccaggaugaauuggugggccgagcacguguaagucaaggugcugguuggucauugagagagacagcauguuuaggaaaguccuaugcccagauguggcaacucauguauuuccauaggcgggauuugagauuagcagcgaaugcuauaugcucagccguaccgguggauuggguaccaacaagucguacaacauggagcauucacgcacaccaucaauggaugacaacagaggauauguugucaguguggaaccgaguauggauagaagaaaaccccuggauggaagacaaaacacauaucucuaguuggggagaugucccuuacuuaggcaaacgagaagaucaaugguguggaucucuuauaggauuaacugcgagggcgacaugggcaacaaacauacaaguagccauaaaccagguacgaagacugauagguaaugaaaauuaucucgacuauaugacaucaaugaagagauucaaaaaugaaucagaccccgaaggugcacuaugguaa

SEQ ID NO: 21631 - RNA, 9879 nt, Artificial Sequence
  derived and/or modified CDS sequence (opt6) from DENV-1__FJ882539__SS-prME
ucaguuacaaugcuauuaaugcuaaugccuacagcucuagcauuucauuuaacuacuagagggggagaaccacauaugaucguuaguaaacaagaacggggaaaaagccuuuuauucaaaacauccgcuggugugaacaugugcaccuuaauagcaauggauuuaggagaauuuugugaagauacuaugacauauaaaugccccaggauaacagaagcagaaccggaugauguugauuguugguguaacgcgacagacacuugggucacguauggaacuuguagccaaacaggggaacaucguagggacaaaaggagcguagcauuagcaccgcauguaggauuaggauuagaaacaagaaccgaaacuuggaugagcucugaaggagcguggaaacagauucagcggguugaaacuugggcauuacggcacccaggguuuaccgugaucgcuuuauuucuggcacaugcaaucggaacuagcauaacccaaaaaggcaucaucuucauuuuguugaugcuaguaacgccgucuauggcaaugcguugcgucggcauaggcucacgggauuuuguagagggccuuagcggagcuacauggguagauguagucuuggaacauggauccuguguuaccacaauggcuaaagauaaacccacucuugacauugaauuguuaaaaacugaagucacuaauccugccguacuaagaaaauuaugcauagaagcaaaaauaucuaauacuacgaccgauucccguuguccaacgcaaggugaagcgacauuagucgaagaacaagaugccaauuuuguuugccguagaaccuucguggauagaggguggggcaacggaugugguuuauuuggcaaaggcucacugauaacuugcgcuaaauucaaaugcguaacgaaacuagagggaaaaacuguccaauacgaaaaucuuaaauacagcgucauaguuacgguacacacuggugaucagcaccagguuggaaaugaaucgaccgagcaugguacgacggccacuauaacaccacaagcgccauccacggaaauucaauuaacagacuauggggcgcucacauuagacuguucaccaagaaccggacuugacuucaaugaaaugguuuuguuaacgaugaaagaaaaaucuugguugguacauaagcaaugguuccuugauuuaccgcuaccuuggacgucaggugcuuuggccucacaggaaacuuggaacagaaaagacuuauugguuacauuuaaaacugcccacgcaaagaaacaagagguugucguacuaggaucucaagaaggagcuaugcacacagcacugacgggugcaacggaaauacaaacaagugguaccaccacgauauuugcgggccaucuaaaaugccgacuuaaaauggauaaauuaacacuaaaaggaaugucauaugugaugugcacaggcaguuucaaauuagaaaaagagguagccgaaacacaacauggcacgguauuaguccaaauaaaauaugagggaacagaugccccuugcaagauaccguucucgacacaagacgaaaaaggcaucacacaaaacggaagauugauaacugcaaaccccauuguuacagacaaggagaaaccuguuaauauagaagcggaaccaccguucggcgaaucguauauuguuaucggcgcaggggaaaaagcucuuaaacuaaguugguuuaagaaaggcuccucuauaggaaagauguucgaagcaacggcgaggggagccagaagaauggccauacuuggagauacagcaugggauuuugguucuauugguggcguguuuacguccguagggaaguuaguacaucagauauucggaacagcauacgguguccuguuuagcggaguuucauggacgaugaagauaggaauaggagugcuccuaacaugguuagguuuaaacaguaggucaacuucacuaucuaugaccugcaucgcaguaggccuuguuaccuuauaccuaggaguaaugguccaggcagauucagguugcgugaucaauuggaagggaagggaacuaaaaugugggagugggauauucguaacuaacgagguucacacuuggaccgagcaauauaaauuucaagcagacucaccaaaacggcugagugcggcuauaggaaaggcuugggaagaaggaguaugugguauaagaagugcaacgagacuugaaaacauaauguggaaacagauaucgaacgagcuaaaucauauuuuacuagagaacgacaugaaauucacagugguagugggcgauguugcaggcauucuagcccaaggcaagaaaaugauacgaccacaaccaauggaguauaaauacaguuggaaaucauggggcaaagcuaaaauaaucggugccgacguacagaauacuacuuucauaaucgacggcccaaacaccccagaguguccagaugaucaacgagccuggaacaucugggaaguagaagauuacggguuuggaauauucacaacgaauauauggcuaaaacuacgagacaguuauacacaaguaugugaucauagacuuaugagugcagcaauaaaggauucgaaagcuguccaugcugacauggguuacuggauugagagugagaaaaaugagacuuggaaacucgcgcgagccagcuucauagaaguaaaaacuuguauauggccgaagagucauacuuuguggagcaaugguguauuagagagugaaaugauuaucccaaagauauaugggggucccauaagucaacacaaucacaggccgggauauuucacucagacugcagguccauggcauuuaggaaaauuagagcucgacuucgaccucugugaaggaaccacagucguaguagacgaacauuguggaaauagaggacccucccuaagaacaacaacagucacugguaagauuauacacgagugguguugccgaucaugcacauuaccgccuuuacgauuuaagggcgaggaugguugcugguaugguauggaaauuaggccagugaaagagaaagaagaaaaucuugucaaaucuaugguuucagcaggaucaggggaaguagacucauuuagucuaggauuguuauguauuaguauaaugauagaagaagugaugagaaguagauggucccguaagauguuaaugacaggcaccuuagccguuuucuuucuauuaauaaugggucaacucacuuggaaugaccuaauucgacuuugcauuaugguaggcgcaaaugcgagcgacagaauggguaugggaacaacauauuuagccuugauggcuaccuuuaaaaugcgccccauguuugcaguuggcuuacuuuucagaagauuaacauccagggaaguauuguuacugacaauuggacuuagccucguagcaucuguugaguugccaaauagccuagaagaauuaggggacggcuuggcaaugggaaucaugauacuaaaacuuuugacugacuuucaaagccaccaacuuugggccacgcucuugagucuuacuuuuaucaaaacaacuuucucacuacauuaugcuuggaagacaauggcgaugguguuaaguaucguaucgcuauuuccauuaugccuaucuaccacaucgcaaaagacuacaugguuacccguacugcucggcagucuaggauguaaaccuuuaacuauguuucuaaucgcggaaaauaaaauuuggggacggaaaucguggccacuuaacgaggggauuauggcaguaggaauaguuucaauauuacuuaguagucuacuuaaaaaugacguuccccuagcgggaccucuaauagcggguggcaugcuaauugcuuguuauguuauuaguggaagcucagcagauuuaucguuggaaaaggcugcagagguuucaugggaggaagaagcggaacauagcggugcaucucacaauauucucguagaaguacaagaugaugguaccaugaaaauaaaagacgaggaaagggacgauacucuaacaaucuuguuaaaggcaacucucuuggcagugucaggaguauacccucuuuccauaccagcaacgcuuuuuguaugguauuuuuggcagaaaaagaaacagaggagcgguguacuuugggauacaccaagcccgccagaaguagaaagggcgguguuagaugauggcaucuauagaaucaugcaaagaggccuuuuaggccguucacaagugggcguaggaguauuccaagaaaauguguuccauacuauguggcauguaacucggggugcuguacuaauguaccaaggaaaaagacuugaaccaucaugggcgaguguuaagaaagacuuaauuucguauggcggagguuggagacuacaaggaucauggaacacaggagaagaaguacaagugauagccgucgagcccgguaaaaauccgaagaauguacaaacagcucccgguacauucaaaacaucugaaggggaaguuggcgcuauagcguuggauuucaagccgggaaccagcggaucuccuauugugaacagggaaggaaagauaguaggucuauauggaaacgguguaguuacaaccagugguacauacguaagugcuauagcgcaagccaaagccucccaagaaggcccguuaccagagauagaagaugaaguuuucagaaaacgaaaucuaaccauaauggauuuacacccagguuccggaaaaacaagacgauaccuacccgcuauugugagggaggcuauuaaacguaaauuacggacacugaucuuggcaccaaccagagugguggcaucagaaauggcagaagcauuaaagggaaugccuauaagauaucaaaccacagcagucaaaucggagcauacaggaaaggagauuguggaucuaaugugccaugcaacauucacaaugagauuacuuagcccgguuagaguuccaaacuacaacaugauaauaauggacgaagcucacuuuaccgauccuaguucaauugcagcaaggggauauauaaguacuaggguaggcaugggagaagccgcagcuauauucaugacagcaacuccgcccgguuccguagaagcauucccacagucgaaugcgguuauacaagacgaggaaagagauaucccggaacgcaguuggaauaguggcuacgaauggauaaccgauuuucccgguaaaacaguuugguuuguuccaaguauuaagucgggaaaugacauagcgaauuguuuacgcaagaacgggaagcgaguaauacaauuaucaagaaaaacguucgauacugaguaccagaaaaccaaaaacaacgacugggauuauguaguaacaaccgauauaucagaaaugggagcuaauuuccgagcggauagagucauagauccgagacgauguuugaaaccaguaauucucaaggacgguccugagcgggucauuuuagcagguccaaugccaguuacgguugcaagcgcagcacaacgacgggggcgcauaggucgaaaccacaauaaggaaggagaucaauauauauacaugggccaaccgcuaaacaacgacgaggaccacgcacauuggacugaggccaaaaugcuuuuagauaauauaaacacaccugaaggaauaauccccgcacucuucgaaccagagagagagaaauccgccgcgauagauggagaauauagauuacgaggcgaagcccgaaaaacauucguagaacuaaugcgacggggcgaccuuccaguuugguuaucauauaagguugcuucagaaggguuccaguacucggaucgcagaugguguuuugauggagaacgaaauaaccagguucuagaagaaaauauggauguggaaauauggacgaaagaaggugaaagaaagaaauugcgaccgagguggcuugacgcacgaacuuauagcgauccacucgcacuacgcgaguucaaagaguucgcagcagggagaagaagugugagcggggacuuaauucucgagauagguaaacuuccacaacaucuaacgcaacgagcccagaaugcgcuagacaaucuaguuauguuacauaacagcgagcaagguggcagagcguaccgacaugccauggaagaauuaccagauacgauugaaacccuuaugcuccuugcacuuauagcuguuuuaacaggcgguguaacgcuuuucuucuugucgggcagaggacucgguaaaacaucuauuggucuacuuuguguuauggcaucgucgguucuacuauggauggcgagcguagaaccccauuggauugcugcuaguaucauauuagaguucuuccuaauggucuuauuaauaccggagccugaucgacaaagaaccccacaagacaaucaauuggcauauguaguaauagggcuauuguuuaugauucuuacaguagcugccaaugagaugggacuuuuggagacuacuaagaaagauuuagggauaggacauguugcaguggaaaaccaucaucacgcagcgaugcuagacguagacuuacauccugcaucagccuggaccuuguaugcggucgcuaccacaauuaucacgcccaugaugcgucauacgaucgaaaauacaacugcaaauauuucguuaacagccauagcaaaucaggcagcuauauuaaugggguuggauaaagguuggccaauuaguaaaauggauauuggaguacccuuauuagcgcuuggcugcuauucccaagucaacccuuuaacccuaaccgcggccguuuuaaugcucguugcacacuacgcgauuauagguccagguuugcaagcgaaagcuacgcgagaagcucaaaaacguaccgccgccgguauuaugaaaaacccgaccguagacggcaucguagccauagaccuagacccaguaguauaugaugcaaaauucgaaaaacaauuaggacaaauaaugcuauuaauauuaugcacaucacagauucuauugaugagaacuacgugggcccucugugaaaguauaacccuagcuacuggaccguugacuaccuugugggaagguagcccagguaaauuuuggaacacgacgauugcaguuucuauggccaacauuuuucgaggcucauaucuagcgggagcaggccuagcuuuuagccuaaugaaauccuuaggaggcggcagacguggcacaggagcgcaaggggaaacacugggagaaaaauggaaacgucagcuaaaucaacugaguaaaucggaguuuaauacguauaaaaggucgggaauaauggagguagacagaucugaagcaaaagaagggcuaaaaaggggugaaacaacaaaacaugcaguaucacguggaacagcuaaauuaagaugguuuguggaacgaaaucuuguaaaaccugaagguaaagugauagaucucggaugcggucgagggggcuggagcuacuacugcgcgggacuaaagaaaguaacagaaguaaaaggauacacaaagggagggccggggcaugaggaaccaauucccauggcaaccuauggauggaaucuuguaaaacugcacagcggcaaagacguguuuuucauaccaccugagaaaugcgacacucuucuaugugauauaggugaaagcucuccaaaucccacuaucgaggaaggaagaacauuaaggguauugaaaaugguagaaccuuggcuacgaggaaaucaauucuguauuaaaauauuaaauccauacaugcccagcguuguugaaacacuagaacagaugcagagaaaacacggaggcauguuaguccggaacccauugagucgaaauucaacucacgagauguacuggguuucguguggaacaggaaacauugugucugccgugaacaugacgucgaggaugcuguuaaaccgguucacaauggcacaucguaaacccacauaugaaagagauguagaucuaggagcugggacucgccaugucgcaguggaaccagaaguugcaaacuuggauauaauuggacaacgcauugagaauauaaaacaugagcauaagucuacuuggcauuaugacgaggacaauccauauaaaacaugggccuaccauggauccuacgaaguaaagcccaguggcagcgcgagcucuauggugaacggagucgucaaauuacuaaccaagccaugggaugugauaccaaugguaacacaaauagcaaugacagauacuacaccauucggacaacaacguguuuuuaaagagaaaguugauaccagaacaccaaaagcaaaaagagggacagcacaaauuauggaaguuacagcaaaauggcuguggggauuuuuaaguagaaauaagaagccacgaauuuguacaagagaagaauuuacacgcaaaguccgaucaaacgcagcaauaggggcugucuuuguugaugaaaaucaauggaacucagcgaaggaagcaguagaggaugaaagauuuugggaucuagugcacagagagcgugaguuacauaaacagggaaagugugccacuugcguguauaacaugaugggcaaacgagagaagaaacuuggagaauuuggaaaagcaaagggaagccgggcaauaugguauaugugguugggagcaagauuuuuagaguucgaagcgcuugguuucaugaaugaagaucacugguucaguagagaaaacagcuugucagguguggagggagaggguuugcacaaauuggguuauauuuugagagacaucaguaaaauaccaggcgguaauauguacgccgaugacacagcuggaugggacacacgcauuacugaagacgaccuucaaaaugaagcuaaaauaacugauauuauggagccugaacaugcauuauuagcuaagagcauuuucaagcucaccuaccaaaauaaggucguuagaguccaaagacccgcaaagaauggcacggucauggacguaauaucuagaagagaccagagggggagcgggcagguaggaacauauggcuugaauaccuuuacuaacauggaagcacaacucauacgacaaauggaaucggaaggaauauuuaguccaucagaauuggaaacaccuaaucuugcgggaagaguauuagacuggcuugaaaaacacggcguggaacguuuaaagcgcauggcuauaucgggugacgauugcguuguuaagcccauagacgacagguucgcuacugcauugacagccuuaaaugauauggguaaaguuagaaaagacaucccccagugggaaccgucuaaaggauggaacgauuggcaacaagucccuuucugcagccaucacuuucaccaacuaauuaugaaggauggcagagagauagucgugccaugccgcaaccaagaugaauugguaggacgagcaagggugucgcagggagcuggauggucccuuagggagacagcuugcuuaggaaaaucauacgcgcagauguggcaauuaauguauuuucaucgcagagauuuacgauuagcggcgaaugcuauuuguagugcuguaccuguagacuggguuccaacgagcagaacaacauggagcauucacgcacaucaccaauggaugacaacagaagauaugcuauccguauggaaccgaguguggaucgaagaaaauccuuggauggaagacaaaacucauauaucaagcuggggugauguacccuauuuagggaaacgugaagaucaaugguguggaagucugauaggauugacggcacgagcuacgugggcaacuaauauacaaguggcaauaaaucaagugagacgauuaaucggaaaugaaaacuauuuagacuacaugacaaguaugaagcgauucaaaaaugagucugauccugagggugcccucugguaa

SEQ ID NO: 21632 - RNA, 9879 nt, Artificial Sequence
  derived and/or modified CDS sequence (opt6) from DENV-1__FJ882541__SS-prME
aguguuacuauguuacuaauguuaaucccaacggcguuggcuuuucaccuuacgacacguggaggagaaccucauaugaucgucucuaaacaagaaagaggcaaaagccuacuuuuuaaaaccucagccgguguaaauaugugcacguuaauugcaauggaucucggggaacugugcgaagauacuaugaccuauaaauguccacgaaucacagaaguugaaccagaugacguugacugcugguguaauacgacagacacauggguaacauauggcaccuguagccaaacgggugaacaucguagagacaaacggucuguagcccuagcaccgcaugugggauuaggucuugaaacccgugccgaaacguggauguccagugagggugcguggaaacaaauacaaaaaguggaaaccugggcacuucgccaccccgguuucacuguaauagcgcuauuuuuagcacacgcgauagguacaaguaucacccaaaaaggaauuauuuuuauauuauuaaugcuugucacacccagcauggcuaugcguugcgugggaauuggcucuagagacuuuguugaaggucugagcggagcaacuuggguagauguagucuuagaacauggcaguugcguaacaacaauggcuaaagauaaaccaacacuugauauagaguuacucaaaacugaaguuacuaacccagcuguccuccgaaaacuauguaucgaagcaaaaauaucuaacacgacaacugauuccagaugcccaacucaaggagaagcaacauuaguggaggaacaagacgcaaacuucguuuguagaagaaccuucguagauagagguuggggcaacgguugcggauuauuugguaaaggaucccuaauaacaugcgcuaaauucaaauguguaacaaaauuggaaggaaagauaguacaauaugagaacuuaaaauauucaguuauaguaacaguucacacaggagaucaacaucaagucgguaacgaaucaaccgagcacggaacgaccgcuacgauaacaccacaagcgccaaccucagaaauucaauugaccgacuauggagcacuuacuuuggauuguucuccuagaacgggacuagauuuuaacgagaugguacugcuaacaaugaaaggaaaaaguuggcuagugcauaagcaaugguuuuuagacuuaccguuaccuuggacgucaggcgcaagcacuagccaagaaacauggaaccggcaagaccuauuaguaacuuuuaaaaccgcacacgccaagaaacaagaaguagucguucuaggaucacaagaaggugcaaugcacacagcauuaacaggggcaacggaaauacaaacauccgguacaacgacaauuuucgcagggcauuuaaaauguagauuaaaaauggauaaguuaacgcuaaaaggaaugaguuacgucauguguacaggcaguuucaaacuagaaaaagagguggcugaaacccaacauggaacgguucucguacaaauuaaauaugaagggacagacgcgcccugcaagauaccguuuaguacccaggaugagaaaggcguuacacaaaaugguagacuuaucacagcaaacccaauuguuacugauaaggaaaaaccagugaauauagaggccgaaccuccuuuuggugaaaguuauauaguaauuggcgcuggagaaaaagcacugaaacugagcugguuuaagaaaggcucuagcauaggaaaaauguucgaagcaacagcuagaggugcaagaagaauggcaauacucggggauacugccugggauuucggcaguauaggagggguauucacaucgguggggaaacuuguacaucaaauauuuggaacugcuuacggugucuuguuuaguggcguaaguuggacuaugaagauuggaaucggaguguuacuaacuuggcuaggacuaaacucacguucaaccagccugucuaugacuuguauugcaguaggccuuguaacucuauaucucggcguuaugguacaagccgacucugguugcguaauaaauuggaaaggucgagagcuaaaauguggcucagguauuuuuguuacaaacgaaguacacacauggacagaacaguauaaauuucaggccgauucuccaaagagauugucugcagccauuggcaaggcuugggaggaaggaguauguggaauacguagugcaacuaggcuagaaaauauaauguggagacagauauccaaugaacuaaaccauauccuauuagaaaaugauaugaaauuuacaguaguaguaggagauguaguaggaauauuagcucaagguaagaaaaugaucagaccacaaccaauggagcauaaauacucuuggaaaaguuggggcaaggcuaagauaauaggagcugacguccagaauacuacuuuuauaauagauggaccaaacacuccggaaugcccggaugaccagagggcauggaacauuugggaaguggaagacuacgguuuugggaucuuuacaacuaacauaugguuaaaacuccgagacucuuauacccaaguaugugaccacagacuaauguccgcagcuauaaaggauaguaaagcgguacacgcugauaugggauauuggauagagucugagaaaaaugaaacguggaaguuagccagagcuucauucauugaagucaagacaugcauauggccaaaaagucauacauuguggaguaauggcguccuagagucagagaugauaauaccaaagauauauggaggaccgauuucacaacauaacuaucgaccaggauauuuuacacagaccgcaggaccauggcaucuagguaaauuggaauuagacuuugaccuaugugaggguaccacgguagugguagaugaacauuguggcaacagaggaccuucacuacggacaacuacgguuacaggcaagaucauacacgagugguguugucgaaguugcacacuucccccauuacgauucaaaggagaagaugguugcugguaugguauggagauuaggccaguaaaggagaaagaagagaaccucguuaagucaauggugucagccgggucgggcgaaguagauagcuuuucucucggauuauuguguaucaguauaaugauugaagaagugaugcguucuagauggucucgaaaaaugcuaaugacugggaccuuggcaguguucuuucuauuaauuaugggucaauuaaccuggaaugacuuaaucagaucuuguauuauggugggugcgaaugcaucggacaggaugggaaugggaacaacuuacuuagccuuaauggcaacuuuuaaaaugcgaccgauguucgcagugggacuauuauucagaagauuaaccucacgggagguacuacuacuaaccauaggacugaguuuagucgcuucaguugaauugccaaauagucuugaggaauuaggcgauggcuuagcuaugggaaucaugauacuuaaacuauugaccgauuuucaaucauaccaauuaugggcaacccuauugagccucacauucauuaaaacaacuuuuagcuugcacuaugcguggaaaaccauggccaugguccuguccauugugucucuacuaccacuuugccuaucuacaacuagccagaaaaccacaugguugccagugcuacuggguucccuugguugcaaaccucugacuauguuuuugaucgcagaaaacaaaauaugggguagaaaaucauggccacugaaugaggguauaauggcugucggaaucguguccauucuacugucuucucugcugaagaaugacguaccacuagccgguccacuuauagcaggcggaauguugauagccugcuaugucauaucugggagcucggcugacuuaucacuagaaaaagcugcagaagugucaugggaggaagaagcggaacacagcggggcgucucauaacauauuaguagagguacaggacgacggcacuaugaaaauaaaagaugaagaaagagaugacacucuaacgauacuauuaaaagcaacguuauuggcuguuucagggguuuauccgcucucgauaccugcgacauuauuuguaugguauuuuuggcagaagaagaaacaaagaaguggaguauuaugggauacaccuucgccuccugaagucgaacgugcugugcuagaugauggaauuuauagaauaaugcaaagaggcuuacuagggaggagucaaguaggugugggagucuuucaagaaaauguuuuucauacaauguggcacguuacacgaggugcagugcucauguaucaaggcaaacguuuggaacccucaugggcuucuguuaagaaagauuuaauaaguuaugggggaggauggcgucugcaaggaucauggaauacgggggaagaaguccagguuauagcaguagaaccaggcaaaaacccuaaaaauguucaaacugcaccaggcaccuucaagacgccugagggggaagugggcgcuaucgcacucgauuuuaagcccgguacgucuggcucuccaaucguaaaucgagagggcaagauaguugggcucuaugguaauggcguugugacuacaucaggaacguacgucagugcgauagcucaagcuaaggcaagucaggaagguccuuuaccugagaucgaagacgaaguauuuagaaagcggaaucugacgauuauggacuugcauccagguucuggcaaaacacgaagauauuugccagcaauuguacgagaagcaauaaagagaaaacuacgcacauugaucuuggccccaacacggguuguagcuucagaaauggcagaagcccuaaagggaaugccgauaagguaccaaacaacagcagucaaaucagagcacacgggaagagagauaguagauuuaaugugccaugcuacauuuacuaugcgacugcuuuccccggucagaguaccaaauuauaacaugauuaucauggacgaagcacacuuuaccgaccccucuaguauugcugcucgggguuauaucagcacucgaguaggcaugggagaagcugcagcuaucuuuaugacggcaaccccacccggaucagucgaagcauuuccgcaaaguaacgcugugauucaagacgaagaacgagauauuccggaacgaucguggaauagcggcuacgaauggauaacugauuuccccggaaaaacagugugguuugugccaaguauaaaaagcggaaacgacauagcaaacugcuugaggaaaaauggaaaaagggugauucaauuaagccgcaagacauucgauacagaguaccagaaaacuaaaaauaacgauugggacuauguagugacgacagauauaucugaaaugggagccaacuucagggcugaucgaguaauagauccgagaagguguuugaagccugucaucuuaaaggauggaccagaacgaguuaucuuagcaggaccgaugccaguuacaguugcguccgccgcucaaagacgagguagaauaggcagaaaucacaacaaggaaggggaccaauauauuuacaugggacaaccguuaaauaaugaugaagaucacgcacauuggacugaagcuaaaauguuacuugacaacauaaacacaccagaaggaaucauaccagcucuauuugaaccagaacgcgagaaaagugcugcaauagauggagaauauagauuacgaggagaagcuagaaagacguuuguugaacucaugagacgaggggaccuuccggucuggcuuagcuacaaaguggcuucagaagguuuucaauauucagaucgacguuggugcuuugauggugaacguaauaaucaaguacuagaggaaaauauggacgucgaaauauggacaaaggaaggagagaggaagaaauuacgaccaagaugguuagacgcacggacuuauucagauccacuugcacuuagagaauuuaaggaauuugccgcggggaggcguaguguuucuggggaucugauauuagagauaggcaaacucccgcaacacuuaacccagagagcucagaacgcauuagauaauuuagucaugcuacacaacagugagcaaggugggagggcauaucgccacgccauggaagaacuaccugacacgauagaaacguugaugcuauuagcacucauagcaguauuaacuggcggaguuacguuguucuuuuuaucgggcaggggccuaggaaaaacaucuauuggcuuguuaugcguaauggcaucuagcgcucuauuguggauggcaaguguagagccacacuggauagcugcaagcaucauauuggaauuuuuccuaauggucuugcucaucccagaacccgaccgccaaaggacuccacaagacaaucaguuagcauauguggugauuggacuauuauucaugauacucacuguggcugcgaaugaaauggggcugcucgaaacuacgaagaaagaucuuggaauaggacauguggcaguagaaaaccaccaccaugcgacgauguuggacguggauuuacacccggcgucggccuggacucucuacgcuguagcaacaacuauuauaacgccaaugaugaggcauacuaucgagaacacaacagcgaacauuucgcugaccgccauugcgaaccaagcugcaauuuuaaugggccuugauaagggcuggcccauuucaaaaauggauauaggaguaccuuuguuagcuuuaggguguuacucucaaguuaauccacuuaccuuaacagccgcaguguuaauguuaguagcucauuacgcaauuaucggacccgguuuacaagcgaaagcuacuagagaagcucaaaagcguacugcggccgguauaaugaagaauccaacagucgacgggauuguagcaauagauuuagauccuguagucuacgacgcaaaauuugagaagcaauuaggacaaauuaugcuauuaauacuuugcaccucacagauacucuuaaugcguacgaccugggcuuuaugugaaucaauaacacuggcgacgggaccacugacuaccuugugggaaggaucccccggaaaguuuuggaacaccacaauagcaguaucaauggcaaacauuuuucgaggaucuuaucuagcuggggccggcuuggcguuuaguuuaaugaaaucucuaggagggggacgaagaggaacaggcgcacaaggagaaacacuaggcgaaaaguggaaacggcaacuuaaccaguuaaguaaaagugaauuuaacacuuacaaaaggaguggaauaauggaaguugaucguucagaagcaaaagaaggccuuaggcgcggagaaacaacaaaacacgcggugaguagagggacggcuaaacuccgcugguuuguagaaagaaaucucgucaaaccggaaggcaaaguuauugacuuggguuguggaagaggggguuggagcuacuauugugcgggacucaagaaaguuacugaaguuaaagguuauaccaaaggugguccgggacaugaagaacccauacccauggccacuuauggauggaaccucguaaagcuccauucuggaaaggacguauuuuucauaccuccugaaaaaugugauacuuuguuaugcgauauuggagaaucauccccaaacccaacuauagaagaaggaaggacccucagaguccugaagaugguggaaccuugguuacgggguaaccaauuuuguauuaaaauauugaacccauauaugccaucaguugucgaaacccuagaacaaaugcaaagaaaacaugguggcaugcuagucagaaacccgcuuuccaggaauagcacacaugaaauguacugggucaguugugguacuggaaacauaguaucugcaguuaauaugacgagucggauguuacuaaacagguucacuauggcccacagaaaaccaaccuacgagagggacguggaucuuggggcagguacgcgucacguugcagucgaaccugaaguagcaaauuuagacauaauaggucaaagaauagaaaauauuaagcaugaacauaaaucaacguggcacuaugacgaagauaauccguauaaaacaugggcuuaccauggaucauacgaaguaaaaccaucuggcucagcaucaucaauggucaauggagucguaaaguuauugacuaagccuugggacguuaucccaauggucacccaaauugcaaugacugacacgacuccauucggucaacagagagucuuuaaagagaagguagauacuaggacaccgaaggcaaaaaggggcacagcccaaauuauggaaguaacagcaagaugguuauggggcuuccuaucaagaaacaaaaagccacgcauauguacaagagaagaauuuacaagaaaaguacgaagcaacgcagccauaggagcaguauuuguagaugagaaccaguggaacucugccaaggaagcgguagaagacgaaagauucugggauuugguucaucgggagagggaguuacauaaacaagguaaaugugcgaccuguguuuauaacaugauggguaaacgggaaaagaaguugggugaguuugguaaggcgaaaggcucgcgggccauaugguacauguggcuuggggcaagauucuuggaauuugaagcgcuaggguuuaugaacgaagaucacugguucucaagggaaaauucccucucuggggucgaaggcgagggauuacacaaacuaggcuacauccuacgagauauaaguaaaauaccuggugguaauauguaugcugaugacacugcagguugggauacucggauaacggaagaugaucuacaaaacgaagcaaagauaacugacauaauggagccagaacacgcguuguuggcgacgaguauauucaaacuaacuuaucaaaacaaaguaguuagaguucaaagaccugcuagaaaugggacuguuauggacguaauuaguagaagagaucagcgagggucaggucaaguuggaacauauggacuuaacacuuucacuaacauggaagcacaacuaauacgccagauggaaagugaagguauauuuagucccucugaauuagaaacuccuaauuuagcagaacgaguacuugauuggcuagagaagcauggaguagagcgacuaaaaagaauggcaauaucuggagaugacugcgucgugaaacccauugacgaccgauucgcgacggcguuaucggcguuaaaugauauggggaaaguacggaaggacauaccgcagugggaaccuucaaagggauggaaugauuggcaacaaguucccuuuugcucacaucauuuucaucaacuaauaaugaaagaugggagagagauagugguaccauguagaaaucaagaugagcuagugggaagggcuagagugucacaaggggcaggauggucccuuagagaaacagccugucuugguaaauccuacgcccaaauguggcaacuuauguacuuucauaggagggacuugagacuagcagcuaaugcuauaugcagugcggucccaguugauuggguccccaccaguagaacaacuuggucuauucaugcucaucaccaauggaugacaacggaagauaugcucagugucuggaaucgagucuggaucgaagagaauccuuggauggaggacaaaacgcacauaagcucuuggggagaugucccuuaccucggaaaaagagaagaccaauggugugguaguuuaauagguuugacugcacgggccacaugggcaacuaauauccaaguagcaaucaaucaaguucgcaggcucauuggaaacgagaacuaccuagacuauaugaccucuaugaagagauuuaaaaaugaaagugacccggaaggagccuuaugguaa

SEQ ID NO: 21633 - RNA, 9879 nt, Artificial Sequence
  derived and/or modified CDS sequence (opt6) from DENV-1__FJ882542__SS-prME
ucuguaacuauguuacucaugcuuaugccaacagcucuggcauuucaucucacaaccaggggaggugaaccgcacaugaucguuacaaaacaagaaagaggaaaauccuuguuguuuaaaacuucagcugguguuaauauguguacauugauagccauggacuuaggcgaauuaugugaagauacuaugacguacaaaugcccgagaauuacagaagccgaacccgacgauguggauuguugguguaacgcaaccgauacuuggguaacguaugguacauguucacaaacaggagaacacaggcgagauaaacgaucuguagcacuugcaccccaugugggauuaggacuagaaacucgaaccgaaacauggaugagcagugaaggagcauggaaacaaauacaacgaguagaaaccugggcuuugcgacaucccggauucaccgucauagcacuauuucuugcccaugcuaucggcacaucaauuacucaaaaagguauaaucuuuauccuauuaaugcuagugaccccaucaauggcaaugcgaugcguagguauugggucacgagacuuuguagaaggacucaguggcgccacuugggucgacgucguuuuagaacaugguaguuguguaaccacuauggcaaaagauaaaccaacauuagauauagaauugcuaaaaaccgagguaacgaaccccgcgguacuucgaaaauuauguaucgaagccaaaaucagcaauacaacaacugauagucguuguccaacccaaggagaggcuacccuaauggaagaacaagaugcaaauuuuguaugcagacguaccuuugucgaccgcggauggggaaauggguguggcuuauuugggaaaggaucccuaauaacaugcgccaaauucaaaugugugacgaaacuagaaggaaaaauaguccaauaugaaaaucuuaaguacagugugauuguuacaguacacaccggagaucaacaccaaguugggaaugaaucuaccgaacauggaacuacugcaacgauaaccccacaagcaccuacuucagaaauccaauuaacagauuacggugccuuaacguuagacuguagcccacguacuggguuggauuucaaugaaaugguccuauuaaccaugaaggagaaaagcuggcuaguccacaaacaaugguucuuagaucugccacuaccuuggacaucaggagcuucaaccucccaagaaacauggaauagacaagaccuauuaguuacauucaaaacugcccaugcuaagaaacaagagguaguaguccuuggaucacaggaaggagcuaugcauacggcacuuacuggagccacugagauacagacuucagguacaacuacuauauuugcaggucacuugaagugcagauuaaaaauggacaaacuuacuuugaaagguaugucguacguaauguguacuggaucauuuaagcuagaaaaagaaguugcugaaacccagcaugguacaguccuuguucaaauaaaauacgaaggcacugaugcaccauguaaaauucccuuuaguacacaagacgaaaaaggcguuacacagaacggaagguuaauaacagcuaacccaauaguaacugauaaagaaaaacccguaaauaucgaagcagaacccccuuuuggggaaagcuauaucguaauaggcgccggcgaaaaagcacuaaaacuuuccugguucaagaaaggaagcucuauaggcaaaauguucgaagcgaccgcaagaggugcuagacgaauggcaauacugggggauaccgcaugggauuuugguaguguuggagguguauuuacaaguguugguaaauuaguacaucagaucuuuggaacagcauauggaguauuauuuucuggcguaaguuggaccaugaaaauaggcauuggaguucuauuaacauggcugggauugaacuccagaaguacaagucucucgaugacuuguauugcgguuggauuagucaccuuguaucuagguguaaugguacaagcugacucaggcuguguuauaaauuggaaagggcgcgaacucaagugcggcucugggauuuucguaacaaaugaaguacauaccuggaccgagcaauacaaguuucaagcggauaguccuaagcgauuaagugcagcaauagguaaagcaugggaagaaggaguauguggcauccgcucagcuacucgcuuagaaaacaucauguggaagcaaauuucaaaugaacucaaucauauccuacuagagaacgacaugaaauucaccgugguugugggagauguagugggaauacuagcccaaggaaagaagaugauacguccacaaccuauggaacauaaauauucuuggaaaucauggggaaaggccaaaauuauaggcgcggauguucagaacaccacguucaucauagauggaccaucuacgccagaaugcccagaugaucaacgugccuggaacauaugggaaguggaggacuacgguuucgggaucuuuacaacuaauauaugguuaaaacuucgugauuccuauacucaaguaugugaucacagacugaugagugcagcaauaaaggacaguaaagcaguccaugcagauaugggauacuggaucgagucggagaaaaacgagacguggaaacucgcucgcgcgaguuuuauagaagugaaaacgugcauuuggccgaaaucucacacauuauggagcaacggaguacuagaaagcgaaaugauuauaccaaaaauuuauggaggacccauuagucaacacaacuaucgaccagguuacuucacgcaaacugcugguccauggcacuuaggaaaacuugaacuugauuuugacuugugugagggaacuacagugguaguugacgaacacugcggcaaucgaggaccaagucugagaaccacaaccguuacggggaaaaucauacaugaauggugcugucgaucauguacgcuaccaccuuugagguuuaaaggagaagauggguguugguacggaauggaaauaagaccgguuaaggaaaaagaagaaaaucuugugaaauccauggucucagcuggaucaggagaagucgauucauuuucuuuaggacuauugugcauuaguauaaugauagaagaaguaaugaggucuagguggucacgaaaaauguugaugacaggcacacuggccguauuucuauuacucauaaugggacaauuaacuuggaaugauuuaaucagauuaugcauaaugguuggcgcgaaugcgucagacagaauggguaugggcacaacguauuuagcguugauggccacauucaaaaugagaccuauguuugcgguuggacuauuauuucgacguuuaacaucucgagaaguccuauuauuaacuauaggacuuucuuugguagcguccguagaacuuccuaacucgcuggaagaacuaggugacgggcuagcaaugggaauaaugauacucaaguuauuaaccgacuuucagagucaccaauuaugggcaacgcuacuaucccucacauucaucaagacaacucugucacuucauuaugcauggaaaacuauggcuaugguucuguccaucgcuucauuauucccuuuaugccuauccacaacaagccagaaaacgacaugguuaccaguuuuauuaggcagucuagggugcaagccucuaacuauguuuuugauuacagaaacaaagauaugggggcguaaaucuuggccuuuaaacgaagguauuauggcaguugggguuguguccauccugcuuagcucacuccuuaaaaaugacguaccacuagcuggucccuuaauagcuggugggaugcuaauagcauguuaugucauuagcgguaguucggcagaucucucuuuggagaaagcggcagaaguuaguugggaagaagaggcagaacacucaggagcaucgcauaauauccuugugguaguacaggaugaugggacuaugaaaauaaaggaugaagaacgagaugauacguugaccauauugcuaaaagcuacauugcuagcuguuuccgggguauauccacuuucaauacccgcaacauuauucguuugguacuucuggcagaaaaagaagcagcgaagcggcguacucugggauacgccuaguccaccggaaguggaaagggcaguccuugaugacgggauuuacagaaucaugcagcgaggucucuuaggaagaagucaggugggcguuggaguauuucaagaaaacguuuuucacaccauguggcauguaacccguggugcaguucuaauguaucagggcaaaagauuggagccuucaugggcaucagucaagaaagauuugauaagcuauggugguggcuggagauuacaaggcucuuggaacacaggagaagaaguacaaguaaucgccguagaaccagggaaaaaccccaagaauguacaaacagcaccuggcacuuuuaaaaccccagaaggggaaguuggagccauagccuuagacuucaaaccaggcacuagcggaaguccuauagugaacagggagggaaagaucguuggguuguauggaaacgguguagucaccacaagugguacguacgugucagcgaucgcgcaagcgaaggcuucccaagaaggaccacuaccagaaauugaggacgaaguauuuagaaaaaggaacuugacaauuauggaccuccaucccgggucaggaaagacaagacgauauuugccugcaaucgugcgugaggcgauaaaacgaaaauugagaacccugauucuagcgccaacacgugucgucgcaagcgaaauggcagaagcacuuaaaggaaugcccauacgauaucagacaaccgcgguaaaaucugaacauaccggcaaggaaauaguagauuuaaugugucaugcuacauuuacuaugaggcuacugucgccagugcguguuccgaacuauaauaugauaaucauggaugaagcacauuuuacagacccgagcagcauagcggcucgaggauacauaucaacaagagugggaaugggagaagcugcugcgauuuuuaugacagcgacucccccuggaucaguagaagcauucccucaauccaacgcuguaauacaagacgaagaacgugauauaccagagagaucuuggaacaguggguacgaguggauaacugacuuccccggcaaaacgguaugguucgucccgagcauuaaaucugguaaugauauugccaacugucuacgaaagaacggaaagagaguuauacaauuauccaggaagacauuugacacagaauaucagaagacuaaaaauaacgacugggauuacgugguuacuacagauauuucagagaugggcgcaaauuuuagggcagaccgaguuauagacccccgaagaugccuuaaaccaguaauucucaaggacgguccugaacguguaauauuagccggucccaugccaguaacaguagcaucagcagcucagcgucgagggagaauagggcguaaccauaauaaagaaggagaucaauacauuuauauggggcaaccuuuaaauaacgaugaagaucacgcccauuggacggaagcuaaaaugcuguuagauaacauaaacaccccugaaggaauaauaccagcauuauuugaaccugaacgagaaaaaucugcggccauagauggugaauaucgccucagaggagaggcaagaaagacuuuuguugaacuuaugagaagaggagaccuaccaguuuggcugagcuauaaagucgccucagaggguuuucaguauagugacagacguugguguuuugauggagaacgcaauaaccaaguauuagaagaaaacauggacgucgagauauggacaaaagaaggagaaaggaagaaauuacgaccacgguggcuagacgcaaggaccuacucagacccgcuagcccuacgugaauuuaaagaauuugcagcuggaagaagaucugucaguggugaucugauauuagagaucgguaaguuaccacaacaucuuacgcagcgagcacaaaaugcucuggacaacuuaguuauguuacauaauagugaacagggaggcagagcauaccgucaugcaauggaggaacuaccugauacaauugaaacacucauguuauuagccuugaucgccguacuaacugguggaaugacucuauucuuuuuaaguggccguggacuugguaagacaucaaucggauuauuaugcgucauggcaucuucuguuuuacuuuggauggcaucgguagagccgcauuggauugcagcaucaauaauacucgaguucuuucuuaugguauuacugauuccagaaccggaucgccaaagaacaccucaggauaaucaacuggcauacgucguuauagguuuacuauucaugauucucacagucgcugccaaugaaaugggccuguuagaaacaacgaagaaagaccucggcauagggcauguugcuguagaaaaucaucaucaugcuacuauguuagacguggaucuacaucccgcgagugcguggacacuauaugccgucgcaacaacuauaauaaccccaaugaugcgccauacaaucgaaaacacaaccgcgaacauuucucuuacugcaauagcaaaucaggcggcuauauugaugggcuuagacaaagguuggccuauuucgaagauggauauagguguuccguuacuagcucuaggaugcuauagccaagugaaccccuugacucuaacagcugcuguacugauguuaguagcucacuaugcgauaauuggcccaggacugcaggcaaaagccacacgagaagcccagaaaagaaccgcagcaggaauaaugaaaaauccaacaguagauggcauuguagcaauagacuuagauccagucguuuaugaugcaaaguucgagaagcagcuuggucagauaauguuacugauauuaugcacuucgcaaauccuauuaaugcgcacgacaugggcacuaugugaaucaauuacguuagcaacugguccauuaacaacgcuaugggaagguuccccagguaaauuuuggaauacgacuauagcagugaguauggcaaauauuuucagggggucauaccuugcgggagcuggacuagccuuuucguuaaugaagaguuugggaggaggacgaagggguaccggggcgcagggagaaacauuaggagaaaaauggaagagacagcugaaccaauuaagcaagagugaguucaacauauauaagcgaucagguauaauggaaguagaccgauccgaagcuaaggaaggacuuaaacguggggaaaccacaaggcaugccguuuccagaggaacagcaaaacugcggugguucgucgaacgaaaucucguuaaaccagaaggcaagguaauugaccuaggauguggaagagggggauggucauacuacugugcaggacugaagaaaguuacagaaguaaaggguuacacuaagggaggaccaggacaugaagaacccauaccuauggcaaccuaugguuggaacuuagugaaacuccacucgggaaaagaugucuucuuuaccccaccggagaaaugugauacgcuccugugcgacaucggagagucuucaccaaacccgacaauugaagaagguagaacccuaagaguacuuaaaaugguagaaccuuggcuuaggggaaaucaguucugcauaaaaauauuaaacccauauaugccaucuguaguagagacucuggaacagaugcaacgcaaacacggagggaugcuaguuaggaacccccuuuccagaaauucaacacacgaaauguacuggguaaguuguggcacaggaaauauaguaagugccguuaauaugacgagcaggaugcuacuaaauagauuuacaauggcccaucgaaaaccuacguaugagagagauguugauuuaggagcuggaacgagacacguggcgguagaaccggaaguagcuaacuuggauaucauaggucaacgcauagagaauaucaaacacgaacauaagucaaccuggcacuaugaugaagauaacccauauaagacuugggcauaucacggcucuuaugaggucaaaccgaguggaucugcaucuucaauggugaacggugucguuaaauuacucacuaaaccuugggacguaauaccuauggugacacaaauagcaaugacugauacuacucccuucggacagcaacguguuuuuaaagaaaaaguagauacucgaacuccuaaagcgaagagaggaacugcgcaaauaauggaaguaacagcuagguggcuuuggggguuuuuaaguaggaacaagaaaccacguauuuguacuagagaagaauuuacacgcaaaguacgaagcaaugcagcaauaggugcugucuucguagaugaaaaccaguggaauagugcaaaagaagcaguggaagaugagagauucugggaucuuguacaaaaggaaagagagcuacauaaacaagggaaaugugcaaccuguguauacaauaugaugggaaagagagagaagaaauuaggagaguucgggaaagccaaagguucuagagcuauaugguauauguggcugggagccagauuccuagaguucgaggcuuuaggguuuaugaaugaggaucacugguucagucgugaaaauucacuaagcgggguagaaggagaaggccuacacaaguugggauauauccucagagacaucucaaaaauuccuggagggaauauguacgccgaugacacagcggguugggacacaaggauaacagaggaugauuugcagaacgaagcaaagauuacugauauaauggaaccugaacacgcauuguuagccacaucaauuuuuaaauuaacuuaucaaaauaaagugguucgugugcagcgccccgcgaaaaacgguacaguuauggauguaauuucaagacgagaccaacgggguucaggacaagucggaacauaugguuuaaacaccuuuacgaauauggaagcucagcugauaaggcaaauggaaagugaaggaauauuucuucccucagaacuagaaacaccaaacuuagcagagagaguuuuagauuggcuugagaaauacggaguagagagacucaaaaggauggcgauuucuggagaugacugugucguuaagcccauagaugauagauuugccacagcacuaacugcuuuaaaugauaugggaaagguccggaaagacauaccacaaugggaaccaagcaaagguuggaaugauuggcaacaaguaccauuuuguagccaccauuuccaucaauuaauaaugaaagauggacgugaaauaguuguaccgugccguaaccaagaugagcucguugggagagcucgggucagccagggggcuggguggucucugagagaaacggcaugcuuggguaagaguuacgcacaaauguggcagcugauguacuuucaucgacgagaccucagacuggcggcaaacgcaaucuguucagcaguaccgguagauugggucccuacaucaaggaccacauggucaauccacgcacaccaccaauggaugacaaccgaagauaugcuuucuguauggaauagaguauggauugaggagaauccauggauggaagauaaaacucauguauccaguuggggagauguuccauaccuugggaaaagagaagaccaaugguguggcucuuugauuggacugacggccagagcaacuugggcaagcaacauacaaguugcuauuaaccaaguucguaggcucauugggaaugaaaacuacuuagauuauaugacaucuaugaaaagauuuaaaaacgaaggagacccagaaggagcauuaugguaa

SEQ ID NO: 21634 - RNA, 9879 nt, Artificial Sequence
  derived and/or modified CDS sequence (opt6) from DENV-1__FJ882543__SS-prME
ucuguaacuaugcuacuuauguuaaugccuacagccuuagccuuucauuugacgacacggggaggagaaccacauaugauaguaacuaaacaagaaagaggaaaauccuuacucuuuaaaacauccgcaggcguuaauaugugcacguugauagcaauggaccuaggcgaacuaugcgaagauacuaugacauacaaaugcccaagaauaaccgaagcagaaccagaugauguagauuguugguguaaugcuacagauacuugggugaccuaugguacaugcagccaaaccggcgaacaccgacgagacaaaagaucaguugcauuggcaccacacguugggcugggccuugaaacaagaacugaaacguggauguccucagaaggagcauggaaacaaauacaacgaguagaaaccugggcucuaaggcacccaggauucacagucauagcacuuuuccuugcucaugcuauagguacuagcauuacgcaaaaaggcauaauauucauacuacuaauguuaguaacgccaucaauggcaaugagguguguuggaaucggaaguagggauuucguagaaggcuuaucuggugcgaccugggucgauguuguacuagaacacggcucgugcgucaccacgauggcaaaagauaaaccaacacuugauauugaauugcuaaaaaccgaaguaacuaauccugcaguacuaagaaaauuaugcauagaagcaaaaauuucgaauaccacgacggauaguagauguccgacccagggagaagccacauuaauggaagaacaagacgcgaacuuuguguguaggcgaacuuucguagauagagguuggggaaaugguugugguuuauuuggaaaaggaaguuuaauuacgugcgcaaaauucaaauguguuacuaaauuggaagggaaaauaguccaauaugaaaaucuaaaauauucaguaaucguuacgguucauacaggggaucaacaucagguuggcaaugaaaguacugagcacgguacuacagcaaccauaacaccacaagcaccuacuucagaaauacaacuaacugauuauggugcguugacuuuagauugcagcccccgaaccgggcuagauuuuaacgaaaugguauuacuaaccaugaaagagaaaucauggcuagugcacaaacaaugguuucuagaucuuccuuuaccauggacgaguggggcuucuaccucccaagaaacuuggaacagacaagaucuauuagugacauucaaaacugcacacgcuaagaaacaagaaguugugguucuugggagucaagagggugcaaugcacacggcacugacaggagcaacagaaauacaaacuucaggaacaacuacuauuuuugcaggucaucucaaaugucgucugaaaauggauaaacuuacacuaaaagguaugucuuauguaaugugcacaggaucauuuaaacuggaaaaagaaguggcugaaacacagcacggaaccguucucguccaaauuaaauaugaaggaacagacgccccauguaaaauuccauucucuacacaagacgagaaaggugucacucaaaauggacguuuaauuacagcaaauccaauuguaacagauaaagaaaaaccaguaaacauagaagcugagccaccuuuuggcgagucauacauuguuauaggugcuggagaaaaagcccucaaguuaucaugguuuaagaaaggauccagcauaggaaaaauguucgaagcuacagcaaggggagcaagaagaauggcaauuuugggagauacagcuugggauuuuggcaguauugggggaguauuuacgaguauaggcaaguuaguacaucaaauauucgggaccgcuuauggaguuuuauucagugguguaagcuggacuaugaagaucggaauagguguucugcugacauggcuaggguuaaauucgcggucaacauccuugucaaugacauguauagcaguaggccugguaacgcucuaucucggaguuauggugcaggcugacuccggauguguuauaaauuggaaaggacgggaauuaaaauguggaucagguaucuuuguaacgaaugaggugcauacuuggaccgaacaauacaaauuucaagcagacaguccaaaacguuuaucggccgcaaucggaaaggcaugggaggagggcguuuguggaauaagaagcgcaacuagauuagaaaacauaauguggaaacaaaucaguaacgaauugaaccauauacuucucgaaaaugauaugaaauuuacagucguaguaggagauguuguagguauccuugcccaggguaaaaagaugauccgaccacagccaauggaacacaaguauagcuggaaauccuggggaaaagcaaaaauaauaggggcugauguacaaaauacaacuuucauuaucgacggcccaaacaccccagaauguccggaugaucaaagggcuuggaauauuugggaagucgaggacuauggauucggaauauuuacaaccaacaucuggcuaaaaaugagagacucauacacucaggucugugaucaucgauuaauguccgcggcaauaaaagacuccaaggccguacaugcggauauggguuacuggaucgaaucggagaaaaaugaaaccuggaaacuugcuagggcuucuuuuauagaagucaaaacuuguaucuggccuaaaucgcauacucuauggucaaauggaguauuggaaucagaaaugaucauuccaaaaauuuauggaggaccaaucucacaacacaaccaucguccaggguauuuuacacaaaccgccggaccuuggcaucuugguaaauuggagcuagauuuugaucuaugcgaggggaccaccguaguaguagaugaacauuguggaaaccgagggccaucgcugaggacaacaaccguaaccgguaaaauaauacacgaauggugcuguaggucuugcacuuugccgccacuccgcuuuaagggcgaagauggauguugguacgguauggaaauaagaccgguaaaagagaaagaagaaaacuuaguuaagucaaugguauccgcgggcaguggagaaguugacagcuuuagccuaggauuacucuguauuagcaucaugaucgaagaaguaaugagaucuagauggaguagaaaaauguuaaugaccggcacccuagccguauuucuuuugcuaauuaugggacaacucacuuggaacgaccucauucgacuuuguauaauggugggcgcaaaugcauccgauagaauggggaugggcacaacuuaccuagcacuuauggcuacguuuaaaaugcgaccaauguuugcaguuggccuccuuuuuagaagacuaacaagcagggaggugcuucuacucaccauagggcuaucacucguugcuucuguggagcucccaaacaguuuagaagaauugggugacggucucgcaaugggcauaaugaucuuaaaauuauuaacagauuuucaaagccaucaauugugggcugcacuuuuaagucuaacguucauaaagacuacgcuaucgcuucacuacgcauggaaaacgauggcaaugguuuugaguauagucagucuaauaccucugugccucaguacgacgagucagaaaacaaccugguuacccguauuacuagggaguuuaggauguaaaccauugacuauguuuuuaauugcagaaaacaaaauuuggggacguaagucguggccauuaaacgaaggaaucauggcagucggggucguaucaauacuauuaucaaguuuacuuaaaaaugacgucccucuagccggaccauuaauagcuggaggaauguugaucgcuuguuauguaauuagcggcuccagcgcugaccuaagccuugagaaagcagccgaaguaaguugggaagaagaagcugaacauagcggcgcuucacacaacauccuaguagagguacaagacgacgguacaaugaaaauaaaagaugaagaacgagaugauacacugacuauauuauuaaaagcgacauuguuagcugugucaggaguuuacccauugucuauaccggcgacucuauuugugugguauuuuuggcagaagaagaaacagcgaucagggguguuaugggauacuccaaguccuccagagguagaaagagcgguacuagaugacggcauuuacaggauaaugcaaagggggcuguuagggagaucacagguagguguagggguguuccaagagaauguauuucauacaauguggcaugucacucgaggagcgguuuuaauguaucagggaaaacgcuuggagccauccugggccagugucaagaaagaucuaauauccuauggggguggcuggagacuacaaggaucuuggaauacuggcgaagaggugcagguuauagcgguggaacccgguaaaaacccuaaaaacguacagaccgcccccggaacguuuaagacgccagaaggagaagucggugcaaucgcacuggacuuuaagccggggacauccgguucccccauaguaaauagggaagggaaaauaguagguuuauacggaaaugguguaguaacgacaaguggcacguauguaucagcaauagcacaggcgaaagcuagccaagaaggaccccugccggaaaucgaagacgagguuuuccguaaaaggaaucucacgauaauggaucuacacccaggcucagggaaaacacggcgguaccucccagcaauaguaagggaagcaauaaaacgaaaauugagaacucuuauauuagcucccacuagaguggucgcuagugaaauggccgaggcauugaagggcaugccgauacguuaucagacaacagcuguaaaaucagaacauacagguaaagagauaguugaucuuaugugccaugcgacauuuacaaugcgacuucuaucaccaguccgaguaccaaauuacaacaugauaauaauggaugaagcgcacuuuacugacccauccagcauagcugcaagaggauauauaucgacgcgaguagguaugggagaagcagcggcuauauuuaugaccgcuacaccaccggguucuguagaggcauucccccaaucuaaugcagugauucaagaugaagaaagagacauuccagaaagaucauggaauagcggcuaugaauggauaaccgauuuucuaggcaaaacgguaugguuugugccaagcauaaaaucggguaaugauauagcaaauuguuuacguaagaacggaaagagaguuauacaacuuaguagaaaaacauucgauaccgaguaucagaagacuaaaaauaaugauugggauuacgucgugacaaccgauauaucagaaaugggggccaacuuuagggcagaucggguaauugauccacgucggugcuuaaaaccuguuauuuuaaaggacggucccgagcgaguaauucuagcugguccuaugccaguuacuguugcgucagcagcacaaaggagaggcaggauaggacgaaaccauaauaaagaaggcgaccaguauauauauaugggacaaccacucaacaaugaugaggaccaugcccacuggacggaagcaaaaauguuauuggacaauauaaauacaccagaaggcaucauaccagcguuguuugaacccgagcgggaaaagagugcagcuauugauggagaauauagauuacguggugaggcaagaaagacuuucguugagcuuaugagaagaggggaccuuccugugugguuaaguuacaaaguggcuuccgaaggguuccaguauucggaucgcagaugguguuucgauggagaacgaaauaaucaaguucuugaagaaaacauggauguggaaauuuggacaaaggagggggaaaggaagaaauuacguccucgauggcuagacgcacgcacguauagugauccacucgcguuaagagaauuuaaagaauuugcagcaggucgacgaagcgugucaggcgauuuaauauuagaaaucgguaaauugccacaacaucucacucagagagcucaaaacgcuuuggauaaucucgucauguugcauaacucggaacaaggagggcgagccuaccgucacgcaauggaagaauuaccugacaccaucgaaacccucaugcuacuagcguuaauagcggugcuuacuggaggcguaacacucuuuuuccuaucagguagaggauuagggaaaacaagcauuggcuuacuaugcguaauggcaucuaguguccuauuauggauggcgaguguagagccgcauuggauagcggcgucaauaauacuagaguucuucuuaaugguauuauuaauccccgaaccugaucggcaacguacaccgcaagacaaccaacuggcuuacgucguaauaggauuguuguuuaugauuuuaacuguagcagccaacgagaugggucuauuagagaccaccaagaaagauuuagguauaggucacguagcgguagagaaccaccaucacgcaacaaugcucgacguagaucugcauccagcuucggcauggacgcucuaugcggucgcaaccacaauaauuacgccaaugaugcgacauacuauagaaaauacuacagcuaacaucucauugacagcuauugccaaucaagcagcuauauuaaugggauuggacaaaggauggccaauaaguaagauggacauuggagugccgcuccuagcuuuaggauguuacucucaaguuaauccauuaacauugacugccgcaguauuaaugcuuguagcucauuaugcuaucauaggcccuggacuacaagcaaaagcaacccgugaggcucaaaaacgcaccgcugcaggcauuaugaaaaauccaacagucgacgguauaguagccaucgauuuagauccaguuguauaugacgcaaaauuugagaaacaguuaggacaaauaaugcuauuaauacucuguacaucacaaauauuacuaaugaggacuacgugggcacugugugagucaaucacacuagcaacagggccgcuaacgacucucugggaggguucccccgguaaauuuuggaauacuacgauugcagucagcauggcaaauaucuuuagaggguccuaccuugcgggagcuggccuugcguucucgcuuaugaaguccuuaggaggugguaggcgaggaacaggggcucaaggugaaacacuaggcgagaaguggaaacgacaauuaaaucaauuaucuaagucugaauuuaacauauauaaaagaucuggaauuauggaaguagacaggucagaggccaaagagggauuaaaaaggggagaaacgacaagacaugcaguaucgagaggaaccgcaaagcuaagaugguuuguagaacguaaccuagugaagccagaaggaaaagucauugaucuggggugcgguagagguggguggucuuauuauugugcuggucuuaagaaagucaccgaaguaaaggguuauacaaaaggaggaccgggacaugaagaaccgaucccuauggccacauauggauggaaucugguuaaauugcauucagguaaggauguuuucuucacuccaccagaaaaaugugauacacuucucugcgauauaggagagucaucgccgaauccgacuauugaggagggacguacguuaaggguucugaagauggucgagccaugguugcgaggcaaucaguuuuguauuaagauacucaaccccuacaugccaucugugguagagaccuuagaacagaugcagaggaaacacgguggaaugcugguuagaaauccucuaucacgaaauagcacucaugaaauguacuggguaaguuguggaacaggaaacauugucagcgcgguaaacaugaccagucgaauguugcugaauagauucacuauggcucaccgaaaaccuacuuaugaaaaagacguugaucugggugcugguacucgacauguagcagucgaaccagaaguugccaaccuggacauaauaggucaaagaaucgagaacauuaaacaugaacacaagucgacguggcauuaugaugaggauaaucccuauaaaacuugggcauaccauggaucuuaugaaguaaaaccuucgggaagugcuucuaguauggugaacggaguaguaaaguuguuaacaaagccuugggacgucauucccaugguuacacaaaucgcuaugacagauacuacacccuuuggucagcaacgaguuuucaaagaaaaaguugauacaagaacuccaaaggcaaaacgaggaacaguacagauuauggaaguaaccgcgagguggcuaugggguuuucucucaagaaauaagaaaccuagaauauguacuagggaagaguucacucgaaaaguucguaguaacgcagcuauaggugcgguguuuguagaugagaaccaauggaacucagcaaaagaagcaguagaggaugaacgguucugggaucuagugaagaaagaacgagaguugcacaaacaagggaaaugugcgacaugcguauacaauaugaugggaaaaagagagaagaaacuuggagaguucggcaaagcuaaaggguccagggcaauuugguauaugugguuaggggcgagauuccuagaauuugaggccuugggcuuuaugaacgaagaucacugguucucgagggaaaauucguuaucaggggucgaaggagaaggccuccacaaacuugguuauauauuacgggauauuucgaaaauaccaggagguaauauguacgcagaugauacggcaggaugggacacaagaauuacagaagaugaccuucaaaaugaagcaaaaauuacagauauuauggaaccagagcaugcauuauuagcaacgaguauuuuuaaacuaacauaucaaaacaagguaguaagagugcaaaggccagcuaaaaauggaacgguuauggaugugauaucgagaagagaccaaaggggcucaggacaaguagguacguacggcuugaauacauuuacuaauauggaagcacagcuaauacgucaaauggagucggaaggaauauuucucccgucagaacucgaaacgcccaaucuagcugaaagaguauuagauugguuagagaaauauggaguagagagauuaaaaagaauggccauaaguggugaugacugcguaguaaaaccaauagaugaucgguuugccacagccuuaacugcucugaacgacaugggaaaaguuagaaaagacaucccacaaugggaaccuaguaaaggauggaacgacuggcagcaagugccauuuugcagucaccauuuccaucagcuuauaaugaaagacgggcgagaaauaguaguuccauguagaaaucaagacgaguuaguagggagggcaagggugagucagggugcuggcuggaguuuacgagagaccgcauguuuagggaaaucguaugcacagauguggcagcuaauguacuuucauagacgcgacuuaagauuagcugcuaaugcuaucuguucggcuguccccguagacuggguccccacaaguaggacuacauggucgauucacgcucaccaucaauggaugacaaccgaagauaugcucucaguuuggaacagaguguggauugaggaaaacccguggauggaagauaaaacacaugucagcucaugggaagauguaccuuaucuagguaaacgugaagaucaaugguguggcagcuuaauuggacugacggcgagagcuacaugggcuucaaacauucaaguagcgauaaaccaagucaggcgccuaauugguaacgagaacuaucuugauuacaugaccucaaugaaacguuucaagaaugagggcgauccagaaggugcauugugguaa

SEQ ID NO: 21635 - RNA, 9879 nt, Artificial Sequence
  derived and/or modified CDS sequence (opt6) from DENV-1__FJ882544__SS-prME
aguguaacuauguuauuaaugcuaaugccaaccgcgcuagccuuucaucuaacuacccgaggaggggaaccucacaugauaguaagcaaacaagaacgagguaaaucuuuguuauucaaaacaucagcaggaguaaauauguguacacuaauagccauggauuugggagaacuaugugaagauacuaugacguauaaaugcccaaggaucacugaaacugaaccugaugauguggauuguuggugcaaugcaaccgacacaugggugacauacggaacaugcagccaaacaggagaacacagaagagauaaaagaucgguugcgcuagcaccccacguaggacucggacuggaaacaaggacagaaacauggaugucaagugaaggagcauggaaacaaauccaaaggguagaaacgugggcucucagacaucccggguuuacgguaauagcacuauuccuugcacaugcgauagggacaaguauuacccaaaaaggaauuaucuuuauacuuuuaauguugguuacgccgucaauggccaugcguuguguaggcaucggaaaccgagauuuuguagaaggauuaucuggcgcaacuuggguugaugucguacuagaacacggauccuguguuacgacuauggcaaaagacaaaccaacgcuagauaucgaauuauuaaaaaccgaaguaacgaauccugcaguuuuaagaaaacuuuguauagaagcaaaaauaucaaauacaacgaccgauucuagaugcccuacucaaggagaagcuacgcuaguagaagaacaagaugcaaacuucguaugcagacggacauuuguugacaggggaugggguaauggguguggauuauucgguaaagguagcuuaauaacaugugcaaaauucaaaugugugacaaaacuggaagguaaaaucguccaauacgaaaaucuaaaauauaguguaauaguuaccguacauacuggugaucaacaucaaguagguaaugaaucaaccgaacaugguacuacugcuaccauaaccccacaagcaccgacuacugagauacaauuaacggacuauggagccuuaacacucgauugcucucccaggaccggcuuagauuucaacgaaaugguuuuacuaacuaugaaagagaaaagcuggcuaguucauaaacagugguuucuagaucuaccccuaccguggaccagcggugcgaguacgucacaggaaacguggaaccgucaggaucuucucguaacuuuuaaaacggcacacgccaagaaacaagaagucguuguacuuggaagucaggaaggggcuaugcauacugcauuaacaggagcuacggaaauacagacuuccgguacgacaacuauauuugcaggacaccugaaaugcagauuaaaaauggacaaauuaacacuuaaagguaugucauauguaauguguaccgguucauucaaauuagaaaaagaaguagccgaaacgcaacaugggacgguacucguucaaauuaaauacgagggaacagaugcaccaugcaaaauaccauuuaguacacaagaugagaaaggugugacacaaaauggaagacuaauaacagcaaacccgaucguuacagacaaaggcaaaccagucaauaucgaggcagaaccacccuucggggaaaguuacauuguaauaggagcaggagaaaaagcucuuaaacugaguugguucaagaaaggaucaucaaucgggaaaauguuugaagcaacagcuagaggcgcccguaggauggcaauauuaggagacacggcaugggauuucggcuccauaggagguguauucaccucaguagguaaacuuguccaucaaauuuuugggacugcguauggagugcucuuuaguggaguaaguuggacaaugaagauaggaauaggcguuuuauuaacuugguugggauuaaauagucguagcaccaguuugucgaugacauguaucgcaguuggucuaguuacccuuuaccucggaguaaugguucaagcugacaguggcugugugaucaacuggaaaggacgggaauuaaagugcggaaguggcauauucgucaccaaugaggugcacacauggacagaacaguacaaauuucaagcagauucucccaaacggcucucagccgcaauugguaaagccugggaggaaggcguuugugggauacgcagcgcaacuagacucgagaacaucauguggaaacaaaucucaaaugaauugaaucauaucuuacuagaaaacgauaugaaauuuacaguugucgugggcgacguagcaggaauuuuagcgcagggaaagaaaaugauaagaccacaaccaauggaguauaaguauucauggaaaaguugggguaaggcaaaaaucauaggugccgauguucagaacacaacauuuauaauugauggaccaaacacuccagaguguccugacgaucaaagagcuuggaauaucugggagguagaagauuacggcuuuggaaucuuuaccacaaauauauggcuaaaacuucgagauucuuacacccaagugugcgaucauagauuaaugucagcagcgauuaaagacucgaaagccguacaugcagauaugggauauuggauagaaucagagaaaaaugaaacuuggaagcuggcaagagcaaguuucaucgaaguaaaaacuugcauuuggccgaaaucccauacacuauggucaaacggaguacucgaaagcgagaugauaauaccaaagaucuacggaggucccauuucucaacauaauuaucgaccuggcuauuuuacgcaaacugcuggacccuggcaccuggguaaauuagaauuagacuuugauuuaugcgaagggacuacuguaguaguagaugagcauuguggcaauagaggacccucccuuagaacaacuacaguaacggguaagauuauacacgaauggugcuguaggagcuguacucuuccuccacuucgguuccggggcgaagauggaugcugguauggaauggaaauaagaccugucaaagagaaagaagaaaaccuagugaaaucaauggucagugcagggucgggcgaaguugauucauucucguuaggguugcuuugcauaucaaucaugaucgaagaaguaaugagaucccgauggucaagaaagauguuaaugaccggaaccuuagcuguuuucuucuuauugauaaugggacaacuaacauggaaugauuuaauacguuuaugcaucaugguaggcgccaacgcgucagacagaaugggaauggguacaacauaccuugcauuaauggcaacauuuaagaugagaccaauguucgcuguuggucuguuauuuagacgucuaacuagcagagaggucuuacuauuaacuauagggcuuucuuuaguugcaagcguagaauuacccaauucccuggaagaacuaggcgauggacuagcaaugggaauuaugauccuaaaacuuuugacugacuuucaaucacaucaacucugggcaacacuucuaucccuaacguuuauaaagaccacuuucucacugcauuacgcauggaaaacaauggcaaugguacuauccauaguaucgcuauuuccgcuuuguuugaguacuacaagucagaaaacuacgugguuaccuguuuugcugggcagucuuggauguaaaccgcugacaauguuccugauugcugaaaauaaaauauggggacguagaucauggccccugaacgaaggcauaauggcaguuggcauuguaucgauauuacuuucgagccuacugaaaaaugaugucccacuagcuggaccacugauagcuggugguaugcuaaucgcauguuauguaauuucgggaaguucggcagauuuaagucucgagaaagccgcagaaguuagcugggaagaagaggccgaacauucaggagcaucgcauaauauauuagucgaaguacaagaugaugguacaaugaaaaucaaagacgaagaacgagacgacacauuaacuauauuguuaaaagcuaccuuacuagccgucucgggaguauauccacuuucuauaccggcaacucuauucguaugguauuuuuggcagaagaagaaacagagaucuggaguccuaugggauacacccagcccgccagaagucggacgagccgugcucgaugacgguauauaucguauaaugcaacgaggacuacuuggacguucacaaguagggguuggcguuuuccaagaaaacguuuuucacacgauguggcacguaacaagaggagccguauugauguaccaagguaaacgauuagaaccguccugggcuucuguaaagaaagaccuaauuagcuacggcgggggauggagauugcaagggaguuggaacacaggagaagaaguucaagugauagcugucgaaccaggcaaaaaucccaaaaacgugcagaccgcaccaggaacguucaaaacaccugaaggcgagguaggugcaauagcacuggauuucaagccggggacaucugguucaccaauuguaaaucgcgaaggcaaaauaguuggccuguaugggaacggcguuguuacuacuucagguacauacguaagcgcgauagcccaggcaaaggcuucacaagaagggccuuuacccgaaauagaggaugaaguauuuagaaaaagaaacuuaacaaucauggauuugcauccaggcagcgguaagacacgucgauacuuaccagcgauuguuagagaagcaauaaaaagaaaguuaaggacccuaauuuuagcgccgacucggguaguugcaagugaaauggccgaagcguuaaaggguaugccaauuagguaccagacaacagcugugaaaucagaacauacgggaaaagagaucguggacuuaaugugucacgcuacauuuacgaugagacuucuuucaccgguaagaguuccuaauuacaauaugaucaucauggacgaggcucauuucacagauccaaguaguauagcagccaggggcuauauuucaaccaggguaggcaugggagaagcagcagcaaucuucaugacugccacaccaccggguucaguggaagcauucccacaaaguaaugcagucauucaggacgaggaaagagauaucccagaacggaguuggaacuccggguacgaauggauaacugauuuuccaggcaaaacaguaugguucguaccuuccauaaagucggggaaugauauagccaacugcuuacggaagaacggaaaaagaguaauucaacuuagccguaaaacauuugauacagaauaccaaaagacuaaaaacaaugacugggacuauguugugacuacugauauaagugaaaugggugccaacuuuagagcagauagaguuauagauccaagaagaugucucaaaccgguuauacuaaaagacgggcccgagagaguaauauuagccgggccuaugccggucacuguagcuagcgccgcucagcgcagggggcgcauuggucgaaaucacaacaaggaaggcgaucaauacauauauaugggccagccucuuaauaacgacgaagaucacgcucauuggacagaagcgaagaugcuucuggauaauauaaauacgccggaagguauaauaccagccuuauuugaaccugagagagagaaaucugcagcuauugauggugaauauagauuaagaggcgaggcaagaaaaacauuuguugagcuaaugcgacgaggcgaccuaccaguguggcuauccuacaagguagcgagcgaaggauuccaauauucugacagacguuggugcuuugauggugaacgaaacaaccaaguauuagaagagaacauggacguggagaucuggaccaaggaaggcgaaaggaagaaacuacgcccacgauggcuugaugcacgcacuuacucugacccacucgcauuaagagaguucaaagaguucgccgcaggucguagaaguguuucgggggaucuaauucuagaaaucgguaaacuuccgcagcaucuaacccaaagagcacaaaacgcacuagauaaccuaguaauguuacacaauagcgagcagggcggaagggcauaucgucacgcgauggaagaacuuccggauacuauagaaacgcuuaugcugcucgcucuuaucgcaguuuuaacagguggcguaacauuguucuucuugagcggaagaggauuggggaaaacuuccauugguuuauuauguguuauggccagcagcguguuacuauggauggcgucaguagaaccccacuggauagcagcaaguauaauacuagaauuuuuccuaaugguccuucuaauaccugagcccgacagacagaggacuccucaagauaaucaacuugcguauguugugaucggccuuuuauuuaugauuuuaacugucgcagcaaaugagauggguuuauuagaaacuacuaagaaagauuuagggaucggucacguugcaguggagaaucaccaccaugcagcuaugcuugauguagaccuacaucccgcuagcgcauggacauuauaugcaguugcgacaaccauaauaaccccuaugaugcggcacaccauagaaaauaccacagcuaauauuaguuuaacagcgauagcgaaucaggcugcaauucuaaugggcuuagauaaaggauggccaauaaguaaaauggacauaggaguuccacuccucgcauuagguuguuacagccagguaaauccgcucacgcuaacagcugcaguuuugaugcuagucgcccauuaugcaauuauuggaccaggccuacaagcaaaagcaacaagggaagcacagaaaaggacggcggcgggaauuaugaaaaauccuacugucgacggcauuguagccauugauuuagauccgguagucuaugaugcuaaauucgaaaagcaguuaggacagauaaugcugcucauuuuguguacaucacaaauucuccuaaugcgcacuacgugggcguugugcgaaucaauaacuuuggcaacggggccguuaacuacacuaugggaaggcuccccagguaaguuuuggaauacgacaauugcuguuucaauggcaaauauuuuuaggggcucguauuuagcaggagcaggccuugcauuuucacuaaugaaaucccucgguggugguagacguggaaccggcgcucagggugaaacacuaggcgagaaauggaagcggcaacuuaaccaacucucgaaguccgaguuuaauaccuauaaaagaucgggcauaauggaggucgauagaagcgaagcaaaagaagggcuaaaacgaggugagacaacgaaacaugcugucagccgggguacagccaaacuaagaugguuuguugaacguaaucuuguaaaaccggaaggaaaaguaauugaucuaggguguggaaggggcggguggagcuacuacugugcaggauuaaagaaggucaccgagguaaaagguuauacgaaagggggaccaggccaugaagaaccaauccccauggcgacguaugguuggaaccuaguuaaauugcacagugguaaagacguauuuuucauuccaccggagaagugugacacacuuuuaugcgacauaggagaaaguucuccuaacccgacgaucgaagaaggucgcacccuucgagugcuaaaaaugguggaacccuggcuaagaggaaaccaauuuugcaucaaaauucugaauccauauaugccuucugucguagaaacgcuagaacaaaugcagcgaaaacacggaggaaugcuaguaaggaacccauugucaaggaacaguacgcacgaaauguauugggucucaugugguacuggaaauaucguauccgcgguaaacaugacgucacgaaugcuacucaaccgauuuacaauggcacaccgaaagccaacauacgaaagagauguagaucuaggugccgguacgcgccacguagcgguagaaccggaaguagcaaaccuagacauuauaggacagcgaaucgaaaacauuaaacacgaacauaagucaacauggcauuacgaugaagauaauccguauaaaaccugggccuaucauggauccuacgaaguaaaaccgaguggaucggcgucaucgaugguaaauggcguuguaaagcuacugacgaaaccaugggaugucaucccaaugguaacccaaauagcuaugacugacacgaccccauucggccaacagcgaguauucaaagagaaaguugauacaaggacacccaaagcuaaacggggaaccgcccaaauaauggaaguuaccgcuaaaugguuaugggguuuucuaucucgaaauaagaaaccgcgaauauguacgcgagaagaguucaccagaaaaguaagaaguaaugcagcgaucggugcaguauuuguagacgaaaaccaauggaacucagcgaaagaggcaguagaagaugaaagauucugggaucucguucauagagaaagagaacuucauaaacaggguaaaugugccacaugcguuuauaauaugauggguaagcgagagaagaaacuaggggaguucgguaaagcgaaagguucacgugcuauaugguauauguggcugggagcacgauuucuagaauuugaagcacuaggauuuaugaaugaagaccacugguuuucaagagaaaauagucuuagcgguguagaaggugagggauuacacaaacuaggcuacauucuacgggauauuucuaacauaccaggcgggaauauguacgcagaugacacugcuggcugggacacacgaaucacagaagacgauuuacagaacgaagcccguauaacagauauuauggagccggaacaugcguuauuagcaaaaucgauauuuaaacuuacuuaucaaaauaaaguagucagaguacaaagaccugcgaaaaacgggacaguuauggacguaauuucacgaagagaccaacggggauccggacaaguaggaaccuacggcuuaaauaccuuuacaaacauggaggcacaacugauaagacaaauggaaagugaagggaucuucagucccucagaguuagaaacuccgaaccuugcagagagaguccuagauugguuagaaaaauaugguguagagcgacuuaaaagaauggcaauaaguggugacgauugcguugucaagccaauugaugauagauucgccacugcgcuuacagcuuuaaaugauaugggaaaaguccgcaaagacauaccccaaugggaaccauccaaagguuggaaugauuggcaacaagugccuuucuguucucaucacuuccaucaacuuaucaugaaagaugguagagagauaguggucccauguagaaaucaagaugaauuggucggcagagcucgugugagccagggagcagguuggagucuaagagagacagcauguuuaggaaaaaguuaugcucaaauguggcaacuaauguauuuucacagaagagaucuccgcuuggccgcgaaugccauuugcucugccguaccgguggacuggauccccacaucacguaccacguggaguauccacgcucaccaccaauggaugacgaccgaggauaugcugagcguguggaauagaguauggauagaagaaaauccauggauggaagacaaaacucauauaucaaguuggggagauguaccuuauuuagguaaaagagaggaucaaugguguggcucauuaaucgggcuaaccgcaagagcaaccugggcaaccaacauucagguggcaauuaaccagguacgaaggcugauugggaaugagaacuaccuagacuacaugacgaguaugaaaagguucaaaaacgaaucggauccugaaggugcucugugguaa

SEQ ID NO: 21636 - RNA, 9879 nt, Artificial Sequence
  derived and/or modified CDS sequence (opt6) from DENV-1__FJ898371__SS-prME
aguguaacaaugcuauugaugcuaaugccaaccgcacuagcuuuucauuugaccacccgcggaggugaaccccauaugauaguuaccaaacaggaacgaggaaaauccuuauuauuuaaaacgucagcaggagucaacauguguacauuaauagcaauggaccuaggagaauugugcgaagacaccaugacauacaaaugcccacgaaucacagaagcugaaccagacgacguagauugcuggugcaaugcuacugacacguggguaaccuaugggacguguagccaaacuggagaacaccgacgugauaaacgaaguguugcucuagcuccucaugugggauuaggauuagagacaagaacagagacuuggaugucuucagaaggagcauggaaacaaauucaacguguagaaacuugggcgcuaagacauccugguuuuaccgucauagcacuauuuuuagcacaugcaauaggcacaucuauuacacaaaaaggaauaauauucauacuauuaaugcucgucacaccaucaauggcgaugagauguguaggcauuggaucaagagacuucguggaaggucugucgggcgcaacgugggucgacguaguacuagaacacgggaguugcgugacaacuauggcuaaagacaaaccgacguuagauauagaacuuuuaaaaacagaagugacaaauccggcggugcuucggaaacuauguauugaggcaaaaauaaguaauacgacuacugauucucgauguccaacacaaggcgaagcuacucuuauggaggaacaagacgccaacuuuguaugccgucgaacuuucgucgaucguggcuggggcaauggcuguggcuuauuuggaaaagguagcuugauaacuugugcaaaauuuaaauguguaacaaaacuagaaggaaaaauaguacaguacgaaaaucuuaaauauucgguaaucguuacaguccacacgggugaccaacaucagguaggaaaugaaucaacagagcacggaacaaccgcaacaauuacaccgcaagccccaaccucugagauucaacuaaccgauuauggugccuuaacgcuggacuguucgccuagaacuggauuggacuucaacgagaugguacuacuuacgaugaaagaaaaaucauggcuaguucauaaacaaugguucuuagaucugccauuaccauggacuagcggcgcaucaacuucacaagaaacauggaaccgucaagauuuauuggugacuuucaaaacagcucacgccaagaaacaagaagucgugguguuaggaagccaagaaggagccaugcauacagcuuuaacuggggcaacggaaauucaaacgucuggaacaacaacaauuuucgcaggucauuuaaaaugucgauuaaaaauggacaaacuaacacucaaaggcaugucauauguaauguguacgggaucuuuuaaauuggagaaagagguagcagaaacgcagcauggcacggucuuggugcaaauaaaauacgaggggaccgaugccccguguaaaauuccauuucuuacacaagaugaaaaagggguuacgcaaaauggaagauugauaacagccaauccuaucguaacagacaaagagaaaccaguaaauauagaagcagaaccgccuuucggcgaaucauacauaguuaucggcgccggugaaaaggcuuuaaaauugucaugguuuaagaaaggcaguucaaucggcaaaauguucgaagcuacugcgagaggcgcuagacguauggcaauccuuggagacacagccugggacuuuggcaguaucggagggguuuuuacaagcgugggcaagcugguacaucaaauuuuuggcacugcuuacgguguucuuuucagcggaguaucauggacaaugaaaauaggaaucggaguauuacuaacuugguuaggacuaaauucgcguucuaccucuuugaguaugacuuguaucgcaguagggcuaguaacuuuguaucuugggguuaugguacaagcagauagugguugcgucauaaauuggaaagguagagaacugaaaugcgguagugguauauucgucacuaaugaagugcauacauggacggagcaauauaaauuccaggccgauucaccaaaaagacuaagugccgcaauaggaaaggcuugggaagaaggcgucuguggcauacguucggccacaagacuggaaaauauaauguggaaacaaauauccaacgaauuaaaccauauacuguuagaaaaugauaugaaguucacagucgucguuggugauguaguagggauacuggcacaaggcaagaaaaugauuaggccacaaccaauggaacacaaguacucuuggaaaucauggggcaaagccaaaauuauuggcgccgaugugcaaaacacaacauucauuauugaugggcccaacaccccggaaugccccgaugaccagagagcauggaauauaugggaaguagaagacuauggguuuggaauauucacuacaaauaucugguugaaacuacgcgauagccauacacaggucugcgaccacagacugaugagugccgcgauaaaagauucuaaagcaguucaugcagauaugggcuacuggaucgaaagugagaaaaaugaaacuuggaaacuagcaagagccaguuucaucgaaguuaaaacauguauauggccaaaaucccacaccuuauggucaaacgguguauuagagagugaaaugauaauaccgaaaauuuauggaggaccgauaucccaacauaacuaucguccuggauauuucacucaaacagcgggaccauggcaccuugguaaacuagaauuagauuucgauuuaugcgagggaaccacggucgucgucgaugaacacugcgguaaccgcgguccaucauugcgcacaacgacagugacggguaagaucauacacgaauggugcuguagaucuuguacacugccaccccuuagauuuaaaggagaagacgguuguugguacgggauggaaauaagaccagugaaagaaaaagaagaaaaucuggucaagagcauggugucugcgggaaguggagagguugauucauuuagccuagggcuccuaugcauaaguauaaugauagaagaagucaugaggagccguuggaguagaaaaaugcugaugacaggaacucucgcaguguuucuacuacucauaauggggcaguuaacauggaaugaccuuauaagauuauguaucaugguaggugcaaaugcgucugaucgaauggguaugggcacaacuuaccuagccuuaauggcaacuuucaagaugagaccgauguucgcagugggauuauuauuucgcagguuaacuucuagggaagugcuccuucucacaauaggacugucucuaguggcuucugucgaacuuccaaacaguuuagaggagcugggggauggacuugcgauggguauaaugauucuuaaauuauugacagacuuucagucacaccaacuuugggcaacauuacugucauuaacauucauuaaaacaacacucucacugcacuacgcauggaaaacuauggcuauggucuuaagcaucguaucacuauuucccuuaugccuaucaacgacgagccagaaaacgacuuggcuaccaguccuucuaggcucauuaggauguaaaccauuaacaauguuccuuauagcagaaaacaagauauggggaagaaaaagcuggccacuaaaugagggaauaauggcuguaggaguagucucgaucuuauugucaucacuacucaaaaaugacguaccucuugcugguccauuaaucgcaggaggaaugcuaauugcuugcuaugucauuagcggcaguagugcagaccuaucccuugagaaagcagcggaaguaucgugggaagaggaagcagaacacucuggagcuagccauaacauccuaguagagguucaagaugacggaacaaugaaaauaaaagacgaagaacgugacgauaccuuaacuauacuuuuaaaagcaacucuccuagcugucucaggcguuuauccauuaaguauuccagcaaccuuauuugugugguauuucuggcagaagaagaaacagagaucaggaguuuugugggacacaccuuccccgccggaaguugaacgggccguucuugacgacggcauuuauagaaucaugcaaagaggacuacucgguaggucacaaguuggcguaggaguauuccaagaaaauguuuuucauacuauguggcacguaaccagaggagcaguacuaauguaucaaggaaaaagguuggaacccaguugggcaagugugaagaaagaucuaauauccuacggcgggggcuggagauuacagggaucuuggaacacaggugaagagguacaaguaauagcagucgagccaggcaaaaauccgaaaaacguucaaacagcaccaggaacauucaaaacgccagagggugaaguuggagcgauagcgcuagacuuuaaaccuggaacuucagguucaccuauaguuaauagggaagguaaaauaguggggcuauacgguaacgggguugugacgacgaguggaacauacgugucagcaaucgcacaagcgaaggcuucacaagaaggcccuuuacccgagauagaggaugaaguuuuccguaaacgaaaccuaacuauaauggacuugcacccaggaucagggaaaaccagaagguaccucccagccauuguaagagaagcaauaaaaagaaaauuaagaacgcuaauacuagcaccaacaagaguaguagcgucugaaauggccgaagcgcuaaaggguaugccaauccgauaucaaaccaccgcuguuaagagugaacauacugguaaagagauuguagauuuaaugugucaugcaacuuucacgaugaggcuauuaaguccuguccgaguuccaaacuauaacaugauaauaauggacgaggcacacuuuacugacccaaguucaauagcugcacgaggcuacauuucaacaagaguagguaugggugaagcagcagcuauauucaugacagcuacaccuccaggaaguguugaagccuuuccucaauccaaugcagugauacaggaugaagaaagagauaucccagagagaaguuggaacucuggauacgaauggauaacagauuuuccagguaaaacuguaugguucguuccuaguauuaaaaguggaaaugauauugccaacuguuuaaggaaaaaugguaaacggguaauacaacuuagucguaaaacauuugacacggaguaccaaaagaccaaaaacaaugacugggauuacguaguaacaacagauauuucugaaaugggggcaaacuuucgagcugaccgcguaauagacccaagaagaugucuaaagccaguuauauuaaaggaugggccagaaagagucauauuggcagggccaaugcccguuacaguugcgucagcggcgcaaagacgaggcagaauuggucgaaaccauaauaaagagggcgaccaauauauuuauaugggucaaccucuaaauaacgaugaagaccaugcacacuggacugaggccaaaauguuauuggauaauauaaauacuccagaaggaauuaucccagcuuuauuugaaccagaaagggagaaaucagcagcaauugauggcgaguauagauugagaggugaggcgagaaaaacguuuguagaacugaugagacgaggagaucuaccuguauggcuuaguuauaaggucgcaagugaaggauuucaguauagugauaggcguugguguuuugacggagaaagaaauaaccaaguuuuggaagagaacauggauguagaaauauggaccaaagaaggagaaagaaagaaacuacgaccccgaugguuagaugcgaggacguacucagauccccucgcgcuaagagaauuuaaggaauuugccgcuggucguagauccgucucaggugauuuaauucuagaaauuggcaaacuaccacaacauuugacacagcgcgcacaaaacgcccuggacaauuuaguuauguuacauaacucugaacagggaggucgcgcuuauaggcacgccauggaagaacuaccagauacuaucgagacgcuaaugcuccuagcacuaauugcagucuugacugguggcgucacauuauuuuucuugagcgggaggggcuuaggaaaaacuucaauaggccucuuauguguaauggcgaguucaguacuccuauggauggcauccguugagccucacuggauagccgcuaguaucauauuggaguucuuuuuaauggugcuacuuauaccugaaccggaucgacagagaaccccacaagauaaucaacuagccuauguaguaauaggauuguuguuuaugauauuaacagucgcugcgaaugaaaugggccuuuuggagacgacaaagaaagauuuagguaucggccauguagcuguugaaaaccaccaucacgcuaccauguuagacguggacuuacauccagcaucugcauggacccuauaugcgguggcuacuacaauuauuacgccaaugaugagacacacgauagagaacacaaccgcuaauauaucacuaacagcaaucgcuaaucaggcggccauauugaugggauuagauaaaggauggcccauaagcaaaauggauauaggcguaccgcuacuugcacuaggaugcuacucucaggucaauccauugacacugacagcugcaguacuuaugcucguggcacauuaugcaauuauaggaccgggucuccaggccaaagcuacgcgcgaagcgcaaaagcgaaccgcagcuggaaucaugaaaaacccuacagucgacggcauuguagccauagaccucgauccuguuguauaugacgcaaaauucgaaaaacaacugggccaaauaaugcuccugaucuuaugcacaucacaaauauuacuuaugagaaccaccugggcuuugugugaaucaaucacgcuggccacgggaccauuaacuacucugugggaaggaagcccuggcaaauuuuggaauacaaccauugcuguaaguauggccaacauuuuccgaggauccuaccucgcgggugccggguuggcuuuuagccuaaugaaaucauuaggcgguggacgacguggaacaggagcucaaggagaaaccuuaggggaaaaguggaagaggcaacucaaucaauuaaguaagagcgaguucaauauauauaagagaucugguauaauggagguagaucggagugaagcaaaagaaggucucaaacguggugagacgacaagacaugcuguaucacgagguacagccaagcuaagaugguuuguagagagaaauuugguaaaaccugaaggcaaaguuauugaccuuggaugcgggagaggcggcuggucuuacuauugugcuggucuaaagaaaguaacagagguuaaaggauauacaaaaggaggaccaggccaugaagaacccauaccuauggcaacuuauggguggaacuugguaaaacuucauucaggaaaagacguuuucuuuacacccccggaaaaaugugauacucugcuaugugacauuggcgagucaucuccaaacccuacaauagaagaaggccggacacuucgugucuuaaaaaugguagaaccuuggcuucgugggaaccaguuuugcauuaaaauuuuaaauccauauaugccuuccgucguugaaacccuagagcaaaugcaacgaaaacacggugguauguuaguacgaaacccacugaguagaaauagcacucacgaaauguauugggugucuugugguacagguaauauaguaucagcaguuaacaugacauccagaaugcuacucaacagauuuacuauggcacaucggaaaccaaccuaugaacgagacguggacuuaggagcaggaacacgacauguugcaguagaaccagaaguagcuaaccuugacaucauugggcaaagaauugaaaacauaaaacaugaacauaaauccacauggcauuaugacgaagauaauccuuacaaaacuugggcauaccauggaucauacgaaguaaaacccagugguagcgccucgaguaugguuaacggcguggucaaguuacugacgaaaccaugggacgugauaccgauggucacacaaauagcgaugacagacacuacaccauuuggacaacaacgaguuuucaaagaaaaaguagauacuagaacuccaaaagcuaaacguggaaccgcccaaauaauggaagugacugcaagaugguuguggggguuccucagccguaacaagaaaccccgaauuugcacuagggaagaauuuacucguaagguaagaagcaaugcagcgauuggugcugucuuuguugaugaaaaccaauggaacucugcaaaagaagcgguugaggacgaaagguucugggaucuugugcaaaaagaaagggaacuacacaagcaaggaaaaugcgcuacauguguauauaacaugauggggaaacgagagaagaaacuuggugaauuugggaaagcaaaagguucucgagcaauuugguacauguggcucggggcacgcuucuuagaguuugaggcuuuaggauucaugaacgaagaccacugguucagucgggaaaauagccucagugguguggaaggugaaggguugcacaaauuaggauauauacuccgcgauaucaguaaaauuccagguggaaauauguaugccgacgacacagcgggcugggacaccagaauaacagaagacgauuuacagaaugaggccaaaauuacugacauaauggaaccagaacaugcguuacuugcuacuucaauauucaaacugacauaucagaauaagguaguuagaguacaacgaccugccaaaaauggcacaguuauggacgucauaagcagaagggaccaaagaggaucaggucaaguaggaacguauggauuaaacacguuuacaaauauggaagcucaauuaauacgucaaauggagagugaaggaaucuuccuacccucugagcuugaaacgcaaaaccuagcagaaaggguacuugauugguuggaaaaauacgguguugaaagacuaaagcgcauggcaauauccggagacgauuguguaguaaaacccauugacgaccgauucgcaacugcuuugacugccuugaacgauauggggaaaguacgaaaagauauaccacaaugggaacccucgaaaggguggaacgacuggcaacagguacccuuuuguucacaucauuuccaucaauuaauaaugaaggacggccgcgagaucguaguuccuuguaggaaccaggaugaacuuguggggcgcgcucgaguaucucaaggcgcugguuggucauuaagagagacagcaugccuggguaaaucuuaugcccaaauguggcagcuuauguacuuucaucgacgcgaucugcgauuagcugccaacgccaucuguucggcaguacccguugauuggguccccacgucacggacaaccuggucaauccaugcgcaccaccaauggaugaccacugaagauauguugucuguauggaauaggguauggauagaagaaaauccuuggauggagaauaaaacucauguuuccucauggggagauguuccuuauuuagguaaacgagaagaccaauggugugggagccugaucggguuaacagcaagggcuacgugggcaucaaacauacagguugcgauuaaccagguucggcgacuaauugguaacgagaacuauuuggacuacaugacgucgaugaaaagguucaaaaaugagggcgacccugaaggggcucucugguaa

SEQ ID NO: 21637 - RNA, 9879 nt, Artificial Sequence
  derived and/or modified CDS sequence (opt6) from DENV-1__FJ882545__SS-prME
ucgguaacaauguuacuaauguugaugccaacagcauuagcuuuccacuuaacgacgagagggggagaaccacacaugauaguaagcaaacaagaaaggggaaaaucucuacuuuuuaaaaccucagcgggaguaaauaugugcacauugauugcuauggauuuaggagaacugugcgaagauacaaugacauauaaauguccaagaauuacagaagcggaaccggacgauguugacugcuggugcaacgcaacugauacauggguuacuuauggaacuuguucucaaacaggcgaacauagaagagauaaacgaaguguagcacuagcaccacacguagguuugggucucgaaacaagaacugaaacauggauguccucagaaggugcuuggaaacaaauucaaagaguagaaacaugggcacuuaggcacccgggauuuacaguaauagcucucuuucuugcacaugcaauuggaacaaguaucacacaaaaagguauuauauuuauacucuuaaugcuagucacaccgucuauggcgaugagaugcgugggaauugggagccgggauuuuguagaaggucucucgggagcaacuuggguagauguaguuuuagaacacgggucuugugugaccacuauggcaaaagacaaacccacauuggauauagaacuuuuaaagacggaaguaacaaauccggcaguauuaagaaaauuaugcauugaagcuaaaauaucgaacacuacuaccgauucaagguguccaacgcaaggagaagcaacuuuaguugaagaacaagacgcaaauuuuguaugcagaagaacuuuuguagauagaggcuggggaaacggcugcggacuauuuggcaaaggcucauugauaacaugugcgaaguuuaaguguguuaccaaacuagaggggaaaauuguccaauacgagaaccuaaaauauucaguaauugucacaguacauacaggugaucaacaccaggucggaaaugaaagcaccgaacacgguacaacagcaaccauaacaccccaagcaccaaccaccgaaauacaauuaacugauuauggagcucuaacacucgacugcuccccaaggacgggucuagauuucaacgaaaugguucuuuugacgaugaaagaaaaguccugguuaguucacaaacagugguucuuagaucuaccacugccguggacuuccggagcgagcacaucucaagaaacauggaauaggcaagaccucuuggucacguucaagacagcgcacgcaaagaaacaggaaguaguggugcuaggaucccaagaaggcgcuaugcauacugcucuaacuggggccaccgagauccaaacgucagguacuacgaccauuuuugcaggccaucuuaaauguagguuaaagauggauaaauuaacccuuaaaggaaugucauauguaauguguacagguagcuucaagcuagaaaaagaaguggcggagacgcaacacgguacaguguuagugcagauaaaguaugaagguaccgacgcacccuguaaaauuccauucucuacacaagacgagaaagggguaacacagaacggcagacuaauaacggcaaacccuauaguaacggauaaagagaagccuguaaauauugaggcagaacccccauucggggaaucauacauaguaaucggggcaggcgaaaaagcccucaaguugucaugguuuaagaaaggaucuuccauugguaaaauguucgaggcaacggcacgaggagcaaggagaauggcgauccuaggagauacagcgugggauuuuggcagcaucgguggcguauuuacgucggucgguaagcuaguucaucaaauuuucgggacggcauacggugugcucuuuaguggugugucuuggaccaugaagauagggaucgguguauuauuaacaugguugggccuaaacagcagauccaccucccucaguaugacuuguauagcuguuggcuuagugacgcuauaucucgguguuauggugcaagcagauuccggaugugucauuaacuggaagggaagggagcuuaaauguggcagugguaucuuuguaacaaaugaagugcauacuuggacugaacaauauaaguuucaggccgauuccccuaaaaggcucuccgcugcaauaggaaaggcaugggaagagggaguuugcgguauacgcagugcaacuagauuagaaaauauuauguggaagcaaauaagcaaugagcuaaaccauauacucuuagaaaaugauaugaaacucaccguaguaguuggagauguugcagguauucuuggucagggaaagaaaaugaucaggccucaacccauggaauacaaauacagcuggaaaucaugggguaaagcgaaaauaauuggugcugaugcacaaaauacgacauucauuaucgauggaccgaauacuccggaaugucccgaugaccaacgcgcauggaauauuugggagguugaagauuauggcuuuggaaucuuuacaaccaauauaugguuaaaacuacgcgacagcuacacucaggugugugaucauaggcuaaugucagccgccauaaaagacaguaaggccguacaugcugacaugggauacuggauagaaucggagaaaaaugagaccuggaaguuagcucgggccaguuuuauagagguuaaaacuugcauauggccuaaaucgcacacacuuuggaguaacggcguacuagagucugaaaugauaauucccaagaucuauggaggaccuauaucccagcacaauuauagaccugguuauuuuacacagacugcuggaccguggcauuuagguaaauuagaacuugauuuugacuuaugugaaggaacaacuguaguuguugaugaacauugugguaaucgaggaccgucuuuacgaacaacuacgguuacuggaaagauaauucacgaaugguguugucgaucuugcacccuacccccguugcguuuuaggggagaagauggauguugguacggaauggagauacgcccaguaaaagaaaaagaagagaaccucguaaaaucuaugguaagcgcaggcuccggagagguagauucauucucacuaggacuauugugcauaucgauaaugauagaagaaguaaugcgaucacgguggagucggaaaauguuaaugacaggaacucuggcuguauucuuccuauuaauaaugggacaguuaaccuggaaugacuuaauucgacuuugcauaauggugggagcuaaugcuagugacagaaugggcauggguacaacauaccucgcacucauggcuacuuucaaaaugagaccgauguuugcaguaggacuguuauuuagacggcuuacuucacgugaaguuuuacuuuugacuauuggacucucguugguggcaucaguggagcuacccaauucucuugaagaacuaggagacggauuagcaauggguaucaugauacuuaagcuacuuaccgacuuccagucucaucaauuaugggcuacauuacuaucauuaacauuuauaaagacaacauucucacuccacuaugcguggaaaaccauggcuaugguauuauccauagugucgcuauuuccauuaugccuuagcacaacaucucagaaaacuaccugguugcccguguuauuaggcucacuugguugcaaaccacuaacgauguuuuuaaucgcugagaacaaaauauggggaagaaaauccuggccacuuaacgaaggcauaauggcaguaggaauagucucuauauuauugagcagucuucucaaaaaugacgucccauuagcggggcccuugaucgcaggcggaaugcuuaucgcaugcuauguaauauccgggagcucagcagacuuguccuuggagaaggccgcagagguuagcugggaagaggaagcugaacacaguggcgccucacauaauauacuuguagaaguccaagaugaugguacaaugaaaauuaaagaugaagagagggaugacacucuaacaauacuauuaaaagcaacucuucuagccguuucgggcguauacccacuguccaucccugcaacacuauucguaugguauuuuuggcagaagaagaaacagcguagcgggguauugugggauacgccaagcccgccagagguagaaagagcaguauuagaugaugggauuuacaggauaaugcagcgcgguuuauuaggcaggucgcaaguagguguugguguauuucaagagaauguauuucacacuauguggcauguaacccgaggcgcaguuuuaauguaucaagguaaacgacuagaaccuucgugggcgucagugaagaaagaucuaaucucguaugggggagguuggagacuccggggcagcuggaauacuggugaagaagugcagguaauagcaguugaaccugguaaaaaucccaaaaaugugcaaacggcuccgggaacuuucaaaacaccggaaggggaaguuggugcgauugcgcuugauuuuaaaccuggcacauccggaucuccaauugugaaucgagaagguaaaauaguuggacuuuacggaaacggcguagugacuacauccggaacauauguaagcgcaaucgcacaagccaaggcuagucaagaggggccauuaccugagauugaggacgaagucuuucgaaaaaggaacuugacuauaauggauuuacacccuggaaguggaaaaacaagaagauauuugccagccauaguaagagaagcaauaaaacgaaaauuaagaaccuuaauauuagcaccgacgagaguaguggcuucagaaauggcagaggcacuaaaagggaugccuauucgguaccaaacaaccgccgucaagagugaacacacuggcaaagaaauaguugacuuaaugugucacgcuacauuuacaaugcgucuauuaucgccaguucguguaccgaacuauaauaugauuauuauggacgaagcucauuuuaccgaucccucgagcauagcugcgaggggcuacauuucgacccgagucgguaugggcgaggcagcggcaauuuucaugacggccacaccaccagguucaguagaagcguuuccacaaucaaacgcgguuauccaagacgaggagagggauauaccggagagaucauggaauagcggcuacgaguggauaacggacuucccaggaaaaacaguaugguuuguaccaucaauaaaaucuggaaaugauauugcaaacugcuuaaggaagaauggaaaaagagucauacaacucaguagaaaaaccuuugacacagaauaccagaaaacuaagaauaaugauugggauuauguugucacgacugauaucucugagaugggagcuaacuuccgggcugacagagucauugauccgaggagauguuugaaacccgucauacuaaaagacggacccgaacgcguaauacuagcuggacccaugccuguaacuguugcauccgcugcacaacgacgaggacguaucggaagaaaucauaauaaagagggagaucaauacauuuacaugggucaaccauugaacaaugacgaagaccaugcacacuggacagaagccaaaauguuauuagauaauauaaauaccccagaagguaucauucccgcuuuauucgaaccagaaagagagaaaucggcagcaguagauggggaauauagauuacgaggugaggcacgcaagacauuuguggaacugaugagacgaggagaucuaccgguaugguuaucauacaagguggcaucagaaggauuucaauauagcgaccgcagaugguguuucgauggugaaagaaauaaucaaguuuuggaagagaauauggauguggagaucuggaccaaagaaggcgagagaaagaaacuucguccccgaugguuagaugcaagaacauacucggacccacuggcccuacgagaauuuaaagaauuugcugcugguagaagaucagucucaggcgauuugauauuggaaauagguaaacuaccccaacauuuaacacaaagagcucaaaacgccuuagauaaucuaguuaugcuacacaauagcgaacagggaggaagggcuuaccgccaugcuauggaagaacuuccagauacaaucgagacacuaaugcucuuagcucuaauugccguacucacgggcggaguuacacuauucuuucuuaguggcagaggauuagggaaaaccaguaucggucuucuuugugucauggccaguucgguucuauuauggauggcaaguguagagccucacuggauagcggcaucgauaauacuagaguuuuucuuaaugguacuguugauuccugaaccggauaggcagagaacaccacaagacaaucaguuagccuacguaguuaucggacuacuauuuaugauauugacgguagcagcuaacgagaugggccuccuagaaacuacuaaaaaggauuuaggaauuggucauguugcagucgagaaccaucaccaugcugcuauguuagauguagaucuacaucccgccagcgcuuggacguuauacgccguggcuacaacgauaauaacuccaaugaugagacauacaaucgaaaacacaacggcuaauauuuccuuaacagcuauagcgaaucaggcggcgauucuuaugggccuggacaaaggauggccuaucucaaaaauggauauagguguccccuuauuagcauuaggcugcuacagccaagucaauccucugacuuuaaccgccgcaguucuuaugcuaguggcucauuaugcuauaauaggaccuggauugcaagcuaaagcuacgagggaggcucaaaaacgaaccgcugcgggaauaaugaaaaauccaaccguagauggcauaguugcaauugaucuggacccuguaguauaugacgcuaaguucgagaagcaauuaggacaaauaauguuacugauccugugcacuucacaaauccucuuaaugagaacaacaugggcucugugugaauccauaacauuagccaccggaccguuaacgacauuaugggaaggcuccccugggaaauuuuggaauacaacgaucgcgguuaguauggcuaauauuuuuagaggcucguaucucgccggugcuggacuugcuuuuucauugaugaagucauuagguggagggagaagagguacuggcgcacaaggagagacccucggugaaaaauggaaacgucaacuuaaucaauuaagcaaaagugaguucaacacuuauaaaaggucaggcaucauggaagucgacagguccgaagccaaagaaggcuuaaaaaggggcgagaccacuaaacaugcgguaagucgaggcacagcaaaacuacggugguucgucgaaaggaaucucgucaagcccgaagguaaagugauugaccuugguugcgguagagguggcuggucguacuauugcgcuggacuaaagaaaguaacagaggucaaagguuacacuaaaggugggccuggacaugaagaacccauuccuauggcaacauacggauggaaccucgucaaauuacauucuggaaaggauguguucuucauaccaccagaaaaaugugacacccuacuaugcgacauaggcgaaucaucuccaaauccuacgauagaagaaggaagaacuuugcgaguacuuaaaaugguagagccuuggcugaggggaaaccaauucuguauaaaaauccuuaacccuuauaugccaucaguaguggaaaccuuagagcaaaugcaacguaagcacggcgguaugcucguucgaaauccauuaucaagaaauucaacgcaugaaauguacuggguuucauguggcaccgggaauauaguaagugcggugaauaugacaucuagaaugcuucucaauagauucacuauggcacaucguaaaccuacauaugaacgugauguagaucugggaacaggaacaagacauguagcaguggaaccggaaguagcaaacuuggacauaauugggcaaagaauugagaauauuaaacaugagcauaaaucgacuuggcacuaugaugaagauaacccguauaagacgugggcuuaccauggaaguuaugaaguaaaaccuucaggauccgcgucuagcaugguuaauggaguagucaaauugcuuacgaaacccugggauguuaucccuaugguaacacaaauagcuaugacggauacuaccccguuugggcaacaacgaguuuucaaagaaaaaguugacacuagaacgccaaaggcaaaacgugguacagcacaaaucauggaaguuacggcaagauggcuuuggggauuuuugucuagaaacaagaaaccaagaauuuguacccgagaagaauuuacacguaaggucagaaguaacgccgcaauaggagccguauucguugaugaaaaccaauggaacagugcaaaagaagcggucgaagaugaaagauuuugggaucugguacaucgggagagagaguuacacaaacaaggcaagugugcaacuugcguauauaacaugaugggaaaacgggagaagaaacuaggagaguucgguaaagcaaaaggaucaagggcaauaugguacauguggcuuggugcaagauuucucgaauuugaagcacucggguuuaugaaugaagaccauugguuuagucgagaaaauucacuauccgggguagaaggagaaggauugcauaaacuaggauauauauugagagauauaaguaaaaucccugggggaaauauguacgcagaugauacugcaggcugggacaccagaauaaccgaagacgaucuacaaaaugaagcuaagauuacagauauaauggagccugagcaugcuuuauuggccaaagcaauauuuaaauuaacauaucaaaacaaaguaguaagaguccaacgaccagccaaaaacggaacaguaauggauguuaucaguaggagagaccagaggggcaguggacagguaggaacauauggacucaauacauuuacaaacauggaagcucaacucauccgacaaauggaaucagaagguauuuucagcccuagcgaacuugagacuccgaaucuggcagaaagggccuuagacugguuggggaaauacggcgucgagagacucaaaagaauggcaauuagcggagaugauugcgucguaaaaccaauugacgaccgcuucgcaacggcacugaccgcacuaaaugauaugggaaaaguccggaaagauauuccucaaugggaaccuucgaaaggcuggaaugacuggcaacaggugccuuucuguagucaucacuuucaccaguugauaaugaaagauggacgggaaaucguuguuccguguaggaaucaggaugaguuaguagggcgcgcuaggguaucacaaggugcaggguggucgcuacgagaaaccgcuugccuaggaaagucguaugcacaaauguggcagcuuauguacuuucaucgccgagaucuuagauuagcugcgaacgcaauaugcucugcugucccgguagacuggguaccgacgagucguacaaccugguccauucaugcacaccaucaauggaugacuacugaagacauguugucagucuggaaucgcguauggauagaggagaaccccuggauggaggacaaaacacauaucucaaguugggaagacguaccauaccuugguaagagggaggaucaauggugcgguuccuugauaggcuuaacagcaagggcuacaugggcgacuaauauacaagucgcgauaaaucaggugagaagacucauaggaaaugaaaacuacuuagauuacaugacguccaugaaacgguuuaaaaacgaaagugacccagaaggugcauuaugguag

SEQ ID NO: 21638 - RNA, 9879 nt, Artificial Sequence
  derived and/or modified CDS sequence (opt6) from DENV-1__FJ898372__SS-prME
ucggugacuaugcuauuaaugcuaaugccgaccgcacuggcauuucacuuaacgacaagaggcggagaaccccacaugauuguaucaaaacaagagagggggaaaucauuauuauuuaaaacauccgcaggaguuaauauguguacucugauagccauggacuuaggcgaacuaugcgaagacacaaugacauacaaaugcccaaggauuaccgaagcagaaccggacgacguggacugcugguguaaugcaaccgauacuuggguaacguacggaacguguagucagaccggcgaacauaggagagauaaacgaucaguggcucuagcaccacauguaggcuuaggacuagaaacaagaaccgaaacauggaugucaucagaaggcgccuggaaacaaauacaaagaguggaaacgugggcauuaaggcauccugguuuuacaguuauagcuuuauuucuggcucaugcuauuggaaccucaauuacacaaaaaggcaucauauuuauucuucuuaugcucguaacgccgucaauggccaugcgaugcgugggaauugguucccgcgauuuuguggaaggacuaagcggagcuacuuggguugaugugguacuagaacacgguagcugugugacaacaauggcaagggacaaaccaacacuugacauugaacuuuuaaaaacugaagugacaaauccagcgguauugcgaaaauuguguauagaagcgaaaauaagcaacaccacaacggacagucgaugcccaacucaaggcgaagcgacauuaguugaagaacaagacgcgaacuucguuuguagaagaacuuuuguagaucgcgguuggggaaaugguugcggauuauucggaaaaggguccuuaauuacaugugcaaaauuuaaaugugucacuaaacucgaaggaaaaauugugcaauaugaaaacuuaaaauauagcgugaucguaaccguacacacuggggaucagcaucagguaggaaacgaaucaaccgaacacggaaccacagcaacuauaacaccgcaagcaccgacaacagagauccaacuaaccgauuauggagcucucacguuagacuguaguccuaggacuggccuggacuucaacgagaugguuuuauuaacuaugaaagagaaaaguuggcucguacauaaacaaugguuucucgacuuacccuuacccuggacuucaggcgcuaguacaucacaagaaacguggaaucgucaagaucucuuaguaaccuucaaaacagcccacgcuaagaaacaagaggucguugucuuggggagucaggaaggugcaaugcacacagcuuuaacuggugcaaccgagauacaaacgaguggaacuacaacaauuuuugcgggucaccuaaaaugucgcuugaaaauggacaaauuaacccuuaaaggaaugucauacguaaugugcacagguagcuucaaauuagaaaaagaaguagccgaaacccaacacggaacaguucugguucagauaaaauacgaaggcaccgacgcacccugcaaaauuccuuucaguacacaagacgagaaaggaguuacacagaauggaagacuaauaacagcaaauccaauagucacggauaaagagaaaccaguuaauauugaggcugaaccaccauucggggaaucauauauugucauaggagcaggggaaaaagcacucaaacuaaguugguuuaagaaagguaguuccauuggcaaaauguuugaagcuacggcacgaggugcucguagaauggccauacuaggagauacggccugggauuuuggcaguauagguggaguauucacaagugucggaaaauuagugcaucaaauuuucggaacagcguauggaguacuguuuucggguguaaguuggaccaugaaaauaggaauuggcguacuacuaacauggcuuggacuaaacucacguucgacaagucuauccaugacaugcaucgcaguaggcuuaguaacgcuauacuuaggaguaaugguacaagccgacagcggaugugugaucaacuggaaagguagagaacuaaaauguggaagugggauauuuguuacaaacgaaguccauacguggacugaacaguacaaauuccaggcugacucgccaaaacggcugucagccgccauugguaaagccugggaagaaggcgucuguggaauuagauccgcuacacgucucgaaaauauaauguggaaacaaauaucgaacgaacugaaucacauauuauuggaaaacgauaugaagcuaacuguugucgucggagacguagcaggcauucuuggucaaggcaagaaaaugauacgaccacaaccgauggaguacaaauacucauggaaaagcuggggaaaagcgaaaauaauaggugccgaugcgcaaaacacuacuuucauaauagacggcccaaauacuccugaaugcccugaugaccaacgagcuuggaauauuugggaagucgaagacuacggauucggaauauuuacaacgaauaucugguuaaaacuacgcgauucguauacacaaguaugugaucaucgguuaaugucagcagcgauuaaggacucuaaagcuguacaugcagauaugggauacuggauagaaagugagaaaaaugaaacauggaaauuagcucgggcuucauuuaucgaaguaaagacgugcauauggcccaaaucccauacauuauggucaaacgguguacucgaaucagaaaugaucauaccaaaaauauauggaggcccuauaucacaacauaauuauagaccaggcuauuuuacacagaccgcagggccuuggcacuuggggaaacuagaauuagauuucgauuuaugcgaaggcaccacuguaguaguagaugagcacuguggaaaucggggacccagucuacgcacaacgacuguaacuggaaaaauuauacaugagugguguugcagaucaugcacucugccuccccuuagguucaggggcgaagacggcuguugguauggcauggagaucagaccaguuaaagagaaagaagaaaaucuaguuaaaagcaugguuucagcaggauccggcgagguugacagcuucagccuuggacuauuauguauuucaauuaugaucgaagaagucaugagaagucgauggucaagaaaaaugcuuaugacagguacguuagcuguauucuuuuuacuaauuaugggccagcugaccuggaaugacuugauacgacuauguauuauggugggcgcaaaugccucugaccguaugggaaugggaaccacguaucuagcauuaauggccacuuucaaaaugagaccaauguucgcuguuggauuauuguuccggaggcucacaaguagagagguguuacuucuuacuauagguuuaagucuuguagcaagcguagaauuaccuaacagccuugaagaacuuggcgacggauuagccauggguauaaugauauuaaaauuacucacugauuuucagucacaccaacuaugggcaacacuacuaucguuaacuuucauaaaaacgacauuuucccuccauuacgcuuggaaaacuauggcaaugguucuguccauagucucucuauuuccccuauguuuaucaacaacaucgcagaagacaacauggcuuccgguucuauuaggaaguuuaggguguaaacccuuaacgauguucuuaauagcagaaaauaaaauauggggacgcaaaucauggccauuaaaugaaggcauaauggcaguugggauugucaguauccuacuaucaucucuguugaagaaugacguaccuuuagcuggaccucuaaucgcuggaggaaugcuuauugcauguuauguaauaucugguucguccgcagaucucucgcuugaaaaagcagccgaggucucuugggaggaagaagcugaacacucuggcgcaagucacaauauccuaguugaaguacaagacgauggaacgaugaagaucaaggacgaagaacgagaugauacuuugaccauucuucucaaagcuacccuauuagcaguauccgggguuuauccauugaguauaccggcaacacuauucguaugguauuucuggcagaagaagaaacagagguccggagugcuaugggauacuccuagucccccagaagucgagagagcuguccucgaugacgggaucuauagaaucaugcaaaggggacuauugggccgcagccaagugggagucggaguauuucaagagaaugucuuccauaccauguggcacgugacuagaggagcgguacugauguaucaagggaaaaggcuggaaccgucaugggcuucuguuaaaaaggacuuaauaucauacggaggcgguuggcgacuacgcgguaguuggaauacaggagaagaagugcaaguuauugcaguagagcccgguaagaauccuaagaauguacagacagcaccugguacauuuaagacucccgaaggggaaguaggugcgaucgcauuagacuuuaagccagguacaucaggaucgcccaucgugaaucgugaaggaaaaauaguuggccuauaugguaacgggguuguuacaaccaguggaacuuauguaucugccauagcgcaggcaaaagcaucucaggagggaccacuccccgagauagaagaugagguauuucgaaaacgaaaucucacuaucauggaccuccauccaggauccgggaaaacaaggagauaccuaccugcuauuguucgugaagcaauaaaaagaaagcuaaggaccuugauauuagcaccuacuaggguugucgcaucagaaauggcagaggcccuuaaagggaugccuauacgauaccagacuacagccgugaaaucugaacauacugguaaagagaucguugauuugaugugucaugcaacuuuuacgaugcgauuacuaagcccaguaagagugccaaacuacaauaugauuauuauggaugaagcucauuucacagauccaaguaguauagcagcgagggguuacauaucuacuagagugggcaugggggaagccgcugcaauauuuaugacagcuacaccaccaggaucuguugaagcauuuccacaaagcaacgcugugauacaggaugaagaaagagacaucccagaacguuccuggaacucuggauaugaguggaucacagauuucccaggaaaaacugucugguucgugccgaguauaaagucagguaaugauauagcaaauugucuaaggaaaaaugggaaaagaguuauacaacuuagcagaaaaaccuuugacacagaguaucagaaaacuaagaacaaugauugggauuacguugucacaacagauauuucugaaaugggagcaaauuuuagggcggacaggguaauagacccccguagaugcuugaagccugucauauuaaaggauggcccagagcgggucauacuugcggguccgaugccuguaacgguagcuagcgcagcucaacggcgaggaaggauugggaggaaccauaauaaggaaggagaucaauauauauauaugggacagccacugaauaaugacgaagaucaugcccauuggacggaggcaaagaugcuucuugauaauauaaauacaccugaaggaaucauuccugcauuauucgaaccagagagggaaaagucggcagcggucgauggugaauauaggcuuaggggagaagcgagaaaaacguuugucgaacuuaugaggagaggugauuuaccaguuugguuaucauauaaagucgccagcgaaggauuucaauauagcgauaggcgauggugcuuugacggagaaagaaauaaccaaguacuggaggagaacauggauguugaaauauggacaaaggaaggagagaggaaaaaguuaagacccagauggcuggaugcaagaacauauucagacccauuagccuuacgugaauuuaaagaguuugcggcugggagacguucaguuagcggggaucuaauccuagaaaucgguaaacuaccucaacaucucacacaaagggcucaaaaugcuuuagacaauuugguaaugcuccacaacagugagcaaggagggcgagcuuauaggcacgcaauggaggaacuaccggacacuauagaaacauugauguuguuagcacuaauagcgguauuaacagggggaguaacucuuuucuuccucucuggacgcgggcuugggaagacuagcauuggacuuuuauguguaauggcaucaucgguauuauuguggauggcaucuguugaaccucauuggauugcagcaucaauaauacucgaguucuuucucaugguccuccuaauucccgaaccggauaggcaacggacaccacaagacaaucaguuagcuuaugucgucauaggcuuacuuuucaugauauugacaguagcugcaaaugaaaugggcuuauuagaaaccaccaaaaaggaccucgguauaggccauguugcaguugaaaaccaccaucaugcugcuauguuagacguagaucuacacccagccuccgcauggacacuauaugcaguagcaacaaccauuauaacucccaugaugcgccauacaauagaaaauacaacagccaauauaagucuaacugccauagcgaaucaggcggcuauccuaauggguuuggacaaaggauggcccauaagcaagauggacauaggugucccucuucuugcauugggguguuacagucagguaaacccacuaacguugaccgcugcuguacugaugcuuguugcucauuaugccauaauagggccuggacuccaagccaaagccacaagggaagcgcagaagagaacggcagcgggaauuaugaaaaauccgacgguagauggaauugucgccauugauuuagacccagugguguaugacgcaaaauuugaaaaacaauuaggucaaauuauguuauuaauacucuguacaucacaaauacuauuaaugagaacuaccugggcacugugugaaucaaucacacuagcgacgggcccauuaacgacacuaugggaaggcagcccagggaaauucuggaauacaacgauugccguuuccauggccaacauuuucagagguuccuaccuagcaggcgcaggucucgcuuucucucuaaugaaaucauuaggcggggguagaagaggaaccggagcacaaggcgaaacauuaggcgaaaaguggaaaagacaacuaaaucaauuaaguaaaagugaguucaacacuuacaaaaggaguggaaucauggaaguagacagaagcgaggccaaagagggcuugaagagaggggagacaacaaaacacgcagugucgcgaggcacggcuaaacugagaugguucguagaaaggaaucugguaaaacccgaggggaaggugauugaccuugggugcggaagaggggguuggagcuauuauugugccggacuaaagaaaguaacugaaguaaaggguuauacaaaaggagguccaggacaugaggagcccauacccauggcuacauaugguuggaaucuaguaaaguugcacaguggcaaagauguauucuuuauaccacccgaaaagugugauacacuacuaugcgauauuggugagaguaguccuaaucccacaauagaggaaggucgcacacuaagaguucucaaaaugguagaaccuugguugagaggaaaucaguucugcauaaagauacuaaaucccuauaugccgaguguaguagagacccucgaacaaaugcaaagaaaacauggagggaugcuagucagaaacccucuuaguaggaacaguacucacgaaauguauuggguuucaugugguacggguaacauaguuucagcggucaauaugacaagcagaauguuauuaaauagguuuacuauggcacauagaaagcccacuuacgaacgagauguagaccucggaacgggcacaagacacguagcaguagaaccggagguagccaaucuagauauaauaggacaaagaauugagaauauaaagcacgagcauaagucaacuuggcacuaugacgaagauaaccccuauaaaaccugggcguaccacgguuccuaugaagugaaaccuaguggaucugcaagcucgaugguaaacggaguaguaaaauugcuaaccaagccgugggacguuauucccaugguuacucagauagcaaugacagacaccacucccuuuggacaacaaagaguauuuaaagaaaagguagauacgcguaccccaaaagcaaagcgaggcacugcacagauuauggaaguaacggcgcgauggcuauggggguuuuuaaguagaaacaaaaagccgagaauauguacaagggaggaauuuaccagaaaagugagaaguaacgcugcgauaggugcaguauuugucgaugagaaccaauggaacucggcaaaagaggccgucgaagaugagagauuuugggaucuuguucaucgagagcgugaauuacacaagcagggaaaaugugcaacgugugucuauaacaugaugggcaagagggagaagaaacugggugaguucggaaaagccaaagguucacgagccauaugguauaugugguuaggugcuagauuccuagaauuugaagcccuuggauuuaugaaugaggaccauugguuuagucgugaaaacagucucucggguguggagggggaaggcuuacacaaacuuggauacauuuuaagagauauuuccaagauacccggaggaaauauguacgcagacgacaccgcaggcugggauacgagaauaacugaggaugaucuacaaaaugaggccaaaauaacugauauaauggaacccgagcaugcacugcuagccaaagcaauauucaaacuaaccuaucagaacaaaguaguaagaguacaaagaccggccaaaaauggcacagugauggauguuauaucuaggcgagaucaacgaggauccggacaaguaggaaccuauggcuuaaacaccuuuacuaauauggaggcucaguuaauacgacaaauggagucugaggguauauucucaccaagcgaacuagagacgccaaaccuugcugaacgagcauuggauugguuagaaaaauauggcguagagagauuaaaaaggauggcuaucucuggcgaugauuguguggucaaaccaauagaugaccgauucgcgacugccuuaacggcccugaaugacauggguaaagugaggaaggacauaccucaaugggaaccaucuaaaggauggaacgacuggcaacaaguuccguuuuguagucaccacuuccaccagcuuauuaugaaagauggucgagaaauuguugucccauguagaaaucaagacgaacuuguaggacgagcacggguaucucaaggggcaggcuggagucugcgagagacagcuugccuaggaaaaucauacgcacaaauguggcaauugauguacuuucauaggcgagauuuacgguuagcggcuaacgcaauauguucggccgucccaguagauugggucccaacgagucggacaacguggaguauacaugcacaucaucaauggaugacgacagaggacauguuaaguguauggaaccgagucuggauagaagagaauccauggauggaggacaaaacucauauuucaucaugggaggauguuccauaucucggaaaaagagaggaccaauggugugggucccugauaggucucaccgcucgagcuacaugggcaacaaauauccagguggcaauuaaucaaguacggagguugauaggaaaugaaaacuaccuugacuacaugacaaguaugaaacgauucaagaacgaguccgauccagaaggcgcucucugguga

SEQ ID NO: 21639 - RNA, 9879 nt, Artificial Sequence
  derived and/or modified CDS sequence (opt6) from DENV-1__FJ898373__SS-prME
ucaguaacgaugcuacuaauguuaaugccgacggcuuuggcguuucaucugacuacuagagguggcgaaccucacaugauuguuagcaaacaggaacgaggaaaaucauuacuauuuaaaacauccgcaggggugaauauguguacacuuauugcaauggaucugggagaacuaugcgaagauacaaugacuuacaaauguccacguauaaccgaaguagaaccagacgauguagacugcuggugcaacacuacagacacuuggguaacguacgguaccugcucacagacuggugaacacagaagagacaaaagaucuguagcauuagcaccacauguaggguuagguuuagaaacaagggcagaaacuuggaugaguagugagggagcauggaaacaaauacaaaaaguugaaacuugggcuuuaaggcauccgggguuuacgguaauagcauuauuccuagcacaugcuauagguacaaguauaacacaaaaaggcauaauauuuauuuuacucaugcuaguuacacccucuauggcuaugcgaugcguagggauagggagucgugauuucguagaagguuuaucuggagcuacguggguagacguagucuuagaacaugggucaugcgucacgaccauggcuaaagauaaaccaacacuagacauagaacuacucaagacugaggucaccaacccagcaguucuaagaaaacugugcauagaagcuaaaaucaguaauacgacaacagacucacgaugccccacacaaggggaagcaacguuaguagaggagcaggaugcaaauuuuguuugccgaaggacauuuguagaccgcggcuggggaaauggauguggccuuuuuggaaaagguaguuugauaaccugcgcaaaauuuaaaugcguaacaaaguuagaggguaagauaguacaauacgaaaaccugaaguacucgguaauugugacgguucauacaggagaucaacaucaggugggcaaugaaagcacugaacacgggacgauagcaacaauaacaccacaagcaccuaccucagagauacaacucacugauuauggagcguuaaccuuggacuguucuccacgaacaggauuagacuucaacgaaaugguacuauuaacaaugaaggaaaaaucuugguuaguacauaaacaaugguuccuugaucuaccauuaccguggacgaguggagcaucgacaucacaagaaacuuggaaccgucaagaucuccuaguaaccuuuaaaacagcucaugcgaagaaacaagaagucguuguuuuagggucccaagaaggggcaaugcauacggcauuaacgggagcuaccgaaauacaaacgacgggcacaacgacaauauucgccggccacuuaaaaugccgacuaaaaauggauaaauugaccuugaaagguaugucauacgucaugugcacgggaucauuuaaacuagaaaaagaggucgcugaaacucaacacgggaccguucuagugcagauaaaauaugaagguacagaugcaccauguaagauaccauuuucaacacaagaugaaaaagguguaacacaaaauggaagauuaauaacagcaaacccuauaguaacugacaaggaaaagccagucaacauagaggcagaaccuccauucggggagucuuacauuguaauaggcgcaggagagaaagcauugaaauuaucgugguuuaagaaaggaucgucuauaggaaaaauguucgaagcgacagccagaggcgcccgucggauggcaaucuugggagauacugcgugggacuuuggaucgauugguggggucuuuacaucuguuggaaaauuaguacaucaaauuuuuggaacagcauacgguguucuauuuucaggugugucauggacgaugaaaauagggauaggagucuuauuaacauggcuaggacuuaauucgagaagcacaucguuaucgaugaccugcaucgcuguuggguuaauaacucuuuaucugggagucaugguacaggcugacucaggaugugugauaaauuggaaggguagggaauuaaaguguggaucaggaaucuuuguaaccaacgaaguacauacuuggacugagcaauauaaguuucaagcugauucaccuaagagguuaagcgcagcagugggaaaggcaugggaagaaggcguauguggaauacgcagcgccacaagacuagaaaauauuauguggagacagauaucuaaugaguuaaaucauauacuauuagaaaaugauaugaaauucacagucguagucggugaugucguagguauacuagcgcaaggcaagaaaaugguacgaccucaaccuauggagcauaaguauaguuggaaaucaugggguaaggcuaagauuauaggagccgacguccaaaacacuacuuuuauaaucgacggacccaacacacccgaaugcccggaugaccaacgagcauggaauauuugggaaguugaagauuacgguuuugguauuuuuaccacaaauaucuggcuaaaacuuagagauuccuauacccaaguaugugaccauagacuuauguccgcggcuauaaaggacuccaaggcuguucacgccgauauggguuauuggauagaaagcgagaaaaaugagacauggaaacuugcucgugcgucuuucauugaaguuaaaacuuguaucuggcccaaaagccauacucuauggaguaauggcguacucgaaagcgaaaugauaauacccaagauuuauggagguccaaucucacaacauaauuaccgcccuggauauuucacucagacagccggcccauggcaucuaggcaaguuagaauuggauuuugacuugugugagggaacgaccgugguuguggacgaacauugcggaaauaggggccccucgcuacgaacuacuaccguaaccggaaaaauuauacaugaaugguguugcaggagcugcacuuuaccaccguuacgguucaaaggggaagacggguguugguauggaauggagauaagacccguaaaagaaaaggaagaaaaccugguaaagaguaugguuagugcaggauccggagaaguugacaguuuuagccuaggacucuuaugcauaucaauuaugauagaagagguuaugcguuccagauggucacgcaaaauguugaugacgggaacguuagcgguuuucuuucuacucauaauggggcaacugacauggaaugauuuaauccguuccugcauaaugguuggugcaaaugcuucagaccgaaugggaauggguacaaccuauuuagccuuaauggccacguuuaagaugagaccaauguucgccguaggcuuacuauuucggagacuaacaagccgggaaguacugcuccuuaccauaggucuuucucugguggccucuguggaauuaccaaacucucuggaagaauuaggagauggauuagcgauggguauaaugauucucaaacuuuuaacagauuuucaaucuuaucaacuaugggcuaccuuacuaucccuaaccuucaucaaaacuacauuuucacuacacuaugcauggaaaacaauggccaugguuuugaguauaguaucauuacuaccucugugcuugucaacaacaucucagaaaacuacaugguugccuguauuacuagguagucuaggauguaaaccauuaacaauguuucuaauugccgagaacaaaauauggggaagaaaauccuggccacuuaaugaaggaauaauggcggucggcauuguaaguauacuauuauccucacuacuuaaaaacgauguaccacuagcaggccccuuaauagcaggagguauguuaauagccugcuauguaauauccggaucuucugccgacuugucauuagagaaagcagcagaagugagcugggaagaggaagccgaacauaguggugcaucacauaauauccuaguagaaguacaagacgauggaacaaugaaaauuaaggacgaagagagggaugacacacucaccauucuauugaaagcaaccuugcuugccguuucugguguauauccacuaucaauuccagcuacuuuauucguaugguauuucuggcaaaagaagaaacaacgaucgggaguucuaugggauacaccaucaccgcccgaagucgaacgcgcuguauuagacgauggaauauaccguauuaugcaaagaggucuccuaggccgaagccaaguaggaguaggaguauuccaagagaacguuuuccacacaauguggcaugucacacguggugcaguacuuauguaucaggguaaacgccuggaaccaucaugggcuagcgucaagaaagaucuaaucagcuauggcggaggauggcgacugcaagguagcuggaacacaggugaagagguccaggugaucgcuguggagccaggaaagaaucccaagaauguccaaacugcuccagguaccuuuaaaacuccagaaggcgaagugggggcaaucgcacuagacuucaaaccgggaacgucuggcucgccuauaguaaauagagaagggaagauagucggucuauaugguaacggugugguuaccaccucuggcaccuacgucucagcuauugcacaggcuaaagcaucacaagaaggaccacuuccagaaaucgaagaugagguuuuucgaaaaagaaacuuaaccauuauggaucuucauccagguucagguaaaacgagaagguacuuaccagcuauagugagggaagcgauuaaaagaaagcuaaggacauuaaucuuagccccaacgcgaguuguugccucagagauggcagaagcguuaaaagggaugccaauaagguaucaaacuacugcagucaaaucagagcauacaggucgcgaaaucguugaccucaugugucaugccacguuuacuaugcggcuucugucgccaguucgaguaccuaacuacaauaugauaauuauggaugaagcucacuucacggacccgaguagcauagcggcccgugguuacaucucaacaagagucgguaugggggaagcugccgcgauauuuaugaccgcuacgccgccaggcucagucgaggcuuuuccacaaucuaaugccguaauucaagaugaggagcgcgacauaccagaaaggucguggaacucaggauaugaauggaucacagacuucccaggaaaaacgguuugguucgugccuucuaucaaaucagguaaugauauagccaauuguuuaaggaaaaacggaaaacgcgucauacaauuaagucguaaaacauucgacacugaguaccaaaagacgaaaaauaaugacugggauuacguaguaacaaccgauauaagcgaaaugggggcuaacuuuagagcugacagggugauagacccucgacgaugcuuaaagccugugaucuuaaaagaugguccagagagggugauauuagcggggccaaugccugucacuguagcaagcgcagcacaacggcggggaaggauugguaggaaccacaauaaggaaggugaucaauacauauacaugggacaaccacuaaauaacgaugaagaccaugcucauuggacagaagcuaagaugcugcuagauaacauaaacacaccggaaggaauuauaccugccuuguuugaaccugaaagggaaaaaucagcagcaauagauggcgaauauagauuacgaggugaggccagaaaaacuuuugucgaauugaugagaagaggagauuuaccggugugguuaucauacaagguggcaucugagggauuucaguauucagaccguagauggugcuucgauggggaacguaauaaucaaguauuagaagagaauauggaugucgaaauuuggacuaaggaaggagaaaggaagaaacuucgaccaagauggcuggacgccagaaccuauagcgacccucuagcacuaagagaauuuaaagaauuugcagcugguagacguagugugaguggugauuuaauucuagaaauagguaaacuaccgcaacaucuaacucaacgugcacaaaaugccuuggauaauuuagugauguuacauaacagcgaacagggagguagagcuuacagacacgcuauggaagaacuuccugauacaauugaaacucucaugcuacucgcacuaauugcgguauugacuggcgggguuacauuguucuuucuaucgggucgagguuuaggaaagacgucuauagggcuccuaugcguuauggcuucaagcgcauugcuauggauggcauccguugaaccacacuggauagcagcaucaauaauccuagaguucuucuuaaugguccugcuaauaccugaaccggacagacaacguacaccacaagauaaucaacuggcguacgucguuaucggccuuuuguuuaugauccuuacaguagccgcaaaugagaugggcuugcucgagacuacgaagaaagacuuagguauagggcacguagcuguggaaaaccaucaucaugcaacgaugcuugacguggacuugcauccagccagugcuuggacacuauaugcugucgccacuacaaucauaacaccuaugaugaggcacacgauugaaaauacaaccgcaaauaucagcuuaacugccauagcaaaccaagcggcaauauuaaugggcuuagacaaaggauggccaauaucgaaaauggauauaggagugccccuccuagcacuagguugcuauucucaaguaaauccauuaacacuaaccgcagcuguuuuaauguugguugcacauuaugcgauaauuggaccaggauuacaagcuaaagcaacuagagaagcccaaaaacgaacggcagcaggaaucaugaaaaauccaacuguagauggcauuguagccauagaucucgacccuguuguauaugaugcuaaauucgaaaaacaguugggacaaauaaugcuucuaauacucuguacaucucagauauuauugaugcgaacaaccugggcgcugugcgaaaguauaacccuagccacugguccuuuaacaacuuuaugggaaggaucucccgggaaauuuuggaauaccacaauugcggucucaauggcaaauauuuuucgugguucuuacuuagccggugcugggcuugcuuucucgcucaugaaaagucuaggugguggccguagggggaccggggcacaaggagaaacacucggggagaaauggaaacgccaauuaaaucaacuaaguaaaucagaguuuaauacguauaaaagaagcgggauuauggaggucgauagaagcgaagcgaaagaaggacuaagaaggggagaaacaacaaaacacgcggugucaagagggacggcaaaacuacgaugguuuguagagcguaaucuagugaaacccgaagguaaagugauagaucuaggaugcgggcguggcggcuggaguuacuauugcgcggggcuuaagaaagugacugaaguaaaaggauauacaaagggagguccuggucaugaagaaccgauuccuauggccacuuauggguggaaccucguuaaauuacauuccggaaaggauguuuucuuuauaccaccagagaaaugugauacauuacuaugugacauuggagagagcucgccgaauccaacuauagaagagggaagaaccuuacgaguuuuaaaaaugguggagcccuggcuuaggggaaaccaauuuuguauuaagauccucaauccauauaugccaucagugguggaaacacuugaacauaugcaacgcaagcauggagggaugcuuguaaggaauccauuaucaagaaacuccacacaugaaauguauuggguaagcugcgggacugggaauauaguauccgccguaaauaugacaagccgcauguuacuuaauagauuuacaauggcacauagaaaacccacauacgaacgugauguugacuugggagcgggaacgcgacacguggcaguagagccugaaguagccaaucuagacauuauaggucaacguaucgagaauauaaagcacgaacauaaaucaacuuggcacuaugaugaagauaacccuuauaagacgugggcauaucauggcaguuaugaaguuaaaccaucagguuccgcgucaagcaugguaaauggcguuguaaaacuacuuacaaaaccaugggacgucauuccuaugguuacucaaauagcuaugacagacacaacacccuuuggucagcaaagaguguuuaaagagaagguagauacaaggacaccaaaagcaaaacgggguacagcacaaauuauggaagugacugcucguugguuauggggauuuuuaagucgcaauaagaaacccagaaucuguacgagggaagaguucacccgaaaagugcggucaaacgcagcaauuggagcaguauuugucgaugaaaaucaauggaacucugcuaaagaagcagucgaagaugaaagauucugggaccuggugcacagggaacgagagcuccacaaacaaggaaaaugugcgaccugcguguauaauaugauggguaaacgcgaaaagaaacuaggagaguuuggaaaggcaaaaggaaguagagccauuugguauaugugguuaggugcgagauucuuagaguuugaggcuuuagguuuuaugaaugaagaucauugguucaguagggaaaauagucugucugguguagaaggggaaggcuuacauaaacucggcuacauacuccgugauauaucaaaaauuccaggcggcaacauguacgcugacgauaccgcugguugggauacuagaauaaccgaagaugaucuacagaaugaggcuaagauaacagacauaauggaaccggagcaugcccugcuagccaccucaaucuuuaaauuaacuuaccaaaacaaggugguccgcguacaaagaccagccaaaaauggaacggugauggacguuaucucaagaagagaucaaagagguaguggacaaguugguacauacggcuuaaacacuuucacaaacauggaagcucagcucauccggcaaauggagucugaaggaauauuuucucccucugaguuagaaacaccaaaucucgcagagcgaguacuugacuggcuugaaaaauauggagucgaacggcucaaaagaauggcaauaaguggagaugacugugucgucaagccgauagaugaucgauuugcgacugcacuaacugcccucaaugacaugggaaaaguaagaaaagauaucccucaaugggagccuucuaaaggguggaaugauuggcagcaaguaccuuuuugcagucaucauuuccaucaauuaaucaugaaggauggcagagaaauaguaguuccguguagaaaucaagaugagcuaguuggucgggccagaguaucccagggagcagguuggucucucagagagacagcuugucucggaaaauccuacgcccaaauguggcaacuaauguauuuccacaggagagaucugagauuagcagcgaaugcuaucugcucagcugugccggucgacugggugccgacaucacgaaccacauggucaauacaugcgcaucaucaguggaugacaacagaggauaugcugagugucuggaaccgcguuuggaucgaagaaaacccauggauggaggauaaaacucacauaucaucauggggugauguaccuuaccuugguaaacgagaagaucaguggugcggcagcuuaauaggauuaacugcacgagcaacaugggcuacaaauauacagguagcuaucaaucaaguuagaagacucauugguaaugaaaacuacuuagauuauaugacaaguaugaaaagauuuaaaaaugaaagugaucccgaaggagcacuaugguag

SEQ ID NO: 21640 - RNA, 9879 nt, Artificial Sequence
  derived and/or modified CDS sequence (opt6) from DENV-1__FJ898374__SS-prME
ucgguuaccaugcuuuugauguugaugcccacugcucucgcauuccaucuaaccacuagagggggagaaccacauaugauagucacuaaacaagaacgcgggaaaaguuuacuguucaaaacuucugcugguguaaauauguguaccuuaauagcaauggacuuaggggaauuaugcgaagauaccaugacauacaaaugucccagaauuacagaagcagaaccagacgauguagacuguugguguaaugcaacugacacuuggguaacuuaugggacuuguagucaaacgggggaacaucgaagggauaaaagaucgguagcucuagcuccacaugucggguuaggauuagaaacaagaacagaaacuuggaugaguucagaaggcgcuuggaaacaaauacaacgcguugaaacaugggcccuaagacacccggguuucaccguaauagcucuauuucuagcccaugcaauugggacuagcauuacacaaaaaggaaucauuuucauacucuugauguuagugacucccucaauggccaugcgcuguguuggaauuggcucaagagauuuuguagaaggauuauccggagcuacuuggguugauguuguucuagaacauggaaguuguguaacaacuauggcgaaagauaaaccuacucuagauauagaguuacugaaaacugaaguuacaaauccagcagugcuucgaaaauugugcauagaagcaaaaauaucuaauaccacuacugacaguagauguccaacgcaaggugaagccacccuuauggaagaacaagaugcuaacuucguuugcagacgcacguuuguugauagaggguggggaaacggcuguggauuauuuggcaaaggaucgcucaucacaugugcgaaauucaaaugcguaacaaaacucgaagguaaaauaguacaauacgagaaccuaaaauacucgguaaucguaacaguccauacaggugaucaacaccaaguggguaacgaaucuacagaacauggaacaacagcuacuauaacuccacaagcacccacgucugagauccaacuuacagacuacggagcucuuacauuagauuguucaccaagaacugguuuagauuuuaaugaaaugguacuguuaacaaugaaagagaaaaguugguuagugcauaaacagugguuuuuggauuuaccauuaccauggacaagcggcgcuagcacaagucaagaaacguggaauaggcaggacuuguuaguaaccuucaagacagcacacgccaagaaacaagaaguuguuguacuagguagucaggagggagccaugcauacugcguuaacgggagcaacagaaauucaaacuuccggaacaacuacuauauuugcaggccaccuuaaauguagacuaaaaauggacaaauuaacauuaaaaggcaugaguuacguaaugugcacaggaaguuuuaaauuggaaaaagaaguagccgaaacgcaacauggaacagugcuuguucagauaaaguacgaggguacugacgcccccugcaaaauacccuuuagcacucaagaugagaaaggagugauucaaaauggaagacuuauaacagcaaauccaauaguaacggauaaagaaaagccagucaacauagaagcagagcccccguuuggagaguccuacauagugauuggcgucggggaaaaagcauuaaaauuaaguugguuuaaaaaggguagcucuauaggaaaaauguuugaagcaacagcaagaggagcaagaaggauggccauacucggagauaccgcuugggauuucggcagcauagguggcguguuuacaucaguagggaaguuaguacaucaaaucuuugggacagcauauggaguuuuauuuaguggcgugaguuggacaaugaagauuggaaucgguguacuauuaacauggcuuggacuuaauucuaggaguacuucauugucaaugacauguauagcuguuggacugguaaccuuauauuuagguguaaugguucaggcugacucaggaugugucauaaauuggaaaggaagagaauuaaaguguggcaguggaaucuuugucacuaaugaaguacauacguggacugagcaauauaaauuucaagcagauagucccaaacgguuaucagcugcuauugguaaggcgugggaagaagggguuugcgguauacgaucugugacgagguuagaaaacaucauguggaagcaaauuaguaaugaauugaaccacauucuucuggaaaacgauaugaaguucacagucguaguaggagauguagucgguauacuagcacaagguaagaaaaugauaagaccacagccaauggaacauaaauauaguuggaagaguuggggcaaggcuaaaauaaucggugcagauguccagaacacaacauuuauaaucgacggaccaaacacacccgaaugccccgacgaccaacgagcauggaauauaugggaaguagaggacuacggauucgguauauucacgaccaacaucugguugaaacugagagauuccuacacacaggcuugcgaucaucggcuaaugagcgcugccauaaaagauucuaaggcuguccaugccgauaugggauauuggauugaaucagagaaaaaugaaacuuggaaauuagcaagagcaaguuucauagagguaaaaaccugcauuuggccaaaaagucacacacucuggaguaacggggugcuggaauccgaaaugguaauacccaaaauauaugguggaccaauaagucaacacaauuaccgcccggguuauuucacacaaacugcuggucccuggcaccuagguaaacuugaacuggacuucgaucuuugugaagguaccacaguuguaguugacgaacacuguggaaauaggggacccucacuaaggacuacaacugugaccggaaaaaucauucacgaaugguguugccggagcugcacauuaccaccgcuacgauuuaaaggugaagacggcugcugguacgggauggaaauuagaccuguaaaagaaaaggaggaaaaucuagugaagaguaugguguccgccgggaguggagaaguagauucuuucucauugggcuuguuaugcauaucaauaaugauagaggaaguaaugagaucgcgcuggagcaggaagaugcuuaugacgggaacucuggcggucuuucuccuauuaauuauggggcaacucacauggaaugauuugauaagacucugcaucauggugggagcaaaugcgucagauaggauggggaugggaacuaccuauuuagcacuaauggcaaccuuuaaaaugaggccgauguuugcaguuggauuacuauuuagacgguugacgagccgagaaguauuacuuuuaacuauagguuugagucuuguagcaagcguugagcuacccaauagucuugaggagcuaggagauggacuagcuaugggaauaaugauccucaaacuucuaacggauuuccagagucaccaacuaugggccacccuccucucauuaacuuucauaaagacgacacuaucauuacauuaugcauggaaaacgauggcaaugguucuuucuauaguaucacuauuucccuugugucuaucaacuacaucacaaaagacuaccuggcuccccgugcuccucgggagccuggguuguaagccuuuaacaauguucuuaauugccgaaaacaaaauuuggggaagaaagagcuggccauuaaacgaaggaauuauggcgguaggcguaguuaguauauuacuuucaucauuacugaaaaacgauguaccgcuagccggcccauuaauugcgggaggaaugcuaauagcguguuauguuauuucagggucaagugcagacuuaaguuuggaaaaagcugcagaagugucgugggaagaagaagcggaacauucgggggcuucgcacaauauacucguggaaguacaggaugacggcaccaugaaaauuaaagacgaggaacgagaugauacccugacaauauugcuuaaagcgacuuuauuagcaguuucaggcguuuauccauugucuauaccggcaacguuauuuguuugguauuuuuggcagaagaagaaacaacgaucugggguccucugggacacaccgaguccuccagaaguagagagagcuguauuggaugacgggauauaccguauaaugcagcgagguuuauuaggaaggucgcaaguuggcguuggaguuuuccaagaaaaugucuuccauaccauguggcacguuacacgaggugcgguacuuauguaucaaggaaaaagguuagagccuucgugggcauccguaaagaaggaucuaaucuccuacggagggggauggcgcuuacaagggucauggaacacgggagaagagguacaaguuauugcgguagaaccaggcaaaaaucccaaaaauguacaaacagcuccugguacauucaaaacaccagaaggagaaguaggcgcaauugcauuagauuuuaagccgggaacaagcggaagucccaucgugaauagagaagggaagauagucggucuauauggaaacggcgucgucacaaccucaggaacguauguuuccgccauugcacaagcaaaggcaucacaagagggucccuuaccugagauugaagaugaaguguuuagaaagagaaauuugacaauaauggaucuucaucccggcucgggaaaaacgagaagguaucuuccggcaaucgucagggaagcaauuaaaagaaaauuaagaacauuaauucuggcccccacaagagucguagcaucggaaauggcagaagccuuaaaaggaaugccaauacgguaucaaacaacagcuguaaaaucggaacauacgggcaaagagauaguagaccuaaugugccaugcgacuuuuacuaugagguuauugucaccaguaaggguuccaaauuauaacaugauaauuauggaugaggcccauuuuacugauccuucaucaauugcagcucgcggauauauaaguaccaggguaggaaugggugaagccgcagcaaucuuuaugacugccacaccuccaggaucaguugaagccuuuccgcaaaguaacgcgguaauccaggacgaagaacgagauauaccagaaagauccuggaacucaggcuaugaauggauaaccgacuuccccggaaaaaccgucugguucguacccucuauuaaaucugggaaugauauagcuaauugcuugaggaaaaauggaaaacgaguuauucaacuuucgagaaagacuuucgacacagaauaucagaaaaccaaaaacaacgauugggauuauguaguaacgacggauauaagcgagaugggugcgaauuuucgcgcagauagggucauagauccaaggaggugucucaaaccugucauccugaaggauggacccgaacgaguaauacuugccgguccuaugccuguaacuguagcaagcgcagcacagagaagaggccgaauaggcagaaaccauaauaaagagggagaccaguacauuuacauggggcagccauuaaacaaugacgaagaucaugcccacuggacugaggccaaaaugcuuuuagacaacaucaacacccccgaagggauuauacccgcguuguuugaacccgaacgugagaaaagugccgcaauugacggugaauacagauugaggggagaagcacgaaagacuuucguagaauugaugcggagaggugaucuacccguguggcuaagcuauaaaguugcaagugaaggguuccaauauuccgacagacgcugguguuuugauggggagcgcaacaaucaaguccuagaagagaacauggauguugagauuuggacaaaagagggcgagcgaaagaaacuaagaccccgcugguuggacgcccgaaccuacucugauccacuagcacuaagagaauuuaaagaauuugcggccggucgccgauccgugucuggcgaccuuaucuuggaaauaggaaaacucccucaacauuuaacgcaacgagcucagaaugcgcuggacaaucuuguuaugcuccacaauagugaacaaggcggucgcgcauaccgccacgcgauggaggagcuaccugacacuauagaaacuuuaaugcuauuggcguuaauagcuguuuugacaggaggcgucacacuauucuuuuuaagcggaagaggccuagggaaaaccucaaucggcuuauuauguguaauggcaucuucaguacuacuuuggauggcaucuguugaaccacacuggauagccgcgaguauuauauuggaauuuuuccuuaugguacuguuaauacccgaaccugaucgacagagaacaccacaagauaaccaauuagcuuauguggugaucgggcuguuauuuaugauccugacuguggcugcaaacgaaaugggguuacucgagacaacgaagaaagaucugggaauaggacauguugcaguugaaaaucaucaucacgcuaccaugcuagacguagacuugcaccccgcaagugcuuggacacuauacgccguagcaacaacuaucauaacaccgaugaugcgucacacuaucgaaaacacgaccgcaaacauuuccuugacugcgauagcaaaccaagcugcuauacugaugggccuagauaaagguuggcccauaaguaaaauggauauuggaguacccuugcucgcucuagguugcuacucacagguaaauccacuuacacuaacagccgcagugcugaugcuuguggcgcauuacgccauaauaggaccugguuugcaagcaaaagcaacuagagaagcacaaaaacgaacagcggcuggcauuaugaaaaacccaacuguggacggcauaguagcuauagaccuugauccaguaguuuaugacgccaaauuugaaaaacaacuggggcagauuaugcuucuuauauuaugcacuucacagauauuacugaugaggacgacuugggcacuuugugaaucaauuacauuagcaaccgggccuuuaacuacccuaugggaggggaguccaggaaaguuuuggaauacaacuauagccguaucuauggcgaacauauuuaggggaucauauuuagcaggagcugguuuagcguuuagccuuaugaagagucuggguggugggagaagaggcacaggagcucagggagagacccuaggagaaaaauggaaacgucaacuaaaucaacuaagcaagagcgaauuuaacauauauaagcgaaguggaauuauggagguugaccgcucagaagcaaaagaaggucucaaaagaggcgagaccacccgacacgcgguuucacgaggaacggccaagcuacguugguuuguugaaagaaaccuaguaaagccggaggguaaagucauugaccuaggaugugguagaggaggaugguccuauuauugugcuggacuaaagaaagugacugaggucaaagguuauacaaagggugguccuggucacgaagaacccauccccauggcuacauacggcuggaacuuaguaaaacuccauagcggcaaagacguguucuuuacaccacccgagaaaugcgauacacucuugugugacaucggggaaaguaguccaaauccaacaauagaagagggcagaacacuaaggguuuuaaaaaugguagaaccauggcuacgcgggaaucaguuuugcauaaaaauacucaauccguacaugccuucagucguagaaacacuggaacaaaugcaacguaaacacggugggauguuaguccgaaacccauuaaguagaaauaguacccacgaaauguauuggguaucaugugguacaggaaacaucguaagugcagugaacaugacuucuagaauguuacugaauagauuuacuauggcacauaggaagccuacauacgagagagauguagacuugggagcuggaacaagacaugucgcaguagaacccgaaguagcaaauuuagacauaauaggacagagaauugaaaacauuaaacacgagcacaaaucaacuuggcauuaugaugaggacaacccuuauaaaaccugggcuuaccauggcuccuaugagguaaaaccuagugguagcgcgaguaguauggucaacggugugguuaaguuauuaacaaaaccaugggacguuaucccaauggugacgcagauagcuaugacagauacaacgcccuucggacaacaacgugucuucaaagaaaagguagacacacgaacaccaaaagcaaagagagguaccgcacaaauuauggaagugaccgccagaugguuaugggguuuucuuagcagaaauaagaaaccacgaauuuguacacgagaagaauuuacaagaaaggucagaucaaacgcagcaauaggugcugucuucguagaugaaaaccaauggaacuccgcaaaagaggcaguagaggaugaaagauucugggaccuaguccaaaaagagagggaacuacacaaacagggaaagugcgcaacauguguguacaauaugauggggaagagagagaagaaacuaggcgaauuuggaaaggcaaagggaucuagagcaauuugguauaugugguuaggcgcacgcuuccuugaguucgaagcucucggauucaugaaugaagaucacugguucucacgcgaaaauagcuuaaguggggucgaaggagagggacugcauaaauuaggguauauuuuaagggacaucaguaaaauaccggguggaaauauguacgcugaugauacggcagggugggauacaagaauaaccgaggaugaucuccaaaacgaagcuaagauuacagauauaauggagccagaacaugcucuguuagccacgucaauauuuaaauuaaccuaucaaaauaagguaguccgaguacaaaggccagcgaagaauggaacagugauggacguuaucucacgaagggaucagcgcggaaguggccaagucggaacauauggguugaauacauucacuaauauggaagcacaauuaaucaggcagauggaaucugagggaaucuucuuaccaagugagcucgaaacgcccaacuuagccgaaagaguucuagauugguuagagaaacacggagucgaaagguuaaaacggauggcuauaucgggcgacgauugugucguuaaaccuauagaugacagauuugcgacagcacuuacggcguugaacgauaugggaaaagugagaaaagauauuccucaaugggaacccucuaaggguuggaaugauuggcaacaaguccccuucuguucacaucauuuucaucaguugaucaugaaagacgggcgcgagauuguugugcccuguaggaaucaagaugagcuuguagguagagcacgaguuucccaaggggcaggauggucgcuacgagaaacagcaugucugggaaaaucguaugcucagauguggcaacugauguauuuccauaggagagaucuacgauuagccgcuaaugccauuuguucggcgguaccaguagacuggguaccaacaaguagaacaacauggagcauacacgcccaucaucaguggaugaccacagaagauaugcuaaguguauggaauagaguauggauagaagaaaacccauggauggaggauaaaacccacguuaguaguuggggagaugucccuuacuugggcaagagagaagaucaaugguguggcucgcucauuggucuaacugcacgagcuacaugggcuucaaacauacaaguagcuauaaaucaagugaggagacuuaucgggaacgaaaauuaccuagauuacaugacgaguaugaaaagauuuaagaaugaaggagacccagaaggggcacugugguag

SEQ ID NO: 21641 - RNA, 9879 nt, Artificial Sequence
  derived and/or modified CDS sequence (opt6) from DENV-1__FJ898375__SS-prME
ucgguaacaaugcuuuuaauguugaugccgacagcauuggcauuucaccuuacuacucguggaggugaaccgcauaugauaguuagcaaacaagaaagaggaaaaucuuugcuuuuuaaaacuucugcugguguaaauaugugcacauuaauugcaauggaucuuggugaauuuugugaagacacaaugacauacaaauguccaagaauuacugaagcagaaccugaugacguagauugcugguguaaugccacugauaccugggugacauacggaaccugcucgcaaacgggggaacaccgaagggauaaacgaagcguagcucuugccccucauguuggccuaggacuugaaacacguaccgaaacauggaugucuagugaaggagcguggaaacaaauucaacgcguagaaacgugggcacugagacacccuggauuuacuguuauggccuuguuccuagcucaugccauagguacuucgauuacacaaaaaggaauuauauuuauuuuacuaauguuaguaacuccaucuauggccaugaggugugugggcauagguucccgagacuuuguggagggccuaaguggagcaacauggguggauguugugcuugagcauggauccugugugaccacaauggcaaaagacaaaccaacuuuggacauagagcuauugaaaacagagguaacuaauccugccguguuacgaaaacucuguauugaagcgaaaauuucaaauacuacuacggacucucgauguccaacccagggggaggccacuuuagucgaagaacaagacgcuaauuuuguaugcagacgaacuuucguugauagagguuggggcaauggaugcgguuuauucgggaaaggcagcuuaauuacuugugcaaaauuuaaauguguuacgaaacuagaagggaaaaccguacaauaugaaaauuuaaaauacagcgucauaguuacgguucauacaggcgaccaacaccaagugggaaacgaaagcacggaacauggaacaacagcgaccaucacuccccaagcaccaagcacagaaauucaauugacggacuacggagcuuuaacauuagauugcaguccaagaacugguuuagacuucaacgaaaugguucuacucacuaugaaagagaaaagcugguugguacauaaacaaugguucuuggaucuaccgcugccguggacaucaggagcgagcaccagucaggaaacguggaaccggaaagaucucuuagugacguucaagacagcucacgccaaaaagcaggagguuguuguacuugguucccaagaaggagccaugcauaccgcauuaacaggagcgacagaaauucagaccucaggaacaacaacuauauuugcaggccauuuaaagugcaggcugaaaauggauaaacuaacacuaaaagguaugucauaugucauguguaccgggucauuuaaacuagagaaggagguagcugaaacucaacaugguacagucuuaguacagauaaaguaugaaggcaccgaugcaccgugcaaaaucccauucucuacgcaggacgaaaaaggcguuacucaaaaugguagauugauuacagcuaauccaauaguaacggacaaagaaaaaccagugaauauagaagcagagccacccuuuggagaaaguuacauagucauuggcgcuggggaaaaggccuuaaaacuuucgugguucaagaaagguucuagcaucggaaagauguucgaagcaacagcccgaggugcaaggagaauggcaauacugggagauaccgccugggauuuuggcucuauaggcggaguguuuacauccgucgguaaguuggugcaucaaauauucggcacagccuaugggguucuauuuagcgguguaaguuggaccaugaaaauugggauagguguacuguugacguggcuaggacuuaauagccgcucaacuagccuuucaaugacgugcauagcagugggacuuguaacacuuuaccuuggaguaaugguucaagcggacucgggaugcguuauuaacuggaagggcagggaguugaagugugguagcgggauauuuguaacaaaugaaguacacacauggacagaacaauauaaauuucaagcagacucaccuaaaagacuauccgcugcgauaggaaaggcuugggaggaaggcguuugcgggauucguagugcuaccagacucgaaaauaucauguggaaacagaucagcaacgaacucaaucacauauuauuagagaacgacaugaaauucacaguagucgucggggauguagcugguauuuuagcucaagguaaaaagaugauuagaccucaacccauggaauauaaauauaguuggaaaucauggggaaaagcaaagauaaucggagcagauguacaaaacaccacauucauaauagauggaccaaacacaccagaaugccccgacgaucaacgagcuuggaauaucugggaaguggaagauuacgguuuugguauauucacaacaaauauuuggcucaagcucagagauucauacacucaagucugcgaucaccgauuaauguccgcagcaaucaaagacucuaaagcuguccaugcagacauggguuauuggauugaaagcgagaaaaaugaaaccuggaaauuggcacgugcaucuuucauugaagucaaaacaugcauuuggccaaagucccauacucuauggagcaauggaguauuggaguccgaaaugauuaucccuaaaauauaugguggucccauuucucagcacaauuaccgaccgggauacuucacccaaacagcugguccauggcauuugggaaaacuugaacucgauuuugauuuaugugaagguacaacgguuguaguagaugagcacugcgguaaucggggaccaucguugcggacaaccacaguuacagggaaaauuauacaugaauggugcugccgaaguuguacgcuaccuccccuaagauucaaaggagaagauggcuguugguacggaauggaaauaaggccaguuaaagaaaaggaagaaaacuugguaaaaaguaugguaucggcagggucaggugaagucgacucauuuaguuugggauuguugugcauaucgauuaugauugaggaaguaaugcgaucccgguggagucggaaaaugcuaaugaccggaacguuagcaguauucuucuuacucauuauggggcagcuaacauggaacgaucuuauucgacucugcauuauggucggcgcuaaugccucagaccggaugggaaugggaacgacauauuuagcacuaauggccacguuuaagaugcgcccgauguuugccguagguuuauuguucaggcgacucacuucgagggaagucuuacuacuaacuaucggauugucguuaguugcauccgucgaauuaccaaacagccucgaggaacuaggggauggguuagcgaugggaaucaugaucuuaaaacugcuuacugauuuucaaucacaccaauuaugggccacacuucuuuccuuaacuuucauuaagacaacauucucuuugcacuaugcguggaaaacuauggcuaugguauuauccauaguuucgcucuuuccccuauguuuaaguacaacgucucagaagacgacgugguugccugugcuacuuggauccuugggguguaaaccucucacaauguucuuaauugcugagaacaaaauauggggaaggaaaaguuggccacuuaaugagggaauaauggcagugggcauaguaucaauacuacuuagcucauuauugaaaaacgauguaccccuagcggggcccuuaauagccggcgguauguugauugcaugcuacgucaucucggguaguucugcugaccugagucuagaaaaagcggcugaagugaguugggaggaagaagcagagcacaguggagcgagucauaauauacuuguagagguacaagaugauggcacuaugaagauaaaagaugaagagagagaugauacgcuaacaauuuuauuaaaagcaacccuauuagcggucucgggaguuuauccacuauccauuccugccacauuauuuguuugguauuuuuggcaaaagaagaagcaaagaagcgggguccuuugggacaccccuagcccuccugaaguggaaagagcaguccuugacgacggaauuuaccgaaucaugcaacgggggcuacuggggaggucacagguaggaguaggcguuuuucaggaaaauguuuuucacaccauguggcaugugacgagaggggcgguccuuauguaucaagguaaaagauuagaaccgucaugggcaucugucaagaaagauuuaauuucguauggaggcggauggaggcugcaaggaagcuggaauacuggagaggagguccaggugauugcaguagaaccuggcaaaaauccgaaaaauguccagacagcuccugguacuuucaaaacaagcgaaggagaagucggcgccauagcacucgauuuuaaaccuggcacaucaggaucaccaauuguuaaucgagaaggaaaaauagucgguuuguacggaaacggaguuguaaccaccuccgggacauacguaagcgcuaucgcucaggcuaaagcaucacaagaaggcccauuaccugagauagaggaugaagucuucagaaagagaaaucuaaccauaauggaccuacaccccggcagcggaaaaaccagaagauauuuaccggccauagucagagaagccauuaaaaggaaacuacggacauuaauacuugcaccaacuagaguaguagcaucagaaauggcagaggcacuaaaaggaaugccuauacgauaucaaaccacagcggugaagucagaacacacuggcaaagaaaucgucgauuugaugugucaugcaacauucacaaugagauuauugagcccugucagaguuccaaacuacaauaugauuauuauggaugaggcucacuuuaccgaucccaguagcauugccgcuagaggguauaucaguaccagaguagggaugggagaagcagccgcuauuuucaugacugcaacucccccaggaucuguagaagcguuuccacaaaguaaugcugugauacaggaugaggagcgugacauuccggaaagaucauggaacuccgguuaugaguggauuacagacuuccccggaaaaacgguaugguuugugcccucgaucaaaagcggcaaugacauugcuaauuguuuaaggaaaaacggaaaaagagugauccaguuaucucggaagacuuuugacaccgaauaccagaaaacgaaaaauaaugauugggacuaugucgucacgacagacauuucugagaugggagcaaacuuccgagcagauagagucauagacccgagaagguguuuaaaaccugugauuuugaaagaugguccggagcgaguuaucuuggcagguccgaugcccgucacaguggcuagcgccgcgcaaaggagaggaagaauagggcgaaaccacaacaaggaaggcgaucaauauauauauaugggucaaccucugaacaaugacgaagaccacgcacauuggacugaagcaaaaaugcuauuggauaauauaaauaccccagaaggaauaauaccagcauuguucgaaccugagcgagaaaaauccgcugcaauagacggagaguacagauuaagaggagaggcaagaaaaaccuuuguggaauuaaugagaagaggcgaccuaccaguauggcuaucacacaagguugccucugaaggcuuccaauauucugauagaagaugguguuuugauggcgagcguaauaaucaaguuuuagaagagaauauggaugucgaaauauggacgaaggagggcgaaagaaagaaacuccgaccaagaugguuagaugcaagaacuuacuccgauccgcuugcucuuagagaauuuaaggaauuugcagcaggccguagauccgugucgggggauuugauauuagaaauagggaaguuaccucagcaccuaacucagcgagcacaaaaugcgcuagauaaccuaguuauguuacacaacucagaacaaggagggagagcuuauaggcaugcaauggaggaacugccagacaccauugaaacgcugaugcuacuagcccuaauugcaguauugacaggcggcguaaccuuauucuuucuaagugggaggggauuagggaagaccucaauaggacuauuaugcguuauggcuucaucaguacuccuauggauggcaucaguagaaccgcauuggauagcggcaucaauaauuuuagaguucuuucuuaugguauuguuaauaccugaaccagacagacaaagaacaccacaagauaaccaguuagcuuacguuguuauuggacuuuuauucaugauacuuacuguugcagccaacgaaaugggauugcuggaaacaacgaagaaagauuuaggcauagggcacgucgcaguggaaaaacaucaucacgcagcgaugcuggacguagaccuacauccggcaucugccuggacucuguaugcggucgcaacuacaauaauuacuccgaugaugagacauacaauagaaaauacuacggcaaacauaucacuuacugcaauugcaaaccaggccgcuaucuugauggguuuggacaaagguuggccuauaucuaagauggacaucggaguaccacuuuuagcucugggauguuacagucaagucaacccauugacccuaacagcagcaguuuuaaugcuaguggcgcacuaugcgauuaucggaccuggucuccaagcuaaagcaacgagagaagcgcaaaaacgaaccgcagcugguauaaugaagaauccgacuguugauggaaucguugcuauugaucuagaucccgucguuuacgacgccaaauuugaaaaacagcuuggacaaauaauguuacuaaucuuauguacaagccaaauacuguuaaugcgaacuacaugggcauuaugcgagaguauaacauuagcaacgggaccacuaacgacauuaugggagggcuccccggggaaauuuuggaauaccacaaucgcuguaucaauggcaaauauuuuucguggcagcuacuuagccggagcaggauuagcauuuagccuaaugaagagucuuggcgguggaagacgcggcacaggagcucaaggagaaacauuaggcgaaaaguggaaacgacagcuuaaucagcuuucaaaaucagaguucaauaccuacaaaagaucuggaauaauggaaguagaucgcucggaggcaaaggaaggucuaaaaagaggugaaacuacuaagcacgcugucagcagagggacagcaaaauugagaugguuuguugaaagaaacuuaguuaaacccgaggguaaagucauagaucucgguuguggucgaggcgggugguccuauuauugcgcuggccucaagaaaguuacagaaguaaaagguuauaccaaaggugguccuggucacgaagaaccaauacccauggcaaccuacggauggaauuuaguaaaauugcauagcggaaaagacgucuucuucauaccaccggagaaaugcgauacguuacuaugugauauaggagagucuaguccuaacccuacuauagaagaaggucguaccuuacguguauuaaagaugguagaacccuggcuaagaggaaaucaauucugcauaaaaauacugaauccguauaugccaagugugguagaaacccuugagcagaugcaaaggaaacaugggggaaugcucguuagaaacccauuaucucgaaauagcacccaugaaauguacuggguuaguuguggaacaggaaauauagugucagccguuaacaugacaucgagaaugcuauuaaauagauucaccauggcacacagaaaaccaacauacgaacgagacguugauuuaggggccgggacacgucacguugcggucgaaccggaaguggcaaaucucgauauuauaggacaacgaauagaaaacauaaaacaugagcacaaauccacauggcacuaugaugaagacaaucccuauaagaccugggccuaccauggguccuaugaaguaaagcccagcggaagugcuagcaguaugguuaacgguguuguaaaauuacuaacaaaaccgugggacguuauaccaaugguaacgcaaauugcuaugaccgauacgacgccauuuggacagcaaagagucuucaaagagaaagucgauacuagaacgccaaaagcgaagagaggaacagcucagauaauggagguuacggcuaaaugguuauggggauucuuaucgagaaacaagaaaccacgaauauguaccagagaagaguucacaagaaaaguaaggaguaaugcugcaauaggcgccguguucguagacgaaaaucaauggaacagugcuaaggaagcgguagaagaugaacgguuuugggacuuaguccauagagaaagggaacuacacaagcaaggaaaaugcgcaacuugcgucuacaacaugaugggaaaacgagagaagaaacuaggggaauuugggaaagccaaagggaguagagcaauaugguauaugugguuaggagccagguuuuuagaauuugaagcccucggauuuaugaacgaagaccacugguuuaguagagaaaauucauuaagcggaguagaaggagaagguuugcacaagcucgguuauauucuacgagauauaucgaaaauuccggguggaaauauguacgccgaugauacagccggcugggacaccagaauaacggaagaugaccugcaaaaugaggcuaaaauuacugauauuauggaaccagaacaugcucuacuggccaaaaguauauuuaaacuaacguaucagaauaaggugguacgaguacaaagaccagccaaaaaugguacuguaauggauguaauaagcagacgagaucaaaggggaucuggccaaguaggcaccuauggauuaaauacauucaccaauauggaggcacaauugauaagacagauggaaucugaagguauuuucucccccucggagcuugaaaccccaaaccuggccggaagggugcuugauuggcuagaaaaacauggcguugaacggcuuaaacgaauggcuauuaguggggaugauugugugguaaaaccuauagaugaucgauuugccacagcacugacugcauugaaugacauggggaaaguuagaaaagauauuccccagugggaaccuucuaaagguuggaacgauuggcaacagguuccuuuuugcagucaucacuuccaucaacuaaucaugaaggauggacgagaaauuguaguaccuugccggaaucaagacgaauuaguaggacgagcgcgcguaucucaaggagcgggcuggaguuuacgcgaaaccgccugcuuagguaaauccuaugcucaaauguggcaacugauguauuuucauaggagagacuugagauuagcagcuaaugcaauuuguucggcaguuccaguagacuggguaccaaccucuagaacuacguggagcauucaugcacaucaccaauggaugaccacagaagauauguuauccgucuggaauaggguauggauugaagaaaacccuuggauggaagacaaaacacacauuucaucauggggcgauguacccuaucuagggaagcgugaagaucaauggugcggaagccuuaucggacuuacugcacgcgcaacgugggcaacuaauauccaggucgcaauaaaucaagugagacgccuuauuggaaaugagaauuacuuagacuacaugacguccaugaagagauuuaaaaaugaaucugauccagaaggagcccuaugguaa

SEQ ID NO: 21642 - RNA, 9879 nt, Artificial Sequence
  derived and/or modified CDS sequence (opt6) from DENV-1__FJ898376__SS-prME
agcgucacgaugcugcuaaugcucaugcccacugcguuggcuuuucaccucacaaccagaggaggugaaccucauaugaucguaacgaagcaagaaagagggaagaguuuauuguucaaaacgagugcaggaguuaauaugugcacauugauagcaauggaucuuggagaacuuugugaagacaccaugacguacaaauguccacgcauuacagaagcugaacccgacgacgucgauugcuggugcaaugcaacagacacauggguaacuuacgguacaugcucccagacaggugaacauagaagagacaaaaggagugucgcacuugcuccccaugugggguuaggauuagaaacuagaaccgaaacauggauguccagcgaaggagcauggaaacaaauucaacgagucgaaacaugggcauugcgacaccccgguuuuaccguaaucgcacuguucuuagcccauguaaucggcacgagcauaacacaaaaagggauuauauuuauauuguuaauguuaguaacuccuagcauggcgaugagaugugucggaauugguucuagagauuuuguagaaggguuaagcggugcuaccuggguagauguuguuuuagaacauggaucgugcguuacgacaauggcgaaagauaaaccaacauuagacauagaacuacugaagacugaagugacaaacccagcugugcuacgaaagcugugcauugaagcuaaaauaagcaacacaaccacugauuccagauguccgacacaaggagaagccacacuaauggaagaacaagacgcaaacuuugucugcagaaggacauuuguugauaggggauggggaaacgguugcggguuauuuggcaagggcaguuuaauaacuugugcaaaauuuaaaugugucaccaaauuagaagggaagauuguucaauaugaaaaccuaaaauauagcguaauagugacggugcauacuggugaccaacaccaaguagggaaugagucaacagaacauggaacuacagcuaccauuacaccucaggcccccacaucagaaauccaguugacugacuauggugcgcuuacuuuagauuguucaccacguacaggucuagacuucaacgagauggugcuauugacaaugaaagagaaaucauggcuaguucauaaacaaugguuucucgacuugccgcuaccguggacgaguggcgcaaguacuucucaagaaacauggaauagacaagacuuacuugugacauucaaaacagcacaugccaagaaacaagaagucguugucuuaggcucccaggaaggagcuaugcacaccgcucuuacuggggccacagaaauccagacaaguggcaccacuaccauauucgcuggucaucuaaaaugcagacuaaaaauggauaaauuaacccucaaaggcaugucauauguaauguguacuggaucuuuuaaacuugagaaagaaguggcagagacacagcauggaacaguccucguacaaauaaaauacgaaggcaccgacgccccauguaaaauuccauuuagcacacaagacgaaaaaggugucacacaaaaugggaggcuaaucacagccaacccaauaguaacugacaaagaaaagccagugaauauagaggcagagccaccauuuggggagucguauauagugaucggagcuggcgagaaggcauuaaagcuaucaugguuuaaaaaggguucuaguauaggaaagauguucgaagccacugcgcguggugcccgcaggauggcgauauuaggugauacugccugggauuuuggaucaauaggaggcguauuuaccagcguggggaaacuuguucaccaaauauucggaacagcauacgggguacuauucuccggcguaagcuggacgaugaaaauuggaauagguguccuauuaaccugguuaggacuaaacucaagauccacgucgcuuucaaugacauguauugcuguugguuuaguuacauuauaccuuggaguaaugguacaagcagacucugguuguguaaucaacuggaaggguagagaauugaaaugcggaaguggaauauucguaacuaacgaaguacacacuuggacagaacaauauaaauuccaggccgacucgccgaaaagacuaucugcagcuauaggaaaagcgugggaagaaggagucugcggaauacgcucagcgacaaggcucgagaauauaauguggaaacaaauaucgaaugaauuaaaccauauauuacuagagaacgacaugaaauuuacaguugugguaggggacguuguaggcauucuugcccagggaaagaagaugauaagaccucaaccgauggaacauaaguauaguuggaaaucauggggaaaagcaaaaauaauuggugcugacguacaaaauacaacuuuuauuaucgaugggccaaacacaccugaguguccggaugaccaaagggccuggaacauaugggaagucgaagacuaugguuuuggcauuuuuacaaccaacauaugguuaaaacugcgugacagccacacgcagguaugugaccaccgauuaauguccgcggccauaaaagacaguaaagcgguacaugcagacaugggguauuggauugaaagcgagaagaaugagaccuggaagcuggcuagagcaucuuuuauugaaguaaaaacuugcaucuggccaaaaucacauaccuuauggagcaaugggguucuagaaucugaaaugauaaucccaaagauuuauggggguccgauaagucaacacaauuauagaccgggcuauuuuacgcaaacugcagggccuuggcauuuagggaaauuagaacuggacuuugacuugugcgaaggcaccacaguuguaguggaugaacauuguggaaacagaggccccagccuaagaaccacuacaguuacgggcaagauaauccacgagugguguuguagaagcuguacacuuccacccuugcguuuuaaaggugaggauggguguugguacggaauggaaauaagaccuguuaaagaaaaagaagagaaucucguaaaaaguaugguaucugccggguccggcgagguagauucauucagucuuggauuauuaugcauuucaauaaugauugaggaaguaaugagaucacgauggucacgaaagauguuaaugacuggaacauuagcaguuuuucuauuauugauaauggggcaauuaacuuggaaugaucuuauucgcuuauguauuaugguuggagcuaaugccagugaccggaugggaauggggacuacguacuuggcucuaauggcgaccuucaaaaugagaccaauguuugcaguaggcuuacuuuuuagaaggcucacuucacgugaaguucuauugcucaccauagguuuaucauugguagcaagugucgaguugccaaauagccuggaagaauugggagauggauuagcuauggguauaaugauuuuaaaacuacucacagacuuccaaucacaccagcucugggcuacccuacuuagcuuaacauucauaaaaacuacuuuaaguuugcauuaugccuggaaaacuauggcgaugguacuaagcauuguaagucuuuuuccuuuauguuugucaacaacaagucaaaagacuacauggcucccaguacugcugggcucauugggauguaaaccacuggcaauguuuuuaaucgcugaaaauaaaauaugggguagaaagaguuggcccuuaaaugaagguauaauggcagugggaguaguuagcaucuuacuaaguagccuauuaaagaaugacgugccgcuagcugggccgcuaauagcagggggcaugcuaauagcuuguuacgugauuucgggaucaucagccgaucucucgcuugagaaagcagccgagguuaguugggaagaagaagcagaacauucuggcgcuucacauaauauucuaguagaaguccaagacgauggaacaaugaaaaucaaggaugaagaaagggaugauacauuaacuauucuauuaaaagccacguuguuagcagucucagguguguaucccuuaagcauuccugcaacacuuuucguuugguauuuuuggcagaaaaagaaacaacgaucgggaguuuuaugggauacgccuaguccaccagaaguagaaagagcaguguuagacgaugguauuuacagaauaaugcagagagguuuacuuggacgaagccaaguuggcguagguguauuucaagaaaacguuuuucacacaauguggcaugugacacgaggagcaguacuaauguaucagggaaaaaggcuagaaccuaguugggcaagcguaaagaaagauuugauuaguuauggugggggcuggagguugcaggggucauggaacacaggagaggagguucagguaauagcgguugaaccuggcaaaaaucccaaaaauguccaaacggcuccagguacguucaaaaccccggaaggcgagguaggggcaauugcacucgauuucaaaccagggacgucaggcucaccgauagucaaucgagaagggaaaauuguaggcuuauauggaaacgguguuguaacaacauccggaaccuaugucagugcaauugcacaagcuaaagcuagccaggagggucccuuaccagaaauugaggaugaaguuuuucguaaaaggaaucuuacaauaauggaccuacacccaggauccgggaaaacuaggcgauacuugcccgcaauuguacgagaagcgauuaaaagaaaacuacgcacauuaauucuugcacccacacgugucguagcuucagaaauggcugaagcucucaaaggcaugccaauuagauaucagacuacugcaguaaaaagugaacacacugguaaagagaucguagacuuaaugugucaugccacauucacaaugagacugcugucacccguuagaguuccaaauuacaauaugaucauuauggacgaggcacauuuuacagaccccaguagcauagccgcgagaggauauauaucaacacgugucggaaugggagaagcagcagcaauauuuaugacagcuacuccaccugguucuguugaggcuuuuccacaguccaaugcagucauacaagaugaggaaagggacauuccugaacgaucuuggaauaguggcuacgaauggauuacagauuuucccgguaagacgguuugguuuguaccuuccaucaaaucaggcaaugauaucgcuaacugccuucgcaaaaaugguaaaagaguuauucagcugucuaggaaaacuuuugauacugaauaucaaaagacaaagaauaaugacugggacuacguaguaacuaccgacauuucagaaaugggggcuaacuuccgugcggaccgaguaauugauccgcgacgaugccuuaaaccggucaucuugaaagacggaccagaacgaguaaucuuagcgggaccaaugccuguuacaguugcaagcgcagcccaaaggagaggaagaauaggaagaaaucauaauaaggaaggagaccaauacauuuauaugggacaaccucuuaauaaugacgaagaucaugcccauuggacugaagcaaaaauguuauuagauaauauuaacaccccggaagguauaauaccagcacuauucgaacccgaacgugagaaaagugcagcuauagauggagaauaucgauuacgcggagaagcacgcaaaacauuuguagaacuuaugcgucgaggggacuuaccaguuuggcuaucauauaagguagccuccgaagguuuccaauacucugauagaagguggugcuucgacggagagagaaacaaucaaguucuggaagagaauauggacguugaaauauggacaaaagagggagaaaggaagaaacuccgcccgcgcuggcucgaugcucgaacauauagugauccuuuagcauuacgcgaguuuaaagaauuugcagcagguagaagaucgguaaguggggauuuaauacucgagauagggaaauugccucagcaucuuacgcaacgugcgcaaaacgcccuggacaauuuaguaauguugcacaauucagaacagggagggcgugcauaccgacacgcaauggaagaauuaccagauaccauagaaacccuaaugcuguuggcacuaaucgcggucuuaacaggcggggugacguuauucuuuuuaucaggucgagguuuggggaaaacaaguauaggauuauuaugcguaauggcgucuucaguuuuacucuggauggcaucuguagagccucacuggauugcagcaucuauaauacuugaauuuuuccuuaugguucuuuugauuccggagccugacagacaaaggaccccgcaggacaaucaauuggcuuaugugguuaucggauuacuuuucaugauacuuacgguagcugcgaacgagauggguuugcucgagaccacgaagaaagaccuagggaucggacacguggcaguugagaaccaucaucacgcuacaaugcuagacguugacuuacauccagcuagcgcauggacauuguacgccguugccacuacaauaauaacaccaaugaugcgccacacaauugaaaauacuacggccaauaucucuuuaacugcaauugccaaucaagcagccauccucaugggauuagauaaaggcuggccaauuagcaaaauggacauaggaguaccguuguuagcucuuggguguuauagucaaguaaauccguugacguuaacagcagcaguccugaugcucguagcucacuacgcaauuauaggcccaggguuacaagcgaaagcgacuagggaggcgcagaaacggacugcagccggcauaaugaaaaauccaaccguagaugguauaguugcaauagacuuagauccaguuguauaugacgcaaaauuugaaaaacaauuaggacaaauaaugcuccugauacuauguacuucacaaauauuauugaugagaaccacgugggcauuaugugagagcauaacacuagcuacagguccucuaaccacuuuaugggaaggaaguccuggaaaguucuggaauacaacgauagcggugucaauggcuaacaucuuuagggguucauauuuggcuggagcaggcuuagcauuuucacuuaugaaaucacuugguggggguagaagagguacuggagcucaaggggaaacccuaggcgagaaauggaagcgccaauugaaucaauuaagcaaaucggaguucaacaucuauaaaagaucaggaauuauggaaguugauagauccgaagcuaaagaaggucuuaaaaggggagaaacuacgagacacgcaguaagcagggguacagcuaaacuuaggugguuugucgagagaaacuugguaaaacccgaagggaaaguaauagaucucggaugcgggagggguggguggucuuauuacugugcugggcuaaagaaaguaacagaaguaaagggauacacaaaagggggacccggucaugaggaaccaauaccgauggccacuuacgguuggaauuuaguaaaguugcauuccggaaaagauguuuucuuuacuccaccggagaaaugcgauacacuacuuugcgauauuggagaaucaagcccuaauccaacaauagaagaagguagaacacuacgugugcuaaaaaugguggaacccugguuaagggguaaccaauuuuguauuaagauucuaaauccauacaugccaagcgugguugagaccuuggagcaaaugcagcgaaagcauggugguaugcuggugagaaacccucucaguagaaauagcacucaugagauguauuggguuagcugugguacuggaaauauuguuucugcugugaauaugacgucucguaugcuucuaaauagguucacaauggcacauagaaaaccaacuuaugagagagacguggaccugggagccggaacacggcauguagccguagaaccugaaguagcaaaccuagacauaauuggacaaagaauagaaaauaucaagcaugaacacaagagcacguggcauuaugaugaagauaauccuuauaaaacuugggcuuaucaugguucuuaugaaguuaagccuaguggauccgcuucgaguauggucaaugguguagucaagcucuuaacaaaaccaugggacgugauaccaaugguaacucaaauagcaaugacugauacuacacccuucggccaacaaagaguguuuaaagaaaaaguagauacacguacuccgaaagcgaaacgaggaacugcucagauaauggaagucacugcucguuggcuguggggauucuuaucuagaaauaaaaagccaaggauuuguacccgggaagaguucacgaggaaagucagaucuaacgcggccauuggagcaguuuuuguagaugagaaucaguggaacagugcaaaagaagcgguugaagacgaaagauuuugggacuugguacagaaggaaagagaacuacacaaacaaggaaaaugcgcuacuuguguauauaauaugaugggaaaaagagagaagaaacuaggggaguucggaaaggcuaaagguaguagagcaaucugguauaugugguuaggcgcgcguuucuuagaauuugaggcuuuaggguuuaugaacgaagaccauugguuuucgcgcgaaaauucauugagugguguugaaggagagggacuacauaaauugggauauauacucagagacauaaguaagauaccaggugguaauauguaugcugacgacacagcggggugggacaccagaauaaccgaggaugaccugcaaaaugaagcaaaaauuacagacaucauggagccagaacacgcccuacuagcaacaagcauauuuaagcuaacguaucaaaauaaggucguaagaguacagcgaccugccaaaaauggaacugugauggacguuauaucgagaagagaucaaagaggaagcggucaaguaggcacguacggccuaaauacauuuaccaauauggaagcacaacucauucgacagauggaaucagaaggaaucuuccugccuuccgaacucgaaacucaaaaucucgcggaacgaguuuuggauuggcuagaaaaguacgguguugaacgucuaaaaagaauggcuauaucuggggaugacugcguaguaaagccuauugacgauagauucgccacggcucuaaccgcgcuuaacgauauggggaaaguacggaaagauauaccccaaugggaaccaucaaaagguuggaacgauuggcaacaaguucccuuuuguucccaccauuuucaucaacugaucaugaaagaugguagagagauaguaguucccugccggaaucaggacgagcucguagggagggcaagaguuucacaaggggcagguuggucacugagagaaacagcgugucuugggaaaagcuacgcgcaaauguggcaacuaauguauuuccacaggcgggacuugcgccuggcggcgaaugccaauuguuccgcugugccaguugauugggucccaacaaguagaacuacauggucaauacaugcccaucaccaauggaugacaaccgaagacaugcucuccguguggaauagagucuggaucgaagaaaacccauggauggaagauaagacucaugugucaucauggggagauguuccguaccuugguaaacgagaggaccaaugguguggaucccugauuggcuugacagcacgagcaacaugggcuucaaauauacaaguggcuaucaaucaaguaagacggcuaauaggaaacgaaaacuacuuagauuauaugacuucgaugaaaagauuuaagaaugagggagacccugaaggagccuuaugguaa

SEQ ID NO: 21643 - RNA, 9879 nt, Artificial Sequence
  derived and/or modified CDS sequence (opt6) from DENV-1__FJ898379__SS-prME
ucuguuacuauguuguuaaugcuaaugccuacagcauuagcauuucacuugacaacacgugguggagaaccccauaugauaguuucaaaacaggagagggggaaaagccugcuguuuaaaacuucagcuggaguuaauaugugcacacucaucgccauggauuuaggugaauuaugugaagacacuaugacauauaaauguccgagaauaacagaaacugaaccugacgaugucgauugcuggugcaacgcaacagauacauggguaacuuaugguacuuguagucagacgggagaacacagaagagacaaaagaaguguagcucucgcuccacacguaggacucgguuuagagacaagaacagaaacuuggauguccagcgagggugcguggaaacaaauacaaagagucgaaacuugggcuuuaagacacccuggguuuacaguaauagcuuuguuuuuagcacauguaauaggaacgucgaucacucaaaagggaauuauauucauacuacuuaugcugguaacccccuccauggcaaugaggugugucgggauaggaucaagagacuuugucgaaggacuuaguggggcaacauggguagacguuguccuagaacauggcucaugcguaacuacaauggccaaagauaaacccacgcucgacauagaacuucuaaaaaccgaaguaacuaacccagccguacuucguaaacucuguauagaggcaaaaaucuccaacacaacgacugauucaagguguccgacgcagggugaagcuaccuuaguugaggaacaagaugcuaacuuugugugcagacggacauuuguggaccgcggcuggggaaauggcuguggacuauucgguaaagggucauugaucacaugugcuaaauucaagugcgucacuaaacuugaaggaaaaauaguacaauaugaaaacuuaaaauauagugucaucgucacuguacacacuggugaucaacaccaaguggguaacgaaaguacagaacacggcacaaccgcuacuaucacaccccaagcuccuacaaccgaaauacaauuaaccgacuauggugcacucacacucgauuguagcccaagaacagguuuagacuuuaacgagauggucuuauuaacaaugaaagaaaagucuuggcuaguccacaaacaaugguuucuugauuuaccccuaccauggaccaguggugccagcacuagccaggaaaccuggaaucggcaagaucugcuagugacuuucaaaacagcccacgccaagaaacaagaagugguaguauuaggcucucaagagggugcaaugcauacagcucuaacaggggccacugagauacaaacaucaggcaccacaacaauauucgcaggacacuuaaaauguagauugaaaauggacaaauuaacuuuaaaaggaaugaguuauguaaugugcacugggucuuuuaaauuagagaaggaaguugcagaaacacagcauggcacaguacugguucaaauaaaauacgaaggaaccgaugcaccguguaaaauucccuucucaacucaagacgaaaaagggguaacccaaaauggaaggcuaauaacugcuaauccgauaguaacagauaaagaaaaaccuguaaauaucgaagcagaaccgccauuuggagaaaguuauauuauuaucggugcaggagaaaaagcauugaaacucaguugguucaagaaaggcaguuccauuggaaagauguuugaagcuacagcaagaggagcaaggagaauggcaauauuaggggacaccgcaugggauuucggcucaauuggcgguguguuuacaaguguugggaaacuuguacaccaaauuuuugguaccgcauauggcguacuauuuuccggaguuucauggaccaugaaaauagggaucgguguacucuuaacauggcuuggucuaaauucccggucuacgucucugaguaugacaugcauagcaguaggcuugguuaccuuauaucuaggaguuaugguccaggcugauucagguugugucauuaauuggaaggggagggaacuaaaauguggaucggguaucuucguaacgaaugagguccacaccuggacugaacaauauaaauuucaagccgacucaccuaaacgccucucagcugcuauaggcaaagcaugggaggagggagugugcggcauacguucagccacacgguuagaaaauauaauguggaagcagauaucaaaugaguuaaaccauauuuuauuagagaaugacaugaaauucacaguagugguuggggacguugcgggaauacuugcgcaggguaagaaaaugauaagaccccaaccgauggaauauaaauauuccuggaaaaguuggggaaaagcgaaaauaauaggagcagacgugcaaaacacaacauucaucauugauggaccuaacaccccagaauguccagacgaucagcgggcguggaacauaugggaaguugaagacuacggcuuuggaauauucacuaccaauauauggcuuaaauuacgugauagcuauacacaagugugugaccaucgcuuaaugucugcggcgaucaaggauucaaaagcaguacaugcggauaugggguacuggauugagucugagaaaaaugaaacauggaaauuagcucgugcuaguuucauagaagucaaaacguguauuuggccgaaaagccacacgcuauggucuaaugguguuuuagaaucugaaaugauuauaccuaaaauauauggagguccaauaucacaacauaacuaucgaccaggauauuucacgcaaaccgcuggccccuggcaccuggguaaguuagaacuugauuuugaucuuugugaggggacaacagugguaguagacgaacacuguggaaauaggggcccaucucuucgaacaacuacggucacuggaaaaauuauacacgaaugguguugcagaaguugcacauuacccccgcuuagguuuaggggcgaagauggaugcugguacgggauggagauuagaccaguaaaggaaaaagaagaaaaccuggucaaaucaaugguaagugcggguucgggagaaguagauagcuucucacugggguuacuuuguaucaguaucaugauagaggaaguuaugaggucgagauggagccgaaaaaugcucaugacugguacacuagcaguauucuuucugcucauaaugggacaauuaacauggaaugauuuaauccgacuuugcauuaugguaggggcaaaugcgucagaucgaaugggaaugggaacgacauaucucgcccucauggcuacuuuuaaaaugaggccgauguuugcagucggacuguuauuuaggagauugaccucgagagaaguacugcucuuaacaauaggucuaucccugguagccucaguggaacugccaaauucauuagaagaauuaggagaugguuuagcaauggguauaaugauucuaaaguuauugacagacuuucaaucacaccaguugugggcaacguuacuuuccuuaaccuuuauuaaaacaacauuuucccuacacuacgcauggaagacuauggcgaugguacuaucaauuguaucguuauuuccauuauguuuaucaacaacgagucagaaaacgaccugguuaccagugcuccuagggucacuaggcuguaaaccgcuuacuauguuucucauugcagaaaauaaaauuugggguagacgcagcuggccacuuaaugaagguauaauggcuguagggauagugucuauauuacuaagcucacuauuaaagaacgacguuccccuagcgggcccacucauagcuggagguauguuaauugcauguuacgugauuuccggaucuucagcagacuugucacuagagaaagcggcagaaguaucaugggaagaagaagccgagcauaguggagcaucgcauaacaucuuagucgaaguacaagacgaugguacaaugaaaauaaaagacgaagaacgugaugauacacuaacgauccucuugaaagcaacuuuauuagcaguaucugggguauauccauuaucuauccccgcgacacucuuuguaugguauuuuuggcagaagaagaaacaaagaucagguguucuaugggauacaccuucuccaccggagguagaacgagcugugcuagacgaugguauuuaucguauaaugcagagaggauuacuggggcguagucaagucggagucggaguauuccaagagaauguauuccauacaauguggcauguaacaaggggagcaguucuaauguaucaggggaaaagauuagagccguccugggcuaguguuaaaaaggacuuaauuucauacgguggagguuggcgauugcaagggagcuggaauacgggugaggaaguacaaguaaucgcaguagaaccuggcaagaaucccaaaaauguucaaaccgcgccaggaaccuuuaaaaccccagagggagagguaggugcaauagcacuagauuuuaaaccaggcacaaguggcucuccuauuguaaauagagaggggaaaaucgucgguuuguacgggaacggcguagugacaacgucugguacguacguaucagccauagcucaagcaaaggcgucgcaagaaggaccacuaccagagauugaagaugaaguuuuuagaaagaggaaucuuacgauaauggaucuucaucccggaagcggaaaaacacgucgguacuuaccagcaaucguccgagaagcaauuaagcggaagcuaagaaccuuaauucuagcaccgacacggguugucgcuucagaaauggcugaagcauuaaaaggaaugccaauaagauaucaaacgacugcuguuaaaucugaacauaccggaaaagagauagucgauuuaaugugccacgcgaccuucacaaugagauuauugucuccuguacgugucccaaacuacaauaugauaauaauggacgaagcucauuuuacugacccgucuagcauagcagcuagagguuauauaagcacuagggucggcaugggagaagcggcugccauuuuuaugacagcaacaccuccagguaguguagaggcauuuccacaaucaaacgcagucauacaagacgaagaacgugauauaccggaacgaucauggaacucagguuacgaauggauaacugauuuucccggaaagaccguaugguuuguaccuaguauuaaaagcggaaaugauauagcuaauugucuuagaaagaaugguaaacgaguaauccaacuaucuagaaaaacuuuugacacagaauaucagaaaacuaaaaauaacgauugggauuacguugucacgacagauauaucugagaugggagcaaauuuucgagcagaucgagucauugaccccagaagaugcuuaaaaccaguuauucuuaaagaugggccagaacgagucaucuuggcaggaccaaugccuguuaccguagcaucagcugcccaaaggaggggaagaauuggaagaaaccauaauaaggaaggagaucaauauaucuauaugggacaaccgcucaauaaugacgaggaucaugcacauuggacagaggcuaaaauguuacucgacaauauuaacacuccugaggguauaauuccugcacuguucgagccagagcgugaaaaaucagccgcaauagauggggaauacagacuuagaggcgaagcgcgaaagacuuuuguagaguuaaugagacgaggugaccucccaguauggcugagcuauaaaguagcaagcgagggauuucaauauagcgaucgaagauggugcuucgauggagaacguaauaaucaaguauuagaagaaaauauggacguagaaaucuggacaaaggagggugaacguaagaaauuacgcccucguuggcucgacgcccguacauauucugauccccuugccuuaagagaguucaaggaauuugcggccggucggagaucugugucuggggaucuuauacuagaaauagguaaacuuccccaacacuugacucaacgagcgcaaaaugcuuuagacaacuuaguaaugcuacauaauagugaacaaggagggagagcauauagacaugcgauggaagaacugccugacacaauagaaacacucauguugcuagcacuuauugcagucuuaacugggggagugacauuauucuuuuuauccggcaggggacugggcaaaacaucaauaggucuauuauguguuauggcgucaucaguccucuuguggauggcgucaguagaaccgcauuggauugcagcaagcauaauuuuagaguucuuuuuaaugguacuacuaauccccgaaccagacagacaaagaacaccacaggacaaucaacuagcuuacguugugauagguuuacucuucaugauucuaaccguagcugccaaugaaaugggacuauuggaaaccacaaagaaagaucuggggaucggucauguugcuguggagaaccaucaucacgcagccaugcuagacguugauuuacauccagcgucagcuuggacguuguaugcaguagcaaccacaauuauuaccccaaugaugcggcauacuauagaaaacacaacagccaacaucagucugacggcaauagcaaaccaagccgcaauacuaaugggucuagacaaaggguggccaauaagcaaaauggauauuggaguaccauuguuagcuuugggaugcuacagucaagucaauccgcucacacucacggcagcaguacucauguuaguagcucacuacgcuauuauagguccuggauuacaagccaaagcuacaagagaagcacagaagagaacggccgcgggaauaaugaaaaauccaacaguagauggaauaguggccauagauuuggauccuguuguguacgaugcaaaauuugaaaaacagcuaggccaaaucauguuacuaauuuuauguaccucccagauacuacucaugaggacaacgugggcgcuaugcgaaaguauaacacuggccaccggaccacuuacuacacuuugggaaggaucuccuggcaaauucuggaauacaaccaucgccgugagcauggccaauauuuuucgcggcucauaccuagcgggggcggguuuagcauucucauuaaugaaaagucucggcgggggaaggagaggaacaggugcacaaggagaaacguuaggagaaaaauggaaacgccaauugaaccaacuaaguaaaucggaauuuaacaccuauaaaagaucuggaauuauggaaguugaucggagugaggcgaaagaggggcugaaacguggugagacaaccaaacacgccgugucaagaggaacagccaaacuccguugguucgucgaaaggaacuuaguaaaaccggaggggaagguaauugauuuaggcuguggaagaggaggauggucauauuauugugcaggccuaaagaaaguaacagaaguaaaagguuauacaaaagggggaccaggucaugaagaaccgaucccaauggcuacuuacggauggaacuugguaaaauuacacuccgguaaggacgucuucuuuauaccacccgagaaaugugauacuuuacugugugacauuggggaaaguucgccuaauccaaccauagaggaaggcagaacguugaggguccucaagaugguagaaccauggcuuagaggaaaucaguuuugcaucaagauuuuaaaucccuacaugccaucaguaguagaaacuuuagaacagaugcaacgaaaacacggugguauguugguaagaaauccguuaaguagaaauaguacccacgagauguauuggguuucgugugggacaggcaacauaguuagugccguaaauaugacaagucguauguuauuaaauagguucacaauggcgcauagaaaaccgacauacgagagagacguagaucucggagccggcacaagacacguagcaguugaaccagaaguagcuaaucucgacauaauaggucagcggauagaaaacauaaaacaugaacauaagagcacauggcauuaugaugaggauaaccccuauaagaccugggcauaccaugguucuuacgaagugaaacccagcggaagugccuccaguauggucaacggaguggucaaauuacugacuaaaccuugggacguuaucccaaugguaacgcaaauagcuaugacugauacuacaccuuuuggccagcagcgcgucuuuaaggaaaaagucgacacuaggacaccgaaggccaagagaggaaccgcacagauuauggaagugaccgcuaaauggcuuuggggauuucugaguaggaauaagaaaccacgcauaugcacgcgggaggaauuuacucgcaaaguccgaagcaaugcugcgaucggugcuguguuuguugaugaaaaccaauggaacagugcaaaagaggcgguagaggacgaaagauuuugggaucuuguucauagagagagagaacuacacaaacaaggcaaaugcgcgacuuguguauacaauaugaugggaaaacgagaaaagaaacuuggggaauuugggaaagcaaagggcucaagagccaucugguacaugugguuaggcgcucgguucuuggaauuugaggcuuugggcuucaugaacgaggaucauugguuuucacgcgaaaauaguuugaguggagucgaaggagaagguuuacauaaacuuggcuacauuuuaagagauauauccaaaauaccuggcggcaacauguaugccgacgacacagcuggcugggacaccaggauuacagaggacgaucuucaaaaugaagcuagaauuacggacauaauggaaccagaacacgccuuauuagcaaaaucuauauucaagcuaacauaucaaaauaaaguaguacgggugcagagacccgccaaaaauggaacgguuauggauguaauuagcaggcgagaccaaagagguaguggacaaguagggacguauggacuaaacacauuuacuaauauggaggcacaacuuauacgacaaauggaaucagaggguauauucagcccaagugagcuugaaaccccaaaucuagcagagcgaguuuuagacuggcuagaaaaauacggugucgaaagacuuaagagaauggcaauuagcggggaugauugcguaguaaagcccauagaugauagauucgcaacggcguugacagcacucaaugauauggguaaaguuaggaaggacauuccacaaugggaaccuucaaaagguuggaaugacuggcaacaaguaccuuucuguagucaucauuuccaucaacuuauaaugaaggacgggcgugagauaguaguuccuuguagaaaucaagacgaguuaguugggcgagcacgagucucccaaggggcaggguggucauuacgcgaaacagcgugcuuggguaaaaguuaugcgcaaauguggcaacuaauguauuuucauaggagagauuuacgcuuagccgccaaugcgauaugcucagcgguaccgguugacuggauaccuacgagucgaaccaccugguccauacacgcgcaucaucaguggaugacuacagaggacauguugagcguauggaacaggguauggauugaagaaaaucccuggauggaagauaagacccauauaucuucuuggggugacguaccguaucuuggcaaaagagaagaccaauggugcggcagcuugauuggacugacugcgagagccacuugggcaacaaauauacaaguagcuauuaaccagguaagacgacuaauaggcaacgagaauuaucuagauuacaugacgucuaugaaaagguucaaaaaugaaucggacccugaaggagcccuuugguag

SEQ ID NO: 21644 - RNA, 9879 nt, Artificial Sequence
  derived and/or modified CDS sequence (opt6) from DENV-1__GQ199773__SS-prME
aguguaacuaugcuucucauguuaaugccaacagcucuugcauuccaccucacaacccgggguggagaaccucauaugaucguuucuaaacaagaacgagguaaaucauuauuauuuaaaaccuccgcaggcguaaauauguguacucuaaucgcgauggacuugggcgaauuuugcgaagauacaaugacauauaaaugcccacgcauuacugaagcugaaccagaugacguugacuguugguguaaugcaacagauacuuggguaaccuacggcacauguagucaaacaggugaacacaggagagauaaaaggucaguugcauuagcaccacacgucggauuggggcuugaaacucgaacugagacguggaugaguagugaaggcgcauggaaacaaauucaaagggucgaaacaugggcuuugagacaucccggauucacuguaauagcauuguuuuuagcacaugcgauaggcacgaguauaacccaaaaaggaaucauuuucauuuuacuuaugcuagugacacccaguauggcaaugcgaugugugggcauuggaagcagagacuucgucgagggccugucuggagcaaccuggguagauguaguccuggaacacggaucaugcgugacaacaauggcgaaagacaaaccaacacuugacauugaauuauugaaaacugaagugacgaacccagccgugcugagaaaacucuguauugaggcaaaaaucaguaauacaacaacggacagucguuguccgacucaaggagaagcgacccugguugaagaacaagaugcaaauuuugucuguaggaggacauucguagaccgaggaugggguaaugguuguggucuauucggaaaagguuccuuaauaacuugugcuaaauucaaaugcgugacaaaacucgaaggaaaaacuguccaauaugaaaauuugaaauauaguguaacgguaacagugcauacgggagaucaacaucaggucggaaaugagucuacggagcacggaacgacagccacaaucacgccgcaagcuccuucgacugaaauacaauugacugauuauggugccuugacauuagacugcucaccaagaacaggacucgauuuuaaugagaugguacuacuaacuaugaaagagaaaaguuggcucgugcauaaacaaugguuccuagauuuaccacuuccuuggacgaguggagcaucuaccagccaagagacuuggaaccguaaagauuuauuaguaacuuuuaaaaccgcacaugcgaagaaacaggaaguaguaguuuuaggaagucaagaaggggcaaugcauacagcgcuaaccggcgcaacagaaauacaaacuuccggaaccacaacuauuuuugcaggucaccucaaaugccgccuaaaaauggauaaauuaacgcugaaggguaugucuuaugugaugugcacuggcaguuucaagcuggaaaaggaaguagccgaaacgcagcacgguacaguucuuguucagauuaaauaugaaggaaccgaugccccgugcaaaauuccauucuccacgcaggacgaaaagggugucacgcaaaacggccgauuaaucacagcuaauccaauaguuacugacaaagagaaaccgguaaacauagaggcugagccaccauuuggagagucauacauaguaaucggagcaggcgagaaggcauuaaaacugagcugguuuaagaagggcaguuccauuggaaaaauguuugaagcaacagcgcguggggcacgccgaauggccauauuaggcgacacagcuugggacuuuggaagcauuggugguguguucacaagcgugggcaagcugguacaucagauauucggaaccgccuaugguguauuguucagcggaguaucauggacuaugaaaauuggaaucgguguuuuacuaacauggcuaggacuuaacuccagaaguacuucauuaaguaugacgugcaucgcuguuggauugguuacuuuauaccuugggguaaugguucaagccgauucuggaugcguaauaaauuggaagggacgggaacuaaaaugcggaaguggaauauucguuaccaaugagguacacacauggaccgagcaauacaaauuccaggcggauagcccuaaaagacucucagcagcaaucgguaaggcuugggaagaagggguuuguggcauccguucagcaacgagacuagagaauauaauguggaaacagauuaguaacgaauugaaccacauccuuuuagaaaacgauaugaaauucacuguuguagucggagacguagcaggaauccuagcucaaggcaagaaaaugauacggccacaaccaauggaguauaaauacucguggaaaaguugggguaaagcaaaaaucauuggagcagauguacaaaacacuacuuuuauaauugacggaccaaacacuccagaauguccugacgaccaaagggccuggaauaucugggaggucgaagauuacggauucggcauauucacuaccaauauaugguuaaaacuaagggauucuuauacccaaguaugugaccaccgacugaugucggcagcaauuaaagauucaaaagcuguccacgcugauaugggauacuggauugaaucagagaaaaaugaaacguggaaguuagcuagagcaucauucauugaagucaaaacgugcauuuggccaaagucacauacauuauggucgaacgggguguuggaaucagagaugauaauaccaaagauauaugggggcccgauaucacaacauaauuacaggccuggauacuuuacacagacugcagggccuuggcauuuaggcaagcuggaacuagauuuugacuuaugcgaagguaccacaguaguuguagaugagcauugcggaaauagaggcccaucucuucguacaaccacaguaacgggaaagauaauucaugaauggugcuguagaaguugcacacuaccgccacugagauuuaaaggagaggauggguguugguaugguauggaaauccggcccgucaaagaaaaggaggagaauuuaguuaaauccaugguaucagccggaaguggugaaguagauaguuucagucugggguuauuguguauuagcauaaugauugaagagguaaugagaaguagguggucuagaaaaauguuaaugacagguacacucgcuguauucuuucuuuugauaaugggacaguuaacuuggaaugaucuaauacgauuguguaucaugguaggcgcaaaugccucugaccgaaugggaauggguacaacuuaccuggcguugauggcgacauuuaagaugagaccuauguucgcaguaggcuuacuauuuaggagauuaacaagucgcgaaguauuauuauuaacaauaggacucuccuugguggcuuccguggaauuaccaaauucacucgaagaauuaggcgacggauuagcuauggguauaaugauccucaaguuacuuaccgacuuccaaucucaucaauuaugggcuacacuguuaucacuuaccuuuauuaagacaacguucaguuuacauuacgcauggaagacaauggcaaugguucuuagcauugucagcuuauucccuuugugccucucaacuacaagucaaaagacuacuuggcuuccuguccuuuugggaucgcuggggugcaagccauugacuauguucuuaaucgccgaaaauaagauauggggcagaaaaagcuggccgcuaaacgagggcauuauggcuguuggaauagucucgauccuacuaucaaguuuacuuaaaaacgacguaccucuagcgggaccgcuaauagcgggagggaugcucaucgcauguuauguuauaaguggaucaucugccgaucugucucucgaaaaagcggcugaaguaaguugggaagaggaagcagagcacucaggagccucacacaauauuuuaguagaagugcaagacgacgguacaaugaagauuaaagaugaggaaagagacgauacacuuacaauacuauuaaaggcaacacuacuugcaguaaguggaguuuauccauuaaguauaccggccacccucuuuguaugguauuucuggcaaaagaaaaagcaaagaaguggggucuuaugggacacccccucuccuccagaaguagaaagagcgguacuagacgacggaauauaucguaucaugcagcgagguuuacucgguagaagucaggucggaguagggguguuucaggagaauguauuccacacuauguggcaugucacuagaggggcaguauugauguaccaggguaaaagguuagaaccgaguugggccucagucaagaaagauuuaaucagcuacggaggagguuggcguuuacagggauccuggaacacuggagaagagguccaaguaauagccguagaaccaggaaagaauccuaagaacguucaaacugcuccagggaccuucaaaacauccgagggggaggucggagcgauagcacuugacuucaagccgggaacguccgguucaccaaucguuaauagagaaggaaaaauaguuggauuauacggaaaugggguaguuacuacaaguggcacauauguaagugcaaucgcacaagcaaaggcgucacaagaaggaccucuuccugagauagaagaugagguuuuucggaagagaaaucucacuauaauggauuuacaucccggaagugggaaaacaagaagauaucugccugcaauaguuagagaggcaauaaagaggaaacuccguacuuugauacuagcuccuacaagaguuguagcaagugaaauggcagaagcacuaaaaggaaugccaauaagauaucagacuacagcagucaaaagugaacauacugguaaggaaauaguugaccuaaugugccaugcuacuuucacaaugcgguuacuuagcccaguuagaguaccuaauuauaacaugauaauaauggaugaggcacacuuuacugauccuaguucgauagccgccagaggcuauaucuccaccagaguagguaugggcgaggcggcggcuauauucaugacugcaacaccaccuggaucaguagaagcguuuccacaaucaaaugcugucauccaagacgaagaaagggauauaccagaacgaucauggaacagcggguaugaauggaucaccgacuucccaggaaagacaguuugguuuguacccucaauaaaaaguggcaacgauaucgcuaacugccugagaaagaacggaaaaagaguuauacaacucucucgaaaaacuuuugauacugaauaucagaaaacuaagaacaacgauugggacuacgucguaacaacugauauuucagaaaugggagcaaacuucagagccgauagaguaaucgaucccagaaggugcuugaaaccaguaauucuaaaagauggucccgaacgagugauacuggcaggcccaaugccagucacgguggcaucugcagcgcagagaaggggccguauuggaagaaaccauaauaaagaaggugaucaguauauauacaugggacaaccauuaaauaacgacgaggaucacgcgcacuggaccgaagccaagaugcucuuagauaacauuaauacgccugaagggaucauuccugccuuauuugaaccagaaagagaaaaaucugcggcaauugauggagaauaucgucucagaggagaagcuagaaagacauuuguagaacuaaugagacggggagacuugccaguuuggcuaagcuauaagguagccagugaaggcuuccaauacucagauaggagaugguguuuugacggugagaggaauaaucaagugcuagaggagaauauggauguagagauauggacaaaagagggggaacgaaagaaacucagaccuaggugguuagaugcgagaacuuauagugauccauuagcauuacgggaguucaaagaauuugccgcaggaaggcguuccguaucgggagaccucauauuagaaauagguaaauuaccacaacaccugacccagagggcacaaaaugcuuuggauaaucuuguuauguugcauaacagcgagcaaggaggacgagcuuaccgucaugccauggaagaacuuccagauacaauagaaacacuaaugcuucuagcguugauagccguacuuacugguggaguaacucuauucuucuuaucgggucgggguuuggggaaaacgucgauugguuuacuaugcguaauggcauccucaguacuacuauggauggcaucuguagagccucacuggauagcagcgagcaucauuuuagaguuuuucuuaaugguacugcucauaccagaaccggacaggcaaagaaccccucaggacaaccaauuagcauacgugguuaucggauuauuauuuaugaucuuaacaguagcugccaaugaaaugggguuacuggagacuacuaagaaggaucuugggauugggcauguagcggucgaaaaccaccaucacgcagcaauguuagauguagacuuacacccugccuccgcguggacguuguacgcaguugcaacaacaauaaucacuccgaugaugagacacacgauugaaaacacaacagcuaauauaagucucacggcuauugcaaaucaggcggccauuuuaauggggcucgauaaagguuggccgauauccaaaauggacaucggaguacccuuguuagcccugggcuguuauucccaaguuaacccgcuaacacugacugccgccgucuuaauguuaguagcucauuaugcuauaaucggaccagguuuacaagccaaagcaacccgagaagcccaaaaacggacugcugccggaauaaugaagaaccccacgguagacggaauuguagcgauugaucuggaccccguuguauacgaugcaaaguucgaaaagcaauugggccaaauuaugcuuuugaucuugugcacaagccagauacuacucaugagaaccacgugggcucuaugugaaucaauuacgcuagcuacagggccguuaaccacuuuaugggaaggcucuccugguaaauuuuggaacaccacaauugcuguaaguauggcaaauauauucagaggaucauauuuagccggggcaggauuagcauucucacugaugaaaucacuugguggaggacguagaggaacaggagcacaaggcgaaacacuaggcgaaaaauggaaaagacaacuaaaucaacuauccaaaagugaauuuaauacuuacaaacggagcgguauaauggaaguagacagaagugaggcaaaagaaggacuaaagcguggugaaacuacgaagcacgcaguaucaagaggaacugcaaaauuacguugguuuguugaaagaaaucuaguaaagcccgaggguaaaguaauagaccuaggauguggccgggguggcuggucuuauuauugugcuggacucaaaaagguaaccgaagucaaaggcuauacuaaaggggguccaggucaugaagaaccgauaccaauggcuacauacggguggaaucuuguuaaguuacacucaggaaaagauguauucuucauuccaccagagaaaugugauacacuucuaugcgauaucggggaaaguaguccuaauccuacaauugaagaaggucgaacuuuaagaguguuaaaaaugguagaaccauggcuaaggggaaaucaauucuguauuaaaauuuuaaacccuuauaugccaucugucguagaaaccuuggaacaaaugcagcgcaaacauggaggaaugcucgucagaaauccacugucuagaaacucaacccaugaaauguauuggguuucaugcggaacagguaacauaguuuccgcaguaaacaugacuagcagaauguuauuaaauagauuuacaauggcacaucguaaaccgaccuaugaaagagacguugaucuuggugcagguacacgucacguagcaguugagccugagguagccaaucuggauaucauagggcagagaauagaaaauauaaaacacgaacacaaaaguaccuggcauuacgaugaagacaauccauacaagaccugggcuuaccacgguaguuaugaagucaagccuagcggaagugcgucuucaaugguuaacggaguuguuaaguuacuaacuaaacccugggacgugauaccuaugguaacacaaauagcaaugaccgauacaaccccuuucggucaacagagaguauucaaagagaaaguagacaccagaacuccgaaggcaaagagggguacggcucaaauuauggaaguaaccgccaaauggcuauggggcuuucuaaguagaaauaagaaaccucguaucuguacccgagaagaguuuacaagaaaaguacgaagcaacgcggcuaucggugcaguauucgucgacgaaaaucaguggaauagugcaaaagaagcugucgaggaugaaagguuuuggaaucucguucaccgggagagagaauuacacaaacaaggcaagugugcgacguguguuuacaacaugaugggcaaacgagagaagaaauugggagaauuuggcaaagcaaaggguucccgugccauuugguauaugugguuaggagcaagauuucuugaauuugaagcucuuggauucaugaacgaagaucacugguuuagucgagaaaauucacuaagcggcguggaaggugaaggguuacauaaacuaggauacauacuuagagauaucagcaaaauuccuggaggcaacauguaugcggacgacacugcaggaugggauacgcgaauaacagaagacgacuuacaaaaugaagccaagauaacggacauaauggaaccagaacaugcacuauuagccaagucuaucuuuaaguuaacuuaucaaaauaaaguagugagaguucaaagaccagccaaaaaugguacugugauggaugucauuagcaggcgggaccaaaggggaaguggucaaguaggaacauacggauuaaauacauucacaaacauggaagcacaauuaauacgacaaauggaaucggagggcaucuucaguccuagugaacuugaaacuccaaacuuggcaggaagaguuuuagauuggcucgaaaaacacgggguggaacgucuuaagcguauggcaauaucuggugacgauuguguaguaaaaccuauagaugacagauucgcuacugcgcucacugcucuaaaugacaugggaaaagugagaaaagauauuccacaaugggagccaucaaaaggauggaacgauuggcaacagguuccguucuguucucaucauuuucaucagcuaauuaugaaggacgguagagaaauaguagugccuuguaggaaucaagacgaauuaguagguagggcaagaguaucccaaggcgccggauggucguuaagagaaaccgccuguuuagguaaaagcuacgcacaaauguggcaauuaauguacuuccaccgccgcgaccuaagacucgcagcgaaugcaauauguucagcugucccagucgauuggguuccaaccucuagaaccacgugguccauacacgcacaccaccaguggaugacaaccgaggacaugcuaucaguuuggaacagaguuuggauagaagaaaaucccuggauggaagauaagacucauaucucgucguggggugacguuccuuaccuaggaaaaagagaagaucaauggugcgguucccugaucggucuaacugcgagagccaccugggcaacaaacauacaaguagccauaaaucaaguucgacgauugauuggaaaugagaacuaucucgacuacaugaccaguaugaaaagguuuaaaaaugaauccgaucccgaaggcgcucuaugguaa

SEQ ID NO: 21645 - RNA, 9879 nt, Artificial Sequence
  derived and/or modified CDS sequence (opt6) from DENV-1__JF937596__SS-prME
agugucacaaugcuacuaauguuaaugccaacggcacuagcuuuucaccuuacuacucgagggggagaaccccacaugauuguuaccaaacaagaacgagggaaaagccuacuauuuaaaacaucggcugguguaaauaugugcacccuaauugcaauggaucuaggagaacuuugugaagacacaaugacauauaaaugcccgcggaucacagaagcagaacccgaugauguggauugcugguguaaugcaacagauaccugggucacauauggaacauguagccagacaggagaacaucgucgugauaagagaucagucgcauuggcgccacauguagguuuaggauuagaaacucguacugaaacuuggauguccucggaaggggcuuggaaacaaauucaaaggguagaaacgugggcucuacgacacccagguuuuaccguaauagcauuauuucuagcgcaugcaaucggcacuucaauaacucaaaaaggaauaaucuucauucuauuaauguuagugacgccgucaauggcgaugcggugcgucggcauaggcucuagagacuucgucgaaggacucagcggcgcuaccuggguagaugugguauuggaacauggaaguugugucaccaccauggcaaaagacaaacccacccuagauaucgaacucuuaaaaacagaaguuacaaacccagcaguacuaagaaaacuuugcauagaagcaaaaauaucgaacaccacaaccgauagccgaugucccacucaaggcgaagcgacgcugauggaagaacaagacgcgaauuucguaugccgucgaacguuuguagauagaggauggggaaacgguuguggucuauuugguaaaggaucacuaauuacaugcgcuaaauuuaaauguguuacuaaacuagaaggaaagaucguacaguacgagaaucuuaaguauagcguaauuguuacaguucauacgggggaucaacaccaaguugguaaugaaaguacagaacacggaacuacagcuaccauuacaccacaagcuccuacaucagaaauucaauuaacagacuacggagcgcuuacucucgauuguagcccaagaacaggacuagauuuuaacgaaaugguauuacuuacgaugaaggaaaaaucaugguuaguacauaagcagugguuccuagacuuaccacuuccauggacaucuggugcgaguacaucucaagagacuuggaacaggcaagacuuguuaguaacauuuaaaacugcccacgcgaaaaagcaagaaguagugguacuagguagccaagaaggagccaugcauaccgcauuaacaggagcaacagaaauacagacaagugguacaacuaccauuuucgcagggcaucuaaagugccgauugaaaauggauaaacuuaccuuaaagggcauguccuacgugaugugcacggggagcuucaaauuggaaaaagaagucgcagaaacacaacauggaacgguauuaguucaaauuaaauacgaaggcacggacgcaccuugcaaaauaccguuuaguacacaagacgaaaaaggagugauacaaaauggcagacuuaucaccgcaaauccaauagucacugauaaagaaaaaccggugaacaucgaagcugaaccgccauuuggagagagcuauauugucauagggguuggugaaaaagcccuaaaauuaaguugguuuaagaaagggagcucuauaggaaaaauguuugaagcaacagcacgaggagcgaggaggauggccauacuaggugacacagcaugggauuucgggucuauaggcggaguauuuacaucagugggcaaacucguucaucaaaucuuuggaacagccuacggaguccuauuuaguggaguaaguuggacgaugaagauugggauaggcguucuuuuaacguggcucgggcuuaauucaagaaguacgucauuauccaugacaugcauagcuguaggucugguuacacuauauuuaggcgugauggugcaagcagauuccgguugugucauaaauuggaaaggacgugaacucaaauguggaagcgguauauucgucacuaacgaagugcauacguggacugagcaguauaaauuucaagcagacagcccuaaaagacuaucugcagcaauagggaaggcuugggaagaaggugugugcggaauuagaucggccacucgccuugaaaacauaauguggaaacagauaagcaaugagcugaaucauaucuuacuagagaaugauaugaaguucacaguaguaguaggggacguuguggggauccuagcacaggggaagaaaaugauaagaccacagccaauggaacacaaauacaguuggaagucuuggggaaaggcaaaaauaaucggcgcagauguacaaaauacgaccuucauaauagacggaccaaacaccccagaaugcccagaugaccagagggcguggaauauuugggaaguggaagauuauggguuugggauauuuacuacaaacauuuggcuaaaauugagagacagcuacacccaagcgugugaccaucguuuaaugagcgccgccauaaaggauaguaaggcaguucaugcagauauggguuacuggaucgagucggagaaaaaugaaacauggaaacuagcgagagccagcuucauagaaguuaaaacaugcauauggccaaaaagccauacacucuggaguaaugguguacuugaaagcgaaaugguaauuccaaaaauauaugggggacccauuucacaacauaauuauagaccaggguauuuuacacaaaccgccggaccauggcaucuagggaaacucgaacucgacuuugaucucugcgagggcacuacggugguugucgacgaacauuguggaaaccgagguccgaguuugcgcacgacgacaguaacgggaaagauaauacaugagugguguuguagaucuuguacucuaccgccucuuagauuuaaaggagaagauggaugcugguauggaauggaaauuaggcccguuaaagaaaaagaagaaaacuuaguuaaaucuauggugagugccggaaguggcgaaguagauucguuuagcuuaggacuuuuguguauaagcauaaugauugaagaagugaugagaucacguuggucacgcaagauguuaaugacggggacauuagcaguuuuucucuugcuaauuaugggacaauugaccuggaaugauuuaauaagauuaugcauaaugguaggugcuaacgcaucagauagaaugggaaugggcacaaccuaccuagcgcugauggcaaccuuuaagaugcgaccaauguuugcgguaggacuuuuauuuagaagacuuaccucccgggagguuuuauuauugacgauugguuuaagucuaguugccucaguagaauuacccaacagcuuggaagaacuuggagacgggcuggcaauggguauaaugaucuugaaguuauuaacugauuuucaaucgcaucagcuaugggcuacauuauuaagucuuacuuuuauuaaaaccacauuaucucuacacuacgcauggaagacgauggcaauggugcuuaguauaguuucccuauuuccacucuguuugucaaccacaagccagaaaacgacaugguuaccgguauuguuaggcucguugggauguaaaccccuuacaauguuccugauugccgaaaauaaaauuuggggcaggaaauccuggccauugaacgaaggaauaauggcgguaggcguaguaagcauuuugcuaagcucuuuacugaaaaaugauguaccuuuagcagguccacuuauagccggcgguaugcuaauagcuuguuaugugauaucugguucuagugcagaucucagcuuagagaaagcagcagaaguuucaugggaagaagaagcagaacauagcggggcaagucauaacauuuuagucgagguccaagaugacggaacaaugaaaaucaaggacgaagaacgugacgauacacuuacaauauuauugaaagccacucuauuagcagugucuggaguguauccgcugucaauacccgcuacacuauuuguaugguacuuuuggcagaagaagaaacaaagaucagguguccuuugggacaccccgagcccgccggaggucgagagagcgguccuagaugaugggauuuauagaaucaugcaacguggucuuuuagguaggagccaagucgguguaggcguuuuccaggaaaacguauuucauacuauguggcauguaacgcgcggagccguacugauguaccaaggaaaacgacuugagccaucaugggcuagcgugaagaaagaucuuauaagcuaugggggugguuggcgacuucaaggcucauggaauacuggugaagagguccaaguaauagcuguggaaccggguaaaaaccccaaaaauguccagacagcccccgguacauucaagaccccugagggagaagucggagccauagcauuagauuuuaaaccuggaacuucggggagccccauaguuaauagagaaggaaagauaguaggacuuuacgggaauggaguaguaacaacgagcgguacuuauguaagcgcgauagcgcaaacgaaagcaagucaggaagguccucuacccgaaaucgaagacgaaguauuccgaaaacgaaaucucacaauaauggaucugcacccagggucaggcaaaacccguagguauuuacccgcgaucgugagagaagcuauaaaacgaaaacuaagaacccugauauuagcaccaacacgaguagucgcuagugaaauggcagaggcuuuaaaaggaaugccaauuagauaucaaaccacugcugugaaaagcgaacauacaggaaaagagauuguugaccugaugugccaugcgacauuuacuaugagacugcucucaccaguaaggguaccuaauuacaauaugauaauaauggaugaagcacacuuuaccgacccgucgagcauugcagcuagggguuacauaaguacaagagucgggaugggcgaagcagcagccauuuuuaugacagccacaccaccuggcucagucgaagcguucccacaaagcaacgcggucauacaagacgaggagagagacauaccagagcguaguuggaacaguggucacgaauggaucacagauuucccaggcaaaacuguaugguuuguuccaaguaucaagucuggaaaugacauagcgaauugcuuaaggaaaaaugggaaaagaguuauucaacucucuagaaaaaccuucgauacagaguaucagaaaaccaaaaacaaugacugggauuacguaguuacuacagauauaagcgaaaugggugcgaauuuccgcgcggaucgcgugauugauccgcgucguugccuuaaaccagucauacucaaggaugguccggaaaggguuauccuagcgggaccuaugccaguaacgguagcgagugcggcccagagaagaggaagaauaggacgaaaucauaauaaggagggugaccaguacauauauaugggucaaccuuugaauaaugacgaagaucacgcacauuggacugaagcaaagaugcuacuggacaacauuaacacaccugagggcauuauaccugcauuguuugaacccgaaagagagaaaagugccgcuauagauggagaauacagacuaagaggggaagcuagaaaaacguuuguugagcuuaugagaaggggugacuugccuguuuggcucucuuacaaaguggcgucggaaggguuucaauauucggaccgaagauggugcuuugacggugaaaggaauaaucagguuuuggaggagaauauggacguagaaauauggacgaaggaaggagaaaggaagaagcuaagacccagaugguuagaugcucgaacauacucagauccuuuagcacuucgagaauuuaaagaauuugcugcuggacgucgaagcguauccggggacuuaauauuagaaauuggcaaauuaccacaacacuuaacacagagagcucaaaacgcacuagacaauuuaguuauguugcacaauagugaacaaggugguagagcguaccggcaugcuauggaggaauuaccugacacuauugaaacacugaugcuucuagcauuaauagcaguauuaacgggaggcgugacacuguuuuucuuaagcggaaggggauuagguaaaacgucgauuggccugcuuugcguaauggcaucaucuguauuauuguggauggcuuccguugagccacauuggauugcugccucgauaaucuuagaguucuuuuuaaugguucuguuaaucccagaaccagacagacaacggacaccucaagauaaucaacuugcguacguaguaaucggcuuacuguucaugauauuaacagucgcagcaaaugaaaugggacuacucgaaacuacgaagaaggauuuaggcauuggccacguugcgguugaaaaccaucaccaugcuaccauguuagacguagaucuacacccugccucugcguggaccuuauaugcugucgcaacaaccauuauaacaccuaugaugcggcauaccauagaaaacacaaccgcuaauauuucuuuaaccgcaauagcaaaccaggcagcuauccucaugggacuggauaaggguuggccgauaaguaaaauggauauagguguaccuuuacuugcguugggauguuauucucaagugaauccguuaacuuuaaccgcugcugugcuaaugcucguugcccacuaugccauaauagggccagguuugcaggcaaaagcaacuagagaagcccagaaaagaacagccgcagguauaaugaaaaauccaacaguagauggaauaguggcuaucgaccuggaucccguugucuaugaugccaaauuugagaaacaguuaggccaaauaauguuacuaauacuauguacgagucagaucuuacucaugagaacgacgugggcucuuugugaaucaauuacgcucgcgacgggaccauuaacaaccuuaugggaggguucaccaggaaaauuuuggaacacaacaauagccguaucaauggcaaauauauuccgaggcucauauuuagcaggagcaggauuagcuuuuucacuaaugaaaucucuuggaggaggacguagaggaacaggugcacaaggugaaacccuaggugaaaaguggaaaaggcaacuaaaucaauugucuaaaucagaguucaauaucuauaaaagaucaggaauaauggaagucgacagaucagaagcaaaagaagguuuaaaacgcggggaaacaacaagacaugcuguaagcagagggacagcuaagcuccguugguuuguggaacguaacuugguaaaaccugaagggaaaguaauugaucugggcugugguagagguggcuggucuuauuacugugcuggacucaagaaagucacugaaguaaaaggauauaccaagggugguccaggucaugaggaaccaauuccuauggcgacuuauggauggaaccuuguuaaguuacauucagggaaagauguguucuuugcaccacccgaaaaaugcgacacucuauuaugcgauauuggcgagagcucuccaaauccgacgauugaagaagggagaacucuacgggucuugaaaaugguagagccuuggcuacguggaaaucaauuuuguauaaagauacuuaauccauauaugccaucgguaguugagacgcuggaacaaaugcaaaggaaacaugguggaauguugguacgcaauccguuaagucguaacucgacccacgaaauguacugggugaguugcgguacggguaacaucguaagugcagucaauaugacaucuagaaugcucuuaaacagguuuacgauggcacaucgaaaaccgacauaugaacgugacguugacuuaggcgcugggacgaggcacgucgcaguugaaccagaaguagcuaaccuugauauuaucggccaacgcauagagaauaucaaacacgaacacaagucuacuuggcacuaugaugaagauaacccauacaaaacgugggcuuaucauggaagcuaugaagucaaaccuucgggaucagcgucuucaaugguaaauggagucguaaaacuauugacaaagccgugggacguaauuccaaugguaacacagauugcaaugacugauaccacucccuucggucaacagcgaguuuucaaggaaaaaguggauacgagaacacccaaagcaaaaagagggacagcacaaauaauggagguaacggcccgaugguuguggggguucuuaagccgaaauaagaaaccaaggauaugcacacgggaggaguucacucgaaaagucagaagcaaugcugcaauuggugcaguauucguugaugaaaaccaguggaacuccgcaaaagaagcaguagaagaugaacgguucugggaccuaguucaaaaggaaagggagcuacacaaacaggguaagugugcuacuugugucuacaacaugauggguaaacgugagaagaaauugggagaguucggaaaagcaaaaggaagucgagccauuugguauauguggcuaggcgcaagauucuuagaauuugaggcguuagguuuuaugaacgaagaucauugguuuucccgagaaaauucacuaucaggcgucgaaggggagggacuacacaaauuaggcuauauucuaagagacauuucuaaaauacccgggggaaauauguacgcugaugauacugcgggaugggauacgaggauaacugaagaugaccuacaaaaugaagcaaaaauuacagauauaauggaaccggagcaugcucugcuggccaccucaauuuucaaauuaacauaucaaaacaaagugguuagaguccagagacccgccaaaaauggaacuguaauggaugucauaagcagaagggaccaacguggaaguggccaaguuggaacauaugggcuaaacacauucacuaauauggaagcccaauuaauaaggcaaauggaauccgaaggaauauuccuuccgucagaauuagagacacccaaucuggcagaaagaguacuagauugguuagaaaagcaugguguggaacgguuaaaaagaauggcgaucuccggagacgauuguguaguuaaaccaaucgaugauagauuugcuacugcacugacugccuugaaugacauggggaagguaaggaaagacauaccacagugggaaccaucaaagggcuggaacgauuggcaacaaguaccauuuuguagucaucacuuucaucaauuaauaaugaaggauggacgggagaucguaguuccguguagaaaucaggacgaacugguaggccgugcacgcguuagucaaggugcaggauggucauuaagagaaacagcaugucuugguaaaaguuaugcucaaauguggcaauuaauguacuuucacagacgugacuuacgacuagcagcaaaugcgauauguagugcuguuccaguugacuggguaccgacaagccgaaccaccuggaguauacacgcgcaucaucaguggaugaccaccgaagacauguugucaguauggaauaggguauggauugaagaaaauccguggauggaggauaaaacgcauguaaguucuuggggagacguaccauacuuaggaaaacgggaagaucaauggugugggucucuuauagggcuuacagcucgugcaacaugggcgucuaauauacaaguagcaauaaaccaggucaggcgcuuaauagguaacgagaauuaucuagauuauaugacaaguaugaagcguuuuaaaaaugagggggacccagaaggugcacucugguaa

SEQ ID NO: 21646 - RNA, 9879 nt, Artificial Sequence
  derived and/or modified CDS sequence (opt6) from DENV-1__FJ898380__SS-prME
agcguuacaauguuacuaauguugaugccaacagcauuagcauuucauuugacaacgcgagguggagagccccauaugaucguuaguaaacaagaaagagguaagagcuuauuguuuaaaacaucagccgggguuaauauguguacucucauugcaauggauuuaggagaacugugugaagacacuaugaccuacaaauguccucgaaucacugagaccgaaccggaugacguugauugcuggugcaaugcaacugauaccugggugacuuaugggacguguucucagacgggagaacaucgucgcgacaaacguuccguggccuuagcaccccauguaggauuagggcuugaaacgaggacagaaacuuggaugucaucugaaggugcauggaaacaaauccaaagaguagagacuugggcucuuaggcauccaggauuuaccguaauagcgcuauuucuagcacaugcaaucgguaccagcauuacucaaaaaggaauuauuuucauccuccugauguugguuaccccauccauggccaugagaugugugggaaucggaagucgagauuucguagaaggauuguccggagcgacuuggguagauguaguacuagaacauggaagcugcguaacaaccauggcaaaagacaaaccaacccuagacauagaacuauuaaaaacagaaguaacuaacccagccguacuucgaaaauuauguauugaggccaaaauaucuaauacuacaacugauucaagauguccuacccaaggcgaggccacucuuguagaagaacaagaugcgaacuuugucuguagacguaccuuuguagauagaggaugggggaacggaugugggcuuuuuggcaaaggcucacuuauuacaugcgcaaaauuuaaauguguaacuaaauuggaagguaaaauugugcaauacgaaaacuugaaauacucaguaauugugacgguacauacuggugaucagcaucaggugggaaacgaaagcacagaacaugggacaacugcaacgauuacuccccaggcacccacgaccgagauacaguuaacugacuauggggcacugacauuggacuguucaccaaggacagguuuagauuucaaugagaugguauugcuaacaaugaaagagaaaagcugguuaguccauaaacaaugguuucuagaccugccauuaccuuggacaagcggcgcuucuacuucgcaagaaacuuggaauagacaagaucuauuggugacauucaaaacagcucaugccaagaaacaagaggucguuguucuuggaucgcaagaaggugcuaugcauacggcuuuaacaggcgcgacugaaauccaaaccucugggacuacaacaaucuucgcuggucaucuaaaaugcagauuaaaaauggauaaacucacacuaaaagguaugaguuacgucaugugcaccgguagcuucaaauuagaaaaagaaguugcagaaacacaacaugggacuguccuaguucaaauaaaauaugaagguaccgacgcgccauguaaaauaccuuucucaacccaagaugagaaaggcguuacacaaaacgggcggcuuauaacagcaaauccgauugugacagauaaagaaaaacccguuaacauagaagccgaacccccguuuggcgaaucauauauugugauaggggcuggagagaaagcauuaaaacuuucaugguucaagaaaggcucaaguauaggaaaaauguuugaagcgacggcacguggagcaagaaggauggcaauacuaggagauacagcaugggauuuugguucaaucggaggcguauuuacaagugucggaaagcuaguucaucaaauauucgguacugcauaugguguuuuauuuucgggaguaucauggaccaugaaaauaggcauugguguguugcuuacuuggcucggauuaaauucgagaucaacaaguuugaguaugacuugcauugcggucggcuuaguuacauuguaccucgggguaaugguacaagcagacucgggcugugugauaaauuggaaaggaagggaacuaaaaugcgguaguggcauuuuuguuacgaacgaaguacacaccuggacugaacaguauaaauuccaggcagacucaccaaaacgauugagugcggcuauaggaaaagcaugggaagaaggcguauguggaaucaggagugcaacuaggcucgagaauauaauguggaaacaaauuucaaaugaauuaaaucauauauuacuugagaacgauaugaaauucacgguaguuguuggagacguagcaggaauacucgcccaaggcaagaaaaugauaaggccccagccaauggaauacaaauacagcuggaaaucaugggggaaggcgaaaauuauaggugcggauguacaaaauaccacauuuauaauagacggaccaaauacgccggagugucccgaugaccaacgagcauggaauauuugggaaguagaggacuauggauuugguauauucacgaccaacauauggcuaaaauuaagggauucuuauacacaggugugugaucaucgcuuaaugucagcugccauaaaagauucuaaagcgguucacgcugauaugggauauuggauagaaagugagaaaaaugagacguggaaacuugcaagagcauccuuuauagaagugaaaacgugcaucuggccgaaaucucacaccuuguggagcaaugguguacuagaaagugaaaugauaauuccaaagauauacggaggaccaauuagucaacacaauuacagaccgggcuauuuuacccaagcagcaggaccauggcacuuaggcaaguuagaguuggacuucgaucucugugaagguacaacaguaguagucgaugaacauuguggaaaccggggcccaucacuucgaacaacaacgguaaccgguaaaauuauacacgaaugguguugcaggaguugcacgcuaccucccuugagguuuaaaggagaggacggcuguugguauggaauggaaauucgacccgucaaagaaaaagaagagaauuuaguaaagagcauggugucggcagguuccggugaggucgauucguucagcuugggacuucucuguauaaguauaaugauagaggaagugaugagaagcagaugguccagaagaaugcuuaugacagguacguuggcuguauucuuucugcuuauaauggggcaauuaacuuggaaugauuugauucggcuauguauaaugguaggagccaacgcuucggauaggauggguauggggacaacguaucuugcacuaauggccacguuuaaaaugaggcccauguucgcugucggccuauuguuuaggagacucacaucuagagaaguucugcuacuuacaaucggacuaagccuugucgccucaguagagcuaccaaauucccuagaggaauuaggugaugggcuggcuauggguauaaugauucugaaauuguuaacagacuuucagucgcaucagcugugggccacauuacuuagucuaacuuuuauuaaaacgacauuuucgcuacacuacgcauggaaaacuauggcuaugguauuaucuauaguuucgcucuuuccauugugcuuaucgaccacuagccagaaaacuacaugguugccuguacuucuugguagucucgguuguaaaccacuaacaauguuccugauagcagaaaauaaaauauggggcaggcggagcuggcccuuaaacgaaggcaucauggcaguggguauuguuagcauuuuacuaaguucccugcuuaaaaaugauguaccuuuagcagguccuuuaauagccgguggaauguugauagcaugcuauguuauaucuggaaguucagcggauuuaaguuuggaaaaagcagcagaagucucaugggaggaggaagcagaacacucaggugcgucacacaauauuuuaguugaagugcaagaugauggaacuaugaaaauuaaggaugaagagagggacgauacacuaaccauacuauuaaaagcaacgcuuuuagcaguuaguggaguauauccccuaucgauaccugcaacucucuucguaugguauuucuggcaaaagaagaaacaacgaucaggcgugcuuugggacacaccuuccccuccagaaguugaacgugcaguauuagacgacgguauauacaggaucaugcagagaggccuacuagguagaagccaaguggguguagggguauuccaggaaaauguuuuucacacuauguggcauguaacaaggggagcgguuuuaauguaccaaggaaaacgacuagaacccaguugggcgucagucaagaaagauuuaauaaguuauggcgggggauggcgccuacagggaagcuggaauaccggggaagaagugcaaguaauugcaguagaaccugguaagaaccccaaaaauguacaaaccgcgccaggaacauuuaaaacuccagaaggggaagucggugccauagcgcuggauuuuaaacccggaacuucagggagcccuauaguaaaucgugaaggaaaaauagucggauuguacggcaauggaguaguaacuacgagugggacguauguuucggcaauagcccaagcgaaagcaucacaggaaggaccuuugccagaaaucgaagaugagguauuuagaaagagaaacuuaacgaucauggaccuacacccaggaagcgguaaaacgagaagguacuugccagcuauugugagggaagcgauuaaaaggaaacuacgcacacuuaucuuggcaccgaccagagucgucgcaucugagauggccgaagcacugaaaggaaugcccauacgauaccaaacuacagcugugaaaucagaacauacgggaaaggaaauuguggauuugaugugccacgcaaccuuuacaaugcgucuccugaguccuguuagagugccaaauuauaacaugauaauuauggaugaggcacacuuuacugacccaaguucuauagcagcgaggggauacauuucuacuagaguuggaaugggagaagcggccgcuauauuuaugacugcuacgcccccagguucgguugaggccuuuccacaaagcaaugcaguuauccaagacgaagaaagagauaucccugaaaggaguuggaacuccgguuaugaguggauaacagauuucccuggaaaaacagugugguuugugccaaguauaaaaagcgggaaugacauugcuaauugccugcguaaaaacggaaagagaguaauucaauuaucgagaaagacguuugauacagaauaccagaaaacaaagaauaacgauugggacuaugugguaacuacagauaucucugaaaugggugcuaacuucagagccgauagaguaauugaucccagaagauguuuaaaacccguuauucugaaagacggucccgaaaggguuauauuggcugggcccaugcccguuaccguagcgucagccgcacaaagacggggcaggauaggaagaaaucacaacaaggaaggcgaucaauauaucuauaugggccaaccacuuaacaaugaugaagaccaugcgcauuggacagaagcgaaaaugcuauuagacaauauaaacacuccagaaggaauuauaccagcucuuuuugaaccagaaagagaaaaaucugcagcgauugauggggaauaucgccuacgcggggaggcgagaaaaaccuucgucgaguugaugcggcggggagaccuaccaguuugguuaucuuacaaaguggcuucugaaggcuuucaauauucagaccgaagaugguguuuugauggcgaaagaaauaaccaaguauuagaggaaaacauggaugucgaaauuuggaccaaagaaggcgaacgaaagaaacuacggccuagaugguuagacgcuagaacauauagcgacccucuugcauugagagaguucaaagaauuugccgcagguaggagaucugugucaggagaucucaucuuagagauagguaagcucccgcagcaccuaacucaaagagcacaaaacgcccuggacaaccuagucaugcuacauaauagcgaacaaggaggacgugcuuauagacacgcaauggaagaauuaccugacacaauagaaacccuaauguuacuggcacuaauugccguccugacuggagggguaacguuguuuuuccugucgggcaggggguuaggaaaaaccucaaucggacuuuugugcgugauggcauccaguguauuauuguggauggcaucaguagagccacacuggauagcagcaaguauuauucuagaguucuuucuaaugguacuuuuaaucccagaaccugaccgacaaagaacaccacaagacaaccaauuagcauauguaguaauaggccuguuguucaugauauuaacuguugcagcaaacgaaaugggauuacuagagacaaccaagaaagauuuggggauagggcauguugccguugaaaaucaucaccacgccgcgaugcuagacguggauuuacauccugcaagugcauggacacuauaugcgguagcuacaaccauaauuacaccaaugaugcgucacacgaucgagaauacuaccgcuaauauaucacuuacagcaauugcgaaccaagcggcgauauuaauggguuuagacaagggguggcccauaucuaaaauggauaucggaguaccgcugcuagcacuuggcuguuacucgcaagugaacccacuuacucuuacagcugccguccuaauguuagucgcucauuaugcaauaauaggaccaggauuacaggccaaagcaacccgugaagcacagaaaagaacagcagcagggauuaugaagaaucccacaguagaugguauaguggcaaucgaccuugaucccguagucuacgacgccaaguuugaaaaacaacuaggacagauuauguuguuaauuuuauguacuucgcagauauuacuaaugcguaccacgugggcccugugugagaguauaacuuuagcuacaggcccauuaacgacccuaugggagggaucuccuggaaaauuuuggaacacaacaauugcuguaucuauggcgaauauauuuagaggaagcuaucuugcuggagcggggcuggcauuuucgcugaugaaaucacucggugguggucgacgaggcacgggagcccagggcgaaaccuugggugagaaauggaaacggcaauuaaaccaauugucuaaaucagaguuuaacacguauaagcgaucagggauuauggaaguagauagaucagaggcaaaagaaggucuuaaaagaggagagaccacuaaacaugcagugucgagaggcaccgcgaaacuucgcugguuuguugaaagaaaucuaguaaaaccagaagggaagguaauagaucucgggugcggaagaggagguuggagcuacuauugugcagguuugaagaaaguaacagagguaaaaggauauacuaaaggcggaccgggacacgaggagccaauaccuauggcaacauacgguuggaauuugguaaagcuacauucagguaaagauguauucuuuauuccaccugaaaaaugugacacauuacugugugauauaggugaguccagcccuaauccgacaauagaagaggggaggacuuuaagggucuugaaaauggucgaaccuugguuacguggcaaccaguuuugcauaaaaauauuaaaccccuauaugccaucaguagucgaaacacuagaacaaaugcaaagaaaacauggcgguaugcuaguccguaauccucuaagcagaaauagcacacacgaaauguacuggguuucuugcgguaccgggaauauaguguccgcagucaauaugacuagccguaugcuucuaaacagauuuacaauggcgcaucggaaaccuaccuaugaacgcgauguagaucuaggagcuggaacuagacauguugccgucgaaccagaaguagcaaauuuagauaucaucggucagagaauagaaaacauaaaacaugagcacaagagcacuuggcauuaugaugaggauaacccuuauaagaccugggcuuaucauggcucguaugaaguaaagccuucuggcagcgccuccagcauggucaaugggguagucaaacuauuaacaaagcccugggacguuauaccaauggucacgcaaauugcgaugacagauacuacaccuuuuggacaacaaaggguguuuaaagaaaaaguggacacgcgaacuccaaaggcaaaaagaggaacagcacagauaauggaagucacagcaaagugguuguggggguuuuuaucuaggaacaaaaagccgcguauuugcacuagagaggaguuuacgagaaaaguuaggaguaaugcugcgauaggcgcugucuucguugaugaaaaucaauggaacucagcgaaagaggcgguagaggaugaacgauucugggaucuaguucacagagagcgagaauuacauaaacaaggaaaaugcgcaacaugcguguacaauaugauggguaaaagagaaaagaaacugggggaauuugguaaagcaaaaggcagucgagcaaucugguacauguggcuaggggcuagauucuuggaauuugaagcgcuaggguucaugaacgaggaucauugguucagccgagaaaauucccuuuccggaguagaaggugaaggacuccacaaacugggguauaucuuaagggauauauccaaaauaccaggagguaacauguaugcagaugauaccgcugggugggauacuaggauaacggaggaugaucuucaaaaugaagcccggauuacugauauuauggaacccgaacaugcgcuacuagcaaaaaguaucuucaaacuaacguaccaaaauaaagucguaagaguacaaagacccgcaaagaauggcacggucauggauguaauuaguagaagagaccaaagaggcaguggucagguaggcacguaugggcuaaauacguucacaaacauggaagcucaauugauacgacagauggagucagaaggaauauucucgccuuccgaauuagaaacacccaauuuagcugaaagaguguuagauugguuggaaaaauaugggguugaacgauuaaaaaggauggcaauuucgggagaugacugcguagucaaaccuaucgaugauagguuugcaacggcauuaacagcucuuaacgauauggggaaagucagaaaagauauaccacagugggaaccaucgaaagguuggaacgacuggcaacaggucccguucuguucucaucacuuccaccaacugauaaugaaagauggaagggagaucguaguuccuugcaggaaucaagaugaacucguaggucgagcucgcgucagucaaggcgccggauggagucuacgcgagacagcaugucuaggaaaaucauaugcacaaauguggcaauugauguauuuccaucggagagauuuacgauuggcggcuaaugcgauuugcucagcgguuccgguagacuggaucccaacaagucgaacgacauggaguauccaugcacaucaccaauggaugacuacugaagauaugcuuucuguauggaaccgcguguggauagaagagaacccuuggauggaagacaaaacucauauaagcaguuggggagaugucccauaucuaggaaaaagggaggaucaauggugcggaucacuaauagguuuaacagcacgagcaaccugggccacaaauauacaaguugcuauuaaccaagugagaaggcuaauagguaaugagaacuaucuggacuacaugacaucaaugaagagauuuaaaaaugagucugauccugaaggugcucugugguga

SEQ ID NO: 21647 - RNA, 9879 nt, Artificial Sequence
  derived and/or modified CDS sequence (opt6) from DENV-1__FJ898382__SS-prME
ucaguaacgauguuauuaauguuaaugccuaccgcuuuagcuuuucaucuaacuacucguggaggggaaccacacaugauaguuucuaaacaagaacgaggaaaaucacuacuuuuuaaaacaagugcuggaguaaauaugugcacucuuauagcaauggaucuuggcgaacuuugcgaagauacuaugacuuauaaaugcccgcguauuacagaaaccgaaccggaugauguagauugcuggugcaaugcuacagacacguggguaaccuaugguacauguucacaaaccggugaacauaggagagacaaacguucaguugcgcuggcuccacauguagggcugggcuuagaaacaagaacugaaaccuggaugucuucugagggagcauggaaacaaauacaacgaguagaaacgugggccuuacgacauccuggauuuacaguuaucgcguuauuccuugcgcaugcgauagggacgucaauuacgcagaaagggaucauauucaucuuguuaauguuggucaccccaucaauggcuaugagauguguuggcauagguaguagagacuuuguagaagguuuaaguggggccacauggguggauguaguauuagaacacggaucauguguaacaacaauggcuaaagauaaaccuacacucgauauugaguuauuaaaaaccgaagucacuaaucccgcgguacuccgaaaacuuugcaucgaggcgaaaauuagcaauaccacuacugacucucguugcccuacucaaggugaagcaacacugguggaggagcaagacgcaaacuucguauguaggagaacguuuguagauagaggauggggcaauggauguggguuauucggaaaaggaucguuaauuacgugugcgaaauuuaaaugcguaacaaaacuagaagguaaaauaguacaauacgaaaauuugaaauauucagugauagucacaguucacacuggggaccaacaucaaguuggcaaugaaaguacggaacauggaacaaccgcgacgauuaccccgcaagcgccuacaacugagauacaauugacugacuacggugcacuuacauuagauugcuccccacggaccggacuagauuuuaacgaaaugguucugcucacgaugaaagaaaaauccuggcucguacacaaacaaugguuccuggauuuaccacugccguggacauccggagcaagcaccucgcaagagacguggaacagacaagaucuuuugguuacuuucaaaaccgcccaugccaagaaacaagagguagucgugcuaggcucucaagaaggugcuaugcauacggcauuaacaggugcaaccgaaauacaaacgagugguacaacaacaaucuuugcaggacaccuuaaauguagacuaaaaauggauaaacugacgcuaaaagguaugaguuacguaauguguacugguucuuuuaaauuagaaaaagagguagcggaaacacaacacgguacaguucugguccaaaucaaguaugaagguacugaugcaccuugcaaaauaccauuuucuacacaagaugagaaaggcgucacacagaauggucgguugauuacagcuaaucccauagucacagacaaagagaaaccggucaauauugaagcagaaccaccguuuggugaaucuuauauuguaaucggagcuggagagaaggcuuuaaaacuaaguugguucaagaaaggcagcagcauuggaaaaauguucgaggcuacagcucguggcgcacgaagaauggcaauuuugggagauacugcuugggacuucggcaguaucgguggcgucuuuacgagcgucggaaaauuaguacaccaaaucuucgggacggcauaugguguucucuuuuccggaguuucuuggacuaugaaaauaggaauuggcguacuucuuacaugguuaggacuaaauucaagaaguacgucuuuaagcaugaccugcauagcuguaggauuagucacucuauauuugggaguuaugguccaggcagacucuggcugugucauaaauuggaaagguagggaacucaaauguggcuccggaauuuucguuacuaaugaaguacauacguggacugagcaguauaaauuucaagccgauucaccaaaaaggcuguccgccgcaauagggaaagccugggaagaaggugugugugguauuagaucagcaacgagacuggaaaauauaauguggaaacaaauauccaacgaauuaaaucauauucuauuggaaaacgacaugaaguuuacaguagugguuggagauguggcaggcauacuggcacaagguaagaaaaugauaagaccacaaccuauggaguacaaauauagcuggaagucaugggguaaagcuaaaaucauuggagcagacguacaaaacacaaccuuuauaaucgacggaccaaauacuccagaauguccugaugaucaacgugcauggaacauuugggaaguggaagauuauggauuugguauauuuacgacgaacauuuggcuaaaacuccgggacaguuacacgcaaguaugcgaccaccgccuaaugagugcagcuauuaaagacagcaaagcaguccaugcggauauggguuacuggauugagucagagaaaaaugaaacauggaaacuagcaagagccaguuucaucgaaguuaaaacuuguaucuggccaaaaagucauacacucuggucuaauggcguuuuggaaucagagaugaucauaccuaaaauuuacggcggaccuauaucucaacauaauuaucgacccgguuacuuuacucaggcggcagggccuuggcaccuagggaaacuagaguuagauuucgacuuaugugaaggaacgaccguagucgucgaugaacauugugguaauagagggccaucacuccgaacuacaacaguuacaggcaaaauaauccacgaauggugcugccgguccuguacguuacccccauuaagguucagaggcgaggacggaugcugguauggaauggaaauacggccaguaaaagaaaaagaagagaauuuaguaaaauccauggugucagcuggcucaggugaaguagauagcuuuagccugggacuacuuuguaucagcauuaugauagaagaaguaaugcgaucgagauggaguagacggaugcuaaugacggggacucuggccguguucuuucuacucauuaugggucagcuuacguggaaugauuuaauucgacuuuguauaauggucggagcgaacgcuucagacagaaugggaauggguacgaccuaucuagcacugauggcuacuuuuaaaaugagaccaauguucgcaguaggacuucuauuucggagauugacaaguagagaaguauugcuucuaaccauagggcugaguuugguagcaucuguugaguugcccaacucacuugaagaacucggcgaugggcuugcaaugggaauaaugauucuaaaguuacuaacggauuuccaaucgcaucaacugugggcgacacuacucaguuugacguucaucaaaacuacauuuaguuuacacuaugcauggaaaacuauggcaaugguccuuucgaucguaucuuuguuuccuuuaugccuuucaacaacaucacagaaaacuaccuggcucccgguucuacuaggcagccucggcugcaagccucuaacuauguuucuuauagcagaaaauaaaauuugggggaggcguucauggccuuugaaugaaggcaucauggcggugggaaucgugaguauacuauuaagcucacuacuaaagaaugacgugccacucgcgggaccucuaauugcaggaggcaugcuaaucgcuuguuacguuauaucuggaaguagcgccgaccucucgcuugaaaaggcugcugaaguaucgugggaagaagaagcggagcauagcggggcuucacauaauauauuagucgaaguccaggacgauggaacgaugaaaauaaaggaugaagaaagagaugauacuuuaacaauacuguuaaaggcaacacuauuagcgguuaguggaguauacccuuuaucuauccccgcuacgcuauuuguuugguacuuuuggcagaagaagaaacaaagaucuggcguccucugggauacuccuucaccuccagaaguugaacgggcaguauuagacgaugggauauacagaauaaugcaaaggggcuuauuaggcagaucucaaguggguguagggguguuucaagaaaacgucuuucacacaauguggcauguaacacguggagcgguccuaauguaucagggaaaaagacuggaaccauccugggcaucggucaagaaagaucuaauuagcuauggaggcggguggcgacuucagggaaguuggaacacuggugaagaaguacaggugauagcugucgaaccaggcaaaaaucccaaaaacguacagacagcaccaggcacauucaaaaccccagaaggugagguuggcgcaauagcacuggauuucaaaccugguacaagcgguucacccauagugaauagagagggcaaaaucguagguuuauacgguaacggagucguaacaacaagcggaacuuacguauccgcuaucgcacaagccaaggcaucacaagaaggacccuugccagaaauagaagaugaaguauuucggaaacgcaaccuuacgauuauggacuuacauccuggauccgguaagacgaggcgcuauuuaccagcaaucguaagagaggcuauuaaaaggaaacuucgaacacuuauccuggcaccaacaagaguaguagcuucugagauggccgaagcguugaaagggaugccgauacgauaccaaacuacagcgguuaaaucagagcacacaggaaaagaaauaguugaucuaaugugucacgccacuuucacaaugagauuacuaucaccuguacgagugccuaauuacaauaugauaaucauggaugaggcacacuuuaccgauccuuucucgauugcagcacgagguuacaucagcacacgaguuggcaugggugaggcagcagcaauauucaugacagccacaccaccuggaagugucgaggcuuuuccacaaucaaacgccguaauccaagaugaagaacgagauauaccggaaaggucguggaacaguggauaugaguggauuacugauuuuccuggcaaaacagugugguuuguuccaucaauuaagagcggaaaugacaucgcaaacuguuugaggaaaaacggaaaaagaguaauacaacuaucucggaaaacauucgauacggaauaccaaaagacuaaaaacaacgauugggauuauguaguaaccacagauauuagugagaugggggcaaacuuuagagcagaccgugucaucgacccuagacgguguuuaaaaccaguaauccuaaaggacggacccgagcgagugauacuggcaggucccaugccggucacaguagcguccgcggcacaaagaagagggagaaucggucguaaccacaauaaagaaggagaccaauauauauauauggggcaaccguugaauaaugacgaagaucacgcccauuggacggaagcaaagaugcuuuuagauaauaucaauacuccagaaggaauuauaccugcccucuucgaaccggaacgagagaaaucggccgcuauugauggugaauaccguuuaagaggagaagcgaggaaaacauucguugaacuaaugcgaaggggcgacuugcccgucuggcuaucuuacaaagucgccagugaaggauuccaauacucugauagacggugguguuuugauggggaaaggaauaaccaagucuuggaggaaaauauggauguggaaauuuggaccaaagaaggagagcgaaagaaguugagaccucgcuggcucgacgcccgcacuuauucagauccccucgcacucagggaauuuaaggaauuugcugccggacguaggaguguaagcuccgaucuuauacuugagauuggcaaauuaccacagcaucuaacgcagcgagcacaaaaugcuuuagauaaccucguuaugcuucauaauucagaacaaggaggaagggcguauagacaugcuauggaggaacucccagauacaauagaaacacuaauguugcucgcucuaauagcaguacucaccggcggaguaacauuguuuuucuugucggguagaggacuagggaaaacaaguaucggacuuuugugugugauggccagcuccguguuacuuuggauggcgucaguagaaccacacuggaucgcugccaguauaauuuuggaguucuucuuaauggugcugcucauuccagaaccugauagacaaagaaccccgcaagauaaccagcuagcauacguaguuauagggcuccuauuuaugauacuaacaguagcggcaaaugagauggggcucuuggaaacaacuaaaaaggaucucggaauaggucauguggcaguagaaaaccaucaccacgcugcaaugcuggauguugacuugcauccugcaucagccuggacguuauaugcaguagcgacuacaauaauuacaccaaugaugaggcauacaaucgaaaauacaacagcaaauaucagucucacugcaauagcuaaccaggcugcaauucugaugggacuagacaaagguuggccaauuaguaagauggacauaggcguuccucucuuagcauuaggaugcuacucacaaguuaauccguugacguuaacagcagcaguauuaaugcuaguagcucauuacgcuaucauugguccugguuugcaagcuaaagccacgcgugaagcgcaaaagcguacugcggccgguauaaugaaaaacccuacuguagauggaauuguggcaaucgaucuugaccccguaguuuaugaugcaaaauuugagaaacaauuggggcaaauaauguugcuaauauugugcacuucacaaauauuauuaaugagaacuacgugggcucugugugaaucaauaacccuagcaaccgggccucuaacaacucuaugggaaggaucgccaggaaaauuuuggaauacuacgaucgccgucucaauggccaacauauuccgggguucguauuuagccggagcuggauuagcuuuuucacuuaugaagucucuaggggguggcaggcgaggcacaggugcucaaggagaaacucuaggagaaaaauggaaaaggcaacucaaucaauuaaguaagagcgaguucaauacuuauaaaagguccggcauaauggaaguagaccgcucagaagcaaaagaaggauugaaacgaggagaaacgacuaagcacgcagugucucguggaacagcgaaguuacggugguuuguggagaggaauuugguuaaaccagaaggcaagguuauugaucugggguguggccggggagguugguccuauuacugugcuggucuaaagaaagucacagaaguaaaagguuauacuaaaggagguccaggacaugaagaaccuaucccuauggcuacauauggcuggaaucuuguuaaacuucauaguggaaaggauguauucuuuauaccaccagagaaaugcgacacacuauuaugugauaucggagaaucaagcccuaauccuacaauugaagaaggacgaacguuacgcguacucaaaauggucgaaccauggcugcggggaaaccaauucuguaucaaaaucuuaaaucccuauaugccaagugucguagaaacucuagaacaaaugcaaagaaaacacggggguaugcucgugagaaacccauuaagccgaaauucaacucaugaaauguacugggucucuugcggcacaggaaacauuguaucagcuguaaauaugacaucgaggaugcuuuuaaauagguuuacaauggcacauagaaaaccaacauaugaacgagacguugaucuaggggcggguacgcgacauguagccguagaaccagaaguagcaaaccucgauauuauuggacagagaaucgaaaacaucaagcacgaacauaaaucgacguggcauuaugaugaagacaauccguacaaaacaugggcguaucacgguucuuacgaagucaaaccaagcgggucagcuagcuccaugguuaacggaguggucaagcuauuaaccaaaccaugggacguuauucccauggucacacaaauagcaaugacagacacuacaccauuuggucaacaacggguauuuaaggaaaagguagauacuagaacccccaaagcgaaaagagguacugcacagaucauggaaguuacugcaaaauggcuuuggggcuuucuuucaaggaauaagaaaccacgcauauguacacgcgaagaguucacccguaagguuaggagcaacgcagcaauaggagcuguguuuguugacgagaaucaauggaacucagcuaaagaagcaguagaagaugaacgauuuugggaucucgugcacagagaaagagaguuacauaagcaaggaaagugcgcaacuuguguauacaacaugauggggaagagggagaagaaauuaggugaauuugguaaagcgaagggcagucgcgcaauaugguacauguggcuaggagcaagauuucuggaguucgaggccuuaggauuuaugaacgaggaucauugguuuagcagggaaaauucauuauccggaguggaaggugaaggauuacauaaauugggguacauacuaagagauauaaguaaaauaccaggaggcaauauguacgcugacgauacggcggguugggacaccagaaucacagaagacgaccuccaaaacgaagcgaggauaacugauaucauggaaccagaacaugcacuacuagcaaaaaguaucuucaaacuaacauaucagaacaagguaguacgagugcaacguccggcuaaaaacggcacaguuauggauguaauaucaaggcgugaucagaggggaagugggcaaguagguacuuauggguuaaacacguuuacuaacauggaagcacaacuaaucagacaaauggaaucagaagguauuuucucacccagcgaacuggaaacucccaaccuugcagaaaggguacuagauuggcuggagaaguacggcguagaacgacuuaagcguauggcaauuaguggcgacgacuguguuguuaaaccaauugacgauagauucgcaacggcacuaacugcgcuaaaugacaugggaaaaguaaggaaggacauuccacaaugggagccuagcaaaggguggaacgacuggcaacaaguuccuuuuuguagccaucauuuucaucaguuaauaaugaaagacgggcgugaaauuguugugcccuguagaaaccaagaugagcuggucgggagggcuagaguaucacaaggagccggguggagucugcgagaaacggcauguuuagguaagucuuaugcacagauguggcaacucauguauuuucaccgucgggaucuucgauuagcggcgaacgcaauaugcucugcgguacccguagacuggauaccaacaaguagaacaacuuggaguauacaugcgcaucaucaauggaugacgacugaagauaugcucucaguuuggaacagaguguggauugaggaaaaucccuggauggaagacaagacacauauaaguaguuggggugacgugccguacuuagggaaaagagaagaucaguggugugguucucucauugguuuaacugcgagggcaacuugggcaacuaauauacaaguagcaauuaaccaagucagacgcuugauagguaaugaaaacuaccucgacuacaugacaucgaugaaaagauuuaaaaaugaaucagacccagagggagcuuuaugguaa

SEQ ID NO: 21648 - RNA, 9879 nt, Artificial Sequence
  derived and/or modified CDS sequence (opt6) from DENV-1__FJ898383__SS-prME
ucuguaacaauguuacuaauguuaaugccgacugcacuugcguuccaccuuacuacgcgaggaggagaaccucauaugauaguuuccaaacaagaaagggguaagagcuugcuuuuuaaaacaagcgcaggaguaaauaugugcacguuaauugcuauggauuugggggaauugugugaagauacgaugacuuacaaauguccaagaauuacugaaacagaaccagacgaugucgacuguugguguaacgccacggauacauggguaacauauggaacaugcagucaaacaggcgagcaccgacgagacaaaagauccgucgcucuggccccucacgucggacucggauuagaaacuaggacggaaacuuggaugucuucagagggagcuuggaaacaaauacaaagaguagaaacgugggccuuaagacacccaggauucacaguaauagcacucuuucuagcucacgcaauaggcacaagcauuacucaaaaagguauuaucuuuauuuuacucaugcuaguuacaccgucaauggcaaugagaugcguagguauagguucccgggacuuugucgaaggcuugucaggggcaacauggguagauguuguucucgaacacgguucaugcguaaccacaauggcuaaagauaaaccgacuuuggacauugaacuacuuaaaacggaaguaacuaauccagcuguauuaaggaaacucuguauagaggccaaaauaagcaauacaacaacugacagccgcugucccacucaaggugaagcuacguuagucgaagaacaagacgcgaauuuuguaugccgaagaaccuuugucgauaggggcugggggaacggcuguggacucuucggcaaaggcucacuuauuaccugcgcaaaauuuaaauguguuacuaaauuagagggaaaaauuguucaauaugaaaacuugaaauauagcguaauugucacaguccacacuggugaucaacaucaaguuggaaaugaaucuacagaacacggaacuacugcaacaauaacaccucaagccccaacaacugaaauccaacuuacagauuauggggcuuuaacauuggacuguaguccacgaacggggcuagauuucaacgagaugguauugcuaacaaugaaagaaaagaguugguuaguacauaaacagugguuccuagaucuaccauuacccuggacaagcggugcaaguaccucgcaagagacauggaauagacaggacuuguugguaaccuuuaaaacugcacacgccaagaaacaagaaguagugguacuugguagccaagaaggcgcaaugcacaccgcauugacuggugcgacugaaauucagaccuccgguacgaccaccaucuuugcagggcacuuaaaauguagacugaagauggacaaacuaacacuaaaaggaaugaguuauguaaugugcacaggcagcuuuaaacuagaaaaggaagucgccgaaacucaacacggaacgguucuuguacaaauaaaauaugagggcacugaugccccgugcaaaauaccuuuuuccacgcaggacgaaaaaggcgucacgcaaaauggacgccuaauaacagcaaacccaauugucacugacaaagagaagccuauaaauauagaagcugagccgcccuucggagaaagcuacauuguuauaggugcaggggaaaaagcucuaaaacuuaguugguucaagaaagguuccaguaucgggaaaauguucgaggcaacagcucgaggagcgagacgaauggcgauucugggcgacacagcaugggauuuuggaaguaucggagggguauucaccagcguuggcaaauuaguucaccagauauucgguacagcguaugggguucuuuucagcggaguuagcuggacaaugaaaauaggcauagguguacuucuaaccugguugggauuaaacuccagaucuacaucauuaucaaugacaugcauugccguaggucuuguaacacuauaucuuggggucaugguacaagcagacucgggcuguguaauaaauuggaaagguagagaacuuaagugcgggucugguauuuuugugacaaaugaaguacauacauggacagagcaguacaaauuucaggcugauucucccaaaagauuaagcgcggcgaucggaaaggcaugggaagagggaguguguggcauucguagugcaaccaggcucgagaacaucauguggaaacaaauaucaaacgaacuaaaucauaucuuacuagaaaaugauaugaaauuuacaguugugguaggcgacguagcagggauucuagcccaaggaaagaaaaugauucguccacaaccgauggaauacaaauauucuuggaaaagcuggggaaaagcaaaaauaauuggggccgacguacaaaauacuaccuuuauuauagauggaccgaauacacccgaaugcccugaugaucaaagagcauggaacauaugggagguagaagauuauggauucggaauuuuuacaacuaacaucugguuaaaacuccgagacucauauacacaggugugugaucacagacuuaugagugcagcuauaaaagauuccaaagcugugcaugcggacaugggguacuggauagagucagagaaaaaugaaacuuggaaauuagcacgagcaucauuuauugaagucaaaacguguauauggcccaaaagucacacacuauggucgaauggaguccucgagagugagaugaucauuccaaaaauauacgguggaccuauaucacagcacaauuaucgcccggguuacuuuacacaggcugcaggaccuuggcaucuaggaaaguuagagcuagacuucgauuuaugcgaaggcacaacuguugugguagaugagcauugcggaaauaggggacccagcuuacgaaccacaacuguuacagguaagauaauacaugagugguguugcagauccuguacacuuccgcccuuaagguuuaggggcgaagauggauguugguacggaauggaaauacgucccguuaaagagaaagaagagaaccuaguaaaguccauggucagugcggguucuggcgaaguagauagcuuuagccuaggccuacuaugcaucucuaucaugauagaagaaguuaugagaucaagauggucaaggcggauguuaaugacaggcacauuagcagucuucuuucuacuuauaaugggccaauuaacuuggaaugaucuaauaagacuaugcauuaugguaggcgcaaacgcuagugauaggaugggcaugggcacgacauauuuagcacugauggcuacauuuaaaaugcgacccauguuugcaguuggacucuuauuccggagacuaacaucaagggaaguucuacuuuuaaccauagguuuaagccuaguugcgucuguggaauuaccaaacucccuugaagaguuaggggauggauuggcaaugggaauuaugauucucaaacuacuuacagauuuucagucucaccaauuaugggcuacacuacuuucauugacauucauaaaaacaacauuuucccuucauuaugcauggaaaacaauggcaaugguacuuaguauagucagcuuauuuccauuaugcuuauccacuacuucgcagaaaaccacaugguugccaguauuauuaggcucacucggaugcaaaccacuaacuauguuccucaucgccgagaauaaaauaugggguagacgaagcuggccacugaacgaggggauaauggcagucggcauagucucuauuuuauuaagcagucuccugaagaaugacguaccgcuagcugguccacugauugcaggcggaauguugauagcguguuacguaauaucaggaaguucugcugauuugagccuagaaaaagcagcagaaguuucaugggaagaagaagccgaacauuccggugccagucacaauauuuuggucgagguucaagacgauggaacuaugaaaauuaaagaugaagagagagaugauacgcuuacaaucuuacuaaaggcuacauuauuagcaguuuccggcgucuauccccuaucgauucccgccacucuuuucgugugguacuuuuggcagaagaagaaacaaagaaguggcguucucugggacacacccuccccaccagaagucgaaagagcggucuuagacgaugguauauacaggauaaugcagcgcggucuguuaggccggagccagguaggagucgguguuuuucaggaaaaugucuuucacacaauguggcacguaacccgaggagccgugcucauguaucaaggaaaaagacuggaaccgagcugggcaucaguaaagaaagaccuaaucucauauggagggggauggagacuccaaggaucauggaacacaggagaggagguccaaguaauagcaguagagccaggcaaaaauccgaaaaacguccaaacugcaccgggaacauucaaaacaccggaaggggaaguaggagcaauugccuuagauuucaaaccugguacguccggaaguccaauaguaaauagagaaggaaaaauuguaggccuauacggaaauggaguugugacaacuuccggaaccuacgugucagcaauagcacaagcuaaagcuagucaagaaggaccccuacccgaaauagaggacgaaguauucagaaaaaggaauuuaacaauaauggaucugcaccccggaagcgguaaaacuaggagauaccucccugcaaucguccgcgaagccauuaaaagaaaauuacggacucuaauccuagccccuacucguguagucgccagcgagauggcagaggcacugaaaggaaugccaauacgcuaucaaacaacugcuguuaagagugagcauacuggaaaagaaauagucgauuugaugugucacgcaacauuuacuaugagacucuuauccccggugagaguaccaaauuauaauaugauaauuauggaugaagcucauuuuacugauccgagcagcauagcagcacgaggcuauauaucaacucgcguaggaaugggagaagcggcugcuauauucaugacugcaacaccaccagguuccguagaggccuuuccacaauccaacgccguaauacaggaugaggagcgagauauaccagagcguagcuggaacucagguuacgaauggauaacagauuucccuggaaagaccguaugguucguaccuucuaucaagagcggaaacgauauagcuaauugucuaaggaaaaaugguaaaagaguaauacaguugucuagaaaaacuuuugacaccgaauaccagaaaacgaaaaauaacgacugggacuauguggugacuacagauaucagcgagaugggagcgaauuuccgcgccgacagaguaauagacccgagacgcuguuuaaaacccguuauucuuaaggauggaccagaaagggucauacucgcagggcccaugccagugacaguagcuagugcagcgcaacgaagagggagaauaggaaggaaucauaauaaagagggagaccaauauauauacaugggucaacccuugaauaaugaugaagaucaugcgcauuggaccgaagcaaaaauguuauuagauaacauaaacacaccggaggggauuaucccugcccuauuugaaccugagcgagagaaaagcgcugccauugauggagaauacaggcuacgaggagaggcaaggaaaacuuucguugaauuaaugagaagaggagaccugccaguauggcuaucguacaagguagcaucagaaggguuucaauauucugacagaagauggugcuuugauggagaacguaauaaccaaguucuagaggaaaauauggauguagaaaucuggacgaaagaaggggagagaaagaaacuccguccucgauggcucgaugcuagaacauauucugauccuuuagcauuaagggaauuuaaagaauuugcggcggguaggaggucugucagcggugaccugaucuuagaaauaggaaaauuaccacagcaccugacacaaagagcacagaaugcccucgauaauuugguaauguuacauaauucagaacaaggcggucgagcguacagacaugcuauggaagaacuuccagacacuauagaaacacuaauguuauuggcgcucauagccgucuugacaggugguguaacacucuucuuucuaagcggccggggccugggaaaaacaucuauaggcuuacuuugcguuauggcgucaucaguauuacuguggauggcuucaguagaaccucauuggauugcggcuaguaucauuuuagaauuuuuccuaauggucuuauuaaucccugaaccagauaggcaaagaacuccacaagauaaccaacuugcguauguuguuauuggacuauuauuuaugaucuuaaccguugcugcaaaugaaaugggucuauuagaaaccacuaagaaagaucucggcauaggucacguagcgguagaaaaccaucaccacgcagccauguuggauguagaucuucauccggcuuccgcauggacccuauacgcuguugcaacgacaauaaucacaccuaugaugcgacacacaauagaaaauacaacugcgaacaucucacuaacugcaaucgcuaaccaagcagcaauauuaauggguuuagauaaaggauggcccauaucaaaaauggauauaggagugccucuauuggccuugggaugcuacucgcaaguaaauccauuaacucuuacugcagcgguucuaaugcuaguagcacacuacgcgauaauagguccaggccuacaagcgaaggcaacacgggaagcacaaaagagaacagcugcugggaucaugaaaaaucccacgguagaugguauuguggcaauugaccuggacccugugguuuacgaugcaaaauucgaaaaacaauuaggucagauaaugcugcuaaucuuguguacaucacagauucuauuaaugaggaccacgugggcacuaugcgaaagcauuacacuugccacuggacccuuaacgacacuuugggaaggguccccuggcaaguucuggaauacaacgauagcaguaaguauggcaaauauauuucgugguagcuaucuagcgggcgcaggcuuggcauuuucauuaaugaaaucacuagguggggguagacgagguaccggagcacaaggagagacgcuuggcgagaaguggaaaaggcaacuaaaucagcuaagcaagagugaauuuaacacauauaagcguaguggaauuauggaagucgauaggagugaagcuaaagaaggccuaaaacgcggagaaaccacuaagcacgcagugucuagaggaacggcuaaguuaagaugguucguagagcgaaacuuaguuaaaccugagggaaaaguaaucgaucugggguguggacggggagguuggaguuacuauugugcaggacucaaaaagguuacagaagugaaaggauauacgaaaggaggaccgggacacgaggaacccauacccauggccaccuacgguuggaauuuaguaaaguuacacucagggaaggauguuuucuucauuccaccagaaaaaugcgacacacugcuaugcgauaucggcgaaagcagccccaauccgacaauagaagaaggaagaacucuaaggguacuuaaaauggucgaaccuuggcuucggggaaaucaauuuuguauuaaaauauugaauccuuacaugcccucaguaguugagaccuuagaacaaaugcaaagaaaacacggaggaaugcuagugagaaauccacuaucacgcaacucgacacaugaaauguacuggguaucgugugguacaggaaauauaguuucagcaguaaacaugacaucucggauguuauuaaauagauucacuauggcucauaggaaaccuacauaugaacgggauguugauuuaggcgcgggaacaagacaugucgcaguagaaccagagguggcgaauuuggauaucauuggacaaaggauagaaaacauaaaacacgaacauaagaguacauggcacuaugaugaagauaaccccuauaagacaugggcauaccauggcucauaugagguuaagccaaguggaucagccagcuccaugguaaacgggguugucaaguuauuaacaaagccgugggauguaauaccgauggugacacaaauagcaaugacagauaccacgccuuucggacaacagcggguuuucaaggagaaaguagacacgcgaacaccaaaagcgaaaaggggaacugcacaaaucauggaaguaaccgcgaaaugguuguggggauuucuauccaggaacaaaaagccaaggauauguacuagagaagaauuuacccguaaggugagguccaaugcagcaauaggagcaguauuuguagacgaaaaccaguggaauagcgcuaaagaagcuguagaagacgaacguuuuugggaucugguacacagagaacgggaauugcacaagcagggaaaaugugcuacauguguuuacaauaugauggguaagagagagaagaaauugggcgaauuugggaaagcuaagggaucgagagcaauaugguacauguggcucggcgccagguuuuuagaauuugaggcgcugggauuuaugaacgaggaucacugguuuagcagagaaaauucuuuauccgguguagaaggagaaggacuccauaagcuaggguacauauuacgagacaucaguaaaauaccaggaggaaacauguaugccgaugauaccgcagggugggacacuagaaucacugaagaugauuuacaaaaugaagcacgaauuacggauauaauggaaccggagcacgcucuacuagcgaagucgaucuucaagcuaacguaccaaaauaaggugguaagaguucaacgcccugcuaaaaaugggaccguaauggauguaauaagucgcagagaccaaagaggcuccggacaggugggcacguauggccucaacacauuuacaaauauggaagcccaacuuauucgacaaauggagucagaagguauauucuccccuagcgagcuagaaacgcccaaucuagcugaacggguuuuagacugguuagaaaaguacggaguggagagacuaaaaagaauggcaauaaguggcgacgacugcgucguuaagccuauagaugaucgauuugcaacugcgcucacagcguugaaugauaugggaaaagugaggaaggacauaccacagugggaaccgaguaaagguuggaacgauuggcaacaaguuccuuuuuguagccaucauuuccaucaacuuauuaugaaggacggcagagagauaguggucccaugcagaaaucaggaugaacuggucggcagagcgagagucucucaaggagccgguuggucacuucgagagacggcgugcuuagggaaaucauaugcucaaauguggcaguuaauguauuuccaccguagagacuuacgcuuggcggcgaaugcaaucuguagugcaguaccaguugacuggauaccaacaucaaggaccacuuggucaauucaugcacaucaucaguggaugacaaccgaagauaugcuaucagucuggaaucgaguuuggauagaggaaaauccuuggauggaagacaaaacacauauaucuucguggggugauguaccauaucuagggaagagagaggaccaguggugcggaucguugauuggguuaacugcacgugcuacaugggcgacaaacauacagguugcgaucaaucagguacguagacucaucgguaacgagaacuacuuggauuauaugacaaguaugaaaagauuuaaaaaugagagugauccggaaggggcacucugguaa

SEQ ID NO: 21649 - RNA, 9879 nt, Artificial Sequence
  derived and/or modified CDS sequence (opt6) from DENV-1__FJ898384__SS-prME
agugugacaaugcuacuaaugcuaaugccaacggcauuagcuuuccauuuaacuacacgagggggagaaccucauaugauaguaaguaaacaagaacgagggaaaucucugcuuuuuaaaacuucagccgguguaaauaugugcacacuaauugcaauggaucuaggagaauuuugcgaagacacuaugacauauaaaugcccaagaauuacagaagcggaaccagaugauguagauuguugguguaacgcaacagauacauggguuaccuaugguacauguucccaaacgggugaacauagacgggauaaaagaucgguggcuuuagcuccccauguaggauugggccuagaaacucgaaccgaaacauggaugucuucagaaggcgccuggaaacaaauucagcgagucgaaacaugggcauuacgacacccaggauuuacaguaaucgcaauauucuuagcacaugcaauugguaccaguauuacgcaaaagggaauuaucuucauuuuacugaugcuaguaacuccaucaauggcaaugagaugugugggaauagguucuagggauuuuguugaaggucuaucuggagcaacauggguagacgugguccucgaacacggauccugcguaaccacgauggcaaaagauaagccgacguuagacauagaauuauugaagacggaaguaaccaauccagcuguucugagaaaacuauguauagaagcgaaaaucucuaauacaacuacagacagucgauguccuacucaaggagaagcaacgcugguagaagaacaagaugcuaauuuuguaugcagacgaacguuuguugauagaggcuggggaaauggaugugguuuguucgggaaaggaucuuugauaacgugugcaaaauucaaaugcgucacuaaguuagaaggcaaaauagugcaauaugaaaaucuaaaauauagugucauuguuacaguacacacaggagaucaacaucaaguuggcaaugaauccacagaacauggaacaacagcgacuauaacaccacaggccccauccacggaaauacaacucaccgauuauggugcauuaacacuagacugcagcccaagaacaggcuuggauuucaaugagaugguauuacucacgaugaaggagaaaucgugguuagugcacaaacaaugguuucuagaccuaccacucccauggacuucuggagcaucaacaagucaagaaaccuggaaccgccaagaccuccuaguaacauucaagacggcucacgcaaagaaacaagaaguuguggugcuagguucccaagaaggagcaaugcauacagcccuaacaggggcuacagagauucaaacgucaggcacuacgacgauuuuugcuggucacuuaaaauguagacugaaaauggacaaacuuacauuaaaagguaugaguuaugugauguguacaggaucuuucaaacuugaaaaagagguggcggaaacacaacauggcacgguucucguacaaaucaaguaugaagguacugaugcccccuguaaaauaccauucagcacacaagacgagaagggaguuacacagaacggaagacuaauaacagcaaacccaaucguaaccgauaaggaaaaaccuguaaauaucgaagcagaaccacccuucggcgaguccuacauaguuauuggggccggagagaaagcucuaaaacuauccugguuuaagaaagggucuucgauugguaaaauguuugaggcgacagcuaggggagcaagaagaauggcuauacuaggggacacagcgugggacuuuggcaguauugguggaguuuuuacaucuguuggaaaauuaguucaucagauauucgggacagcuuacggcguauuauucucuggcgugaguuggacaaugaaaauagguaucggagugcuacuuacauggcuaggguuaaauucucggagcacaaguuuaucuaugaccuguauagcugugggguugguuacucuauaucugggagucaugguacaggcagacagcggaugcguaaucaauuggaagggacgugaacuaaaguguggaucagguauauuuguaacuaacgagguacacacauggaccgaacaauacaaguuucaagcggacucgccaaaaaggcuaucugcagcaaucgggaaggcuugggaagagggcgucuguggcauuagaucagcuacgagauuggaaaacauaauguggaaacaaaucucuaaugaguuaaaccacauauuauuagagaacgauaugaaauuaacaguaguaguaggagauguugccgguauauuggcucaggggaagaaaaugauaagaccccagccaauggaguauaaauacucauggaaaaguuggggaaaagcaaagauaauaggugccgauguacagaacacaacguuuauuauugacggcccuaauacaccugaauguccagaugaccaaagagcauggaacauuugggagguugaagauuacggauuuggaauuuucacuaccaauauuugguuaaaacuuagagacucguacacucaaguuugugaucauagauuaaugucggcugcaauaaaggacaguaaggcgguucaugcagauaugggguauuggauagagagugagaaaaaugaaacuuggaaguuagcuagggcauccuucauagaagucaaaacaugcauuuggccaaaaucucauacgcuuuggucgaacggaguuuuagaaagcgaaaugaucauuccaaaaauuuauggagggccaaucagccaacauaacuauagacccgguuacuuuacacaaacagcaggcccauggcauuuaggaaaguuggaacuggauuuugauuugugcgaaggaaccacaguuguuguagaugaacauugugguaaucgaggaccuuccuuacgaacuacgaccguuacaggaaagauuauccaugaauggugcuguagaucaugcaccuuaccucccuuacguuuuaagggugaagacggauguugguauggcauggagauccguccugugaaagagaaggaagaaaaucuaguaaagaguaugguaucagcaggcaguggugaaguugauucauucucuuuaggacugcuaugcauaucaauaaugaucgaggaagugaugagguccagauggagucggaaaauguugaugacaggcacauuggcagucuucuuucuucugauaaugggucaguuaacuuggaaugauuuaauaagacuaugcauuauggugggagcuaaugcaagugaucgaauggguaugggcacaaccuaucuugcguugauggccacguucaaaaugagaccaauguuugcaguaggacugcuauuuaggcgcuugacuucaagagaaguguugcuguuaacaauaggucugucacucguagcuucuguugaauuaccuaauuccuuagaagaauuaggcgauggucuugcaaugggaaucaugauuuuaaaauugcuaacggacuuccaaagucaucagcuuugggccacuuugcuuaguuuaaccuuuauaaggacaacauuuagucuccacuaugcuuggaaaaccauggcaaugguauuauccauugucuccuuauuuccccuuugccuaaguacaacuagccaaaagacgacauggcuaccaguuuuacucggaagucucgggugcaaaccucuuacgauguucuuaaucgccgaaaauaaaauuuggggcaggaaaucauggccacugaaugaagguauuauggcaguagguauaguaucaauccuucuaaguucuuuacucaaaaacgauguaccccuugcaggaccacugauagcaggaggcauguuaauagcuugcuacguuauuucagggaguagcgcugaucuuagucucgagaaagccgcugagguguccugggaagaagaagccgaacauuccggggccucccacaauauauuggucgaaguucaagaugacgguacgaugaagaucaaagaugaggaacgagacgauacucuaacgauuuuacuaaaagcaacacuacuugcaguuaguggaguauauccauuaaguauaccggccacauuguucguuugguauuucuggcagaagaagaaacaaaggucugguguauuaugggauacuccaucuccgccugaaguagaacgagccguccucgaugacggaauauauagaaucaugcaaaggggguuacuaggucguagucagguagguguugguguauuccaagagaauguauuucacaccauguggcacguaacucguggugcaguacuaauguaucaaggaaaacggcuugaaccaaguugggccucugucaagaaagaccuaauaaguuacggcgguggauggaggcuucaagguuccuggaauacuggcgaagaaguccaaguaauagccgucgaacccggcaaaaaccccaaaaauguucaaaccgcaccgggaacguuuaaaaccagcgaaggugagguuggggcaauagcucuggauuucaaaccagguacauccggaaguccaauugugaauagagagggaaaaauuguaggucuguaugggaacggagucgugaccacaaguggaacauacgugucugcaaucgcacaggccaaagcaagucaagaaggccccuuaccggaaauugaagacgaggucuuuaggaaacgcaauuugaccaucauggaucuacacccagguaguggcaaaacacggagguaucucccggcaaucguaagggaagcaauaaaaagacgcuuacggacucucauauuagcucccacacgggucguagcaucagaaauggcagaggcacucaagggaaugcccauacgauaucaaacuacggcugucaaauccgagcacacaggaaaagaaauuguagacuuaaugugccacgcaacauuuacaaugagacuauugagucccguuagagugccgaauuacaacaugauaauaauggaugaagcgcacuuuacagacccaucgagcauugcagccagaggauauauaucaacccgcgugggaaugggugaagcagcagcaauuuucaugacagcgacaccucccggaucaguagaagcauucccucaaucaaaugccguaauucaagacgaagaaagagacauuccagagagaucuuggaacucuggcuacgaauggaucacugacuuuccggguaagaccguaugguucguaccguccauaaaaagugggaaugauauugccaacugccuuaggaaaaauggaaaacgcguaauacaauuaagucguaaaacauuugauacagaauaucagaaaacgaaaaauaacgacugggacuacguaguaacaacagauauuagcgagaugggagcuaacuuucgggcagacaggguuaucgaccccagacgaugucuaaaacccgugauuuuaaaggacggccccgaaagaguuauacuggccggaccaaugcccguaacaguagcaagugcagcccagcgaagaggaagaauaggaagaaaucacaauaaagaaggggaucaauacauuuauaugggucagccgcucaauaaugacgaagaccaugcacauuggaccgaggccaagauguuauuggacaauauaaauacuccagaggguauaauuccugcccuauuugaaccugaaagagagaaaagcgcagcaauagauggagaauauagauuaaggggcgaagcacgaaagacuuucgucgaacuuaugaggagaggagacuugccaguauggcuuaguuacaaaguagcuucagagggguuucaguacagcgaucgcagauggugcuuugacggggagagaaacaaucaagugcuagaagagaacauggauguugaaauuuggacaaaggagggugagcguaaaaaguuacgaccgagguggcuagaugcacgaacauauuccgacccacuagcccugcgagaauuuaaggaauuugcagcuggacgacgaaguguauccggagauuuaauauuagaaauaggcaaguuaccucaacaccuuacacaaagagcacaaaaugcccuggacaauuuagugaugcuacacaauucagaacaagguggcagagcauacaggcaugcgauggaagaauugccugauacaauugaaacccugauguuguuagcauuaauugcuguucuaaccggcggagucacauuauucuuucuaaguggucgcggacuuggaaaaacuuccauuggguuauuguguguaauggcaucuagcguauuacuuuggauggccucaguagaaccgcacuggauugccgcguccauaauauuggaauuuuucuuaauggucuuguuaaucccagaaccagauagacaaagaaccccucaggauaaccaacuugcauauguugucaucggcuuacucuuuaugauacuuacuguagcugcaaaugaaauggguuuacuagaaaccacuaagaaagacuuaggaauuggacauguggcggucgagaaccaccaccaugcggcuauguuagacguagauuuacauccugcuagcgcauggacucucuacgcuguagccacaaccauuauuacuccaaugaugcggcacacuauagaaaauacuacugcgaacaucagccuaacugcaaucgcuaaucaagcagcaauucuaaugggccucgacaaaggcuggccaauaagcaaaauggacauuggagugccauugcuggcauuaggcugcuacucacaaguaaacccauuaacccuuacggcugcgguguuaaugcuaguagcccauuaugcaaucauagguccaggccuucaagcaaaagcuacacgggaggcucaaaaacggacagcagccgggauuaugaaaaauccgacaguugacggaauaguagcaauugaccuagauccuguuguuuaugaugcgaaguuugaaaaacaacuaggccaaauuaugcuauuaauacuauguacuucucaaauucuauuaaugcguaccacuugggcucugugugaaucaauaacacuugcgacaggaccacuaaccacauuaugggaggggucgccaggaaaauuuuggaauaccacaauagcaguaucaauggccaauauauuuagaggcucauaccuagcuggagcagggcucgcuuuuagucuaaugaaaucgcucggaggagguagaaggggcacgggcgcgcagggggaaacauugggagaaaaguggaagcgacaauugaaucagcuuucuaagagugaguuuaauacauauaaacguucagguauaauggaaguagauagauccgaggcuaaagaaggauuaaagagaggagaaacgacuaaacacgcugucucuagggggacugcuaaauugagaugguuuguggaacgcaauuuaguuaaaccagagggaaaagugauugacuuggggugcggucggggaggcuggucuuauuauugugcuggacuuaagaaggucacagaagucaaaggcuauacgaaaggagggccaggacaugaagaaccgauacccauggcuaccuacgguuggaaucuagugaaguuacauucaggaaaagauguauucuuuauaccaccugaaaaaugugacacacuucuuugcgacauaggagagagcaguccuaauccaacuauagaagaagguaggacacugagaguuuugaagaugguugaaccguggcuaagagguaaccaauuuuguauuaaaauauuaaauccuuacaugcccuccguaguugagacuuuagagcagaugcaacgcaaacauggugguauguuggugcguaacccacuauccaggaacaguacacacgaaauguacuggguaucuuguggaacggguaacauaguaucugcuguaaauaugacaaguaggauguugcuaaauagguucacaauggcacaccgaaagcccacauaugaaagggauguggaucucggagcagguacuagacauguggcaguugaacccgaggucgcaaauuuagacauuauaggacaacgaauagaaaacaucaagcacgaacacaaaaguacauggcauuacgacgaagauaacccuuauaagaccugggcauaucacggaaguuaugaaguuaagccuaguggauccgcaagcucaaugguuaaugggguaguaaaguuauugaccaagccaugggacguaauaccaaugguuacgcaaauugccaugacagacacaacuccuuucggucagcagagaguauuuaaggaaaaaguagacacgagaacgccuaaggcaaagagggguacugcacaaauaauggaaguaacagcaaaguggcuguggggguuucuaucaagaaauaagaagccaaggauaugcacaagagaggaauuuacccgaaaaguacgguccaaugcugcuaucggagcuguauuugucgaugaaaaucaguggaacucagcuaaagaggcaguugaagaugaacgauucugggauuuaguacacagggaaagagaacuccauaagcaagguaaaugugcgacgugcgucuauaauaugaugggcaagagagagaagaaacucggugaauuugguaaagcgaaagguucucgugcgauaugguauaugugguuaggagcucgauuucuagaguucgaagcacuuggauucaugaacgaagaccacugguuuucacgcgaaaacagucuaucgggcgucgagggugaaggccuucauaaacuugguuacauuuugcgugacauuagcaaaauccccggcggaaauauguacgccgaugacacagcuggcugggacacuagaauaacagaagaugaucuccaaaaugaagcaaaaauuacagauauuauggaacccgagcaugcacuauuggcgaaaucuauauucaaacucacauaucaaaacaaagugguuaggguucaaaggcccgcaaagaaugguacugucauggauguaauuucaagaagagaucaacgaggaucgggucaaguugguacuuacggucugaauacauucacgaauauggaagcucaacucauaagacaaauggaaucagaggguauauuuuccccaucagaauuagaaacgccaaaucucgcggguagaguauuagacuggcuagaaaaacauggcguugaacggcugaaaagaauggcaauaucaggggaugacuguguaguuaaaccuauagaugaccgauuugcgacggcacucacugcauuaaacgauauggggaaagucagaaaggacauaccccaaugggagccaucgaaaggauggaacgacuggcaacaaguuccuuuuugcucccaucacuuucaucagcuaauuaugaaagauggucgagaaaucguaguacccugucgcaaccaagacgagcuaguggguagagcaagagugucacaaggugcuggguggucucuuagagaaacagcauguuuagguaaaucauacgcgcaaauguggcaguugauguauuuucauagacgagaccuacgucuugcugcaaaugcaaucugcagcgcugugccuguugacuggguacccacauccaggacaacauggucaauacacgcccaucaucaauggaugacaaccgaggacaugcuaaguguauggaaucgaguauggauagaggaaaacccauggauggaggauaagacacauguaagcagcuggggagacguucccuauuugggaaaaagagaagaucaguggugcggcagccucauagggcuaacggcacgcgcaaccugggcaacaaauauacaaguagcuauaaaccaaguuagaagauugcuugggaaugaaaacuauuuggauuauaugaccaguaugaagagguuuaaaaaugaaucagauccagaaggagcacuaugguag

SEQ ID NO: 21650 - RNA, 9879 nt, Artificial Sequence
  derived and/or modified CDS sequence (opt6) from DENV-1__FJ898385__SS-prME
agcgugacgaugcucuugaugcugaugccgacugcauuagcguuucauuuaacuacacggggaggagaaccccacaugauagugacaaaacaagaacguggaaaaagccuccuguuuaaaacuucggcugguguaaauaugugcacccuaauugcaauggauuuaggugaacuaugcgaagauacgaugacuuacaaauguccccgaauuacugaagcagaacccgaugacguggauuguugguguaaugcaacggacacauggguuacguacgguacauguagccaaacaggagaacauaggcgggauaaacgaucaguagcauuggcaccucaugugggucugggauuagaaacgcguacagaaacauggaugucaagcgagggcgcguggaaacaaauucaacggguagaaacuugggcucuuagacaucccgguuuuacagucauagcacuauuucuagcacaugcuauagggacaucaaucacacaaaaaggcauaauauuuauucuacuaauguuggucacaccauccauggcgaugaggugugugggcaucgguucaagagauuuuguagaaggauuaaguggugccacuuggguagaugucguccuugaacauggaucauguguaacaacuauggcaaaagacaaacccacauuagacauagaacuacuuaaaacugaaguuacuaacccagcgguuuuacgaaaauuaugcauugaagcgaaaauuucuaauacaacaacugauucacgauguccgacacaaggagaagccacauuaauggaagaacaagacgcuaauuucguaugcagacgcacauuuguagacagaggcugggguaacggauguggacuuuucgggaaaggaucccuaauaacgugcgcgaaauuuaaaugcguaaccaaauuagagggaaaaauaguucaauacgaaaaucuuaaauauucgguaauaguuacugugcauacaggagaucaacaucaaguagggaaugaaucaacggaacacggcacaacugcaacgauuacgccucaagccccuacaagugaaauccaauuaacugauuauggggcuuuaaccuuagauuguucaccacggaccgguuuagacuuuaacgaaaugguguuauuaacaaugaaagagaaaaguuggcuggugcacaaacaaugguuccuagauuuaccacuccccuggaccucuggggcaucuacgucacaagaaacuuggaauaggcaagaucuuuuaguaacguucaaaaccgcccaugcgaagaaacaagaaguaguaguuuuggggagccaagagggagcaaugcacacggcccucacuggggcuacggagauucaaacaagcgguacaacaacuaucuucgcuggucauuuaaaaugcaggcucaaaauggacaaacuaacauuaaaagggaugaguuaugucaugugcaccgggagcuuuaaacuagaaaaagaaguugcagaaacgcaacaugggacagugcuaguacaaauuaaauacgaagggacugaugcuccuuguaaaauuccauucagcacucaagacgaaaaagggguaacucaaaacggaagacuaauaacggccaauccaauaguaacggacaaagaaaaaccuguuaacauagaggccgagccaccauuuggagagaguuacauugugauaggggccggugaaaaagcgcucaaacucagcugguucaagaaagguucaaguauaggaaaaauguucgaagcaacagcaagaggagcuagaagaauggcaauucuuggggacacagcaugggauuuuggcucaauaggugguguguuuacaucaguugguaaauuggugcaucaaauuuucgguacggcuuauggaguacuauuuagcggagugucauggacaaugaaaaucggcauuggaguuuuacucacauggcuaggucuaaauucaagaaguacaagucuaucaaugacuugcauagcaguuggauuaguuaccuuauauuuaggagucaugguccaagcugacucaggauguguuauaaauuggaaaggaagagaguuaaaauguggaagugguauauucgucacaaacgaaguucauacuuggacagaacaguacaaguuucaggcagacucccccaagagacuguccgcagcaauugguaaggcaugggaagaaggaguguguggaauaagaagugcuacccgacuagagaacauaauguggaaacaaaucagcaaugaacuaaaccacauucugcuagaaaacgacaugaaauucacaguaguaguagguggagugguaggcauucucgcacaggggaaaaagaugauuaggccgcagccaauggaacacaaauauucauggaaaagcugggguaaagcuaagauaauuggugcggacguacaaaacacaacuuuuauuauagauggaccaaauaccccagagugcccggaugaucaaagagcauggaacaucugggaaguugaagauuacggauucgguauauuuacuacgaacauaugguugaaacuucgugacuccuauacacaaguaugcgaccaccgauuaaugucagcagcaaucaaagacucgaaagcgguacaugcggauauggguuacuggauugaguccgagaaaaaugagacauggaaacuugccagagcuaguuucauugaaguuaaaacgugcaucuggccaaaaucacauacucuaugguccaauggaguacucgaaagcgaaaugauuaucccuaaaauuuauggcggaccgauaagucaacacaacuauaggccuggcuauuuuacacaaacugcagggccuuggcacuuaggcaaacuagagcuagauuucgauuuaugcgaagggacaacuguaguugucgaugaacauugcggaaacagagggccgucccuccgaacaacgacaguaacuggcaaaaucauacacgaaugguguuguaggucauguacguuacccccauuaagauuuaaaggugaagacgguuguugguacgguauggaaaucagaccgguaaaagagaaggaagaaaaccuuguaaaaaguaugguaucugcaggcaguggagaaguugauucauuuucauugggcuugcuuugcauaucgauuaugauugaagaaguaaugagaaguagguggucgaggaaaaugcuaaugacuggaacguuagccguauuucuccuauuaauaaugggacaacuaacguggaacgaccuaauucgauuauguauaaugguaggagcgaaugccucagaccguauggggaugggcacuacauauuuagcacuuauggcaacauuuaaaaugcgaccgauguuugcuguagguuuacuguuucgacgauuaacuagccgugaagucuugcuccuaacuauuggccuuaguuugguagcauccguagaauugccgaauagucuggaggagcuuggagacggucuagcaaugggcauaaugauauugaaauuauuaacugacuuucaaagccaucaauuaugggcaacauuacugagcuuaacuuuuauuaaaaccacuuuaucgcuacauuaugcuuggaagacgauggccaugauucuaaguauaguuucccuauuuccucuaugccuaucgacaacaagucagaaaacgacaugguuaccaguguuauuaggcagccuaggauguaaaccacuaacaauguuuuuaaucgcagaaaauaagauaugggguagaaaaagcuggccuuuaaaugaaggcauuauggcgguugguguaguaaguauuuugcucucaaguuuauuaaagaacgauguaccguuggccggaccacuaauugcgggagguaugcuaauugccuguuaugugauuucuggaucgucggcggacuuaucuuuagaaaaagccgcagagguuagcugggaagaagaggcugagcauucaggagcuagucauaacaucuuagucgaaguacaggaugacgguacaaugaaaaucaaggacgaggaaagagaugauacucugacaauauuauugaaagcuacauuacucgccgugucagggguuuauccucuaucuauacccgcaacacuauuuguuugguacuuuuggcagaaaaagaaacaaagaagcgguguacucugggauacuccaucuccaccagaggucgaaagagccguacuagacgauggaauuuauagaauaaugcaaagaggacuacuagggagaucacaaguuggcgugggcgucuuucaggaaaauguauuucauacaauguggcacgucacaagaggugcgguuuuaauguaucaagggaaaagauuagaacccucuugggcuagcgucaagaaagaucuaauaaguuauggcggaggcuggagacuccaaggaucuuggaauaugggagaagaaguacaggugauagccguggagccggggaaaaauccuaaaaauguacaaacagcuccagguacauuuaaaacaccagaaggggaaguaggagcuauugcauuggacuucaaaccggguacaucaggcaguccuauaguaaaccgcgagggcaagauagucggacuuuauggaaacggaguuguaacaacaagcggaacguacguuuccgcaauugcacaagcgaaagcaucacaggaaggcccguuaccggaaauagaggacgaaguuuuuagaaaaagaaauuugacaauuauggaucuacacccaggaucaggcaaaacacgaagguaccucccagccauuguucgcgaggcaauuaagcguaaguuaagaacguuaauauuagccccuacaagggucguggcguccgaaauggcagaggcauuaaaagguaugccuauaagguaucaaacuacugccguaaagucagaacauaccggaaaagaaauagucgauuuaaugugccacgcgacauuuacaaugaggcuccucucaccgguaaggguuccaaauuauaacaugaucaucauggacgaagcgcauuuuacagacccaucgucuauugcggcgaggggauauauaucaacucgugugggaaugggagaagcggcagcgaucuucaugacggcaacaccacccgguaguguagaggcuuuuccacaaaguaacgcugugauacaagaugaagaaagagacaucccagaacgcagcuggaacucaggauacgaauggauaacggacuucccggggaaaacuguaugguuugugcccucuauaaagucaggaaaugacauagcaaauugucuccgcaagaaugggaaacgugucauacaauuaagucguaaaacuuucgauacggaguaucagaaaacuaaaaauaaugacugggacuauguggugacuacugacaucagcgagaugggugcuaauuucagggcagauagaguaauagacccgagaaggugccugaaaccggugauacuaaaggaugggccugaaagaguuauauuagcagguccaaugccuguuacuguagcuuccgcggcacagagacgugggcgaauaggacgcaaccacaacaaagaaggagaucaguacauauauaugggacaaccauuaaacaacgacgaggaccaugcacauuggacggaagcaaaaauguuacuugacaauauuaauacgccggaagguauaauaccagcacucuucgagccagaaagggagaaaagcgcagcaauugacggcgaguauagguugcgcggcgaagccaggaaaacauuuguagaacuuaugagaagaggagacuugccugucugguuaaguuauaaaguggccucugaaggauuccaauauucagaucgccgaugguguuucgauggagaacgcaauaaccaaguucuggaagaaaauauggauguugagauuuggacgaaagaaggagagagaaagaaacugaggccuagaugguuggacgcaagaacguauuccgauccauuagcuuuacgugaguucaaagaguucgcugccggccgcaggucaguuuccggagacuuaauauuagaaauagggaagcuaccacagcauuugacacaacgugcccaaaacgccuuagacaaccuaguaaugcuacauaauagcgagcaaggaggacgagcauaucgacaugcaauggaagaauugccagauacgauagagacucucaugcuucuggcacuaauagcugucuugaccggaggcgucacgcuuuucuuccuguccggucgagggcuugggaaaacaucaauugguuuacuaugcgucauggccucaaguguacuuuuauggauggcaagcguugagccucacuggauugcugccagcauaauucuagaauuuuuccuuaugguauuacuaauaccugaaccugacagacaaagaacaccucaagauaaucaacucgcguauguagucauaggcuuauuauuuaugaucuuaacuguagcagcgaacgaaaugggucuacucgaaacaacuaagaaagaucuaggaauaggacauguagcagucgaaaaccaccaccaugcaacgauguuggauguagauuugcacccggcuuccgcauggacacuuuacgcgguagcgaccacaauaauaacgcccaugaugaggcauaccaucgagaauaccacagccaauaucaguuugaccgcuauugcuaaccaagcugcgauauuaaugggccuagauaaaggauggccuauuuccaaaauggauauagggguaccacuuuuagcauuaggauguuauucacaagugaauccgcuaacacuuacagccgcaguauuaaugcucguagcgcauuaugcuauuauagggcccgggcuacaagcgaaggccacaagagaggcacagaaaaggacagcagcugggauuaugaaaaaccccacuguagauggaauaguugcaauugauuuagacccaguuguguacgacgcgaaauuugaaaaacaacuuggacaaauaauguuacuaauauuauguacaucacagauucuucuaaugcguacuacaugggcuuugugcgagucgauuaccuuagcaaccggaccacuuacaacgcucugggaaggaucaccaggaaaguuuuggaauacuacaauugcuguauccauggccaauaucuucagaggcucauacuuagccggugcaggucuggcuuucucauuaaugaaaucauuaggugggggcagacgcgguacgggugcccaaggugagacucuuggagaaaaguggaaaagacaauuaaaucagcuuaguaagagugaauuuaacauauauaagagaagugguaucauggaaguggacagaagugaagccaaggaagggcuaaagagaggcgaaacgacuaggcaugcagugucucggggcacagcgaaauugagaugguuuguagaaagaaaccuagucaaaccugaaggaaaagucaucgaccuagggugugguagaggaggauggucauauuacugcgcagggcuaaagaaagugacagaagucaaaggauauacaaagggcgggccgggacacgaagaaccaauaccgauggccacuuauggauggaaucucguuaaacuccauucagguaaagauguguucuuuacacccccagaaaaaugugacacacuuuuaugcgauaucggcgaaucgaguccuaauccgacgauugaggaaggaagaacacucagaguacuuaaaaugguggaaccgugguuaagagguaaccaguuuuguaucaaaauacuuaauccauacaugccgucggucguagaaacacuggaacagaugcaacgaaaacauggagggaugcugguacgcaacccacuuucaagaaauucaacacacgaaauguauuggguaagcuguggaacggggaacaucguaucagcagugaauaugacuagcaggauguuacuaaacagguucacuauggcgcauagaaaaccuacuuaugaacgugacguugacuuaggagccggaacaagacauguggccguugaaccagaaguagcuaaccuggauauuaucgggcaacgcauagagaacaucaaacacgaacauaaaucaacauggcacuacgacgaggauaaccccuauaaaacaugggcauaccauggaucauacgaggugaaaccaucuggaucagcuaguaguaugguuaaugggguugucaaacuucuaaccaagccaugggacguaauacccauggugacgcaaaucgcuaugaccgacacaacaccuuucggucagcagagaguuuuuaaggagaaaguagacacuaggacaccaaaggcaaagagagguacugcacagaucauggaaguaacagcuagguggcuauggggcuuucuaagcagaaauaagaaaccuagaauauguaccagagaagaauuuacacguaaaguccgauccaaugcagcaauuggagcagucuucguugacgaaaaccaauggaacagugcaaaggaagcgguagaagaugaaagguuuugggaucucguucaaaaagagcgagaauuacauaaacaaggaaaaugugcuacuugcguguauaacaugaugggcaagcgagaaaagaaguuaggcgaguucggaaaggcaaagggaucucgcgcgauaugguacauguggcuaggagccagguuucuagaauuugaagcgcuagguuuuaugaaugaagaucauugguucucuagagagaacagccuuuccggcgucgaaggggaaggguuacauaaacuagguuauauuuugcgugacaucucaaaaauaccaggaggaaacauguacgcggacgauacggcaggcugggacaccagaauaacagaagaugaucugcaaaacgaagcuaagauaaccgacaucauggaacccgagcaugcauuguuagcaacaagcauuuuuaaacuuacuuaccaaaacaagguaguucgcguccaacgcccugcuaaaaaugguacggucauggaugucauuuccaggagagaucaaagggggucgggacagguuggcaccuacggacuuaacacauucacaaacauggaagcacaauugauaaggcaaauggaaagugagggaauauuuucacccagugaacuagaaauaccuaaucuagcggaaagagugcuggacugguuggaaaaauacggaguagagcgccucaaacggauggcaauaucgggggaugauugugugguuaagccaauagacgaccgauuugccacagcguugacggcacuaaaugauaugggaaaggugcguaaagacgucccucaaugggaaccgaguaaagguuggaaugauuggcaacaggugcccuuuuguucccaucauuuccaccaacucaucaugaaagauggaagagaaauaguuguuccauguagaaaucaagaugaguuagugggcagagcaagggugagucagggggcaggguggagucuacgagagacugcauguuugggaaaaaguuaugcacagauguggcaacuuauguacuuccacagaagagaucucagacucgcagcgaaugcuauuuguucggcugucccgguagauugggugcccacaucgagaacaacauggucaauacaugcacaccaucaauggaugaccacggaggauauguuauccguuuggaacaggguuuggauagaagaaaacccuuggauggaagacaaaacgcacguuucuaguuggggagauguaccauaccuaggaaaaagagaagaucagugguguggcucauuaauuggucuaacagccagagcaacaugggcaucgaacauacaaguagcaauaaaucaaguucggcguuuaaucggaaaugaaaauuaccuugacuacaugacuagcaugaaacgauucaaaaaugaaggagacccagagggagccuuaugguaa

SEQ ID NO: 21651 - RNA, 9879 nt, Artificial Sequence
  derived and/or modified CDS sequence (opt6) from DENV-1__GQ868608__SS-prME
ucugucacuaugcuauugauguuaaugccuacagcacuggcguuucauuuaacgacacgaggaggagaaccacauaugaucgucagcaaacaagaacggggaaaaucacuacuuuuuaaaacaagugcuggugugaauauguguacacuaauagccauggauuuaggagaauuuugcgaagacacuaugacauauaaauguccaaggaucaccgaagcugaaccagacgaugucgauuguugguguaaugcaacagauacuuggguuaccuaugggacuuguucccaaacuggugaacauagacgcgauaaacgauccguugcccuagcaccacauguuggacucggauuggagacaaggacagaaacauggaugucaucggaaggagcauggaaacaaauacaaagaguugaaacaugggccuuacgccauccuggauucacaguaauagcuuuauuuuuagcccaugcuaucgggacuucaauuacucagaaaggaaucauauucauauuguuaaugcugguaaccccgaguauggcaaugagauguguaggaaucggaucgagagauuuuguggaagguuuauccggagcuacauggguugauguaguuuuagaacacggcucauguguaacuaccauggcuaaggacaagccgacguuagauauugaauuacuaaagacagaagucacuaauccagccguuuugcguaaauugugcauagaagcaaagaucuccaauacaaccacggacagucgcuguccgacacaaggugaagcaacauuaguagaagaacaagaugccaauuucgugugccgcagaacuuuuguagauagaggauggggaaauggauguggauuauuuggcaaagguaguuuaaucacaugugcaaaauuuaagugcguaaccaaacuagaaggaaaaacuguucaguaugagaacuuaaaauacucaguuauuguaacaguucauacaggugaucaacaucaaguagguaacgaaaguacugaacauggcaccacugcgacgaucacaccgcaagcaccuaguacagagauucaacugacagacuacggcgcauuaacguuagauugcuccccaaggacuggauuggacuucaaugaaaugguucuucuaacaaugaaagaaaaagcauggcugguccacaaacaaugguuuuuagaccugccccuaccguggacgucuggagcaucaacgucucaagaaacuuggaauagaaaagaccuauuaguuaccuuuaaaacggcacaugcaaagaagcaagaaguagucguacuaggaagucaagaaggcgcaaugcacaccgcgcuaaccggcgcaacagagauacaaaccagugguaccaccacaauuuucgccgggcaccugaaguguaggcucaagauggauaaacuuacccucaagggaaugucguacguaauguguacggggucuuucaaacuagaaaaagaaguagcagagacacagcauggcaccguuuuaguccagaucaaauacgagggaacugacgcacccugcaagaucccauucucgacucaagaugaaaaagguguaacucaaaacggaaggcuaauuaccgcaaauccaauugucacugauaaggagaagcccguaaacaucgaagcugaacccccauuuggagaaucuuauauaguaauaggagcaggagagaaggcauuaaaacucaguugguuuaagaaaggaaguuccauagggaagauguuugaagcuaccgccagaggggcacgacgcauggcgauuuuaggggauacggcuugggauuuuggaucaaucgggggaguguucacuagcguagguaaacugguccaucaaauauucggaaccgcuuauggaguucuauuuagcggagugagcuggacgaugaaaauugggauaggugucuuacuuacaugguuaggauuaaacagcagaucaacaucuuugucaaugaccuguauugcgguuggcuuaguuacguuguaccuaggagugaugguucaggccgauucaggauguguaauaaauuggaaggggcgcgaauuaaaauguggaucgggcauuuuuguuacaaaugaaguacacacauggacugaacaauacaaauuucaagcagauucucccaaaagauuaucagcagcgaucgggaaggcauggaaggaaggaguuugugggauaaggucggcgaccagacuggaaaauauaauguggaagcaaaucagcaaugaacugaaccauauauugcuggaaaaugacaugaaauuuaccgucgugguaggcgaugucgcugggauccuagcucaagguaagaaaaugauaaggccccaaccaauggaguacaaauacucauggaagucauggggcaaggcuaagauaauuggugcugacguucaaaaugcaacuuucauaauagaugguccaaauacaccggaaugcccggaugaccagcgcgcauggaauaucugggaaguugaagauuacggcuucggaauuuuuacaacgaauauauggcucaaacugagggacucuuauacgcaaguaugcgaccaucgucuaaugagcgcugcaauuaaagauaguaaggcgguacaugccgauauggguuauuggauagaaucugagaaaaaugaaacauggaaauuggcgagagcaucauuuauagaaguaaaaacaugcauauggccaaaaucucauacacuauggucuaauggggugcuagagagcgaaaugauuauaccaaaaauuuauggaggacccauuagucagcacaacuauaggccgggauauuuuacgcagacagcgggaccauggcaucucggaaagcuagaauuagauuucgaucucugcgaaggaacaacaguaguugucgaugagcauuguggcaacagagguccaucucugcgaaccacgacggugaccgggaagaucauucacgaguggugcugcagaagcuguacauuaccuccacucagguucaagggcgaagauggguguugguaugguauggaaauccgaccuguuaaagaaaaggaagaaaaucuaguaaaaucuaugguaucugcgggauccggagaaguugauucuuucucgcugggguugcuuuguauuucgauaaugauugaagaaguaaugaggaguagauggagcagaaaaaugcuuaugacaggcacauuggcuguauucuuucuauuaauuaugggacaacuaacuuggaaugacuuaaucagacuuugcauuaugguuggagccaaugcuucagaccguauggguauggguacuacuuauuuagccuuaauggcuacauucaagaugcgaccaauguucgcggucggauuauuauucagacggcucacaucucgagagguucuguuacuaaccauaggguuaucucuaguggcaucaguugaauuacccaauaguuuagaggaauuaggggauggcuuagcaaugggaauaaugauacuaaaacuucuaacugacuuccaaagucaucaauuaugggccacgcugcucagcuugacguuuauaaaaacaacuuuuucacuacacuacgcauggaagacuauggcaaugguucuuucaauagugagucuuuuccccuuaugucuaagcacgacuucgcagaaaacaacauggcuucccguacuccuagguaguuuaggaugcaagccucuuaccauguucuuaauagcagaaaauaaaaucugggggagaaaaucuuggccgcucaacgaaggcauaauggcagucggcauagucucgauacucuuauccagcuuacuuaaaaaugacguaccucuugcgggcccccuaauugcuggaggaauguugauugcuugcuacgugauaaguggcucauccgcggacuuaagccucgaaaaagcugcggaaguaaguugggaggaagaggcugaacauaguggagcaucacauaauauauuaguagaagugcaagacgaugggacgaugaaaauaaaagaugaggaaagagacgacauguugaccauacuguuaaaggcaacccucuuagcaguuuccgggguauacccacuaucaauaccagcgacacuuuuuguaugguauuucuggcagaagaagaaacaacgauccgguguccuuugggauacaccaaguccuccugaaguagagcgagccguuuuagacgacgggaucuauagaauaaugcagaggggucuacuuggucgcucacagguugggguuggaguauuccaagaaaauguauuucacacaauguggcaugucacuagaggcgcaguauugauguaccaggguaaaagauuagaaccuucuugggcgagcgucaagaaagaccugauaaguuacggugguggauggagguuacaaggaagcuggaauacaggagaagaaguacaagucauugcuguugaaccaggcaaaaaccccaaaaauguacaaacugcgcccggaacuuuuaaaacgagugagggagaagugggggcuauagcguuagacuuuaaaccagggacuagcggaucgccuauuguaaauagggagggcaaaauugucggauuguauggcaauggaguggucacgacaucagggaccuacguaucggccauagcgcaagcaaaagcaucucaagagggaccauuacccgaaaucgaagacgaaguuuucagaaaacggaaucucaccauuauggaccuucacccaggguccggaaaaacgagaagauaucuaccggcuauaguaagagaggcgaucaaaagaaaacuaagaacacuuauauuagcuccaacuaggguagucgcgagugagauggcugaagccuuaaaggguaugccaaucagguaccaaacaacugcaguaaagucagagcauacugggaaagaaauaguagaccuaaugugucaugcuacauucaccaugagauuauuaaguccaguaagagugccaaacuauaauaugauuauuauggaugaggcucauuucacagauccuucuucuauagcagccagaggauacauuuccacuagaguagggaugggugaagcugcagccaucuuuaugaccgcaacgcccccaggcaguguugaggcuuucccgcaaaguaacgccguaauacaagaugaggaacgggauauacccgaaaggaguuggaauagcgguuaugaauggaucacagacuucccaggaaagacaguaugguuuguaccaucuauuaaaagugguaacgauauagcgaacugucugaggaaaaauggcaaaagaguaauacagcucagccgaaaaacauuugauacugaauaucagaaaaccaaaaauaaugacugggacuaugucgugaccacagacauaucagaaaugggcgcaaauuuccgagcugacaggguuauugauccucgucgaugucugaagccugugauauugaaggaugguccagaaagagugauauuagcagguccuaugccaguaacgguagcaucagccgcgcaacgacgggguagaauagguaggaaccacaacaaggaaggugaucaauacauauacaugggacaaccccuaaacaaugacgaggaucacgcccauuggacugaagcuaaaauguuauuggacaauaucaacacaccugaagggauuauaccugcgcuuuuugaaccagaacgggagaaaagcgcagccaucgacggugaguauagacugcguggagaagcgagaaaaacuuuuguugaacucaugcguagaggagaccucccuguuuggcuaagcuacaagguagcaucagagggguuucaauacagugacagacgauggugcuuugauggggaacgaaauaaccaaguacuagaagaaaauauggauguagaaaucuggacaaaagaaggcgaaagaaagaaauuacgaccuagauggcucgacgcaaggacauauucugauccgcuagcucugagagaauuuaaagaguucgcagcaggacgacgguccguaucaggagaccucauacucgaaauaggaaaacugccacaacaucuuacgcagcgugcucaaaaugcguuagacaaccuaguaauguuacauaauagcgaacaagggggucgcgcuuauagacaugccauggaggaguuaccagauacaauagaaacauuaauguuacuagcgcuuauagcaguauuaacugguggaguaacucuauuuuucuugucuggcagaggauugggaaaaacaaguauuggcuuauuaugugucauggcaaguaguguauuauuauggauggccaguguggaaccacauuggauagcagcuucuauaauucucgaguucuuccuaaugguuuuacuaauucccgaaccagauagacaacgaaccccgcaggauaaucagcuagcuuauguugugauaggauuacuuuuuaugaucuuaacaguagcagcaaacgagaugggauuguuggaaacaacaaagaaagaucuagguauagggcacguugcagucgaaaaccaucaucaugcugcaaugcuagauguagauuuacauccagcaucggcauggacacucuaugcaguagcuacaacgaucauaacgccgaugaugaggcauaccaucgaaaacacuacggcuaacauaucucucacugccauugcaaaccaggccgcuauuuuaaugggauuagauaaaggguggccuauuucuaaaauggauauagguguaccacuacuagcacuaggaugcuauucucaaguuaauccacugacgcuuacagcugccguacuuaugcuagucgcacauuaugcaauaauaggcccaggacuucaagcuaaagcgacaagggaagcccagaaacguacggcggccggaauaaugaagaacccaacagucgaugguauaguagcaauagaucuagacccuguugucuaugacacuaaauuugagaaacaacuaggccaaauuauguugcuuauacuuuguaccucucagauucuuuuaaugaggacaacaugggcauuaugugaguccauuacccuugccacuggaccauuaacuacuuuaugggaagggucaccaggcaaguuuuggaacacuacuauugcggugaguauggcgaauaucuucagagguaguuaucuagcaggagcgggacuugcauucucucugaugaagaguuugggugggggacguagaggaacaggugcccaaggugaaacauugggugaaaaauggaagagacaacuuaaucaacugaguaaaagcgaguuuaauacuuauaaaagaucuggaauuauggaaguagauagaucagaggcaaaggaagguuuaaaaaggggugaaacaaccaaacaugcuguaaguaggggaacagcuaaguugcgaugguuuguagaacgaaacuuaguaaaacccgaaggaaagguuauugaccuugguuguggaaggggaggauggucauauuacugcgcaggauuaaagaaagucacugagguuaaaggauauacuaaaggggguccgggacaugaagaacccauaccuauggcuacguacgguuggaaccuaguaaaauuacacucugggaaagauguuuucuucauacccccagaaaagugugauacacuacuaugugacauaggagaaagcaguccuaaucccacuauugaggaaggcagaacacugcgugugcuaaaaaugguagagccauggcuacgcgguaaccaguuuuguauaaaaauuuuaaauccauacaugccgucaguaguugagacuuuagaacaaaugcagaggaaacauggaggcauguuaguacgaaauccuuuaucgagaaauucgacacacgagauguacugggucaguuguggaacugguaauauugucucagccguaaauaugacgagccggauguuacucaacagauuuaccauggcacauagaaaaccuacauaugaacgcgacgucgaucugggugcagguacacgacauguggcagucgaaccugaaguugccaaucucgacaucauaggacaaagaauugaaaauauaaaacaugaacacaagaguacauggcauuaugaugaagauaacccuuauaagacaugggccuaucaugguucguacgaaguuaaacccuccgggucagcgaguaguauggugaauggaguagucaaguugcuuacuaaaccaugggacgucauuccaaugguuacccagauugccaugacugauacaacgccguuugggcaacagcgaguuuuuaaagagaaaguugauacaagaacuccgaaggcaaaaagaggaacugcacaaauaauggaggucacagcgaaauggcugugggguuuucuuucacguaauaagaaaccucgaaucuguacuagggaagaguucacucgaaaaguaagaucaaaugcugcuauaggugcuguguuuguggacgaaaaucaguggaacuccgcuaaagaggcugucgaggacgaacguuuuugggaucucguacauagagagcgagaauugcacaaacaggggaaaugcgccacauguguuuauaauaugaugggaaagcgagagaagaaacuaggggaauuugggaaagcuaaaggcaguagagcuauuugguacaugugguugggcgcaagguuccuagaguuugaggcuuuaggcuucaugaaugaggaucauugguucucacgcgaaaauagucuuuccggcguagagggggaaggacuucauaaacucgguuacauacuacgagauaucagcaaaauaccaggcggaaauauguacgcagaugacacggcaggaugggacacaagaaucacagaagacgaucuacaaaaugaagcuaaaauaacggauauaauggaaccagaacacgcucuacuagcuaaaucuauauucaagcucacuuaucaaaacaagguggucagaguccaacgaccagcuaaaaaugguacugugauggauguaaucucccggagagaucaaagagguucaggacaaguaggcacuuaugggcuuaauacauuuacaaauauggaagcucaguuaauucgacaaauggaaucggaaggcauauucagcccauccgagcuggaaacaccaaaucuggcugguagaguucuagacugguuagaaaaacauggagucgaaagacuaaaaaggauggcaauaucuggggacgacugugucgucaaaccaauugaugaucgcuuugcaaccgcauugacagcauuaaaugauauggguaaaguaagaaaagacauaccccaaugggagccauccaagggcuggaaugauuggcaacaggucccauucugcucacaccauuuucaucaacuuauaaugaaggauggccgugagauuguuguaccaugcaggaaucaggacgaacuuguuggcagagcccguguaucgcaaggcgcagguuggucgcugagggaaaccgcuugucuugggaaaagcuacgcacagauguggcaacucauguacuuccaucguagagauuugcggcuagcggcuaacgccaucugcagugcaguuccaguagauuggguaccaacaucacgaacaacuuggucuauccaugcucaccaccaauggaugacgacugaggauaugcuuucaguauggaacagagucuggauugaagaaaacccauggauggaagauaaaacacacauaagcaguuggggugauguaccuuacuuagguaaaagggaagaccaauggugcggcagucucauaggucucacagcaagagcaaccugggcaacgaacauucaaguggcgauuaaccaaguaagaagauuaaucggaaaugaaaacuacuuggauuauaugacaaguaugaaaagauuuaaaaaugagaucgacccugaaggugcuuuaugguag

SEQ ID NO: 21652 - RNA, 9879 nt, Artificial Sequence
  derived and/or modified CDS sequence (opt6) from DENV-1__GQ199774__SS-prME
ucaguuacaauguugcuuaugcuuaugccaacagcauuggcuuuucauuugacuacucgcgguggggaaccgcacaugauuguauccaaacaagaaagaggaaaauccuuacucuuuaaaacaagcgcaggcguaaacauguguacgcucauagcgauggauuuaggcgaacucugcgaagauacgaugacauauaaaugcccaagaaucacugaaguugaaccagaugauguagacuguuggugcaacacaacagauacuugggugacauacggaacuugcagucaaacaggggaacaccguagagauaaaagaucaguugcccuugcgccacauguugggcuugggcuugaaacuagggcagaaaccuggaugaguagugaaggagcauggaaacaaauacaaaaaguagaaaccugggcucuaagacacccgggguuuacaguaaucgcacuuuuucuagcucacgcaaucgggacaucuauaacacaaaaaggcauaauauucauauugcugauguugguuacuccaagcauggccaugcgauguguugguaucgggucacgugacuuuguugagggcuuaucgggugcgacguggguagauguaguacucgaacaugggucauguguuaccacgauggccaaagauaaaccgacguuagauauagaguuguuaaaaacggaaguaacaaacccagcaguccuucguaaacuauguauagaagccaaaauaucgaauacuacaaccgacucucgaugcccuacacaaggagaagcgacauuaguugaagaacaagacgcaaacuucguuuguagacgaacuuuuguugauagaggaugggguaacggcuguggauuguucgggaaagguagcuuaauaacaugcgcaaaauucaaaugcguaacgaaacuagaaggcaaaauaguccaguaugagaaucuaaaauacuccgugaucguuacaguucacacaggagaucaacaccaagucggaaaugagaguacugagcauggaacaaucgcaacuauaaccccucaagcaccuacaucggaaauccaauuaaccgacuauggagcucuuacccuagacugcuccccuagaacaggacuugauuuuaaugaaaugguguuauuaaccaugaaagaaaaaucuugguuaguucauaaacaaugguuucuagaccuaccacucccguggacaucaggugcuucgaccagucaggaaacuuggaaucgacaggauuuguuaguaacauucaaaacagcacacgcuaagaaacaagaaguaguggucuuaggcucacaggagggggccaugcacacagcauugacuggagcaacagaaauccagaccacaggaacuacgacgauauuugccggucacuugaaaugcagguuaaaaauggacaaauuaacacuaaagggcaugucauauguaauguguacagguucuuucaaauuagagaaagagguagcagaaacgcagcaugguacgguauuaguucaaauaaaauaugaaggaaccgacgcuccguguaagauaccauuuagcacucaggaugagaaaggagugacacaaaacgguagauuaauaacggcaaacccuauugucacugacaaagaaaaaccaguaaacauugaagcagagccuccauuuggagagucguauauaguaauaggugcaggggaaaaagcauuaaaacuaucaugguuuaagaaaggaucuagcaucggcaaaauguuugaagcaacggcuaggggagcaaggagaauggccauuuugggcgacacagccugggauuucgggucaaucggaggagucuuuacuucuguaggcaagcuaguacaucagauauucggaacugcuuauggaguuuuauuuuccggcgugaguuggacaaugaaaauugguauaggaguguuacucaccugguugggucugaauaguaggagcacgagcuuguccaugacauguaucgcuguagguuugauuacucuguaucugggggucaugguacaggcagacagcgggugugucaucaacuggaaagguagggaauuaaaauguggcucaggaauauuugugaccaaugagguacauacguggacagaacaauauaaauuucaagcagacuccccaaaaagguuaucugcugcgauaggaaaagccugggaagaagggguaugugggauaagaucagcgacaagacucgaaaauauuauguggagacaaauuucaaaugaauugaaccacauucuacuagagaaugauaugaaauucacagugguggugggagauguugugggaauauuggcccaaggcaagaaaaugguaaggccccagccgauggaacauaaguauucguggaagaguuggggaaaggcaaaaauaauuggagcggauguacaaaacacuacauucauuauagacggaccaaacacacccgaguguccagacgaucaaagagcauggaauauaugggaaguugaagauuaugguuuugggauauuuacaaccaauauauggcuaaaacuuagggacucauauacacaagucugcgaccacagauugauguccgcagcgaucaaagacagcaaagcagugcacgcagauaugggauauuggauugaaagugagaaaaaugaaacauggaaacucgcccgagcuucuuuuaucgaggugaagacuugcaucuggccaaaaucccauacauuguggucaaauggcgugcuugagucagaaaugaucauuccaaaaaucuauggaggaccaauuucacaacauaacuacagaccggguuacuuuacacaaaccgcuggaccguggcauuuaggaaaacuugaacuagauuucgaccucugugaagggacuacgguaguugucgaugaacauugugguaauaggggaccgucucuccggacgacgacggucacaggaaaaaucauacacgagugguguugccgaagcuguacgcuaccaccauuacgcuucaaaggagaggauggaugcugguauggaauggaaaucagaccuguacgagagaaagaagaaaaccucguuaaaucuaugguuucggcuggaucgggcgaaguagauucuuuuucacuggguuugcucuguaucucaauaaugauugaagagguaaugagaaguagguggucgaggaagaugcuaaugacgggaacacuggcuguauucuuuuuacuaauuaugggucaacuaacguggaacgauuuaauaagaaguuguauaaugguaggugcuaacgcuucagauagaaugggaaugggaacuacguaucucgcacugauggcgacauucaaaaugagaccuauguucgcgguggguuuacuuuucagacgauugaccaguagagaaguguuauuacucaccaucgguuugagccuagucgcaaguguugaauuaccgaauagccuagaagaauuaggagauggacuggcaaugggaauuaugauacuaaaauuauugacugauuuucaaagcuaccaacucugggccacuuuauugucauugacuuucauaaagacaacauuuucacuacacuaugcuuggaaaacaauggccaugguuuugucuauuguaucacuucugccccucugcuugucuacaacaucccagaaaacuacuuggcuuccaguuuuacugggcagucuugguuguaaaccacuaacaauguuuuuaaucgcagaaaauaaaauuuggggucgaaaaucguggccuuugaaugaaggaauuauggcaguagggauagucucuauucuuuuauccaguuuacugaaaaaugauguaccuuuagcagguccacucauugccggugggauguuaauagcguguuaugucauaucuggcaguucggcugacuuaucuuuagaaaaagccgcggaggucuccugggaggaagaagccgagcauuccggagcgucgcauaauaucuugguagaggugcaagaugaugggacgaugaaaauuaaagacgaggaacgggaugacacacuaacuaucuuauugaaggcuacauuacucgcuguuaguggaguguacccccuaucuauuccugcgacucuauuuguuugguauuucuggcaaaagaaaaagcaaagaagugguguccuuugggacacacccagcccgccugaagucgaacgggcagucuuagacgacggcauuuaucggauaaugcagagaggauuacuagggagaagccaagugggugugggaguguuucaagaaaacguguuucauacaauguggcacguaacgagaggagcaguuuuaauguaccaggggaagcgacuagaaccaucaugggcuucugucaagaaagaucucauuagcuauggcggcggguggagacuccaaggguccuggaauacaggugaagagguacagguuauugcaguugaaccugggaagaaucccaaaaaugugcaaacagcgcccgggacuuucaagacucccgaaggagagguaggagcaauagcacuagauuuuaaaccggguaccucuggaucgccuaucgucaacagagaagguaaaauaguaggccuauauggcaacggagugguaacuaccuccggaacguacguaucagcaauagcgcaggcgaaagcaucacaagaaggaccucuaccugaaauagaagaugagguuuuuagaaaaaggaauuuaaccauuauggaucugcaccccggaucgggcaagacucguagauauuugcccgcuauugugagagaagcaauaaagcggaaacuaaggacacuuauccuagcaccaacacguguaguagcgucagaaauggcagaagcucuaaaagguaugccuauucgcuaucagacaacggccguaaaaucagagcacacuggacgagagauaguugacuuaaugugucacgcaacguuuaccaugcgucuccuaaguccugugaggguaccuaauuauaacaugauuauaauggaugaagcacacuucaccgacccaaguuccauugcggcacggggauacauaaguacccgaguaggcaugggcgaagcugccgcaauuuucaugacggcuacgccaccagggucuguagaagccuuuccacaaucgaacgcgguuauucaagaugaagaaagggacauuccugagcgcagcuggaauagcgguuaugaauggauaacugauuuuccugguaagacagucugguucguaccuucuaucaaauccggcaaugauauagcaaauugcuuaagaaagaauggaaaaaggguaauacagcucucaagaaaaacauucgauacggaauaucaaaagaccaaaaauaaugacugggacuacguagucacaacagauauuucggaaaugggagccaauuuuagagccgauaggguaauugauccccguagauguuugaaaccgguaauauuaaaagacggacccgaaagaguaauauuagcgggcccuaugccaguaacaguggccuccgcagcacagagacguggaagaauaggucggaaucauaacaaggaaggggaucaauauauauacaugggacagccucugaacaaugacgaagaucaugcccauuggacagaagcaaaaauguuguuagauaauaucaacaccccugaaggaauaauaccagcauuauucgaaccagaacgggaaaaaucggcagcaauugacggggaauacaggcuacggggagaagcaaggaaaaccuuugucgaacucaugagaagaggcgacuuaccagucuggcuaucauacaaaguagccagcgaaggauuccaauacucagaucgacgaugguguuuugauggugaacgaaauaaccaaguacuagaagagaacauggacguggaaauuuggacgaaagaaggcgaaaggaagaaauuaagaccacgaugguuagaugcuaggacguauagugacccacuggcacugagggaauuuaaggaguuugcagccggcagacgcagcguaucaggagaccucauacucgaaauugguaaauuaccccaacacuugacacaacgagcccaaaaugcauuagacaaccuaguaaugcuucacaacucagaacagggcggacgugcguacagacacgcuauggaagaacuuccagacacgauagagacucuaauguuacuggccuuaauagcaguucugaccgggggagucacacuauucuucuuaucagggcguggacucgggaagacauccauaggguuguuauguguaauggcaaguagugcguugcuauggauggcuucugucgaaccgcacuggauugccgcaaguauaauacucgaguucuuucuuaugguuuuauuaaucccugaaccagaccgucagagaacuccacaagauaaccagcuugcuuauguaguaauuggucuuuuauuuaugauauuaacaguagcagcgaaugaaaugggacuauuagaaacgaccaagaaagaucuagggauuggccauguggcaguagaaaaucaucaucaugcaacgaugcucgacguagacuuacaucccgcgucugcuuggacauuauaugcuguagcaacaacgaucauuacacccaugaugcgucacaccaucgagaauaccacggcaaauaucucccuaacagcgauagcuaaucaggcugcuaucuuaaugggacuugauaaagguuggccuauauccaaaauggauaucggaguuccgcuacuugcacuaggcuguuacucacaaguaaacccccuuacacuaacugcagcagugcuaauguuagucgcucauuacgccaucauagguccuggccugcaagcaaaggcaacuagagaagcacaaaaacgcacugcggcuggcauuaugaaaaaccccacgguugacgguauaguggcgauagauuuggauccaguaguauacgaugcuaaauuugaaaagcagcuaggacaaauuaugcucuuaauauuaugcacgagccaaauuuuguugaugaggaccacaugggcucuaugugagagcauuacuuuagcaacaggaccacuaaccacuuuaugggaaggcagcccggggaaauucuggaacacgacaauagcuguuucaauggcaaacaucuuucgugguucuuauuuggcgggagcagggcuugcauuuucucuaaugaaaucacuaggagguggucgaagagguacaggcgcucaaggugaaacacucggagaaaaauggaagagacaauuaaaucaguugaguaaaucggaguucaauacguauaaaagauccgguaucauggaaguugaccguagugaggcgaaagaaggcuuacggaggggcgagaccacuaaacaugcaguuucucgaggcacagcgaaauuaagaugguuuguugaacggaaccuaguaaaaccagagggaaagguuauugaccugggauguggcagaggagguugguccuauuauugugccggcuuaaagaaaguaacggaagucaagggauauacgaaaggagggccaggucacgaagaacccauaccuauggcgacguacggauggaauuugguuaaauuacauuccggaaaagauguguucuuuauaccgccagagaaaugugacacucuacuaugcgauauaggagaaucaagucccaauccaacuauagaagaagguagaacacugagaguccuaaaaaugguagaaccauggcuaagaggaaaccaguucugcauuaaaauccucaacccauacaugccaucaguuguugagacauuggaacacaugcaaagaaaacauggggguauguuaguucguaauccauugagccggaacucuacucacgagauguauuggguuucauguggaacaggaaauauaguuagugccgucaauaugacuucgaggaugcuuuuaaauagauuuaccauggcucaucgaaaaccaacauaugagagagacguagaccuaggugcuggcacaaggcauguggcgguugaaccugaaguggcaaaucuugacaucaucggacaaaggauagagaauaucaaacacgaacacaaaucaaccuggcacuaugaugaagacaaucccuacaaaacuugggcauaucaugggucuuacgaaguaaaaccaaguggcucagcgucuucuaugguaaauggaguugucaaacuuuuaaccaaaccaugggacguaauccccaugguaacacaaaucgccaugacagauacuacuccuuucggacaacagagagucuuuaaagagaaaguggacacaaggacacccaaagcaaaacgagguacagcacaaauaauggaagucacugcccguuggcucuggggcuuccuaucacgaaauaagaaaccgagaauuuguacgagagaagaauuuaccaggaaaguaagaaguaacgccgcgauuggugcggucuuugucgaugaaaaucaauggaacucagcuaaagaagcuguugaagaugaacgcuuuugggaccucguacacagggagcgugaacuacauaagcaagguaaaugcgccacgugcguuuacaacaugaugggaaaacgcgagaagaaacucggugaauuuggaaaagccaaaggaagccgugcaauaugguauaugugguuaggggccagauuuuuagaauuugaagccuuaggauucaugaaugaagaccauugguuuagcagagaaaauucuuuaucaggaguagagggugaaggauugcauaaacuaggauauauauugcgcgauauaucgaagaucccagggggaaauauguacgccgaugauacugcugguugggauacucggauuacugaagacgaucuucaaaaugaagcuaaaaucacugacauuauggaaccagaacaugcauugcuugcaacaucuauauuuaagcugaccuaucaaaauaaagucguuaggguccaaagaccugccaaaaauggaacggugauggauguuauuucaagacgagaucaacggggaucaggacagguugggacguauggucuuaacacguuuaccaacauggaagcccaacuaauaaggcagauggagagugaagggaucuuuaguccaagcgaauuagaaacaccuaaccuagcggagaggguucuagauuggcucgaaaaauauggaguugaaagacuuaaaagaauggcaauuuccggugaugacuguguugucaaaccaauagaugacagguuugcaacugcccuaaccgcuuugaacgauaugggaaaagucaggaaagacauuccacaaugggaaccuuccaaaggauggaacgauuggcaacaaguucccuuuugcagccaccauuuccaucaauuaauaaugaaggauggacgagagauugucguaccaugucguaaucaagacgaguuaguagguagagcaagaguuucgcaaggagcgggcuggucucugcgugaaacagcaugcuuggggaaaaguuaugcgcaaauguggcaacucauguauuuucaucgccgcgaccuacguuuggcggccaaugcaauaugcagcgcaguuccaguugacuggguacccacaucgagaacaaccuggucuauucacgcacaccaucaauggaugacaacugaagacaugcuguccguguggaaucgcguauggauugaagaaaacccauggauggaagauaaaacucauauuucguccuggggugauguuccauaccuggguaaaagagaggaucaauggugugguagccuaauaggacuaacagcacgugcuacaugggcaaccaauauccagguagcaauaaaucaaguacggagauugauuggaaacgaaaauuaccuggauuauaugaccucaaugaaacgauucaaaaaugagucagauccugagggcgcuuuaugguag

SEQ ID NO: 21653 - RNA, 9879 nt, Artificial Sequence
  derived and/or modified CDS sequence (opt6) from DENV-1__GQ199775__SS-prME
aguguaacuaugcucuuaaugcugaugccaacugcgcuagcuuuucaucuaacuacacgcgguggagaaccgcauaugauuguaucaaaacaagaacgcgggaaaagccugcuauuuaaaacaucggcaggaguaaauauguguacucuuauagcaauggacuuaggagaauuaugugaagauaccaugacguacaaauguccaaggauaaccgaagucgaaccagacgacguagacuguuggugcaauacaacagauaccuggguaaccuaugguacauguagucaaacaggggaacaucgacgagauaaaaggucaguugcacuugcuccccaugucggauuaggucuugaaacgagggcugagacauggaugaguucggaaggagcauggaaacaaauucaaaaaguagaaacuugggcacugaggcauccuggcuucaccguaaucgcgcuauuuuuagcucacgcaauaggaacuagcauuacucaaaaaggaaucauuuuuauauuauugauguuagucacaccgaguauggcaaugcgaugcguaggaauugguucuagagauuucgucgaagggcuaaguggcgcaacaugggucgaugucguauuagaacauggcagcuguguuacuacgauggcaaaagauaaaccgacgcuggauauagagcuauuaaaaacggaaguaacgaaccccgcuguucuccgaaaacucugcaucgaagcaaaaauuucgaauacaaccaccgacucacgaugcccaacacaaggagaagcgaccuuaguagaggaacaagaugcaaauuuuguguguagaagaacauuuguagauagaggauggggcaauggaugugguuuguuuggaaaaggaagucuaauaacuugcgcaaaauucaaaugcguaacgaaauuagaagggaaaauuguucaauacgaaaauuuaaaauauucugugauuguaacuguacacacgggcgaucaacaccagguaggaaaugaaucaacugagcacggaacaauagcuacgauaaccccucaagcacccacgucagaaauacagcucacagauuacggagcacuaacauuagacugcucuccaagaacaggguuagauuucaacgaaaugguauuauugacuaugaaagagaaaaguuggcuaguacauaaacaaugguuucucgaccugccgcuaccauggacuucuggagccagcacaucucaagaaacuuggaaucgacaggaccuauuagucaccuucaaaaccgcacaugcuaagaaacaagagguagucguguuagggucgcaagaaggagcaaugcauacugcucuaacaggugccaccgaaauacaaacgacugguacuacaacaauauucgcaggucaucuaaaaugcagauugaaaauggauaaacuaacccugaaagguaugucguaugucauguguacaggcucguuuaaacuggaaaaagaaguagccgaaacacaacauggaacaguccucguucagauaaaauacgaagguacagaugcuccguguaaaauuccauuuucaacgcaagacgaaaagggagucacacagaauggacgacuuauaacagcaaacccgauuguaacagacaaggagaaacccgucaauaucgaggcagaaccuccguucggggaaucuuacauaguaauaggagcuggugagaaggcccuaaaacuguccugguuuaagaaaggaucaaguauaggcaagauguuugaagcuacggcacgaggagcucgacgcauggcaauauuaggcgauacggcaugggacuucgguucaauagguggaguuuuuacaaguguaggaaagcuaguccaucaaaucuucggaacggcauacgguguccucuucagcggagugagcuggacgaugaaaauagguauagguguauuauuaaccugguuaggacuuaacucucggagcacgagccuaucaaugacgugcaucgcgguaggucucauaacacuuuauuugggagugaugguucaggcugauuccggaugcgucauuaauuggaaggggcgugagcuuaaaugugguaguggaauuuuugugacaaacgaaguacauacuuggacggaacaauauaaauuucaagccgacucacccaaaagguugucagccgcaauuggcaaggcuugggaagaagggguuugcgggauaagaagcgccacgcgacuugagaauauaauguggcgacaaauuaguaacgaacuuaaucacauuuuauuggagaacgacaugaaauuuacaguaguugucggagauguugugggcauacuagcucaaggcaagaaaaugguuagaccucaacccauggaacacaaauacaguuggaaaucauggggaaaagcuaagauaauaggggccgacguucaaaauacaacauucauuauagacggcccaaauacuccggagugcccggaugaucagcgugccuggaauaucugggaaguagaagacuaugguuucggcaucuuuacuacuaauauuugguuaaaguuacgagauucauauacucaaguaugcgaucacagauuaaugagugcagcuauaaaagauucuaaggcagugcaugcugacaugggguauuggauugaaagugaaaagaacgagacauggaaguuagcacgugcuucuuuuaucgaaguaaagacuugcauuuggccuaagucccacacauuauggagcaacgggguucuggagagcgaaaugauuauaccgaaaauuuauggaggaccuauuucgcaacacaacuaucgaccgggauauuuuacucaaacagcuggucccuggcacuuaggaaaauuggaacuagauuuugaccuaugcgagggaacuacagucguuguugacgagcauuguggaaacagagguccaucauuacgaacuacaacuguuacgggaaaaauuauucacgaauggugcugucguucuuguacacuacccccacugcguuuuaaaggcgaagacggcugcugguauggcauggagauacgacccguacgagaaaaagaagaaaaccuugucaagucgaugguaucagcaggcucaggagagguagauaguuucagcuuaggauuacuuuguauaaguaucaugauagaagaaguaaugagaucgagauggucgcggaaaauguugaugacaggcacauuagcaguauucuuuuuauugauaaugggacaacuuacauggaaugauuuaauaaggaguugcaucaugguaggugcgaacgcaucugaucgaauggguauggggacaacauacuuagccuugauggcaacuuuuaagaugagaccuauguucgcagucggucuucuguuucgaagacuaacaucgagggagguuuugcuccuaacgauaggccucucuuuaguagcauccguagaauuacccaacaguuuagaagaauuaggcgacggucuugcaauggggauaaugauacucaaguugcuuacggacuuucaaucuuaccaacuaugggcaacacuuuuaagucucaccuucauaaaaacuacguucagccuacauuaugccuggaagacuauggcuaugguucugucaauugugucuuuacuuccuuuaugccuuucaacgacaagucagaaaacuaccuggcugccaguauuguuggggucuuuaggcugcaaaccccucacuauguuuuuaauagcagagaauaagauuuggggccguaagaguuggcccuuaaaugaaggaauuauggcagucggaauugucagcaucuuacucucgagucuacuuaaaaaugacguaccuuuggcagguccacucaucgcuggaggaaugcucauagccuguuaugucauuucuggauccagcgcagacuuaucucucgaaaaagcugcagaaguaaguugggaagaagaggcagagcauagcggggcaagucauaauauauuagucgagguacaggaugaugggacuaugaaaauuaaagaugaggaacgggacgauaccuugacuauuuuauuaaaagcuacauuauuggcaguaucaggcguuuacccccucagcauuccagcaacguuauucgucugguacuucuggcagaagaagaaacaaagaaguggaguguuaugggauaccccauccccgccagaaguagaaagagcuguuuuagaugacggaauauauagaauuaugcaacgaggcuuacuaggucgaagccaaguugguguuggaguguuucaagaaaacguguuucacacgauguggcaugucacacgcggcgcaguguuaauguaucaagguaaacgguuagagccuaguugggcaucaguuaagaaagauuuaauuagcuacggggguggcuggagauuacaaggcucuuggaacacaggagaagaaguacaaguaauagcuguugaacccggcaaaaauccuaagaauguccaaacugccccuggaaccuuuaagacaccagaaggugaaguaggugccaucgccuuggacuucaaaccugguacuucgggaucaccaauagugaauagagaaggaaaaauuguuggauuguaugguaacggaguuguaacgacaaguggcacuuacgugagugcaauagcccaggcaaaggcuucacaagaaggaccacuaccagagauugaggaugagguauuuagaaaaaggaauuugaccauaauggacuugcaccccgguucaggaaaaacuaggagguauuuaccugcgauagucagggaggcuauaaaacguaaacuaagaacauuaauacuagcaccaacacgaguagucgcaucugaaauggccgaagccuuaaaggggaugcccauaagguaucaaaccacugccgugaaaagugaacauacugggagagaaauugucgaucuaaugugucacgcaacauucacuaugcgccuacuaaguccagugcguguuccaaauuacaauaugauaauuauggacgaagcucauuucacagauccaucgucaaucgcagccaggggauacauaucgaccagaguuggaaugggcgaagccgccgcgauauuuaugacggcaacuccacccgguaguguagaagcauuuccacaauccaacgccguuauucaagaugaagaacgagacauaccugaaagaucguggaacucagguuaugaauggauaacagacuuuccugguaaaacuguaugguucguaccgagcauaaaaaguggaaacgacaucgcgaauugccugcggaaaaauggcaaaagaguuauucaacuuucaagaaaaacguuugauacugaauaucagaagaccaagaacaaugauugggacuauguuguuacgacagacauaucagaaaugggcgcaaauuucagggcagacagaguuaucgacccaagacguugcuugaagccugucauauugaaggaugggccagaaagagugauucuagcuggaccuaugccgguaacaguagccuccgccgcccagagacgagggagaauagguagaaaucacaauaaggagggagaucaauauaucuauaugggacaaccccuaaauaacgaugaagaucaugcccacuggacugaagcgaaaauguugcuagauaacauuaauaccccugaggguauaauaccagcauuauuugaacccgaacgagagaaaucggccgcgauugacggagaauaucgauuacgcggagaagcgagaaagacuuuuguugaguugaugcgacgcggagaucuuccuguauggcugagcuacaaaguagcgucagaaggauuucaauauucggauagacguugguguuuugacggugaaaggaacaaucaggucuuagaagaaaacauggauguggaaauauggacaaaagaaggugagagaaagaaacucagaccaagaugguuagacgcacgaacauauucagauccuuuagcauuacgagaguucaaagaauuugcggccgggcgucgaucaguaucuggagaucuaauauuagaaaucgguaaacugccucaacacuuaacacagagagcucaaaacgcuuuagauaaucuuguaauguugcacaauucagagcaaggaggacgagcauaucggcacgcaauggaggagcuaccggacacaaucgaaaccuugauguuguuggccuugauagccguccuaacaggagguguaacgcuguucuuuuuaagcggaagaggacuaggaaagacauccauagguuuacucuguguuauggcaaguagugcguuguuauggauggcaucuguagaaccacacuggauugccgccaguauaauacucgaguucuuucuuaugguauugcuaauuccagaacccgaucgucaacggacaccccaagauaaucaauuggcguauguggucauaggauuguuauuuaugauuuuaacuguagcugcuaacgaaaugggacuguuagaaacgacuaagaaagaucuuggaauaggccaugucgcaguagaaaaucaucaccacgcuacuauguuagauguagaucuccauccugcaagcgcuuggaccuuguacgcaguagcaacuaccauuaucacuccaaugaugcgccauacgauagaaaacaccacagcaaauauaucucuaacugcaauagcuaaucaagcagcaauccuaaugggacuugacaaaggguggccgauauccaaaauggauauuggaguaccauuacuagcccugggguguuacagccagguaaauccguuaacucugacugcagcuguauuaaugcucguagcacacuacgccauaauagggccaggcuuacaagcaaaagcaacaagggaggcacaaaagaggacugccgcaggcauaaugaagaauccaacgguggaugggauuguagcuauugaccucgaccccguaguauaugacgcaaaguucgaaaaacaauuaggacaaaucaugcuucuaauacuaugcacuucacaaaucuuacucaugagaacaacuugggcauuaugugagagcaucacguuagcuacuggaccgcucacaaccuuaugggaaggaucuccgggaaaauucuggaacacaaccaucgcuguaaguauggcaaauauuuuuagaggaaguuaucuagcuggugcaggucuggcauuuagccuaaugaaaagccuagggggcggucguagaggaacuggggcucagggggagacucugggagaaaaauggaaaagacagcuaaaucaacucucgaaaucagaauuuaacacguauaaaagaucagggauuauggaaguugaucguagugaagccaaagaaggacuucguagaggagaaacaacaaagcacgccguaagccgaggaacugcuaaauuacgaugguuuguugaaaggaaucuaguuaaaccagagggaaaagucaucgauuuaggaugcggaaggggagguuggucauacuauugugcugggcuaaagaaaguuacagaagucaaaggauauacaaagggaggaccaggacacgaggagccaauuccuauggcaacauauggauggaaccuagugaaacuacauagcgggaaagauguguuuuucaucccgccugagaaaugugauacacuucucugugauaucggcgaguccaguccaaauccaacaaucgaagaagggagaacacuuagaguucuuaagaugguagaaccaugguuaaggggaaaucaauuuugcauaaaaauauuaaaucccuacaugccaucuguaguggaaacacuggaacacaugcaacgaaaacauggaggaauguuaguaaggaacccccuaagcagaaauucuacgcaugaaauguauuggguuaguugcgguacgggcaacauaguuucugcaguuaauaugacgucaagaauguuacugaauagguuuaccauggcccauaggaaaccaacuuaugagagggauguagacuuaggagcugggacaagacacguagcuguugaaccugaaguagcaaaccuagauaucaucgggcaaagaauagaaaauaucaaacaugaacacaaaucgacauggcacuacgacgaggauaauccguacaagacaugggccuaucaugguucguacgaagucaaaccaucgggauccgcuucguccaugguaaaugguguuguuaaacucuuaacuaaaccgugggauguaauaccuauggugacacaaauagcuaugaccgauaccacgccuuucgggcaacaaagaguuuucaaggaaaaaguggacacaagaacgcccaaagcaaagagaggaacugcucaaaucauggagguaaccgcgagauggcuauggggcuuucuuagucgaaauaaaaagccccgcauuuggacgagagaagagguaacucgcaaaguccgaucaaacgccggcaucggcgcgggugugggugaugaaaaucaauggaauagcgccaagaaaggcguugaagaugaacgauucugggaucuaguacaccgugaaagagaacuucauaaacaagggaagugcgcaacuuguguauauaauaugauggguaagagagagaagaaacuaggagaauuugguaaggcuaagggcagucgugcgauaugguauauguggcucggcgcucgauuucucgaguucgaagccuuggguuuuaugaaugaagaucauugguucucuagggaaaauucuuuaucugguguugaaggcgaagggcuacauaaauuagguuacauacuaagagauauaaguaaaaucccugguggaaauauguaugcugacgauaccgcugggugggauacccgaauaacggaggacgaucuacagaaugaagcaaaaauuacugauauaauggagccagaacaugccuuauuagcaaccucaauauucaaacugacuuaucaaaauaaggugguaaggguacaacgcccggcgaagaauggaacuguaauggacguuauaucaagacgugaccaaagaggaucgggucaggucggcacauauggguuaaauacauuuacuaauauggaggcacaguuaauacgucagauggaaucagagggcauauuuucgccuucagaauuggaaacaccaaauuuagcagagcggguacuagacugguuggaaaaguauggcguugagagacuaaaacggauggcaaucucuggugaugacuguguagugaaaccuauagaugauagguuugccacugcucuuacugcacuuaacgauaugggaaagguaagaaaagauauuccucaaugggagccaucaaagggguggaacgacuggcaacaaguucccuuuuguucucaccauuuucaccaauugauuaugaaggacggaagagaaauagucguuccauguaggaaucaagaugaauugguagguagagcaagagucucucaaggcgcuggguggagcuuaagagaaacagccugucuaggaaaaaguuaugcccaaauguggcaauuaauguauuuucauagacgugaucucagacuugccgcgaacgcuauauguucugcugucccaguugauugggucccgaccucaaggaccacauggaguauacaugcgcaccaucaauggaugacaacagaagacaugcuaagcguuuggaaccguguuuggauugaagagaauccuuggauggaagauaagacacacauuagcaguuggggagauguacccuaucuagguaagcgggaagaucagugguguggaucacuuauaggauuaacagcgcgagcaacuugggccacaaauauccaaguagcaauaaaucaagugcgaagauuaauuggaaaugaaaacuaccuagauuacaugaccucaaugaaacgauuuaagaacgaaagcgauccagaaggagcgcuuugguag

SEQ ID NO: 21654 - RNA, 9876 nt, Artificial Sequence
  derived and/or modified CDS sequence (opt6) from DENV-1__FJ882546__SS-prME
agcgugacaauguuacugauguuaaugccuacagcucuagcauuucaccucacaacacgaggaggugaaccccacaugaucguaaguaaacaggagagaggaaaaucuuugcuuuucaaaacaagcgcaggcguuaacauguguacuuugaucgcuauggaccuuggagaacuaugugaagauacaaugacauacaaauguccccgcauaaccgaagcagaaccagaugacguggauuguuggugcaacgccacggacacauggguaaccuaugguacaugcagucaaacaggggaacaucguagagauaaaagaaguguggcgcuggccccacaugugggauuaggucuagaaacgaggacugaaaccuggaugaguagugaaggagcguggaaacaaauccaacgaguagaaacaugggcauuaagacaucccggauuuaccgucauagcauuauuuuuagcgcaugcuauaggaacaagcauaacucaaaaaggaauuauauuuauucucuugaugcuugugacaccaagcauggcaaugagaugugucgggaucggcagcagagauuuuguagaaggauuaaguggugcuacauggguugauguuguacuggagcacggaucuugcguuacuacaauggccaaagauaaaccuacauuggauaucgaacuacuaaagacagaaguaacgaauccugcuguacuacgcaaacuguguaucgaagcaaaaauaaguaauacgacuacagauuccagguguccaacacagggugaagccacuuugguagaagaacaagaugcuaauuuuguuuguagaaggaccuuuguagaucguggcuggggaaaugguugcggccuuuuugguaaaggaagccucauuacuugugcgaaauuuaagugugucacaaaguuagaaggaaaaauuguucaguacgaaaaccugaaguauucuguaauuguaacggugcacaccggugaucaacaucaggugggaaaugaaaguacggaacacggcacaacagcaacaauaacuccacaggcaccuacaacugaaauacaacuaacagacuauggugcccugacucuugauugcucucccagaacaggacuugauuuuaaugaaaugguucuauugacaaugaaggaaaaaaguuggcuaguacacaagcaaugguuuuuagauuuaccuuuaccguggacuagcggcgcgucgaccucccaagagacguggaaucgucaagaccuucuggucacauuuaaaacugcgcacgcaaagaaacaagaaguuguagugcuaggaucacaggaaggagcaaugcacacggcauuaacuggggcuacggaaauucagaccucagguacaacaacuauauuugccggacauuugaaauguagauuaaaaauggauaagcuuaccuuaaaggguaugaguuacguaauguguacaggaaguuucaaauuggaaaaagaaguggcagaaacccaacaugguaccguacuaguacaaauaaaauacgaagguacagacgcaccaugcaaaauacccuucucaacccaagaugagaaaggggucacucaaaacgggcgacuaauaacagccaauccaauagugacggacaaggaaaaaccugucaacauugaagcugaacccccguuuggcgagagcuacauaguuauuggcgcaggggaaaaagcguuaaaacugucaugguucaagaaaggcucgaguauaggaaaaauguucgaagccacagccaggggagcacgcaggauggcaaucuuaggagauacagcaugggauuuugggucaauuggcggugucuuuaccaguguagguaaacuuguucaucaaauauucggaacagcauauggugugcuauuuucaggagucaguuggacaaugaaaauugguauuggcguccuucuaacuugguuagggcuaaacucaagaucaacaucauuaucaaugaccuguaucgcuguugggcuugucacuuuauaucuugguguaaugguucaagcagacucugguugcguuaucaauuggaaaggaagagaguuaaaguguggauccgguauuuuuguaacaaacgagguucacacauggacagaacaauauaaauuucaagcggacuccccgaaaagacuuucugccgccaucggcaaagcaugggaagagggugucuguggaaucagaucagccacuagguuagaaaacauaauguggaaacagauuucuaaugaguuaaaccauauauuacucgaaaacgacaugaagcuaacgguagucguaggagacguugcuggaauucuuggacagggaaagaaaaugauuagaccacaaccgauggaauauaaauacucguggaaaagcugggggaaggcaaagauuauuggugcugaugcucaaaacacuacguuuaucauagauggacccaacacuccugaauguccagaugaccaacgugcauggaacauaugggagguagaagacuacggauucgggauauuuaccacaaauaucuggcuuaaacuuagagauucguacacacagguaugugaccauagacucaugagcgcagcaaucaaagauaguaaagccgugcaugcagacaugggauauuggauugaaagugaaaaaaaugaaacuuggaaacuagcucgggcgucuuuuauagaaguuaaaacguguauauggcccaaaagccauacucucugguccaacggcgucuuagagucagaaaugauaauacccaagauuuacgggggcccgauaucacaacacaacuauagaccuggauacuucacacagacggcgggaccguggcacuuaggaaaacucgaauuggauuucgaccuuugugaaggaacaacagugguaguugaugaacauuguggaaacagaggccccagccuccgaacaacuacuguaaccggaaaaauaauccaugaaugguguugucgauccugcaccuuaccuccucuuagguucagaggagaagauggauguugguacggaauggaaauacguccaguaaaagagaaagaagaaaauuuaguaaaaucaauggugagugcagguuccggagaaguggauucuuuuagccugggcuuacuuugcauaagcauaaugaucgaggaaguuaugcgaucuagauggagccguaaaauguuaaugacugggacacuagcaguauucuuuuuacugauaauggggcaacuaacauggaaugaccuaauaaggcuaugcauuauggucggggcuaaugcaagugaucgcaugggcauggguacgacauacuuagcguuaauggcaacauuuaaaaugagaccaauguucgcuguaggauuauuauuucgucgacuaaccucaagagaaguacuacuccuaaccauuggucucagcuugguagcaaguguagaacucccgaacaguuuagaagaacuaggagauggacuagccauggguaucaugauucuaaagcuucugacggauuuucaaagucaucaacuuugggccacauuguuaucucuuacguucauuaaaacaacauuuagucuacauuacgcuuggaaaacuauggccaugguauuaucuaucgugaguuuauuuccccucugccuuucaacaacaucucagaaaacuacuugguugccuguauuauuagggucuuugggaugcaaaccacuaacgauguucuuaaucgcugaaaauaagauauggggaagaaaaagcuggccacuuaacgaagguauuauggcuguaggcauagugaguauacuacugucaagucuacucaaaaaugaugugccauuagcuggaccucucauagccgguggaauguugauagcaugcuaugugaucaguggaucuucggcagaucugaguuuagaaaaagcggccgaaguaucuugggaagaagaagcugagcauaguggagcaucacacaacauauuaguugagguacaagaugaugguacaaugaagauuaaagaugaagaaagagaugacacucuaacaauuuuacuaaaagcuacucuauuagcaguuaguggcgucuacccucuuucaauaccugcgacgcuguuuguaugguauuucuggcaaaaaaaaaaacaaaggagcgguguauuaugggacacaccauccccccccgaaguugaaagagcggugcucgaugauggaauauaccgaauuaugcaacgaggccuguuaggcagaucacagguaggaguaggaguauuccaagagaauguuuuucacacaauguggcauguaacaaggggagcugugcuaauguaucaaggaaagcgacuagaaccaucaugggcgucugucaaaaaagaccuaauuucauacgggggaggauggagauugagagguucuuggaacacgggggaggaaguacaaguuaucgcaguggagcccgggaagaauccuaagaauguacaaacggcaccggguacauucaaaacaccggaaggagaaguaggggcgaucgcucucgauuucaaaccgggaacaaguggauccccuauugugaauagagaaggaaaaauagucggacuuuacgggaauggaguaguaacaaccucaggcacauacguuucagcaauagcacaagccaaagcgagucaagaagguccauuaccagagaucgaagaugagguguucaggaagagaaaucuaacaauaauggaccuucacccagguagcggaaaaacucgaagguaccuaccugcuauaguaagagaagcuaucaagaggaagcuucgaacucuaauccuugcaccaacaagagugguagcuucagagauggcggaggcuuugaaagggaugccuauaagauaucaaacaaccgcgguaaagucugagcauacagggaaagaaauuguagaucuaaugugucacgcaacguucacgaugagauuacugagcccagucagaguaccaaauuauaauaugauuauuauggaugaggcucauuuuaccgaucccucaucgaucgcagcucgcggcuauauaaguacgcgggucggaaugggugaggccgcugcgaucuuuaugacagccacaccuccaggguccguagaagcguuuccacaaucaaacgccgugauacaagacgaggaaagagacauuccugaaagaagcuggaauucgggauaugaauggauaacggacuuuccagggaagacaguaugguuugucccuagcauuaaaagcgggaacgacauagcgaauugucuuagaaaaaacggaaaaagaguaauacaauuaucaagaaagaccuucgauacagaguaucagaaaacaaaaaauaaugauugggauuauguaguaacgacugacauuagugaaaugggagcaaauuuccgagcagaccgugugauugacccgagacguugcuuaaagcccgucauucuaaaggacgguccggaaagaguaauacucgccggaccaaugccagugaccguagcguccgcagcacaacgaagggggagaauaggcaggaaccauaauaaagagggagaccaauacauauauaugggacagccauuaaauaaugaugaggaucaugcacauuggacugaagcaaaaauguugcuggacaauaucaauacuccagaaggaauuauuccagcacuauucgaaccugaaagggagaaaucggcggcuguggauggagaguauaggcucagaggugaggcaagaaaaacuuucguagaacucaugagaaggggagaccuuccgguauggcuuucauauaagguagcuucagagggauuccaauauagcgauagacgauggugcuucgauggugagagaaacaaucaaguacuggaagagaauauggauguagaaauuuggacgaaagaaggugaaagaaagaaauugcgaccccgauggcuagaugcacgaacauacucagacccguuagcuuugcgagaauuuaaggaguucgcagcgggcagaaaaucgguaucaggugaucucauacucgaaauuggaaaauuaccgcaacaccuaacucaacgcgcacagaacgcccucgacaaucuuguaaugcuacauaauucggaacaaggaggacgagcguaucgccaugcgauggaagaauuaccagacacuauagaaacucuaauguuauuagcgcuuaucgcaguguuaacaggaggaguuacacuguucuuucuuagcggcagaggguuagguaaaaccucuauaggauuacuaugcgucauggccaguagcguuuuguuauggauggcuucaguagaaccacauuggauagccgccucaaucauuuuagaauucuuccuuaugguacuauuaauucccgaaccugauagacaaagaacuccucaagauaaucaauuagcguauguagucaucggauugcucuuuaugauacuaacgguggcggcaaaugaaauggggcuccuugaaaccacuaaaaaagaucuuggcauaggacacguugcuguggagaaucaucaccacgcagcgauguuggauguugaucugcaucccgccagugcuuggacacuguaugcgguagcaacaacgaucaucacgcccaugaugagacauacaauagaaaauacaacagcuaauauuagucugacagcgauagcgaaucaagcagcgauauuaaugggguuggacaaaggauggccaauuucuaagauggacaucggaguaccguuacuagccuuaggauguuacagccaagugaacccacuuacucuaaccgcagcuguacuaaugcuaguagcucauuaugcuauuaucggucccggccuucaagcuaaggcuacucgagaagcacaaaagcguacagcugccggcauuaugaaaaacccaacuguggacggaauagucgcaauugaccuggaccccgucguauaugacgcaaaauucgaaaaacagcuaggacagaucauguuacugauucuaugcacuucucaaauauuacuaaugcguacuacgugggcauuaugugaaaguaucacgcuagcaacuggcccgcuaacaacuuuaugggaaggcaguccaggcaaauuuuggaauacaaccaucgcuguaucaauggcuaauauauucagaggauccuaucuugcuggugcgggccuagcauuuaguuugaugaaauccuugggaggaggcaggagaggaacaggggcucaaggugaaaccuuaggggagaaauggaaacgccaauuaaaccagcuuucuaaaucugaauuuaauacauacaaaaggucaggcauuauggaaguagauagaagcgaagcaaaagaaggucucaaaagaggcgaaaccacuaaacaugcagugucucgugggacugcaaaacuuagaugguuuguagagaggaaccuugugaaaccagaaggaaagguaauagaccuuggaugcgggcguggcgguuggaguuauuauugcgcgggacuaaagaagguuaccgaagugaagggauacacaaagggugggccaggccaugaggaaccuauaccaauggcaacguauggauggaaucucgugaaacuacacucuggaaaagacguauuuuucaucccaccugaaaaaugcgacacauuacuaugugacauuggugagucaagcccuaacccgacaaucgaggaagguaggacuuugcguguacuuaagauggucgaacccuggcuucgagguaaucaauuuugcaucaaaauauugaacccauauaugcccaguguuguagaaacgcuagaacaaaugcaacguaaacauggagguaugcuaguuagaaacccacuuucucgaaacagcacucaugaaauguauuggguuucgugcgggacggguaauaucguaucagcgguaaacaugacaagccgaauguuacuaaacagguuuacaauggcucaccgaaaaccaacauaugaacgggacguagaucucgggacagggacgcggcacguugcuguagagccugaaguagcgaaccuggauauaauaggucaaaggaucgaaaauauaaaacacgagcacaaaaguacguggcauuacgacgaagacaacccauauaaaacuugggcuuaucacgguaguuacgaggucaaaccaaguggaagugcaucgucaaugguaaacggugucguaaaacuguugacuaaaccaugggauguaauucccauggucacccaaauagcaaugaccgaacuacaccuaggacaacagagagucuucaaggaaaaaguagauacaaggacgccucgugcuaaaagagggaccgcucaaauuauggaaaugacagcccgauggcucuggggauuuuugaguagaaacaaaaucccaagaauauguacuagggaggaguuuacacguaaaguuagaucaaaugccgccauaggggcagucuuuguugaugagaaucaauggaauagugcaaaggaagccguugaagacgaacgguuuugggaccuugugcaccgggaaagagaguuacauaaacaaggcaagugcgcaaccugugucuauaauaugaugggaaaaagagagaaaaaauuaggugaguuuggaaaagcaaaaggaaguagagcaauaugguacaugugguugggcgcaagauuucuagaauuugaggcauuggguuucaugaaugaagaucauugguuuagcagagaaaauuccuuaaguggcguggaaggggaaggucuccauaaauugggauacauuuuacgcgauauaucaaaaauuccaggcggaaacauguaugcggacgauacugcaggaugggacacaaggauuacugaagaugauuugcaaaaugaggccaaaauuacugauauuauggagcccgagcaugcccuacuagcaaaagcuaucuucaagcuuacguaucaaaacaagguaguaagaguacaaagaccagcuaaaaauggcacagucauggacguuauaucacgaagagaucagagaggaucaggccaagugggaaccuacgggcucaauaccuuuacaaauauggaagcacaauugauuagacagauggaaucagaagagauuuucucuccguccgaacuggaaacaccaaauuuggcugaacgagcuuuggacuggcuugaaaaauacggcguagaacgucuuaagaggauggccauaagcggugacgacuguguugugaagccgauagaugauagauuugcuacagcccucaccgccuuaaaugauaugggaaaaguaagaaaggauauaccucaaugggaaccgaguaaaggauggaaugauuggcaacagguaccauucugcagccaucauuuccaccaauuaauaaugaaagacggcagagaaauuguugugccaugucggaaucaagaugaauugguagggcgagcucgagucucccaaggcgcagguuggucucuacgggaaacagcuugccuagguaaaucguacgcccaaauguggcaacuaauguacuuccacagacgggaucuucgucucgcagcaaaugcgaucugcucagccgucccaguugauugggugccuacuucccggacaaccuggagcauccacgcccaccaucaguggaugacuacugaagacaugcugagcguuuggaacaggguuuggauugaagagaauccauggauggaagauaaaacccauauaaguuccugggaagacguuccuuauuuaggaaaaagagaagaucaauggugcggcagccucauagguuuaacagcccgcgcuacuugggcuacuaacauucaaguugccauaaaucagguucggcgauuaauuggcaacgaaaauuaucuugacuacaugaccucaaugaaaagguuuaaaaaugagucagaccccgagggagccuuaugguga

SEQ ID NO: 21655 - RNA, 9879 nt, Artificial Sequence
  derived and/or modified CDS sequence (opt6) from DENV-1__KF921935__SS-prME
agcgugacgauguugcuaaugcuuaugccuacugcucucgcauuucaucuuaccaccagagguggagaaccacauaugauaguaucaaaacaagaacgaggaaaaucacucuuauuuaaaaccucagcuggggucaauaugugcacguuaauagcuauggaucugggagaacuuugcgaagacacuaugacguauaaaugucccagaauaacugaaacugagccugacgaugucgacuguuggugcaacgcuacggacacuuggguaacguaugggacauguucccaaacgggagaacaccgacgagacaaaagaucuguugcuuuagcgccucaugucggacugggucuugaaacaagaacggaaaccuggaugaguucugaaggggcguggaaacaaauacaaagaguugagacuugggcacugcgccacccaggauuuacagugauugcacuauuucuagcacacgcaauagggaccagcauaacacaaaaaggaauaauauuuauucuuuugaugcugguaacgcccucuauggcaaugcgcuguguagguauagguucuagagauuuuguagaaggguuaaguggagcaacguggguagaugucguucucgagcauggcucauguguuaccacaauggcuaaagacaaaccaacucuagacauagaguuacucaagaccgagguaacuaauccugcaguacuaagaaaacuuuguauagaagcuaaaauaaguaauacaaccacugauucucgauguccaacacaaggagaagcuacgcucgucgaagaacaggaugcuaauuuuguaugucgaagaacauuuguagauagaggcuggggcaaugguugugguuuguucgguaaagggagucuaauaacaugcgccaaguucaaauguguuacuaaauuagaagggaaaauugugcaauaugaaaaucuaaaauauaguguaauuguaacuguacauacgggagaucaacaucaagucgggaaugagaguacggaacacgguacaacagcaacuaucacaccccaagcccccacaacggagauacaauuaacagauuauggagcauuaacacuugauugcagucccagaacaggguuagauuucaacgaaaugguacuauuaacaaugaaagaaaaaucauggcucgugcacaagcagugguuccuugaccuaccuuugccuuggacaucuggggccucaacgucucaggaaacauggaaucgacaggacuuacucguaacuuucaagacggcacacgccaagaaacaagaagugguuguacuaggaucacaggaaggggcgaugcauacggcauuaacaggugccacagagauccaaacgucgggcacuacuaccaucuuugccggacacuugaagugcagauuaaaaauggacaaacuaacauuaaaaggaaugaguuacgugauguguacagggucguucaagcuagagaaagaaguugcugaaacacaacacggaacagucuuaguacagauaaaauaugaaggcaccgacgccccuuguaaaauccccuuuuugacacaagacgagaaaggaguuacacaaaacggacgacuuauaacugcuaauccgauaguaacagacaaggaaaaaccuguaaauauagaagcggaaccaccuuuuggggaaucuuacauaauaauaggugcgggagaaaaggcauuaaaacucaguugguuuaaaaaggggaguagcaucgguaagauguuugaggcuacagcccgaggcgcaagaagaauggcaauauuaggggacaccgcaugggauuuuggcagcauuggcggaguauuuacuucuguagguaaauuaguacaucaaaucuuuggaacagcauauggcguacuguuuucuggagucaguuggacuaugaaaauuggaauaggaguccugcuuacaugguugggauugaacaguagaagcacaagucugagcaugacaugcauagcagugggacucguuacauuguaucugggagucaugguacaagccgauucgggaugcguaauuaauuggaagggucgugaauuaaaauguggcaguggaauauucguuacuaacgagguccauacauggacagaacaauauaaauuccaagcggauagcccgaagagacuaagcgcagcuauaggaaaggcuugggaagaagguguauguggcauuagaucagcuacuagguuagaaaacauaauguggaaacaaaucucuaacgaauuaaaucacauuuuauuagaaaaugacaugaaauuuacaguagucguuggagacgucgcaggcauucuagcacaaggcaaagaaaugauacgaccccagcccauggaauauaaauacucauggaaaaguuggggaaaagcaaagauaauaggcgcagauguacagaacacuacguuuaucauagauggaccaaacaccccugaaugcccugaugaucaaagagcguggaauaucugggaaguagaagauuaugguuuuggcauuuucacgaccaauauuuggcuuaagcuaagggauagucacacacagguaugcgaccauaggcuuaugucugcugcuauaaaagauucaaaagcaguucacgcagacaugggcuauuggaucgagagcgaaaagaacgaaaccuggaaacucgcaagagcaaguuuuaucgaaguaaaaacaugcauauggccaaagucacauaccuuguggucuaauggaguauuagaaucagaaaugauaauaccgaaaaucuacggugguccuauuucacaacauaauuauagaccaggcuauuuuacgcaaacugcggguccauggcaucuugggaaguuagaacucgauuuugaucuaugcgaagguacaaccguggucguagaugaacauugugguaacagagggccaucacuuagaacuacgacugugacggggaaaaucauucaugaaugguguugcagaucauguacauugccaccccuaagauuucggggagaagauggaugcugguaugggauggaaaucagaccaguuaaagagaaagaagagaaccucgucaaaucaaugguaucugcuggauccggugagguggacagcuucagucuaggacucuuaugcauuucuauaaugauagaagaaguuaugaggucgcgauggucacgaaagauguuaaugaccggcacucucgccguauuuuucuuacuuauuaugggacaacuuacauggaaugaucuuauaagacuaugcauaauggugggugcaaaugcauccgacagaaugggaauggguacaacauacuuagcacucauggcaacauucaagaugagaccgauguuugcaguaggccuauuguuccgucggcucacuagccgugaggugcuacucuuaacaauuggucuaucuuugguagccucagucgaauuaccgaauagucuugaggaacuaggggacggauuagcgaugggaaucaugauuuuaaaguuauugacagauuuccaaagucaucaacuaugggccacgcuauugucacucacuuuuauuaaaacaacguucucauugcauuacgcguggaaaacuauggcaaugguccuuucuauaguaucauuauuuccuuuguguuuaucgacgacaucccaaaagacuacauggcucccuguacuacuaggcagccuaggaugcaaaccauuaacaauguuucugauagccgagaacaaaauauggggaaggcggagcuggccgcugaaugaagguauaauggcaguaggaauaguguccauuuuacuaaguagccuacugaaaaacgacguccccuuggccgguccguugauagccggugguauguuaauugcuuguuauguaauaucgggaucgucggcugacuuaucacuagaaaaagcggcugaaguuagcugggaggaggaagcagaacauaguggcgcaucgcauaacauacuuguugagguacaagacgauggaacgaugaaaauaaaagacgaagaaagagaugauacucuuacuauccuauuaaaagcaacuuuacuugcagugaguggaguauacccacuaucaauuccagcgacuuuauuuguaugguacuuuuggcagaaaaagaaacaacgaagugggguccucugggauacucccagcccucccgaaguagaacgugcuguccuagacgauggaauauaccgaauaaugcaaagaggucuacugggaagaagccaagugggagucggagucuuucaggagaaugucuuucacacaauguggcacgucacacgaggggcaguuuuaauguaccagggaaaacgacuagaaccuagcugggcaaguguuaaaaaggaucugauaucauauggcgguggguggcguuuacaagguucuuggaacaccggcgaagaaguucaagucauagcuguagagccggguaaaaauccuaagaauguacaaacagcuccggguaccuuuaaaacuccagagggagaaguaggagcaauugcccuggacuuuaaaccuggcaccucugggucaccuauuguaaauagagagggcaagauaguaggacuauacggcaauggagugguuacgacaucuggaacguaugucucagcuauagcccaagcuaaggcgagccaggagggcccucugcccgaaauagaggacgagguguucagaaaaagaaauuuaaccauaauggauuugcauccagggucaggaaaaacacgucgauaucugccagcaauagugagagaagcaauaaaaagaaaacuuagaacgcuuauuuuagcaccaacaagagugguugcaagcgaaauggcagaagcucucaaaggcaugccaauucgauaccagacaacagcgguaaaaucugaacauacugggaaagagauaguugaucuaaugugucaugcaacauucacuaugcgacuauuaucucccgucagaguaccaaauuauaauaugaucauaauggacgaggcgcauuuuacagaucccaguuccauagcagcacgaggguauauaucaacacgaguggggaugggagaggcggcugcaauuuuuaugacagcaaccccuccagguucgguagaggcguucccacaaucaaacgcugugauacaagaugaggaaagagauauaccagaacguucuuggaacuccggcuaugaauggauaacggacuucccaggaaaaacagucugguucguaccuucaauaaaauccgguaaugauauagcaaacugucucaggaaaaauggcaaacgagucauacaguuaagccgaaaaacauuugauacugaguaucagaaaacgaaaaacaacgauugggauuauguuguaaccacugauauaucugaaaugggagcaaauuuccgggccgauaggguuauagacccccgcagauguuuaaaaccaguuauuuuaaaggauggcccggaacgaguaauauuagcuggaccaaugccaguaaccgucgcaucugcugcucaaagacgaggccguauaggaaggaaucauaauaaagaaggugaucaguauauauauaugggacaaccacuaaacaacgacgaagaucaugcgcacuggacggaggcgaaaaugcuauuggauaacauaaauacacccgaggggauuaucccagcauuguuugaacccgagagggaaaaaucagcagcaauagauggagaauauagguugaggggagaagcacggaagacauucguugaauuaaugagaagaggagaucuaccagucuggcuuucauacaaaguagcaagugaggguuuucaguacuccgaucguaggugguguuucgauggagaacggaacaaucaagugcuagaagaaaauauggacguugaaauauggacaaaagaaggugagaggaagaaauuacgaccacgaugguuagacgcuagaacauacucggacccucuggcauuacgugaauuuaaagaauuugcugcugggaggagaucugucuccggagauuuaauacuggaaauagguaaacuaccacaacaccuaacccaaagagcucaaaaugcuuuggacaauuuagugauguugcauaauagugaacaaggugguagggcuuaccggcacgcuauggaggaauuaccagauacgauagaaaccuuaauguuacucgcguugauagcuguauuaacgggaggaguaacauuauucuuucuauccggccgaggucuagggaaaacaaguaucggacugcuaugcguuauggcaucgucaguccuauuguggauggcgucuguugagccgcacuggauagccgcaagcauaaucuuggaguucuuuuugaugguacuuuugauaccugaaccugacagacaaagaaccccacaagauaaccaacuagcauacguuguaaucggccuauuguuuaugauuuuaaccguggcggcuaaugaaaugggucuccucgaaacaacaaagaaggacuuggguauuggucauguagcagucgagaaucaucaucaugcagcaaugcuagauguggaucuucauccggcaagugcauggacuuuguaugcuguugcaaccacuaucauaacucccaugaugaggcauacaauugaaaauacuacagcuaacauuucacugacagcaauagcaaaccaagccgcaauucuaaugggacuagacaaaggauggccuauuagcaagauggacaucgggguuccacucuuagcuuugggauguuauagccaaguaaauccccuuacucuaacggcagcaguauuaaugcuagucgcucauuacgcuauaauuggaccgggcuuacaggcgaaggcaacccgagaagcgcagaaaagaacugcagcagguauaaugaaaaauccaacaguagacggcaucguggccauagaccuagacccuguuguauaugacgcuaaauuugaaaaacaauuaggccaaauaaugcucuugauccucuguacaucccaaauuuuguuaaugcguacaacaugggcuuuaugugagucaauuacauuagccacugguccuuuaacuacguugugggaggggucuccaggcaaauuuuggaauacuaccauagcuguuucaauggcuaauauauucagaggaucauaucuagcuggggcaggacuggcuuucagccucaugaaaucacucggcggagggcgaagagggacaggagcucaaggagaaacguuaggggaaaaauggaaacgacagcugaaucaacuaagcaaaucugaguucaacacauauaaaagaucaggaauaauggaaguugauaggucagaagcaaaagagggacuuaaaagaggagaaacaacaaaacacgcaguaucacgaggaaccgcaaaacuccggugguucguggaaagaaauuugguaaagcccgaggguaaaguuauagaucugggcugcggcagaggcgguuggaguuauuauugugcuggcuugaagaagguaacggaggugaagggauacacgaagggagguccgggacacgaagaacccauacccauggcgacauauggcuggaauuugguaaaacuucauucugggaaagauguauuuuucauaccaccggaaaagugugacacacuacucugcgacaucggagaaucgucaccuaauccaacuauagaggaaggaagaacucuccgagugcugaaaaugguagaaccaugguuaaggggcaaucaguuuugcauaaaaauauugaauccuuacaugccuucuguaguagaaacacucgaacagaugcagagaaaacauggagguaugcuagugcguaauccucucucacguaauucgacgcaugaaauguacugggucagcuguggaacaggcaauauugucucagcgguaaauaugacaagcaggauguuacucaaucguuucacaauggcacauagaaaaccaaccuaugaacgagacgucgauuuaggggcaggaacaagacauguggcgguagaaccagaaauagcaaacuuagacaucauaggccaaagaauagaaaacauaaagcaugaacacaaaucuacauggcauuaugaugaggauaauccuuacaaaacuugggcauaccauggaucguaugaagugaaaccgaguggaagugccagcucaaugguaaauggaguaguuaaacuauugacaaaaccaugggacguaaucccuaugguaacgcaaauagcaaugacugauaccacuccuuuuggccaacaaagaguauucaaagaaaaaguagauacccggacgccaaaagcuaaaaggggaacugcccaaauaauggaaguuaccgcuaaaugguuauggggauuucuuucccgaaacaagaaacccagaaucuguacgcgggaagaauuuacccguaaagugcguucgaaugcagcaauaggggcaguuuuuguugaugaaaaucaguggaacucagccaaggaagcaguagaagaugagagguuuugggaucugguacaccgagaacgagaauugcauaaacaaggaaagugcgcaaccugugucuacaacaugauggguaaaagagagaagaaauuaggagaguucggaaaagcuaaaggcagcagagcaauaugguauauguggcuaggcgccagauuucuagaauuugaagcccucggauuuaugaacgaagaucacugguuuucacgcgaaaacucuuugucuggcguagaaggagaaggucuccacaaacuaggauacauucuuagagauaucucaaaaauccccggugggaacauguaugccgaugauacugcugguugggauacacgaaucaccgaagacgacuugcaaaacgaagcuagaaucacugacaucauggaaccagaacacgcuuugcucgcaaaaucuauuuucaaacuaacuuaucaaaacaaagugguacguguacaacguccugccaaaaaugggacgguuauggauguaauuagcaggagagaccaaaggggaucgggccaagucgguacuuauggcuuaaacacauucaccaacauggaggcccagcuaauaagacaaauggaaagugagggaauauucaguccuagugagcuagaaacacccaaccuugccgaacgaguguuagacuggcucgaaaaauauggaguggagcgccuuaagagaauggcaauaaguggcgacgacuguguaguaaaaccaauugacgauagauuugccacagcacuaacagcuuugaaugacauggguaaagugcgaaaagauauaccccagugggaaccaucaaagggguggaaugacuggcaacaaguaccguuuuguucacaucauuuccaccagcuaauaaugaaagacgguagagaaauugugguuccaugucgcaaucaagacgagcucguagguagagcacgagugagucagggugcaggguggucauuaagagaaacagcgugucuaggaaagucauacgcccaaauguggcaauuaauguacuuucauagacgugaccuaaggcuugcggcuaacgcuauauguucggcaguaccaguagacuggauaccgacgucgcgaacuaccuggaguauacaugcacaucaucaguggaugacgacagaagacaugcuaucugucuggaaucguguuuggaucgaagagaauccguggauggaggauaaaacgcacauaaguuccuggggugauguccccuauuuaggaaagcgagaagaucaaugguguggaagucuuauuggccuuacagccagagcaacuugggcuacuaacauacagguagccauaaaucaaguucggcgacuaauagggaaugaaaauuaucuagauuacaugacaagcaugaaaagauucaaaaacgaaggugacccagaaggugcguuaugguaa

SEQ ID NO: 21656 - RNA, 9879 nt, Artificial Sequence
  derived and/or modified CDS sequence (opt6) from DENV-1__GQ199776__SS-prME
ucaguaacaauguuacuuauguuaaugccaacagcauuagcauuccacuuaacgacaagggguggagaaccacauaugauaguuucuaaacaagaaagggguaaaucccuucucuuuaaaacauccgcaggagugaauauguguaccuuaauagcaauggauuugggagaacuuugugaagauacuaugacguauaaauguccuagaaucacagaaacugaaccugaugauguagauuguuggugcaaugcaacagauacuuggguaacguauggaacauguucccagacgggagaacacagaagagauaaacggagcguagcuuuagcaccacacguagguuuaggacucgaaaccagaacugaaacguggaugaguucugagggagcauggaaacagauacagagaguagagacgugggcucuacgccacccuggguuuacuguaauagcacuauuucuagcacaugcaauaggaacaaguauaacacaaaaagguauaauuuuuaucuuauuaaugcucgugacaccgaguauggccaugcgaugcguaggaauaggaucuagggacuucguugaagguuuaucgggcgcgaccuggguugaugugguacucgaacacggaucaugcguaaccacuauggccaaagauaaaccuacccuagacauagaacuccuuaaaacagaaguaacuaauccagccguacuuagaaaacucuguauagaggcgaaaaucucaaacaccacaaccgacuccagauguccgacgcagggugaagccacucuuguagaagaacaggacgcuaauuuuguauguagacgcaccuuuguagacagaggaugggguaauggaugugguuuauuugggaaagggucacugauaacaugugcaaaauucaaauguguaaccaaacuagaaggaaaaauaguucaauaugaaaauuuaaaauacucaguaaucguuacaguccauacuggggaccaacaccagguaggaaacgaaucuacggagcaugggacaacggccacaauaacuccacaagcacccacaacggaaauacaacugacagauuauggugccuuaaccuuggauuguagcccacgaacaggauuagauuucaaugagaugguauuacuuacuaugaaagaaaaaucguggcuaguacauaaacaaugguuucuagauuugccacuaccuuggacuuccggagccagcaccucccaggaaacauggaauagacaagauuuacuuguuacguuuaaaaccgcccacgccaagaaacaagagguagugguauuaggaucacaagaaggugccaugcauacagcccuuacuggugcaacagagauucaaacaaguggcacaacaacaauuuucgcugggcaucucaaaugccgucuaaaaauggacaaacucacccucaaaggaaugucauacguuaugugcacagguucguuuaaacuggaaaaagagguugcagaaacacagcacggcacuguucuagugcagauaaaauacgaaggaacugaugcacccugcaaaauaccguucucaacccaagacgagaaaggugugacccaaaauggcagauuaauaacugcaaaccccauuguaaccgacaaagaaaaacccgugaauauagaagcugaaccacccuuuggagagucauauauagugauaggagccggugaaaaagcacugaaauuaaguugguucaagaaaggaucaucaauagggaaaauguuugaagcgacagcccgaggagcgagaagaauggcuauacugggagauacagcuugggauuuugguucaauaggcggggucuuuacaaguguuggaaaauugguucaucaaauauucggaacugcuuacggggugcucuuuagcggcgucucauggacuaugaaaauuggcauaggaguucuguuaaccugguuaggucuaaauucaagaaguacaucucuuucaaugacauguauagccgucggacuuguaacucuauacuuggggguuaugguacaagcagauagugggugcguuauaaacuggaaaggaagagaauuaaaauguggcucgggaauuuuuguaacgaacgagguucacaccuggacagagcaauauaaauuccaagccgauucgcccaaaagguuaucagcagcaauuggaaaagccugggaagagggagucugugguauacgaucagcuacacgacuugaaaacauaauguggaaacaaauaucuaaugaauuaaaucacauucucuuagaaaaugauaugaaauuuacuguuguaguaggagauguggcaggaauauuggcgcaaggcaaaaagaugauaagaccccaacccauggaauauaaauauucauggaaaagcugggguaaagcaaagauaauaggagcagaugugcaaaauacaacauuuaucauugacgguccuaauacaccggaauguccggaugaucaaagagcauggaauauuugggaaguagaagacuauggauucggcauuuuuacaacuaacauuuggcuuaaguugcgagauucauauacucaagugugugaucacagacuaaugagcgcugcuauuaaagauagcaaagcaguacaugcggacaugggcuauuggauugaauccgagaaaaaugagacguggaaguuagcgagagcgaguuuuaucgaaguuaaaacguguauauggccaaagucacacacuuuauggaguaacggcguauuggaaagugaaaugauaauaccuaagaucuauggaggaccaauuucacaacauaauuacagaccuggauauuuuacccaagcagcagggccauggcauuuaggaaaguuggaacuagacuuugaucuuugugaagggacaacugucgucguugaugaacacugugguaaucgagguccaucguuacgcacuacuacuguuacagguaaaaucauacaugaauggugcugucgcaguugcacucucccuccacuuagauuucguggagaagaugguuguugguacggaauggaaauccguccgguaaaggagaaagaagaaaaccuaguuaaaucaauggugagugcagggaguggggagguagauucauucagucugggauugcuaugcauuagcaucaugaucgaggaaguaaugaggucucgauggagcaggaggauguuaaugaccggcacacuggccguauucuuuuuauuaauaaugggacaacuuacauggaaugaccugauucgacuauguauuauggucggggcgaacgcuucagauagaauggguauggggacaacguaccucgcacucauggcuacuuuuaaaaugagaccaauguucgcaguaggacuacuauuccgucgauugacgucgagagaagugcuccuccugacaauugggcuuucucugguagcaucgguagaauuaccuaacucucuugaagaacugggugacgguuuggcgaugggaauuaugauauugaaacuacuaacagauuuccaaucucaucaauuaugggcaacauuauuaaguuuaaccuucaucaagacuacgcuaucauugcauuaugcuuggaaaaccauggccaugguacuaucuauagucucccuauuuccacuaugcuugucuaccacaucucagaaaacaacauggcugccagugcuucugggaucucugggaugcaaacccuuaacuauguuucuaauagcugaaaauaaaauauggggaagacggagcuggcccuuaaacgagggaauaauggccguaggcauaguuaguaucuuguuaucaagucuucucaaaaaugauguuccauuagcaggaccucugauagcuggugguaugcuuauagccugcuauguuauaucaggaucauccgcagacuuaagucuugagaaagcugcggaaguaaguugggaggaggaagcggagcauucgggagcuagucacaauauacucgucgagguacaagacgaugggacaaugaagauaaaggaugaggaaagagaugauacgcuaacuauccuacuaaaagcaacacuguuagcuguuucaggcguuuauccguuaucaauccccgcuacauuauuugugugguacuucuggcagaagaagaaacaaagaucaggcguacucugggacaccccaagcccaccagaaguggaacgagcaguacuggaugauggcauuuauagaauuaugcagcgagguuuauugggacggagccaaguugggguagguguauuucaagaaaauguauuccacacaauguggcauguaacacggggcgccguacuuauguaccaaggaaagcguuuagagccuagcugggccuccgucaagaaagaucuaauuagcuacggaggaggauggagacugcaagggucguggaauacaggggaagaaguucaagugauugccguagaaccaggcaaaaaucccaaaaauguccaaacugcaccuggaaccuuuaaaacaccagaaggugaaguuggggccauagcucuggauuucaaacccgggacguccggaucuccgauagucaacagagaagggaaaauuguagggcuauacggaaacggcguuguaacuacuucuggaacauauguaagugcuauagcucaagcaaaagccagccaagaaggcccacugccugaaaucgaagaugaaguauuucgcaagcgaaacuuaacgauuauggaccuacauccgggcaguggaaaaacacgccguuauuugccggcaaucguuagagaagcuaucaaacguaaguuaagaaccuuaauuuuagcgccaacacggguuguagcgucagagauggccgaagcauuaaaaggcaugcccaucagauaucaaacaacagcugugaaaagugaacacacugggaaagaaauaguugaucuaaugugccacgcuacuuuuacaaugagauuacuaucucccguacgaguuccuaacuacaacaugauuauaauggacgaggcucauuuuacugacccaagcucaauugcagcaagagguuacaucucaacgcgaguagggaugggggaggcugcagcaauauuuaugacagccacuccgccgggaucagucgaagcauucccacaaucgaaugcuguaauacaagacgaggaaagagauauuccugaacgaagcuggaacucgggauaugaguggauuacugacuucccaggaaagacuguuugguucgugccaucuauaaaauccgguaaugacauagcaaacugccuuaggaaaaaugggaagagaguuauucaacuaagccgcaaaacguucgauacggaguaucagaaaaccaaaaacaacgauugggacuauguagucacaacagauauuucagaaaugggagcuaauuuucgggcagauagggugauagacccgcguagaugccuaaagcccguuauccugaaagacggaccugagaggguaauucuagccggaccaaugccgguaacgguagccuccgccgcacaaagaagaggaagaauagggaggaaucauaauaaagaaggggaccaauacauuuauauggggcagcccuuaaauaacgaugaagaucaugcccacuggaccgaggcaaaaaugcuccuugacaauaucaauacacccgaaggaauuauaccugcauuauuugagccugaacgcgagaaaucugcugccaucgauggggaauaucgauuaagaggggaagcacggaaaacauuuguagagcugaugcgaaggggugauuugcccguguggcuuagcuauaaaguugcaagugaaggauuucaguacucagauagacgauggugcuuugauggcgaacgaaauaaccaaguacuagaggaaaacauggacgucgaaauuuggacaaaggaaggggaacguaagaaauuaagaccuagguggcuggacgcaaggacauauucagauccuuuagcgcugagagaguucaaagaauuugcagccgggagacggucaguuaguggagaucuaauacuagagauaggcaaauuaccacaacauuuaacucaacgagcucaaaaugcguuagauaacuuagucauguuacauaauucagaacaaggagggagggccuacaggcacgcaauggaagaauugccggacacuaucgaaacauuaaugcugcuagccuugauugcaguacugacuggaggcgugacacuuuucuucuuaucgggcagaggucuaggcaaaacaucuauagguuuacuaugcgucauggcuaguucaguacuacucuggauggccagcguggaaccacacuggauagcagcuaguauaauacuugaguucuuuuuaaugguguugcucauaccagaacccgaccgacaaaggacaccgcaagauaaccaacuagccuacgugguaauaggucuauuauucaugauucuaacagucgcggccaacgaaaugggauugcuugagacaacaaagaaagacuuagggauagggcauguggcaguggagaaucaccaccacgccgcuauguuagauguugaucuccacccagcaucugcauggaccuuauaugcuguggccaccacaauaauuacaccgaugaugaggcacacgauagaaaacacaaccgcaaacaucucguuaacggcuauagcaaaucaagccgcuaucuugaugggccucgacaaaggauggccuauaaguaaaauggacauaggggugccacuucucgccuuggguuguuacucacaaguaaaucccuuaacuuuaacagcugcuguguuaaugcuugucgcacauuaugccauuauaggcccuggauuacaagcgaaagccacucgagaggcucagaaacgaacggccgcgggaauuaugaaaaaucccacagucgacggaaucguagcaaucgacuuagauccaguugucuacgacgcgaaauuugagaaacaauugggacaaaucaugcuccuuauacuuugcacaagucaaauucugcuaaugagaacaaccugggcacuaugugaaucaaucacguuagccacaggcccguugacaacauuaugggaagguaguccaggcaaauucuggaauacuacaauugcaguaaguauggcgaacauauucagaggaucuuauuuggcaggggcuggacuagcauuuucccugaugaaaaguuuagggggagggcggcgugguacaggagcacagggagaaacccugggcgaaaaguggaaaagacagcuaaaucaacuaagcaaaucagaauuuaauacguauaaaagaaguggcauaauggaaguagauagauccgaagcaaaggaaggucuaaaaagaggugagacuaccaaacacgcaguaucaagagguacagcaaagcuaaggugguucguagaaagaaaucuaguaaaaccggaagguaaaguaauagaucugggcugcggaagggguggcuggagcuacuacugugcgggucuaaagaaagucacugaagugaaagguuauacaaaaggcgggcccggucaugaggaaccaaucccgauggcuacauacgguuggaaucucguaaaacuacauagcggaaaagauguauucuuuauaccgccugaaaaaugugacacacuacuaugcgacaucggagaauccuccccaaaucccacaauugaggaagggcgaacacuucgcguccugaaaaugguggagcccuggcugcgaggaaaucaauuuugcauuaaaauauuaaauccauacaugccaaguguuguggaaacacuugaacaaaugcaaagaaaacacggugggauguuagucaggaacccacucaguagaaacucaacacaugaaauguacugggucucaugugggacuggaaauauaguuucugcuguaaauaugacaucccggaugcuacucaacagguuuacuauggcccaccgcaagccuacguaugaacgagacguagacuugggcgcugguacacgacaugucguaguagagccagaaguagcaaacuuagacauaauaggccaacgaauagagaauauaaaacaugaacacaaaucuacauggcacuaugacgaagauaauccguauaaaacaugggcuuaccacgggaguuaugaggugaaaccuucgggaucugcuucaagcaugguaaauggaguugugaaauuguuaacgaaaccaugggauguuauacccaugguuacgcaaaucgccaugacagauaccacaccuuucgggcaacagagaguauucaaagaaaaagucgauacaagaacaccaaaggcgaaaagggggacugcacaaauuauggaaguaacagcgaaauggcuauggggcuucuuaucgcgcaauaagaaaccgcgaauauguacacgugaagaauuuacgagaaaaguacgaucgaaugccgcaauaggugccguuuuuguagacgagaaccaauggaacucagcuaaagaagcaguagaagaugaaagauucugggaucuaguccauagagagcgagaacuacauaagcaagguaagugcgcaacuugcguguacaacaugauggguaaacgagagaagaaacucggcgaauuugguaaggcaaaaggauccagagccauuugguauaugugguugggugcccgauuucucgaauuugaagcacuuggcuuuaugaacgaagaccauugguuuucacgcgaaaauucucuaaguggagucgagggcgagggauuacauaaauuaggcuacauauuacgagacaucucaaaaauaccaggagggaacauguaugcagacgacacagcaggcugggauacccgaauaacugaagacgauuuacaaaacgaggcaaggauaacagauauaauggaaccagagcaugcauuauuagcaaagaguauuuucaagcuaacauaucaaaauaagguagucagggugcaacgaccagccaaaaacggaacaguaauggauguaauaucaagacgugaccaaagggggucaggacaaguugggacuuacggauuaaacacauucacgaauauggaagcacaacuuauaagacaaauggagagugaagggauuuuuagcccgucagagcuugaaacaccuaaccuagcagagcgcguauuagauugguuagaaaaguauggcguggaacgcuuaaaaaggauggcuauaagcggagacgacugcguagugaaaccaaucgacgaucgcuuugcaacggcacuuaccgcuuugaaugauauggggaaaguacguaaagacauaccccaaugggaaccaucuaaaggcuggaaugacuggcaacaaguaccuuucuguucacaccauuuucaucaauuaaucaugaaagacgguagagaaaucguugugccuuguagaaaccaggacgaacuuguaggacgugcacgaguaucucagggcgcuggauggucauuaagggagaccgcauguuuaggcaaaucauaugcacaaauguggcaauuaauguacuuucaccgacgcgauuuacguuuggcagcaaacgcaauauguagcgcgguuccugucgauuggauacccacgucacgaacaacuuggaguauacaugcucaccaucaauggaugacuaccgaagauaugcuuagcguuuggaaucguguauggauagaggagaacccauggauggaagauaaaacacacauuucuucauggggugacguuccuuaccuagguaagcgagaagaccaauggugcgguagucuuaucgggcuaacagccagggcaacgugggccaccaauauccaaguagcaauaaaucaagucagaagauuaauagggaacgagaauuaccucgauuauaugacaucaaugaaaagguuuaagaaugaaucagacccggaaggagcucucugguaa

SEQ ID NO: 21657 - RNA, 9879 nt, Artificial Sequence
  derived and/or modified CDS sequence (opt6) from DENV-1__GQ199777__SS-prME
ucaguuaccauguuauuaauguuaaugcccacugccuuagccuuccauuuaacaacucgaggaggcgaaccccauaugaucguaucuaaacaagaaagaggcaaaucuuuauuauucaaaacuuccgcggguguaaacaugugcacgcugauagccauggaucucggagaacuuugugaagacacaaugacauauaaauguccgagaauaacagaaacagaaccagaugauguugauuguuggugcaaugcuacugacacuuggguaacguauggaacauguagucaaacuggggaacaucgucgugauaaaagaagcguagcccuagcaccucauguaggauugggacuagaaacaagaacagaaacguggauguccagcgaaggagcuuggaaacaaauacaacgaguagaaaccugggcccuacgucauccaggcuuuacgguaaucgcuuuauucuuagcacauguuauugguaccucaauaacacaaaaagguauuauauuuauucuauuaauguuaguuacaccaucaauggcaaugcgcugcguaggcauuggaagccgagauuuuguugaaggccuaucaggcgcaacauggguugacguagugcuugaacacggaucuuguguaaccacuauggccaaagacaaaccuacccuugauaucgaauuacuaaaaaccgaaguaacaaauccagcuguacuaagaaaacuauguaucgaagcaaaaauaucuaauacuacaacagauucuagaugcccaacgcaaggugaagccacuuugguagaagaacaagacgcgaacuucguaugucgaagaacguuugucgacagaggcuggggcaauggcuguggucuguuuggaaaagggucucugauaacuugugcuaaauuuaaauguguaacaaaauuggaaggaaaaauaguacaauaugaaaauuuaaaauacagcgucauaguuacaguacauacaggugaccagcaucaaguaggaaacgaaucaacugaacacggcacaacagcaacgauaacaccacaagcaccuacaacagaaauacaacucacggacuauggagccuuaacacuagauuguucaccaaggacagguuuagauuuuaaugaaaugguguuauuaacaaugaaagagaaaaguuggcuugugcauaaacaaugguuucuugaccucccuuuaccguggaccucaggugcaaguaccucacaggaaacauggaaccgucaagauuuauuggucacguuuaaaacggcacacgccaaaaagcaagaaguuguaguuuuagguucacaagaaggugccaugcauaccgcacuaacuggugcaacagaaauacaaacaaguggcacaaccacaaucuucgcuggacacuuaaaaugcagauuaaaaauggauaaauuaacgcuaaaagguaugaguuacguaaugugcacaggcuuauucaaacuggaaaaagaaguugcugaaacucaacaugguacaguuuuaguacagauaaaauaugaaggaacugaugccccuuguaaaauuccuuuuagcacacaagaugaaaagggugucacacaaaacggcagauuaauaacugcgaaucccauaguuacagauaaggaaaaaccuguaaacaucgaagcagagccaccuuuuggcgaaaguuauauaaucauaggagcuggggaaaaggcccuaaaacuuucgugguuuaagaaaggaucuucaaucgguaaaauguucgaagcgacagcacgaggggcacgaaggauggcgauauugggggauacagcaugggauuucgggaguauagggggaguguuuacuagcgugggcaaauuagugcaccaaauauucggcacagccuauggaguacuauuuuccggaguaaguuggacuaugaagauugguauuggaguguuacucacgugguuagggcuaaauucacgauccacuucguugaguaugacaugcaucgccgucggccuaguaacacuauauuuaggcguaaugguacaagcugauucaggcugcguuauaaacuggaaagggagagaacuaaaguguggaucagguauauucguaaccaaugaaguacacacauggaccgaacaguacaaauuccaagcugacaguccgaagcgacuaagugcugcaaucggaaaagcaugggaagaaggaguauguggcauuagaucagcgacccggcuugagaauauaauguggaagcaaauuucaaacgaacuaaaccauauacuguuggagaaugacaugaaauuuacaguaguaguaggagauguagcaggaauacucgcccagggaaagaaaaugaucaggccccaaccuauggaauacaaauauucuuggaaaaguuggggaaaagcaaaaaucauaggggcagauguucagaauacuacauuuauuauugacggccccaauacuccagaguguccggacgaucaaagagcauggaacauaugggaaguagaagauuaugguuucgguaucuuuacgaccaacaucuggcuaaaacuaagggauucauacacgcaaguaugcgaucauagauugaugucagcagcgauuaaagacucuaaagccguucacgcggauaugggauauuggauagaaagcgagaaaaacgaaacauggaaauuagcuagagcguccuucauagaaguuaaaaccuguauauggcccaaaucacacaccuuauggaguaacggggugcuagaguccgagaugauuauaccgaagauauauggcgggcccaucagccaacauaacuaucggccagguuacuuuacccagacagcuggcccauggcaucugggaaaguuggaacuggauuucgauuuaugcgaaggaacgacuguuguaguggacgaacauugcggcaauagagggccaaguuugcggaccacaaccguaacaggaaaaauaauacaugaaugguguugcaggaguugcacguuaccaccuuuacgcuuuagaggggaagacggauguugguauggcauggagauccggccaguuaaagaaaaagaagaaaaucuagugaaaucaauggucagugcuggcaguggagaagucgacucauucucucucggauugcuuuguaucucgauuaugauagaggaagucaugagaagucgauggaguagaaaaaugcuaaugaccgguacauuggcuguauucuuccuacucauuauggggcaacuuaccuggaaugacuuaauuagauuaugcauaaugguuggugcuaacgccagugacagaaugggaaugggaacuacauauuuagcauugauggcgacauucaaaaugagacccauguuugccguaggauugcuauuccguagauugacuagcagagaaguauuauuacuaacaaucggucuaucccucgucgcuucaguagagcugccaaauucauuagaagaacugggcgauggguuggcaaugggaauaaugauauugaaacuauuggccgauuuccagagucaccaauugugggcuacauuacucagcuuaacauucauaaaaacuacauuuagucugcauuaugcauggaaaacuauggcgaugguacucucuauaguuucacuguuuccauuaugucuaucgacaacaagucaaaagacuacauggcuacccguccuucuuggaucguuagguuguaaaccacuaacgauguuuuugauagcagaaaauaagauuuggggacguagaucauggccguugaaugagggaaucauggcuguaggcauagucucaauccuacuaucgucccuauugaaaaacgacgucccauuggcaggucccuugauagccggcggcauguugauugcauguuaugucauaucaggcucuagugcagaucucaguuuggaaaaagcagccgaaguaucaugggaagaagaggcggaacauagcggagcaucgcauaauaucuugguagaaguacaagacgacggaaccaugaaaauuaaggaugaagaacgcgacgauacguuaaccauuuuauuaaaagccacuuuauuagcaguaucagggguuuacccguuaucgauucccgcaacgcuauucgucugguauuucuggcaaaagaagaaacaaagaaguggagucuugugggacacaccuagcccgccagaaguugaaagagccguacuugaugauggaauauacagaauaaugcaacggggccuucuagggagaucacaaguaggggucggaguauuucaagaaaauguuuuccacacgauguggcacguaacucguggggcaguacuuauguaucaagggaaaagacuagaaccaucaugggcgucugugaagaaagaucuaauaucauacggugguggcuggagacugcaggguucuuggaacaccggagaagaagugcaggucauugcuguagaaccuggcaaaaauccgaaaaacguucaaacugcuccgggcaccuuuaaaacgccagagggugagguuggugcaauagcacuagacuucaaacccggaacgaguggaucgccaauugugaaucgcgaaggaaaaauagugggauuguauggaaauggcguugugacaacgucuggaacguacguuagugcgauugcacaagccaaggcgucucaggaaggaccccuuccagaaaucgaggacgagguauuuaggaaacguaauuuaacaauaauggaccuacacccagguagcggcaaaacacgucgcuaucuaccagcuauuguucgugaagcaauuaaaagacgccuaagaacguuaauauuggcgccgacuagaguaguagcuucagaaauggccgaagcucuuaaaggaaugccgauaagauaucagacaacugcaguaaaaucggaacauaccggaaaagaaaucguagacuugaugugucaugcuacauucacuaugcgacuucuaucaccuguuagaguuccaaacuacaacaugauaauaauggacgaagcucacuuuacagauccguccagcaucgcugcaagagguuacauaucaacaagagucgggaugggugaagcagcagcaaucuucaugacagcuacgccaccuggcucaguagaagccuucccacaaagcaaugccguaauucaagaugaagaaagagauauaccagaaagaucauggaacagcgguuaugaauggauaaccgacuuuccaggcaaaacagucugguuuguaccaucgauaaaaucaggcaaugacauugcaaauugccugcgcaagaauggaaaaagaguaauacaguugagccgaaaaaccuuugacacugaauaucagaaaacgaaaaauaacgauugggauuacgucguuaccacagacauaagcgagaugggagcaaacuuccgagcugaccgagugauugauccacgaaggugucucaaaccuguuaucuuaaaagauggcccagaacgaguaaucuuggccggaccaaugccggugacgguugcaucagcugcccagagacgcggccgcaucggcaggaaccauaauaaagagggggaucaauauauauacaugggacaaccacuaaacaacgacgaggaucacgcucauuggacagaagcaaaaauguuguuagacaauaucaacacaccggaaggaaucauaccugcacuauuugaaccagaacgugagaaguccgcagcaaucgauggggaauaucguuugaggggagaagccaggaaaacuuucguugaacuuaugagaaggggugacuugcccguuuggcucucguauaaaguugcaagugaaggguuccaguauagugaucgaagauggugcuucgauggggaacguaacaaccagguuuuagaagagaauauggauguugaaauuuggacuaaagaaggcgagaggaagaaauuaaggccgagaugguuagacgcuagaacguacucagacccgcuugcccugagggaguuuaaggaguucgcagccggcaggcgaagcguaucgggugaucuaauauuagaaauagguaagcucccacaacauuuaacgcaacgggcgcagaaugcuuuagauaaucucgucauguugcauaauucugaacaaggagguagagcguauagacaugcaauggaagaacugccagauacuauagaaacuuuaauguuacucgcguuaauagcaguauuaacaggaggaguaacguuauuuuucuuaucagguagaggacucgguaagacaucaauaggccuauuaugcguaauggcgucaucgguccuguuauggauggcuucuguagaaccgcacuggauagcagcauccauaauuuuagaguucuuccuaaugguccuguuaauacccgaaccugaccgccaacguacuccacaagauaaccaacuggcuuacguuguaauaggguuacuuuuuaugauccugacggucgcugcaaaugaaaugggucuccuugaaacaacgaagaaagacuuaggcauuggccauguugcaguugaaaaccaccaccaugccgcuaugcuugacguagauuuacacccugcgucugcauggacucuuuaugcaguagcuacaaccaucauuaccccaaugaugagacauacgauagaaaauacaacagccaacauuagcuuaacagcuauagcaaaccaagcugcaauucuaaugggacuagacaaaggauggccuauaucuaaaauggacaucggaguucccuuauuagcccuaggaugcuacagccagguaaauccauugacgcuuacagcagcaguucugaugcucguggcgcacuacgcuauuauuggaccaggucuccaagccaaagccacacgugaggcucaaaaacgaacagcggcggguauuaugaaaaauccuacuguagauggcauugucgcuaucgacuuggacccaguaguuuacgaugcaaaguuugagaagcaacugggucaaaucaugcuauuaauccuuuguacuucccaaauuuuacugaugagaacaacuugggcacuaugugagucuauuacacuagccacugguccacuuacaacccuaugggaaggcaguccagggaaauuuuggaacaccaccauagccguaaguauggcaaacaucuuccgagguagcuaccucgcgggugcaggacucgcauucagucuuaugaaaagccucgggggaggaagacgugggacuggagcgcaaggugaaacauuaggggaaaaguggaaacgucaauugaaucaguugucgaaaagugaguucaacacauacaaacgauccgggauuauggagguggacagaucagaagcaaaagagggcuugaaaagaggagaaacaacuaaacacgccgugucacgugggacagcaaagcuacgaugguucguagaaagaaacuugguuaaaccagaaggaaaagucauagauuuaggaugcggaagaggaggcuggagcuacuauugcgcagguuugaagaaaguuacagaagugaaaggauauaccaaaggugguccgggacaugaagaaccuaucccaauggcgaccuacggcuggaaccuagucaaacuacauagugggaaagauguauucuuuauuccacccgaaaaaugugacacucuguuaugcgacauaggcgaaucuucuccaaauccaaccaucgaagaaggccguacacugagagugcuaaaaaugguagagcccugguugaggggaaaccaauuuugcaucaaaauucuaaauccuuacaugcccagugugguagaaacucuagaacagaugcagcgaaaacacgguggaauguugguacggaaccccuugucaaggaacaguacucaugaaauguauuggguaucaugcggaaccgggaacauuguaucagccguuaacaugacgaguagaaugcuucuuaacagguuuacaauggcucaccgaaaaccaaccuaugaaagagauguugacuuaggagcugguacacgacacguagcaguggaacccgaaguugcuaaucuugauauaauaggucagcggaucgaaaauauuaaacacgaacauaagucaacuuggcauuacgaugaagacaacccauauaaaacuugggccuaucauggcuccuacgaaguuaaaccaagcggaagcgccucgucaaugguuaaugggguaguaaaguugcuuacaaaaccgugggauguuauucccaugguaacccaaauugcgaugaccgauacaacaccauuuggucaacaacguguauuuaaagaaaagguagacaccagaacccccaaagcuaaaagagggacagcgcaaauaauggaaguaacggcaaaaugguuauggggauuucuaucacgaaauaagaaaccccgcauauguacaagggaagaguucacccgaaaggugcgaucuaaugcugcuauuggagcuguguucguagacgagaaucaauggaacagcgcuaaggaagcaguagaagacgaacgcuuuugggaucuaguucacagagagcgagaguuacauaaacaagggaaaugugcaacuugugucuacaauaugaugggcaaaagagagaagaaacucggggaguucggaaaagcaaaaggcaguagggcgaucugguacaugugguuaggcgcuagauuucuagaguucgaggcuuugggcuuuaugaaugaggaccauugguuuagucgagaaaacucacugaguggcguagaaggagagggauuacauaaacuugguuauauacugcgagacaucucgaagauuccagguggcaacauguacgcagaugacaccgccggaugggauacaaggaucacugaagaugauuuacagaaugaagcgagaauaaccgauauaauggaaccagagcaugcguuacuagccaaaucuauauuuaaguuaacguaucagaacaaggucguacguguacagagacccgccaaaaacggaaccguaauggacgucauaagcaggcgggaccaaagagggucaggacagguagguaccuaugguuuaaauaccuuuacaaacauggaagcacaguuaauaagacaaauggagucggaagguaucuuuaguccuuccgaguuggaaacaccaaauuuagcugaacggguucuagacugguuggagaaauaugguguagaacgccucaaacgaauggcaauauccggagaugacuguguaguuaaacccauagacgacagguuugcgacagcucugaccgcuuugaaugauauggggaaaguuagaaaggauauaccacagugggagccaucuaagggauggaacgacuggcagcagguaccauucugcucccaucauuuucaccaauuaauaaugaaagacggacgggaaauaguaguaccaugucgcaaccaggaugaauuaguuggaagggcgagaguaucgcaaggcgccgguuggagccuuagagaaacagcaugccucggaaaaagcuaugcacaaauguggcagcuaauguauuuucaucgccgggaccuuaggcucgccgcaaaugcuauauguuccgcagugcccguagauuggauaccuacaucaagaacgacauggagcauacaugcucaucaucaauggaugacaacugaggacauguuaucuguauggaaucgaguauggauagaagaaaauccauggauggaggacaaaacccauauaaguucauggggagauguucccuaucucggaaaaagggaggaccaauggugcggaucuuuaaucggauuaacagcaagagccacuugggcuacaaacauccaggucgcuauaaaucaaguaagacgacucauuggaaaugaaaacuaucuugauuacaugacaucaaugaagagauuuaagaaugaaucagauccagaaggggcacuaugguaa

SEQ ID NO: 21658 - RNA, 9879 nt, Artificial Sequence
  derived and/or modified CDS sequence (opt6) from DENV-1__GQ199778__SS-prME
ucuguaacuaugcuccuuauguuaaugccuacagcccucgccuuucauuuaacaacuagagggggagaaccgcauaugaucguaucaaaacaagaaagaggaaaaucccuauuauuuaaaaccucggcggguguaaauauguguaccuugauagcaauggauuugggggaacuaugcgaggacaccaugacuuauaaauguccccgaauaacugaaacagaacccgaugauguugauugcuggugcaaugcuaccgacaccuggguaacauauggaacguguucccaaacuggugaacauagaagagauaaacgaaguguagcacuagcgccucacguaggucucggacuugaaacaagaacagaaacguggaugaguucagagggagcuuggaaacaaauacaaagaguggaaacuugggcacuaagacauccaggauucacaguuauagcccuauucuuagcccaugcaaucgggacaaguauaacucaaaaaggaauaauauucauucuucuaauguuaguaacaccaaguauggcaaugcgaugugucgggauaggaaguagagacuuuguugaaggauuaaguggggcaacuuggguagacguuguguuggagcacggaagcugcgugacuacgauggcaaaagacaaaccgacauuagauaucgaacuacuaaaaacugaaguuacaaaucccgcaguacuacgcaaacuguguauagaagccaaaaucucaaauacgacaacagacagcagauguccuacucaaggagaagcaaccuuaguagaagaacaggaugccaauuuugugugcagacggacguuuguggacagggguugggguaaugguuguggguuauuuggaaaaggcagcuuaaucacaugugccaaauucaaauguguaacaaaauuggaagguaaaauuguucaauaugaaaaucuaaaauauuccguaauugugacagugcauacgggggaucaacaccaaguugggaacgagucaaccgagcacggcacgaccgcuacaauaacuccucaagcaccaaccacagaaauacaacuaacagauuacggagcuuuaacacuugacugcuccccacguacaggauuggacuucaaugagauggugcucuuaacaaugaaagagaaaaguugguuaguccauaaacaaugguuccucgaucuaccuuugccauggacuucaggcgcaucuacuagccaagaggccuggaauaggcaagauuuacuggugacuuuuaaaacagcccaugcuaagaaacaggaaguugucguucuaggaucacaagagggugcaaugcauaccgcacuaaccggagcgacagaaauccaaacaucuggaaccacuacaaucuuugcaggacacuuaaaauguagacuaaaaauggauaaauuaacucuuaaagguauguccuacguuaugugcacgggaaguuuuaaauuggaaaaagaaguagcagagacccaacauggcacagucuuaguacaaauuaaauaugaaggaaccgacgcaccguguaaaauuccuuucucaacacaagaugaaaagggaguuacacaaaacggacgguuaauaacugcaaauccuauaguaacagauaaagaaaaaccugugaauaucgaggcugaaccaccauuuggagaaagcuauauagugauuggagcaggcgaaaaggcuuuaaaauugucaugguucaagaagggaaguuccauagguaaaauguuugaggcuacugccaggggagcgagaagaauggcaauucucggagauaccgcaugggauuuuggaucaauuggaggaguauucacaucgguagggaagcuaguacaucagaucuuugggacagcuuacggaguacuguuuucuggcguaucauggacgaugaagauagguauuggugucuuauuaaccugguuaggauugaauagcagaucaaccucguugucuaugacauguauagcaguaggucuuguuacucuguacuuggguguaauggugcaggcagauuccggcugugugauaaauuggaaggggagagaacuuaaauguggaagcggaauauuugugacuaacgaagugcacacauggacagaacaauacaaauuucaagccgacaguccuaaacggcuaucagcagcgauugguaaggcaugggaagaagguguauguggcauuagaucagccaccagacuugagaacauuauguggaagcaaauaucaaaugaacuuaaucacauacuacuggaaaacgauaugaaguucaccguagugguuggggauguagcaggcauacucgcucaagguaagaaaaugauccgaccacaacccauggaauauaaguauuccuggaaaaguuggggcaaagcgaaaauuauuggagcagauguacagaacacaaccuuuauaauagaugguccgaacacaccggaauguccagaugaccaacgugcauggaauauuugggaaguugaagauuacggcuucggaauauuuacaacaaauauuuggcuuaaacuaagagauuccuacacucaaguaugugaucaccgauuaaugucggcugccauuaaagauucaaaggcaguccacgcggacauggguuacuggaucgaauccgaaaagaacgagacuuggaaacuugcucgagcuucguucauagagguuaagaccugcauauggccaaagucacauacucuuuggucaaaugggguacuagagucagaaaugauaauacccaagauauauggaggaccaauaucucagcauaauuaucguccgggauauuuuacucaggccgcagggccauggcacuugggaaaauuagaacuugacuuugaucuaugcgaaggaacuacgguaguaguagaugaacauuguggcaaucgaggcccgagccuaagaacgacuacagugacaggaaaaauaauacacgaaugguguugcagaucauguacucuaccaccuuuaagauucaggggugaagauggauguugguauggcauggagauccgaccaauaaaagaaaaagaagaaaaccuggugaaaagcaugguaagcgcuggcuccggagaaguugacucuuucucacucgguuuacuauguauaucaaucaugaucgaagagguaaugaggucuagauggagcaggaggauguuaaugaccggaacauuagccguauucuuuuuauugauaauggggcaacuuacuuggaacgaucuaauaagacuguguauuaugguaggugccaaugcguccgacagaauggguauggggacgacguauuuagccuuaauggcaacauuuaaaaugaggccaauguuugcggugggcuuacuauuucgacgucuaacaaguagggaaguauugcuucuuaccaucggacuaagucugguagcuucuguagaauuacccaauagcuuagaggaacuuggcgauggccucgccauggguauaaugauacuaaaauuacuuacagauuuucaaucccaucaauuaugggcaacgcuauuaagucugaccuucauaaaaacaacguuuucacuacauuaugcguggaagacuauggcgaugguccuauccauaguaucauuguuuccacuuuguuuguccacaacaagucaaaagacgaccuggcuaccuguacucuuaggaucacuuggcuguaaaccguuaacaauguuccuuauagcagagaauaaaauauggggccgucgcagcuggccacuaaacgaaggaauuauggcagucgguaucguuucgauccuauuaagcagucuccucaaaaacgacgugccauuagcggggcccuuaauugcaggaggaaugcuaauugccugcuaugugauaucugguuccucagcagacuuaagccuagaaaaggcggccgagguaagcugggaagaagaagcugaacacaguggagcaagccauaauauccucguagaaguacaagacgauggcacuaugaaaaucaaagaugaagaacgggacgacacgcuaacaauuuugcuaaaagcaacucuguuagcaguuucagguguuuauccacuuuccaucccagcaacuuuauuugucugguauuucuggcagaagaagaaacaaagaucugggguguuaugggacacuccaagucccccggaaguugaaagggcgguauuagaugaugggauuuaccgcauaaugcagcgaggguuauuaggaaggucccaaguuggaguuggagucuuucaagagaacguauuucacaccauguggcaugucaccaggggugcagucuuaauguaucagggaaagagguuagagcccucgugggcaucuguuaagaaagauuuaauuagcuacggugggggauggcgacuacagggaagcuggaacacaggugaggaaguccaaguuauagcugucgaaccagggaaaaauccuaaaaacguccaaaccgcaccagggacuuucaaaacuccugagggugagguuggggcuauagcauuagacuuuaaaccuggcacaaguggcaguccaauaguaaauagggagggaaaaauaguaggauuguauggaaauggaguaguaacaacuucaggaacauauguaucugcuaucgcucaagcgaaggcuucacaagaaggccccuuacccgaaaucgaagaugaaguauuccguaagcguaaucuaacgauuauggaccuacauccagguucaggaaaaacaagaagguaucuacccgcuauugugagagaagcaaucaaaaggaagcuaagaacauuaauuuuggcuccuacccgaguuguugcuagugaaauggccgaagcucuaaaaggcaugcccauuagauaccaaacaacggcagugaaaucggaacauacugguaaagagauaguagacuuaaugugccaugcgaccuuuacaaugagauuauuaucaccagugcgagucccaaacuauaauaugauuaucauggacgaagcacauuuuaccgauccaucuuccauagcggcucgaggguacauaucaacuagaguaggaaugggagaagcggcagcgauuuucaugacggcgacuccaccaggaucaguagaagcauuuccucaaucgaaugcaguaauucaagacgaagaacgugauauuccagaacguucuuggaacucaggcuaugaauggauaaccgacuuuccagguaaaacuguaugguuugucccgagcauaaagagcggaaaugauauugcgaacugccugaggaaaaauggaaaacgagucauacaguuaagcaggaaaacguucgauacagaguaccagaaaacuaaaaacaaugauugggauuauguugugacaacugacaucucagagaugggagcgaacuuuagagcagacagggucauagacccgagacggugccugaagcccguaauauuaaaagaugggccagagcgaguaauuuuggcaggaccuaugcccgucacuguggcgagugcagcgcaacguagggggcgaauaggucgaaaucacaauaaagaaggugaucaauauauauauauggggcagccccuuaacaaugaugaagaccacgcacacuggacagaagcaaaaaugcuacucgauaacaucaacacaccggaagguaucauaccggcauuauuugagccagaaagggaaaaauccgcagcaaucgacggagaauauagauuaagaggagaagcucgaaagacauuuguggaguuaaugcgcagaggagacuugccaguaugguuaagcuauaaaguagccucagagggauuccaauauagugaccgacgguggugcuuugacggagagcgaaacaaucaaguucuagaagaaaauauggauguggaaauuuggacaaaagaaggagagagaaagaaacuucggcccagguggcuagacgcaaggacguauagugacccguuagcgcuuagagaauuuaaggaauuugcggcaggcagacgauccguuucaggcgacuuaauuuuagaaaucggcaaacugccucagcaucuuacucaaagggcacaaaacgcuuuagauaauuuaguuauguuacauaauucugaacagggaggacgagcuuaucgacacgcaauggaggaacugccagauacgauagaaacuuuaaugcuccuugcccuaauagcaguacucacaggcggaguuacacuguucuucuuauccggaagaggccuagguaagacgaguaucgggcuucuguguguuauggccucaaguguccuacuauggauggccaguguagaaccgcauuggauugcugcuagcauaauacuugaguucuuuuuaaugguguuacuaauaccagaaccagaccgucagagaacuccucaggacaaccagcuagcuuaugucguaauugggcugcuauuuaugaucuuaacagucgcagcaaacgagaugggacuauuagaaaccacuaagaaagaccucgguaucggccacguggcuguagaaaaucaucaucaugcugcaauguuagacgucgacuuacacccggcuucagcguggacacuguaugcagucgcaaccacgaucaucacuccgaugaugcgacacacuauagaaaauacaacagcaaacauaagucuaacugccauugcaaaccaggcagcuauauuaaugggauuagacaagggcuggcccaucucuaaaauggauaucggagugccuuuguuagcuuuaggauguuacucacaagugaaucccuuaacucucacggccgcugucuugaugcugguagcacauuacgcaauuauaggaccuggcuugcaagcgaaagcaaccagggaagcgcaaaaacgaacagcagcugguauuaugaaaaaucccacaguagacggaauaguggcuauagauuuggauccaguugucuaugacgccaaauuugaaaaacaauugggacaaauaaugcuacuuauccuauguaccucccaaauccuacuaaugagaacaacgugggccuuaugcgaaagcaucacccuugcgacaggaccacugacgacucuuugggaagguucaccugguaaguucuggaauacaacaauagccguaaguauggcuaacaucuuuaggggguccuaucuagccggugcaggcuuagcuuuuucuuuaaugaaaucuuuaggagguggccgaagagggacuggggcacaaggggagaccuugggagaaaaauggaaaaggcaacucaaccaauuaucuaagagcgaauuuaacacguacaaacgcagugguaucauggaaguagaucguucagaggccaaggaagguuuaaaacguggagaaaccacaaaacaugcagucaguaggggaacagcaaaauuacggugguuugucgagcgaaacuugguuaaaccagagggaaaaguuauagaccuugggugcggaagagguggguggucauauuacugugcuggacucaagaaagugaccgaagugaagggauacacaaaagguggcccaggacaugaagaaccaauaccuauggcaacuuauggauggaacuuggugaaacuacacagcggcaaggauguuuucuuuauacccccggaaaaaugugauacuuugcuaugugacauuggcgagaguucuccgaacccaacuauugaagaaggccgaaccuuaagagugcuaaaaaugguggaacccuggcucagggguaaucaguuuugcauuaaaauccuuaacccauauaugccgagcgucguagaaacuuuagaacagaugcagcguaaacacggaggcaugcuuguaagaaauccacuaaguagaaauagcacccaugagauguacuggguuucguguggaacaggaaacauuguaucagccguaaauaugacaucaagaaugcuccuuaacagguuuaccauggcacaucgaaaacccacauaugaacgggacguugaucugggggccggaacacgacauguggccgucgaaccagagguugcaaauuuagacauaauaggccagcgcaucgaaaauauaaagcaugaacacaaaucaacuuggcacuacgacgaagauaauccauauaagacaugggcauaccauggguccuaugaagugaaacccucggggucagcuagcucaaugguaaacggagugguuaagcucuuaacaaaacccugggaugucauuccuaugguaacacaaauagcuaugacagauacuaccccauucggccaacagagagucuuuaaagaaaagguggauacaagaacuccaaaagcaaaaaggggaacggcucaaaucauggagguuacugcuaaauggcuauggggauucuuaucuagaaacaagaaaccucguauauguacccgcgaagaguucacccggaaaguucgcucgaacgcugcaauuggagcuguauucguugacgaaaaucaauggaacucugcuaaggaagcugucgaagaugagagauuuugggaccucguacauagagagagagagcuucauaagcaaggaaaaugugcaacaugugucuauaauaugaugggaaaaagagagaagaaauuaggcgaguuugggaaagccaagggaucuagagcaauaugguauauguggcuuggugccagauuucuugaguucgaggcauuaggauucaugaacgaagaucacugguuuaguagagagaauaguuuaucuggaguagaaggagaaggcuuacacaaacuaggcuauauauuaagggacauaagcaaaauaccuggagguaacauguaugcugaugauacagcaggaugggacaccaggauaacagaagaugauuuacaaaaugaagcccgaauaacagauauaauggaacccgaacacgcuuuacuagcaaaaucuauauucaaguuaacauaucaaaauaaaguaguccgcguucaacgaccggcuaaaaauggcacuguaauggauguaauuucuagaagagaccaaagaggcucggggcagguuggaaccuauggacuuaauacauucacaaacauggaagcacaauuaauacgacaaauggagucugaggguaucuucucgcccuccgagcuagagaccccaaaccucgcagaacgaguacuagauuggcuagaaaaauauggaguugaacgacugaaacgaauggcuauuagcggagaugacugcgucgucaaaccuauugaugauagauuugcaaccgcacugacagcauuaaaugauauggggaaagugcggaaagacauuccccaaugggaaccuucuaaggguuggaaugacuggcaacaagugcccuuuuguagccaucauuuucaucaauugauaaugaaagauggaagagaaauagucgucccgugcagaaaccaagaugaauuagucggccgggcacgggucucgcaaggcgcuggauggagucucagagaaacagccugccuagggaaaucauacgcccaaauguggcaauuaauguacuuucaccguagagacuugcgauuggcagcuaaugcaaucuguucugcaguaccaguggauuggauaccaacaagucguacuacauggucaauacacgcgcaccaucaauggaugacaacagaagauaugcuaagcguuuggaaucguguauggauugaagaaaacccauggauggaggauaaaacccacauaaguaguuggggagacgugccauaccugggcaaacgagaagaccaaugguguggcagcuugauaggucuaacggcacgagcgaccugggcgacaaacauccaaguggcaauaaaccaaguccgccgcuuaaucggaaacgaaaacuacuuagacuauaugaccucuaugaagagauucaaaaaugagucggacccagagggugcacugugguaa

SEQ ID NO: 21659 - RNA, 9879 nt, Artificial Sequence
  derived and/or modified CDS sequence (opt6) from DENV-1__GQ199780__SS-prME
ucagugacaauguuauuaauguuaaugcccaccgcacuagcuuuucacuuaacuacaagaggaggagaaccccauaugaucguaaguaaacaagaaagggggaaaucuuuacuuuuuaaaacaagugcaggaguaaauauguguacgcucaucgccauggauuuaggagaauuuugcgaagacacuaugacuuauaaauguccaagaaucacugaagcagaaccugacgauguugacugcugguguaaugcuacggauacgugggugacauaugggacaugcucucaaacgggagaacauaggagagauaaacguucuguugcauuagcaccacaugugggccuagguuuagagacgaggacagaaaccuggaugaguagugaaggagcauggaaacaaauccaacgaguugagaccugggccuuaagacauccgggauucacaguaauagcauuguucuuggcacacgcaauagguacaucaauuacgcaaaaaggaauuauauuuauccuucuaaugcugguaacaccaagcauggcaaugagauguguaggaauugguucaagagauuucguagaaggauuaucaggagcgacuugggucgacguaguucuggaacacggguccuguguaacuacaauggccaaagauaaaccuacgcucgacaucgagcuauuaaaaaccgagguaacaaauccugccguauugcgaaaauuauguaucgaggccaaaaucagcaauacaacuacggauucgagaugcccaacccaaggagaggcaacccuugucgaagaacaagacgccaauuuuguauguaggcgcacguucguagaucgaggguggggaaauggguguggacuauuugggaaaggaucauugauaacaugugccaaauuuaaaugugugacgaaacuggaaggcaaaaucguucaauaugaaaacuuaaaauacagcguuauaguaacgguacauacgggcgaucaacaucaagugggaaaugaaucaacggaacauggaaccacagcaacuauuacuccacaagcaccuaguaccgaaauucaacugacagacuauggcgcacugacccuggauugcuccccacgaacaggauuagauuuuaacgaaaugguauuacuaacuaugaaagagaaaucgugguuaguacacaaacaaugguuccuagauuugccccucccuuggacaaguggugcuagcaccucccaagaaacuuggaaucgaaaagaccuauuagucacauucaaaaccgcucaugcaaagaaacaagaagugguaguuuuagguucucaagaaggagcgaugcacacugcacuuacaggcgcgacagagauucaaacuucaggcacuacuacgauuuuugcuggccacuuaaaaugcagacuaaaaauggacaaacuuacucuuaaaggaaugaguuaugugaugugcacagguucguucaaauuggaaaaagaaguugcagaaacucaacacgggacaguccuuguacaaauaaaauacgaaggaacagacgcuccuuguaagauacccuuuucaacacaagaugaaaagggcguaacacaaaauggucgacuuauaacugcuaaucccauaguaacagauaaagagaagccaguuaauauagaagcugagccacccuuuggugagucuuacauaguaaucggcgcgggugaaaaggccuugaaauugaguugguucaagaaaggcuccagcauaggcaaaauguuugaagcgaccgcucgcggagcaagaaggauggcuauucuuggagacacagcuugggauuuugguaguaucggaggagucuucacuucagugggcaagcuaguacaccaaauauucggaacugcuuauggcguucuauucagcggcguaucauggacaaugaaaaucggcauagggguccuguuaacguggcuaggauuaaacucuaggucaacaucuuuaucaaugacguguauagcagucggucuaguaacguuauacuuaggaguuaugguucaggccgauucaggauguguaauuaauuggaaaggcagagaacuaaaaugcgguucuggcauuuuugugacgaaugagguacacacuuggacagaacaguacaaauuucaggcagauuccccaaaaaggcuaucagcugcuauagggaaggcuugggaggaggggguaugcgguauacgaucggcaacacgccuggaaaacauaauguggaaacaaauaucgaaugaauuaaaccacauucuauuggaaaacgacaugaaauuuacggucguuguaggugauguagcaggcauacuugcacaaggcaagaaaaugauccguccacagccaauggaauacaaguacaguuggaagucuuggggaaaagcaaaaaucauaggugcugauguucaaaauacgacauucauaaucgacgguccaaauacucccgaaugcccagaugaccaaagggcauggaacauuugggaaguugaagauuaugguuucggaauauucacgacaaauauauggcuuaaacuuagagauagcuauacacaaguaugugaucacaggcuaaugagugcugcaauaaaagauaguaaggcagugcaugcagauaugggauauuggaucgagucggaaaagaaugaaacuuggaaguuggcgcgggcuucguucauugagguaaaaacuuguauauggccaaagagccauacucuuugguccaaugguguuuuggaaucagaaaugauuauaccuaagauauauggagguccgauaucccagcauaauuaucgaccaggguauuuuacucagaccgccgguccauggcacuuaggaaaacucgaacuggacuuugacuuaugugaaggaacaacaguuguuguggaugaacauugugggaauagagggccaucucuaagaacaacaacgguaaccgggaagauaauccaugaaugguguugcaggagcuguacauuaccuccauuaagauuuaaaggagaagacggaugcugguacgguauggaaauacgcccggucaaagaaaaagaagaaaaucugguaaaaucaauggucagugcagguagcggggaaguagauucguuuucuuugggauuauuaugcauaaguauuaugauagaagagguaaugagaucuagaugguccagaaaaauguuaaugacaggcacacuagcuguauucuuucuucuaauuaugggucagcugacauggaacgaccugauaagacuuuguauaauggucggugccaaugcaucugaucguaugggaaugggaacuacuuacuuggccuuaauggcuaccuucaaaaugagacccauguuugcaguaggcuuguuauuccgaaggcuaacuucgcgagagguauugcucuuaacaauaggucuaagucugguagccaguguggagcugccaaauagucuugaagaacucggugacggacuagcgauggggauaaugauuuuaaaacucuuaacagauuuucagucacaucagcuaugggccacacugcuaucacuaacuuuuauaaaaacaacguuuagcuugcauuaugcuuggaagacaauggcuaugguacuuucgauaguuucgcuauuuccuuugugucuuaguacaacuucacagaagacgacgugguuaccaguauuacuagguucacuugguuguaaaccauuaaccauguuccuuauugcagaaaauaagauauggggacgaaaauccuggccgcuaaacgaagguaucauggcuguugguaucguuucuauauuacuuucagccuuguugaaaaaugaugugccccuagcuggacccuugauagcuggcggcaugcuuauagccuguuacguuauaagcgguucuagugccgauuuaucuuuagaaaaagcggcugaagucucgugggaggaggaagcugaacacagcggggcaucgcacaauauucucguugaaguccaagacgacggaacaaugaaaauaaaggaugaagaaagagacgauacuuuaacuauauuguuaaaagccacacuacuggcggugucaggaguuuauccucuaaguauaccagcaacuuuguucguuugguauuucuggcagaagaagaaacaacguucaggaguacuaugggacacuccauccccgccagaagucgaaagggcugugcuugacgacgguaucuauagaaucaugcaaaggggacuauuaggccgaucacaaguuggaguuggaguuuuucaagagaauguuuuccauaccauguggcauguaacgaggggugccguccuuauguaucaggggaaaagauuagaaccuucaugggcaagcgucaagaaagaccuaauaucuuacggagguggauggagacuacaaggaucauggaacacaggcgaagaaguucaaguuauagcaguggaaccuggcaaaaauccuaaaaacguacaaacagccccaggaacauucaaaacgagugaaggagaggugggcgccauugcacuugacuucaaaccaggcacuucuggaaguccuauagucaaucgagaagggaaaauagucggguuguacggaaaugggguggucacuacaucaggcacauacguuagcgcgaucgcccaagcaaaagccucacaagaaggucccuuaccugaaauagaagaugaaguuuuucgaaaaagaaauuuaacuauaauggaccuccauccggguucgggcaagacaaggagauacuugccugcuauagugcgggaggcaauaaaacggaaacuuagaacgcucauauuagcacccacaagaguaguagcaucggaaauggcagaagcucuaaaagguaugccaaucagguaccaaaccacagccguaaaaagugaacauacggggaaagaaauuguugaccuuaugugccaugcuacuuucacaaugagauuacuaagcccuguaagggucccaaacuacaauaugauaauuauggaugaagcacauuuuacagauccgucaucgauagcagcaagaggguauauuuccacuaggguugggaugggagaggcggcagccauauuuaugacggcaacuccaccaggaucaguagaggcuuuuccucaaucaaaugcuguuauacaggaugaggaaagagacaucccggaaaggagcuggaacucaggguaugaauggaucacagauuucccaggaaaaacagucugguuuguaccuagcauaaaauccgguaaugauauugcuaauugcuuacggaaaaauggaaagagggugauacaacucagccguaaaacuuucgacacagaauaucagaaaacuaagaauaaugauugggacuauguaguuaccacggacauuagugagaugggggcuaacuuucgugccgacaggguaauagauccgagaagaugccuuaagccaguaauucuuaaggaugggccugagcgagucauauuagcagggccaaugccggucacaguggcaagugcggcacaaagacgaggacgaaucgggaggaaucacaauaaagaaggugaucaguacauuuauaugggucaaccucucaacaaugaugaggaucacgcacacuggacagaggcaaagaugcuacuugauaauauuaacacgcccgaaggaauuaucccggcucuuuuugaaccugaaagagaaaagagcgcggcuauugauggagaguaucgccugagaggcgaagcaaggaaaacauuuguggaacuaaugcggcguggggauuugccagucuggcuaaguuacaaaguagcuucagaaggauuucaauauucagaccggcgguggugcuucgacggagagcguaacaaucaaguucucgaagaaaacauggacguugaaauauggacaaaggaaggagaaaggaagaaauuacguccgagaugguuagaugcccgaaccuauagugacccgcuugcccuccgcgaguuuaaggaauuugcagccggccgaagaucuguguccggugauuugauacuugagauagguaagcugccacaacauuuaacucaaagagcucaaaacgccuuagauaaucucguaauguuacauaauagcgaacaaggcgggagagcauaucgucaugcgauggaagaauuacccgacacgauugagacucuaauguuauuagcguugaucgccguuuuaaccgguggaguuacucuauucuuuuuaucgggucguggguugggaaaaacuucaauaggguuacucuguguaauggcaucuaguguacuacuauggauggcaaguguggagccgcauuggaucgcagcgaguauaauuuuagaauuuuucuuaaugguauuauuaaucccugaaccagacaggcagagaacuccacaagacaaucaguuggcuuaugugguaauaggacuuuuauuuaugauacuaaccguagcagcaaaugaaaugggauuacuggaaacuacuaagaaagaccuaggaaucggacauguagcagucgaaaaucaccaucaugccgcaaugcuugacguugacuugcauccagcauccgcauggacauuauacgcggucgcaaccacaauaauaaccccuaugaugagacauacaauagaaaauacaacggcuaauauaucucugacugcgaucgccaaucaagcagcuauauuaaugggacucgauaaaggguggccaauaucgaaaauggauauugggguaccucuauuagcacugggauguuauucacaaguuaauccgcuaacccuaacagcugcaguacuuaugcugguggcgcauuaugcuaucauaggacccggacuacaagcaaaagcaacgagggaggcacaaaaacgaacagcagcagggaucaugaaaaauccaacgguggacggaauugucgcuauugaucuugaccccguagucuaugacgccaaauucgaaaaacaauugggucaaaucauguuauuaauccuguguaccagucagauacugcuuaugcgaaccacgugggcucucugugaauccauuacuuuggcaacuggaccucuaacgacauugugggaaggaagccccggaaaguucuggaauacaacuauugcagugucaauggccaacaucuuucguggcaguuaucucgcgggcgcugguuuggcauuuagcuuaaugaaaucccucggagguggacggagaggaacuggagcacaaggcgaaacacuaggggaaaaauggaaaagacaacuuaaccaacuguccaaaucagaguucaacaccuacaaaagauccggcauuauggaagucgaucguuccgaggcuaaagaaggauugaaaagaggagaaacuacaaaacaugcugugucgcguggaaccgcgaagcucagaugguuuguagaacggaaucuaguaaaaccugaagguaaaguaauagauuuaggaugcggcagaggugguuggucauacuauugugcgggguuaaagaaaguaaccgaaguaaaaggguauacaaaagguggcccgggacaugaagaaccaauuccaauggcaacauaugguuggaaucuggucaaauuacauucagguaaagauguauuuuucauaccgccugaaaaaugcgauaccuuacuaugugauaucggcgagagcagcccuaauccaacaauagaagaaggccggacauuacggguccuaaaaaugguagagccaugguuaagaggaaaucaauucugcauuaaaauucuaaacccuuacaugccaagcgucgucgaaacucuagagcagaugcaaagaaagcauggaggaauguuaguaagaaauccauuaucaagaaacaguacacacgagauguacuggguaagcugugguaccggcaacauaguaucugcuguaaauaugacgagucggaugcuauuaaaucguuucacuauggcucauaggaagccuacguaugagagagacguagaucugggugcuggaacaagacacguagccguggaaccggaaguagccaaucuagacauuaucgggcaaagaauugaaaauauaaaacacgaacauaagagcaccuggcauuaugaugaggacaauccuuauaaaacaugggcuuaucacggaucauacgaaguaaaaccgagcgggagcgcaucaagcaugguaaauggaguagucaaacuccucacuaaaccaugggauguuauuccuaugguuacacaaauagcuaugacugauacaacacccuucggccaacaacgaguuuuuaaagagaaaguugacacaagaacaccaaaggcuaaacgaggcacggcucagauaauggaaguaacagcaaaauggcuaugggguuucuuaucgcgaaacaagaaaccaagaauuugcacacgagaagaguucacgagaaaggugcggucgaaugcagcaauaggugcaguuuuuguagaugaaaaucaauggaacucagccaaggaagcugucgaagaugaaagguuuugggauuuaguucaucgagaaagggaauuacauaaacaagguaaaugcgcaacaugcguguauaauaugauggguaagagagagaagaaacuuggggaauuuggcaaagcaaagggaaguagagcuauaugguacauguggcuaggagcuagauuucucgaauuugaggcgcuaggguuuaugaaugaagaucauugguucaguagggaaaauucuuugucgggaguggaaggcgaaggccuccauaaacuugguuacauccuuagagauauaucgaaaauaccuggcgguaacauguaugcggacgacacugcggggugggacaccaggaucacagaagaugaccugcaaaaugaggcaaaaauaacagacauaauggaacccgaacacgcguuguuagcaaaaucgauauucaaacugaccuaccaaaauaaaguagugagaguccaacgcccugcuaaaaacgggacaguaauggauguuauuuccagacgagaucaacgagguucgggacaggucggaacauacgguuuaaauaccuucacuaauauggaggcccaauuaauacgacaaauggaaucagaagggauauucucaccaucagaacuugaaacuccuaacuuagcugggcgugugcuagacuggcucgaaaagcacggggucgaacgguuaaaacgaauggcaauuucuggagaugauuguguagugaaaccgauagaugaccgauuugcuacagcguuaacugcauuaaacgauauggguaaaguucgcaaggauguaccucagugggaaccaucgaaaggauggaacgacuggcaacaaguuccauucuguucucaccauuuccaucaauugauuaugaaagacggacgcgagauuguuguacccugccgaaaccaggaugaacucguggguagagcucgaguaucacaaggagccggguggagccucagagagaccgccugccugggcaaaaguuaugcucaaauguggcagcuaauguauuuucauagacgagaucugagacuggccgcaaacgcaauauguucggcaguuccuguagauuggguaccgacaagcagaacaacgugguccauacaugcgcaccaucaguggaugacuacagaagauauguugaguguuuggaaccgaguauggauagaagaaaacccuuggauggaggacaagacucauauaaguagcuggggugauguuccauaccugggaaaaagagaagaccaguggugugguucucuaauaggucuaacagcaagagcaacgugggccacuaacauccagguugcaauuaaccagguccggcgauuaauaggcaacgagaacuaucuagauuacaugacgucaaugaaaagauuuaaaaaugaaucagaucccgaaggugcauuaugguga

SEQ ID NO: 21660 - RNA, 9879 nt, Artificial Sequence
  derived and/or modified CDS sequence (opt6) from DENV-1__GQ199781__SS-prME
aguguaaccaugcuuuuaaugcugaugccaaccgcacuagcguuucaccuuacaacacgagguggugaaccacauaugauaguaaccaaacaagaacgcggcaaaucuuuauuauuuaaaaccagugcagggguaaacaugugcacucuaaucgcaauggacuugggagaauuaugcgaagacacuaugacguauaaaugucccagaauuacagaagcagaacccgaugauguggacugcuggugcaacgcaaccgauaccuggguaacuuacggaaccugcucucaaacuggugaacacagaagggacaaaagaucaguugcccuagcaccacacguaggccuagggcuugaaacgagaacagaaacauggaugucuagugaaggugcauggaaacaaauucaaaggguggaaacaugggcuuuacgacauccuggauuuacuguaauagcacucuuccuagcgcaugcaauaggaacaucuauaacgcaaaaaggaaucauauuuauuuuacuaaugcuugucacgccauccauggcuaugcgaugcgucgggauaggaucccgagauuucguagaaggacuaagcggagcaacauggguggaugugguauuagaacauggaucaugcguaacuaccauggccaaagacaaaccgacauuggauaucgaauuauuaaaaacagaaguaacaaauccggcugugcuaaggaaacuaugcauagaagcaaaaauaucaaauacgacuacagauucgagaugcccuacucaaggagaagcgacucuuauggaggagcaagaugcuaauuuuguuuguagaaggaccuuuguugauagagguugggguaacgguugcggucuuuucgguaaagggucacuaauuacgugugcuaaauuuaaaugugucacaaaacuggaagggaaaauuguacaauaugaaaacuugaaauauucgguaaucguaaccguucauacaggagaucagcaccaaguugguaaugaaagcacugaacacgguaccacagcuacaauaacuccccaagcaccuaccagugaaauacaguuaaccgauuauggggcgcucacuuuggauuguucaccaagaaccggacuagauuucaacgaaaugguguuacucacuaugaaagaaaaaucauggcuaguacauaagcagugguuucuugaccuaccucuaccguggacaaguggugccucaacaucucaagaaacuuggaacaggcaagaucuacugguaacauuuaaaacggcacacgcgaagaaacaggaaguaguuguucuuggcagccaagagggagcgaugcauacagcucucacuggagcaacggagauccaaacgucaggaacuacgaccaucuucgcugggcaucuaaaaugcaggcuaaaaauggacaaacuaacgcugaaagguaugaguuauguuauguguacaggaucuuuuaaguuagaaaaagaagucgcugaaacccaacacgggacaguauugguucaaauaaaauaugaggggacggaugcgccguguaaaauaccguucagcacgcaggacgaaaagggcgucauccaaaacggccggcuuaucacggccaauccaauaguaacugauaaggaaaaaccggucaauauugaagcagaacccccuuuuggcgaaagcuacauaguaauagggguuggagaaaaagcauugaaacucucaugguuuaagaaaggauccaguauagggaaaauguuugaggcgacugcaagaggggcucgaagaauggcaauacucggagauacagccugggauuuuggcucgauuggcggcgucuucacuucgguagggaaauuaguucaucagauuuucgguacagcguacggagucuuguuuucuggcguaaguuggacuaugaagauaggaauuggcguacuguuaacaugguuaggacuuaacuccaggucaacaucacuaucgaugacuuguauagcugugggcuuggugacucuguaucuagggguaaugguccaagcagauaguggaugcgucauuaacuggaaagggcgagaacuaaaauguggauccggaauauuuguaacgaacgagguacacacauggacagaacaauauaaauuccaagcagacucgccaaagcgauugucagccgcaaucgguaaggcuugggaggaaggcguuugugguauucgauccgcaacccgauuagaaaacauuauguggaagcagauaagcaacgaauugaaccacauacuauuagagaacgauaugaaauuuacaguaguugucggagacguaguaggaauacuagcccagggcaaaaagaugauacguccucagccaauggaacauaaauauucuuggaaaucauggggcaaagcuaaaauaaucggggcagacgcccaaaacacgacauuuauuauagauggacccaauacacccgaaugcccagaugaccaaagagcauggaacauaugggaaguagaagacuauggauuuggaauuuucacaaccaauaucuggcucaaguuaagggacucauauacgcaggcuugugaccauagacuaaugagcgccgcaauuaaggauagcaaggccguacacgcugacaugggauauuggauagaaagugagaaaaaugaaaccuggaaacuagcucgugcuucauuuaucgaaguaaaaacuugcauauggccuaaaucacacacgcuguggucaaacggcguucuagaaagugagaugguaauacccaaaaucuacggcggaccaaucucacagcacaauuauagaccaggguacuucacacaaacagccggcccuuggcacuugggaaaacuagaauuggauuuugauuuaugugaagggaccacgguagucguugacgaacauugugggaaucgaggacccucccucagaacgacuacugucacagggaagaucauucacgaguggugcuguagaucguguaccuuaccucccuugagguuuaaaggugaagacggcuguugguauggcauggaaaucagaccagucaaagagaaagaagagaaucuagucaaaucaaugguaucggcagguucaggggaagucgauaguuucucccuuggacuauuguguauuagcauaaugaucgaagaaguuaugcgauccagaugguccagaaaaauguuaaugacgggaacucuagcaguauuucuguuguuaauaauggggcaacuaacguggaaugaccuaauacgacuauguauuaugguaggagcaaaugccucugacaggaugggaauggggacgacauacuuggcauugauggcaacauuuaaaaugcguccgauguuugcuguaggauuauuauuucgucgacugaccucaagggagguuuugcuacuuacgauaggacuaagccucguagcaaguguugaacuaccuaacucauuagaagaacucggggaugguuuggcaauggguaucaugauccugaaacuuuuaaccgacuuucaaucccaccagcuaugggcuacgcugcuuuccuuaacguuuauaaagacaaccuuaucccuccacuacgcauggaaaacuauggcgauggugcuuaguauuguauccuuauucccacuauguuuaucgacaacaucacaaaagacaacuuggcugccugucuuacuugguucccuugggugcaaaccccucacaauguuuuuaauagcggaaaauaaaauauggggaagaaaaaguuggccacuuaaugagggaaucauggcaguagggguagucaguauauuauuaucaucucuucuuaagaacgacguaccacuagcaggaccguugauugcuggugguaugcuaauagcaugcuauguuauaaguggaagcagugcagaccucucucuagagaaggcagcugaggugaguugggaagaagaagcagaacauaguggggccucucacaauaucuuaguggaaguucaggaugacggcacaaugaaaauaaaagacgaggagcgggaugauacccuuacuauauuguugaaagcuacucuguuagcuguuucaggagucuacccuuuaagcauaccugcgacacuguucguaugguauuuuuggcagaaaaagaaacaacggaguggcguuuuaugggacacaccaucaccacccgaaguugaacgagcagucuuagacgaugguaucuauagaauaaugcaaagaggguugcuugguagaagccaaguaggaguuggagucuuucaggaaaacgucuuccacacaauguggcacguuacuagaggagcugugcuaauguaucaaggaaaaagacuagagccgucaugggcuucagucaagaaagaccuaauuagcuacggcggaggauggaggcuacaagguagcuggaacacaggugaagagguacaagugauagcggucgaaccgggcaaaaauccaaagaauguacagacagcgcccggaacauuuaaaaccccagaaggagaaguaggggcgauagcucuagacuuuaaaccuggaaccucaggaucuccaauaguuaaucgagaaggaaaaauagugggucuauaugggaacggaguugucacaaccuccgguacauauguaagcgccauagcacaaacgaaagccagucaagaggggccucuaccugaaaucgaagacgaaguauucagaaaacggaaucugacuauaauggaccuccauccuggauccggcaaaacucgacgauauuuaccggccauuauucgagaggcaauaaaaagaaaacugcgcacucuuauucuagcuccaacaagaguaguagcuagcgagauggccgaggcuuuaaagggcaugccgauaagauaucaaaccacagcaguuaaaagcgaacauaccgggaaggaaauagucgaccuaaugugccaugcaacauucacgaugcgauuacuaucuccaguuagagugccuaacuauaacaugauaaucauggaugaagcucacuuuacggauccaucaaguauagcugcaagaggcuacauuaguacacgcguaggaaugggagaggcagcugcuauuuuuaugacagcaacaccaccgggaucaguggaggcuuucccacaaucuaaugcaguaauccaggaugaggaacgagauaucccugagagaagcuggaacucaggauacgaauggaucacugauuucccaggcaagacaguaugguucguaccaaguauaaagucugggaaugacauagcaaauugccuaaggaaaaacggaaaacgcguuauacaauuaagccgcaaaaccuuugauacugaauaucaaaagacuaaaaauaaugacugggauuauguaguaacuaccgauauaucugaaaugggagcaaacuuuagagcggaccgagugauugauccuagacgguguuuaaaaccaguaauauugaaagauggcccggaaagaguaauacucgcgggcccgaugccaguaacuguggccucagcugcacagaggagaggacgaaucggaaggaaucacaauaaggagggagaucaauauauuuauauggggcaaccauuaaauaacgacgaagaucacgcacauuggacagaagcaaaaauguuacuagauaauauaaacacuccggagggaaucauuccggcccuuuuugaaccugaaagagaaaaaucugccgcgauugacggugaauacagacuucgaggugaagccagaaaaacauuuguggaacuuaugagacguggagaucuucccgucugguuaaguuauaaagucgcaagugaagguuuccaauauagugauagacggugguguuuugacggggaacguaauaaucaagucuuggaagaaaauauggauguagaaauuuggacuaaagaaggugaaaggaaaaaguuaagaccgagaugguuagaugccagaacguacuccgacccacuagccuuacgagaguucaaagaguucgcagcaggcagacggagcguaaguggagaucuaauucuagaaauugguaaauugccgcagcaucugacccaacgagcgcaaaaugcccuugacaaccucguaaugcuacacaacucagaacaagguggcagagcuuauagacacgcgauggaggaacuaccagacaccauagaaacucuuaugcuucuagcauugauagcaguuuuaacagggggaguaacacuguucuuuuugaguggacguggcuugggaaagacuucgauuggauuguugugcguuauggcuagcucuguguuauuguggauggcaucuguggaaccccacuggauagcagcuaguaucauucuggaguucuuccuaaugguacuuuuaauaccggaaccagauaggcaacgcacaccucaagauaaucaacucgcuuauguagugauaggccuuuuauuuaugauucuaacaguagcagcuaacgaaauggguuuauuagaaacgacaaagaaggaccuggguauaggucacguggccguagaaaaucaucaccacgcaacuaugcuggacguagaccuucauccagcgucagccuggacccuuuaugcaguugcgacgaccauaaucacuccaaugaugagacauacaaucgaaaauacaacugcaaauauaucgcuaaccgcaauagcgaaucaagcggcaauccuuaugggacuggauaaaggauggccaauuucgaagauggauauaggaguuccgcuauuagcuuuaggguguuauagucaaguaaacccacuaacauuaacugcagcgguccucaugcuugucgcacacuaugcaauaauagggccgggcuuacaggcgaaagcuacaagggaagcccagaaaagaacugcggcaggaauaaugaaaaaccccacaguagauggaauagucgcaauagacuuggacccuguaguauaugaugccaaauuugagaaacaacugggucaaauaauguuacugauuuuaugcacaagucaaauauuguugaugagaacgacgugggcucucugcgaaucuauaacacuugcuacgggaccauuaacuacuuugugggagggaucuccaggaaaauuuuggaauacaaccauugcgguaaguauggcgaauauauucaggggaucuuacuuggccggagccggauuagcauucucguuaaugaaaucauuaggaggaggcagaagaggaacaggagcgcaaggagagacguugggggaaaaauggaaaagacaacuaaaccaacuaagcaagucugaguucaacaucuacaaaagaucaggcauaauggaaguagaucgaagcgaagcaaaggaaggacuaaagagaggggaaacaacacgacaugcaguguccagagggacggcuaaauugcguugguuuguugaaagaaaccucguuaaaccagaagguaaggucaucgauuuggguuguggccgagguggaugguccuacuacugugcuggucucaagaaaguaacagaaguuaaagguuacacaaaagggggaccaggacacgaagaaccuauuccuauggcgacguacggauggaauuuagugaaauugcacucagguaaagacguguucuuugcgccaccagaaaaaugugacacacuucuaugcgauauuggggaaaguagcccuaauccgaccaucgaagagggccggacauuacguguucuaaaaaugguagaaccuuggcuaagagggaaucaauucuguauaaaaauucuaaauccuuauaugccaagcguuguugagacguuagagcagaugcagagaaaacacggaggaaugcucguccgaaauccauugucaagaaacucaacgcaugaaauguacuggguguccuguggaacugggaacauagucagcgcaguaaauaugacaucacgaaugcuacuaaacagauucacaauggcccacagaaagccaacauacgaaagggacguagaucuuggugcggguacaagacauguagcgguagaaccagagguggcgaauuuagauauuauuggccaaagaaucgagaauauaaagcacgaacauaaaucaacuuggcauuacgacgaagauaaucccuauaaaacaugggcauaucacggaucauaugagguuaaaccaaguggaucagcaucaucaauggucaaugguguuguaaagcuacuaacaaaaccuugggauguuauucccaugguaacgcagauagccaugacggauacaaccccuuuuggacagcagagaguauuuaaggagaagguagacaccagaacacccaaagcaagaagaggaacggcucaaauuauggagguaacagcuaggugguuauggggauuucuaaguagaaauaagaaaccucgaauuugcacucgcgaagaguucacucguaagguuaggucuaaugccgcaauaggagcgguguucguggacgaaaaccaguggaacucagcaaaagaggcaguugaagaugaaagguuuugggaucuaguacaaaaggaaagagaacugcauaaacaaggcaaaugugcgacuugcguauauaacaugaugggaaaaagagagaagaaacuaggagaauuugggaaagcaaaagguucacgcgcaauaugguacaugugguuaggugcgagguuucuagaauuugaagcccuuggcuuuaugaacgaagaucacugguucaguagagaaaacucuuugaguggugucgaaggcgaaggacugcauaaacuagguuacauacuucgagacaucaguaagauaccgggaggaaauauguaugccgacgacacagccggaugggauacuagaauaaccgaggaugauuugcaaaacgaagcuaagauuacagacauaauggaaccggagcacgccuuacuugcgacuucgauuuucaagcugacauaccaaaauaaaguggucagaguacaacggccugccaaaaauggaacugugauggacguaauuucaaggagggaccaacguggaagcggccaaguagguacguacgggcucaauacauuuacaaauauggaagcccaacuaauaagacagauggaaucugaaggaauuuuccuuccuagcgaguuagaaacgccaaacuuagccgagagaguucucgacuggcuagaaaaacauggcguagaaagacuaaagcguauggcaaucuccggcgacgacuguguaguuaaaccuauugaugaucgauucgcuacugcauugacagcuuuaaaugacaugggaaaaguacgaaaagauauaccacagugggagccgagcaaaggcuggaaugauuggcaacaaguacccuucuguucacaccauuuucaccagcuaauuaugaaagaugggcgagaaaucguugugccaugccguaaccaagaugaguugguuggcagagcacgaguuagucaaggcgcaggaugguccuuacgggaaacagcuugucuggggaagucguacgcacaaauguggcaacuaauguauuuucacaggcgggaccucagauuagccgcaaacgccauauguagugcagugccaguugauuggguaccaacaaguaggacaacauggagcauucaugcacaucaccaauggaugacgacagaagauaugcuaucgguguggaacagaguguggauugaagagaacccuuggauggaggacaaaacucauguaagcucauggggugacguaccauaccuaggaaagagagaagaccaaugguguggaagccugauuggacugacugcucgcgcaacaugggcuagcaauauccagguagccaucaaucaagugcgccgcuuaauaggaaacgaaaacuacuuagauuauaugacaaguaugaagcgcuucaaaaaugaaggagaucccgaaggggcuuuaugguaa

SEQ ID NO: 21661 - RNA, 9879 nt, Artificial Sequence
  derived and/or modified CDS sequence (opt6) from DENV-1__GQ199782__SS-prME
agugugacuauguuacuuaugcugaugccuaccgcauuagcuuuucaucuuacaacaagagguggagaaccgcauaugaucguaacaaaacaggaacgaggaaaaagucugcuauucaaaacaagcgcuggugugaacaugugcacacugaucgcaauggaccuaggagaacuaugugaagauaccaugacauacaaauguccccguauuacagaagcugaaccagacgauguagacuguugguguaaugcaacugacacauggguaacguaugggacaugcucgcaaacaggagaacaucggcgggacaaaagaaguguugcacuggcaccacauguugggcucgguuuagaaacucggacagagacuuggaugucaucagaaggagcguggaaacaaauacaaagaguggaaacaugggcuuugcgacauccuggguuuaccguaauagcucucuuucuugcccaugcaauugguaccucuauuacucaaaaagguauuauauuuauccuauugaugcuaguuacgcccaguauggccaugcgcugcguugggauaggaucuagagauuuuguggagggauuaucaggagcuacauggguagacguuguauuagaacauggaaguugcguaacaacaauggcaaaagacaaaccuacacuugauauagaacucuuaaaaacagaaguaacgaauccugccguacuuagaaaauugugcauagaagcgaaaauuucuaauaccacgacggacagucgaugcccgacucagggugaagcaacgcuuauggaggaacaagaugcuaacuuuguuuguagaagaacauucgucgacaggggauggggaaauggaugcggcuuauuugggaaaggcucguugauaaccugcgcuaaauuuaaauguguaacaaaacucgaaggaaaaaucguccaguacgaaaaccuuaaauauucggucauuguuacaguucauaccggggaccaacaccaaguaggaaaugaaucaacagaacacggaacaacagcuacgauaacaccacaagcacccacaagugaaauacagcugacagacuacggagcgcuaacguuagauuguagcccaagaaccggguuggacuucaaugaaaugguacuguugacaaugaaagagaaaagcuggcuaguccacaaacaaugguuccuagacuuaccccuuccauggacaucuggggcgucaacaucucaagaaacguggaauagacaggaucuauuagugacauucaaaacggcacaugcgaagaaacaggaaguugucguauuagguagccaagaaggugccaugcauacagcccuuaccggcgcaacagaaauucaaacaaguggaacuaccacaauuuuugcgggccauuugaaaugccgucuuaaaauggacaaacuaacguuaaaaggaaugucuuauguuauguguacaggaaguuuuaaacuugaaaaagaaguagccgaaacacagcauggaaccguccuagugcaaaucaaauaugaaggcacagaugcuccaugcaaaauaccuuuuaguacucaggaugaaaaaggcguaacacaaaaugggagacuuauuacagcuaauccaaucguaacggacaaggagaagccagugaauaucgaggcggaaccaccuuucggggagucuuacaucguaauaggagccggugaaaaggcacugaaacuaucuugguucaagaaagguucgucaauugguaaaauguuugaggcaacagcacgaggagccagaagaauggcuauauuaggugacacugcaugggacuuuggcucuguagguggaguuuucacguccgucggaaaguuaguucaucaaauauuugguacagcguacgguguucuauuuucaggaguaucuuggacuaugaaaauaggaauaggugucuuacuaaccugguuaggacuuaacucacgcucaacaagucuuucaaugacauguauugcaguuggguuagucacuuuguacuuaggcguuaugguacaagcggauagugguugugugauaaacuggaaaggcagagaguugaaaugcggaagcgguauauuuguaaccaacgagguacauacuuggaccgaacaauauaaauuucaagcagauucgccuaaaagacuaagugcugcaauugggaaagcaugggaagaaggaguauguggcauucgaagcgcaacuaggcuagaaaauauaauguggaagcaaauuaguaaugaauuaaaccauauacuucuugagaacgauaugaaguuuacuguuguuguaggagauguugucgguauauuagcgcaaggcaagaaaaugauuagaccccaaccaauggaacauaaauauaguuggaaaucgugggguaaagcuaaaauaaucggagcagauauacagaauaccacuuuuauaaucgauggcccgaacacaccggaaugcccugaugaucaacgugccuggaauauaugggaaguugaggacuaugguuuuggcauauuuacaaccaauauauggcuuagacuuagggauucauauacccaagucugcgaccacagauuaauguccgccgcaauuaaggauucaaaagcuguacaugcagacaugggguauuggauugaaagcgagaaaaaugaaacauggaaacuagcgagggcuuccuuuaucgaaguuaagacgugcauauggccaaaaucccauacauuauggagcaacggaguucuugaaagugaaaugauaauaccaaagauauauggagguccaauuucacaacauaacuaucgaccuggcuauuucacgcaaacagcuggaccuuggcaccucggaaaauuggaacuagauuucgaucuuugcgaagguacuacaguaguaguggaugagcauuguggaaauaggggacccagucugaggacaacuacaguaacagguaaaauaauccacgaaugguguuguagaagcuguacucuaccacccuuacgauucaaaggggaagacgguuguugguauggcauggaaauacgccccgucaaggaaaaagaagaaaaucuuguuaaaagcaugguuagcgcaggaaguggagaaguagacucguuuucgcuugguuuacuauguauauccauuaugguagaagagguuaugaggucgagauggagucguaaaauguuaaugacaggaacguuggcuguuuuccuacuacucauaaugggacaacucacuuggaacgaucuuauacgccuguguauuaugguaggcgcuaacgcaagcgauagaauggggaugggcacuacauaccuugcacuaauggccacauucaaaaucagaccaauguuugcuguaggcuuauuaguaagaagacucacaagucgagaagugcuguuguugacaauuggucuuucuuuagucgccagcguggaauugccaaacaguuuagaagaacugggugacggccuagcuaugggaauaaugauacuuaaguugcuuacugauuuucagucccaccaauuaugggccaccuuauuaagccucacguucauaaagacaacgcucucauuacauuaugcauggaaaacuauggccaugguccugucaauagucucauuguucccauuauguuuaucgaccacaucacagaaaacuacgugguugccaguucuauuggggucacucggauguaaaccccuaacgauguuucuaaucaccgaaaauaaaaucuggggccgcaaaaguuggccucuuaaugaagggaucauggcagucggagugguaucaaucuuguuaucaagucuacucaaaaacgauguuccacuggccgguccacuaaucgcgggcgguauguuaaucgcuuguuacguaauuucggguuccucugcugauuuaucccuugagaaagcagccgaagugucaugggaagaggaggcugagcauuccggugccagccacaacauauuaguagagguacaagacgacggaacgaugaaaauuaaagaugaagaaagagacgauacuuuaacuauucuccucaaagcaacuuugcuagcaguauccggggucuaccccuugucuaucccagcaacacuuuuuguaugguauuuuuggcaaaagaagaaacagcgauccgguguacucugggauacuccuagucccccagaggucgaaagggcaguccucgacgauggaaucuauaggauaaugcaaagaggauuacuaggacguagccaagugggagugggcguguuccaagaaaauguauuccauaccauguggcauguaacacguggggccguuuugauguaucaaggaaaaagacuagaaccaaguugggcaagugucaagaaagaucuaaucucauacggugggggauggcgucuacaaggaucuuggaauaccggggaggaaguucaaguuauugcgguagaaccuggaaagaauccaaagaacguacaaacagcgccggggacguuuaaaaccccugaaggcgaagucggugcuauagcacuugacuuuaaacccgggacgaguggaaguccgauagucaaucgcgagggcaaaauaguuggcuuguauggaaaugggguggucacgacaucuggcaccuauguuagcgcaauugcacaggccaaggcuucacaggaaggaccccuuccagaaaucgaagacgaggucuucagaaaaagaaauuuaacuauaauggaucuccauccaggcucaggaaaaacuagaagauauuuacccgcaauaguacgggaagcgauuaaaagaaaauuaagaacgcuaauauuagcuccaacccggguaguggcuucugaaauggcagaggcucuuaaagguaugccgauuagauaucagacuacagccguaaaaucagaacacacaggaaaagaaauuguugauuuaaugugucaugcaacauuuacuaugcgcuuacuaucaccaguacgggugccaaauuacaacaugauuauaauggacgaagcacauuucacagacccaucgaguauugcagcaaggggguacaucaguacacgaguugguaugggugaggcagccgcaauauucaugacagcuacaccaccagggucuguugaagcauuuccacaaaguaaugcuguuauacaagaugaggaacgagacauacccgagcgcucauggaauagcgguuaugaguggauuacagauuuuccugggaaaacgguuugguuuguuccaucaauuaaaucaggaaaugacauagcaaauuguuuaaggaaaaaugggaagagaguuauucaguuaaguaggaagacauucgauaccgaauaucaaaagacaaagaauaaugauugggacuauguggugacaacugacauaagcgaaaugggggcgaauuucagagcagacagaguaauagauccaagacguugccugaaaccagucaucuugaaggacgggccugagaggguaauacuugcuggaccuaugccugugacgguagcuucggcagcacaacggagaggaagaauaggaagaaaccauaauaaagaaggugaucaguauauuuacaugggacagccacuaaacaacgaugaagaucacgcacacuggacagaggcuaaaauguuacuagauaauaucaauacaccggaaggcauaauuccagcccucuucgaaccggaacgggaaaaaucggcagcuauagacggggaauacagguuacgaggagaagcaaggaagacauuuguugaacugaugcgacgaggcgacuugccaguuuggcugucuuauaaaguugcaucagaaggcuuccaauauucugauagacgguggugcuuugacggggagcguaauaaccaaguucuggaagaaaauauggacguagaaauuuggaccaaagagggagaaaggaagaaacuuagaccucgaugguuagacgcaaggacuuacucggauccacuagcccugagggaguuuaaagaauuugcagcagggcgaaggucagugucgggugaucucauccucgaaauugggaagcucccucaacacuuaacacaaagggcucaaaaugcauuagauaacuuaguuaugcuccacaauuccgagcaaggcggacgcgccuaucgacaugccauggaagaacuaccggacacuauagagacacucaugcuuuuagcacucauagcuguccuuaccggagggguuacgcuauuuuuccuuaguggacguggauuaggaaaaacauccaucggucuauugugcgugauggccucaaguguccuauuguggauggcuucuguagaaccacauuggauagcugcauccauuauccuugaguucuuuuugaugguacuucuuauaccggagccugauagacaaagaacgccucaagauaaccaauuagcauauguuguaauaggacucuuauucaugauauuaacuguagcagcaaacgaaaugggccuucuugaaacgacuaagaaggaucuuggcauaggccacguagccguagaaaaucaucaucaugcuacaauguuggacguagaucuccacccagcuucagcauggacucuguacgcaguugcaacgacaauaaucacucccaugaugagacauacaaucgaaaauaccacagcgaauauuucacuaacugcuauugcaaaccaagcugcgauacuaaugggacuggacaaaggauggccaaucucuaaaauggauaucgguguuccacuacuugcacuggguuguuauucgcaaguuaacccacuaacacuaaccgcagcaguauugauguugguugcucauuacgcaauuaucggaccuggauuacaggcaaaagcaacuagagaagcacagaaaagaaccgccgcuggaaucaugaaaaauccgacugucgacggaauaguugcaauugaccuggauccgguuguauaugaugcgaaauucgaaaagcaauuaggccaaauaauguuacuaauauuaugcacuagccaaauauuacuaaugcguacuacaugggcacuuugcgagaguauuacccucgcaacagguccuuuaacuacacuaugggaaggcaguccuggaaaguuuuggaauacaacgauagcagucucaauggccaauaucuucagagggagcuaucuggcgggugcaggucuggcuuucaguuugaugaaaucccuaggaggcggaagaaggggaacuggugcgcaaggugagacacuaggagaaaaguggaaaagacaacuaaaucaauuauccaaauccgaguucaacauuuauaagagaucaggaaucauggagguugacagaagcgaggcuaaggaaggucugaagagaggagagacuacacgacaugccgucucgagaggaacugcaaaacugaggugguucguugagcgcaacuuagugaaaccagaaggaaagguaaucgaucuugguuguggccgagguggauggaguuacuacugcgcuggacuaaagaaaguuacggaaguuaaagguuauacgaaaggggguccgggacacgaagaaccuaucccuauggcuacuuauggcuggaaccugguuaaauuacacagugguaaggacguauucuuuacaccaccagagaagugugauacccuccuuugcgauauuggagaaaguaguccgaacccgacaauagaagaagggcgcacucuuagaguauuaaagaugguggaaccauggcugagagggaaccaauuuugcauuaaaaucuugaacccguauaugccgaguguaguagagacccuggaacagaugcagagaaaacaugggggaaugcuaguucgaaauccuuuaaguagaaacucgacacacgaaauguacuggguaucaugcggcacuggcaauauaguaagcgcagucaauaugacgucacggaugcuccuaaauagauuuacuauggcccauagaaaaccaaccuaugagcgagauguagauuuaggagcagggacuagacauguagcuguagagccugagguagcuaacuuagauauuauuggacaaagaauagaaaauaugaaacacgaacauaaaagcacauggcauuacgaugaagauaaucccuauaagacaugggcauaucauggaucauaugaaguaaagccgucugggucggccucaaguaugguaaauggaguugucaaauuauugaccaagcccugggacgugauaccuaugguaacgcagaucgcaaugacggauaccacacccuuuggacagcagaggguuuucaaagaaaaggucgauacccguacgccgaaagcgaaacgcggcacagcucagauaauggaaguaaccgccaggugguuguggggguuuuugucccgaaacaagaaaccacgcauaugcacaagagaggaguucacaagaaaaguccgaucgaacgcugcaauaggcgcgguauuuguugaugagaaucaauggaacuccgcaaaagaagccgucgaagaugaacgguucugggaucucguacaaaaagaacgcgaacuacauaagcaggguaaaugcgcaacgugcguuuauaauaugaugggaaagagagagaagaaauuaggagaguucgguaaagcuaaggggucaagggcuauaugguacaugugguugggggcacgauuucuggaguucgaagcacucggauuuaugaacgaggaucauugguucaguagggaaaacucauuaucugguguagaaggggaggguuuacacaaguuaggauauaucuuacgagauaucucuaaaauuccuggcggcaacauguaugccgacgauacggcaggcugggauacuagaauaacugaagaugacuugcaaaaugaagccaaaaucacggauauaauggaaccggagcacgcacucuuggcaacaucaaucuuuaaauuaacuuaucagaauaaagugguccgcguacaaagaccagcuaagaacggaacuguuauggauguuauaaguaggcgagaccaacgaggaaguggacagguagggacauacgggcuaaauacauucaccaacauggaggcacagcuaauccgacagauggaaucagaaggaauauucuuaccgagugaacuagagacaccaaacuuggcagaaaggguccucgacugguuggaaaaauauggaguugaacgauugaaacguauggcaauauccggggaugauugugucgucaagccaauagaugauagguucgccacagcccuaacagcacuuaacgacauggggaaaguaagaaaagacauaccccaaugggaaccuaguaaaggcuggaacgauuggcaacaaguaccauuuuguagucaccacuuucaccaauuaauuaugaaagauggacgagaaauaguagugccgugucgaaaccaagacgagcucguaggcagagcacgagucagucagggagcuggauggucauuaagggaaacagcuugcuuaggcaaguccuaugcgcaaauguggcagcuaauguauuuucaucgacgcgaucuaagauuagcugcuaaugcuauuugcucagcaguacccgucgacuggguuccaacgucaagaacuacuuggucaauucaugcucaucaucaguggaugacuacugaggacauguugaguguauggaauagaguguggauagaggaaaauccuuggauggaagacaaaacucauguuuccucguggggugauguuccuuacuugggaaaacgcgaagaucaaugguguggaucuuugauaggcuuaacggcgcgcgccacaugggcuuccaacauucaaguugccauaaaccagguaagaagacuuauagguaacgaaaauuacuuagauuacaugacaagcaugaaacgauucaaaaaugagggcgauccugaaggagcacuaugguaa

SEQ ID NO: 21662 - RNA, 9879 nt, Artificial Sequence
  derived and/or modified CDS sequence (opt6) from DENV-1__GQ199783__SS-prME
aguguuacgauguuauuaaugcuaaugccaacagcauuggcuuuccaucugacaacccguggcggagaaccccauaugauagucacuaaacaagaaagaggaaagagcuuacuauuuaaaacauccgcgggcguaaauauguguacacuaaucgcaauggaucuaggugaacuaugugaagauacaaugacauauaaaugcccaagaaucacugaagccgaaccagaugauguagauugcugguguaaugcaacagauacguggguuacuuauggcacauguucacagaccggugaacauagaagggacaaaagaucuguggcacuugcaccacacguuggguuaggcuuagaaacucggaccgaaacuuggaugucaagugaaggggcguggaaacaaauucaacguguugaaacgugggcgcuaagacauccaggguuuaccguaauugcauuguuucuagcacacgccauuggcacaucgauuacacaaaaaggaauaauauuuauucucuugaugcuuguaaccccuucuauggcgaugcguuguguaggaauaggaucacgugacuuuguagaaggaacgucuggagcuaccugggucgacguaguacuugaacacggaucaugcguuacuacaauggcgaaagauaaaccaacacuugacauugaacuuuuaaaaaccgaaguuacuaauccagcagugcucaggaaauugugcauagaagcaaaaauuagcaacacaacuacagauucucggugcccgacucaaggggaagcaacauuaauggaagaacaagaugcuaauuucguauguagaaggacauuuguagauagaggcuggggaaaugggugcggacuuuuuggaaaagguagccuaauaacuugugcaaaauucaaaugugugacuaaacuagaaggcaaaauuguacaauaugaaaaucugaaauacagcguaauagucacaguacacacuggugaccaacaccagguagggaaugaaaguaccgagcacgguacgacggcgaccauuacaccacaagcaccaacaagugaaauucagcuaacugauuauggagcucuuaccuuagacuguuccccacggacuggauuagauuucaaugaaaugguuuuacuuacuaugaaagagaaaaguuggcuaguucacaaacaaugguucuuagaccuuccguuaccuuggacaucgggugcaucaaccucccaagaaacauggaacagacaagauuuauugguaaccuuuaaaacggcacacgcuaagaaacaagaaguagucgugcuaggaagccaagaaggagccaugcauaccgcgcuaacuggggcaaccgagauacaaacaagugggacaacgacaauauuugcaggccauuuaaaauguagguuaaaaauggauaaguuaacguugaaaggaaugucauauguaauguguacugggucauuuaaacuugaaaaagaaguagcugaaacacaacauggaacagugcuuguucaaauaaaauacgaaggaaccgacgcgccauguaaaauacccuuuucaacccaagaugaaaagggaguaacgcagaacggacgccuuauuacggcaaauccgauagugacugauaaagaaaaaccagucaauaucgaagcagaaccaccauuuggugagucguacauaguaauuggugcaggcgaaaaagccuuaaaauuaaguugguuuaagaaaggauccucaauagguaaaauguucgaagcuacggcacguggcgcgcgaagaauggcaauacucggagauaccgcaugggauuuugguuccgucggugggguuuuuacuucaguuggaaaguuggugcaucaaaucuuuggaacagcauaugggguauuauucucaggcguaucauggacaaugaaaauuggcauagguguccuguuaacuuggcuaggccuaaauucaaggaguacgucccuuucaaugacauguauugcggucggcuuaguaacuuuauaucucgggguaaugguccaagcugacucaggcuguguaauaaacuggaagggacgcgaacuuaaauguggaucaggaaucuuuguaaccaaugaaguucauacauggacagaacaauacaaguuccaagccgauagcccuaagcguuuaagcgccgccauaggaaaagcaugggaagaagguguaugugguauacguucgagcacccgucuugaaaacauuauguggaaacaaauaaguaaugaguuaaaccacauacucuuagaaaacgauaugaaguucacaguagucguaggcgauguaguaggaaucuuggcgcaagggaagaaaaugauccgcccacagccgauggaacauaaauacucauggaagaguugggggaaagcaaagauaaucggugcugauguccaaaauacgacauucaucauagauggaccuaauacgccggaauguccagacgaccaaagggcauggaauauuugggagguagaggacuacggauucggcauauuuacuacuaacauuugguugaagcuacgggauucauauacgcaagucugugaccauagguugaugucugcggcgauaaaagauucuaaggcaguacaugcugauaugggguauuggauugaaagugagaaaaaugaaacauggaaguuggcucgugccagcuuuauugaagucaaaaccugcauuuggcccaaaucgcauacguuauggagcaauggaguacuggagagcgagaugauaauaccaaagaucuauggaggaccaauuucccaacacaauuaccgcccaggguacuuuacucagacagcgggacccuggcacuugggaaaguuggaauuagauuuugaucuaugugaaggaacaacgguagucguugacgaacauugugguaaucguggccccucacucaggacaacaacagucacugggaaaauaauucacgagugguguuguagauccuguacuuuaccaccauuaagauucaaaggagaagacgggugcugguauggaauggagauaaggccagucaaggaaaaagaggaaaaucucguuaaaagcaugguaagugcagguuccggugagguugauagcuuuucacuagguuuguuauguauaucaauaaugaucgaagaaguaaugagaucaagauggucuagaaagauguuaaugacagggacacucgcaguauucuuacucuuaauaauggggcaacuaacguggaaugaucuuauuagauuauguaucaugguaggcgccaaugcaucagacaggaugggcaugggcacaacguauuuagcgcuaauggcgacauucaaaauuagaccgauguucgcaguagguuuacuuuuccgucgacuuacaucaagagaaguccuccuucuuacaauagggcuaucgcucguagcaucuguagaauuaccaaacagccuugaagaauuaggagacggguuagcuauggggauaaugauacucaagcuacugacggacuuccaaucacaccaacucugggcaacauugcuuucucucacguucauuaagacaacacucagcuugcaucaugcauggaaaaccauggcuauggucuuaaguauaguaucauuauuuccauugugccuaagcacaacgucacaaaagaccacaugguuaccugugcucuuaggaaguuuaggcuguaaaccacuaacuauguuucuaauaacagaaaacaaaauaugggggagaaagagcuggccauuaaacgaaggaauuauggcaguugguguugucuccauauuacuaagcagcuuauuaaagaacgauguaccuuuagcaggaccauuaauugcggguggaauguuaauagcauguuauguaauuagcgguucuagcgcugaucuuagccuugaaaaagcagcugaaguaucuugggaagaggaagcggagcauucaggagcuucacacaacauacuuguagaaguacaagaugaugguacgaugaaaaucaaagaugaagaaagagacgacacacuaacgauucuccuaaaagcaacauuacuagcggucucgggaguguacccucuuagcaucccagccacauuguuuguaugguauuuuuggcagaagaagaaacaaagaucaggagugcuuugggauacaccgucgccuccagaaguugaacgcgccguuuuagaugauggaaucuacagaauuaugcagcgaggauuauuagguagaagucaaguaggcgucgggguuuuccaggaaaauguauuccacacaauguggcauguaacacgcggagcagugcuuauguaccaaggcaagcggcuugagcccagcugggcauccgucaagaaagacuugaucucguauggaggugguuggcgcuuacaagguucauggaauaccggggaggagguucaaguaauugccguagaaccggguaaaaauccuaaaaacguucaaacugcuccaggcaccuucaaaacucccgaaggugagguuggugcaauagcacucgauuuuaagccagguacaagugggucgccaauaguuaauagagaggguaaaauagugggacucuaugguaauggugugguuacuacaaguggaacauauguaagcgcaaucgcccaaacuaaggcaucccaggaagguccacuacccgaaauagaggacgaaguauuccguaaaaggaaucuaacuauaauggauuuacauccugguucggguaaaacgcgccgcuaccuaccugcuauugucagagaagcgaucaaacggaaacuuagaacacuuauauuagcaccuacaaggguaguugcuagugaaauggccgaagcacuaaaagggaugcccauacguuaucagacuacagcaguaaaaucugaacauacuggaaaagaaauugucgaucuaaugugucacgccacauuuacaaugagacuacugucuccaguccgaguaccuaauuauaauaugaucauaauggacgaagcucauuuuacugauccuucaagcauugcggcaaggggcuacauuuccacacguguuggaaugggagaagcggcagcuauauucaugacagcuacacccccaggaaguguugaggccuuuccccaaaguaaugcaguaauucaagaugaggaacgagauauaccagagaggucauggaacagcgguuacgaauggaucacagauuucccaggaaagacuguuugguucgugccuucgauaaaaagugggaacgauauagccaauugucugcgcaagaauggaaaaagaguaauacaacucucuaggaaaaccuucgauacagaguaucagaaaacuaaaaauaacgacugggauuauguaguuacuacggauauaucugaaaugggagcgaacuuuagagcugaucguguuauugacccccgaagaugccucaaaccaguuauuuugaaagauggaccugaacgaguaauacuggcuggccccaugccagugacggucgccucagccgcgcaaagacggggucguauagggagaaaccauaauaaagaaggagaccaauacauauacaugggucaaccacuaaauaacgaugaagaucacgcucacuggacugaagcaaagaugcuacuugauaauauaaauacaccagaagggaucauaccagcccuuuuugaaccugaaagagaaaagucugcugcaauagauggcgaauaucgucugagaggagaagcgagaaaaaccuucguugaauugaugcgacgaggagaccuaccaguuuggcuuuccuacaaaguagcaagugaagguuuucaauacucggaccggagauggugcuuugauggugaacgcaauaaucaaguacuugaagaaaacauggauguagagaucuggacaaaagagggugaacggaagaaacuucgaccaagaugguuagacgcucguacuuauagcgacccguuggcacuacgggaguuuaaagaauuugccgcaggaagacgauccguaaguggagacuugauacuggaaauagguaaacuuccucaacaucucacucaaagagcgcaaaaugcacuagacaaucucguuauguugcacaacucugagcaagggggacgagcguacagacacgcuauggaagaacucccagauacaaucgagacgcucaugcuacuggcauuaauagcaguuuuaacgggaggcguuacucuauuuuuccucucgggacguggcuugggaaaaacgucgauuggguugcucugcgucauggcuucaucaguccuauuauggauggcuuccguggaaccgcauuggauagcagccucaauuaucuuagaguucuuucuuaugguauugcugauccccgaaccggauaggcaacguacaccacaggauaaccaacuagcuuacguuguaaucgggcuuuuauucaugauucuuaccguagccgcaaaugaaaugggccuacuagaaacaacuaagaaagacuugggaauugggcacguagcuguagaaaaccaucaccaugcaacaaugcuagacguugacuuacauccagcgucugccuggacucuauacgcaguagcaacuaccauuaucacaccgaugaugcgacacacuauagaaaauacgacagcuaauauuagcuuaacugcaauugcgaaucaagccgcaauucugaugggucuugacaaaggcuggccuauuaguaagauggauauuggagugccccuccuagcucuaggaugcuauucccaagugaauccacuaacccuuaccgcagcuguacugauguuaguagcccauuaugcuauaauuggacccggacugcaggcaaaagcaacaagggaggcgcaaaagagaacggcugccgguauuaugaaaaacccuacaguugauggcaucguggcgauagacuuagauccuguuguuuacgacgccaaauuugagaaacaacuagggcaaauuaugcuauuaauccuuuguaccagucaaauacuccuaaugagaacgacuugggccuuaugcgagagcauuaccuuggccacaggcccguuaacuacucuaugggaaggaagcccaggcaaauuuuggaauacaacuauugcaguaaguauggccaauaucuuucgaggaucauaccuugcaggagcugggcuagcuuucucccucaugaaaucccucggagguggucggagaggaaccggagcacagggagagacuuuaggugaaaaauggaaaagacaguuaaaucaauugagcaagucggaguucaauauuuacaaaagguccgguauuauggagguugaucguagugaagcaaaggaagguuuaaaaaggggagaaacgacuagacacgcuguaaguagggggaccgcuaaauuacgcugguucguugaaaggaauuuaguaaagcccgaaggaaaaguaauagaucuuggcuguggaagaggaggauggucuuauuacugugccggauuaaagaaaguaacagaagugaaaggauacacgaaaggagggccgggacaugaagaaccaauaccuauggccaccuauggcuggaacuugguaaaacuucacagcgguaaagauguauucuuuacaccucccgaaaaaugugacacccuccuaugugacauaggugaaaguaguccgaauccaacuauugaagagggacgcacucucagaguguugaaaaugguugagccuuggcuuagaggcaaucaauucuguauaaaaauacuaaauccauauaugccuucuguaguagaaacacuagaacaaaugcaacgaaaacauggugggaugcuaguccgcaacccuuuaucacgaaauaguacacaugagauguauuggguaaguuguggaacagguaauauugucuccgcgguaaacaugaccaguagaaugcuacuaaaccgcuuuacuauggcccauagaaaaccaacuuaugaacgcgacguagaccuaggggccggcacuaggcacgucgcuguagaacccgaaguggcuaauuuagauauuaucggucagcguauagaaaauauaaaacaugaacauaaaaguacguggcauuaugaugaagauaauccuuauaaaacgugggcguaucaugguaguuaugaaguuaagccaucuggaucggcuucuucaaugguuaacgggguagugaagcucuuaacgaaaccaugggacgucauuccuauggucacccaaauugccaugacagauacgacuccguuuggacaacagcggguuuucaaagagaaaguagauacaagaacaccaaaagcaaaacguggcacugcccaaauuauggagguaacagcacggugguuauggggcuuucuaucacguaacaagaaaccaagaaucuguacacgcgaggaguucacaaggaaagugcgauccaaugcggcaauaggugccguauuugucgacgaaaaccaauggaacucggccaaagaagccguggaagaugaacguuuuugggacuuagugcaaaaagaacgagaguuacauaagcaggggaagugugcaaccugcguuuacaauaugaugggaaagagggagaagaaauuaggagaguuuggaaaggcaaaagguucuagagcuauaugguauauguggcuuggugcacgauuccuagaauuugaagcucuuggcuuuaugaaugaggaucauugguuuaguagagaaaauuccuuaucggguguagagggggaaggacugcacaaauugggauacaucuuacgagauauaucaaagauuccagguggcaauauguacgcagaugauacagcugggugggauacgcgaauuacugaagaugacuuacaaaaugaagcaaaaauaacggacauaauggaaccggaacaugcguuauuagcaacaaguaucuucaaacugacauaccaaaacaagguagugaggguucagaggccugcuaagaaugguaccguuauggauguaauaucgcgaagggaucaaagggggucaggccaggugggaacguauggacuuaauacauucaccaacauggaggcacaacugauaaggcaaauggagucagaggguauauuuuugcccucagaguuagaaacacccaacuuggcagaaagaguacucgacuggcucgaaaaauacggaguugaaagauuaaaacguauggcaauuuccggugacgauugcgucgucaaacccauugaugaucgauucgcgacugcacuaacagcacucaacgauaugggaaaaguaagaaaggauauaccacaaugggaaccgucaaaaggauggaaugauuggcaacagguaccguucuguucacaucauuuccaucagcuuauaaugaaagacggcagagaaaucguugucccuuguaggaaccaagacgagcuaguaggcagagcaagggugucucaaggagcaggauggagccugcgcgaaacugcaugccuugguaaaucauaugcccaaauguggcaacuaauguauuuccaccggcgagauuuacgauuagcagcgaacgcuauaugcagcgcgguuccuguugauuggguacccacgaguagaacaacuuggucaauucaugcacaccaccaauggaugacuacugaggauaugcuaaguguauggaaccgaguguggauagaagaaaacccauggauggaagacaaaacucacgugucaagcuggggcgacgugccauauuuagguaaaagagaagaccaguggugcggaagucuaauuggauuaacagcgagggcaacaugggccuccaacauccaaguagcaauaaaucaaguuaggagauuaauaggcaaugagaacuaccuugauuauaugacaaguaugaaaagauuuaaaaacgaaggggaucccgaaggugcacucugguga

SEQ ID NO: 21663 - RNA, 9879 nt, Artificial Sequence
  derived and/or modified CDS sequence (opt6) from DENV-1__GQ199784__SS-prME
ucaguaacaaugcugcuuauguuaaugccgacagcucuagcuuuucacuuaacuacgagagggggugaaccgcacaugaucguaacaaaacaagagagaggcaaaucguuauuauucaaaacguccgcuggaguaaauauguguacauuaauugcuauggaucuuggugaacuaugugaagauacaaugacauauaaauguccccggauaaccgaagcggaaccagaugauguagacuguugguguaaugcaacggauacauggguuacauacggaacaugcagucaaacgggagaacacagacgggauaaacgaucgguagcacuugcaccacauguaggguuaggccuagagaccagaaccgagacuuggaugucgagugaaggugcuuggaaacaaauacaaagaguagaaacuugggcucuaagacacccuggauuuacgguaauugcauuauuccuagcacaugugauagguaccuccauaacucaaaaagguauuaucuuuaucuugcucauguuaguaacaccuucuauggcgaugagaugcguaggaauaggaaguagagauuuuguggaaggcuuaagcggagcaacuuggguugacguugugcuagagcauggauccuguguuaccacgauggcaaaagauaaaccaacucuugauauugaauuauuaaaaacugaaguaacgaacccagcuguauuaaggaaauuauguauugaagcaaagauuucaaacacgacuacggacucucgguguccuacacaaggagaagcuacgcuuauggaagaacaagacgcaaauuuuguuuguagaagaacauuuguggacaggggcuggggaaacggguguggacuauuuggaaaagggucccuuauuacuugugcaaaauuuaaaugugugaccaaguuggaaggaaagauaguacaauaugaaaaucuuaaauacuccguuaucguaacggugcacacuggagaucaacaccaaguuggaaaugaaagcacugagcacggaacuacagcaaccauaacaccgcaggcaccaaccagugaaauucaacuaacugauuauggagcucuaacacuugauuguucuccuagaacuggucuagauuucaacgagaugguauuacuaaccaugaaggaaaagucaugguuaguacacaagcaaugguuucuagaucugccauuaccuuggacauccggggccucuacaucgcaagaaaccuggaaccgacaggauuuauuaguuacuuuuaaaacagcgcaugccaagaaacaagaaguuguagugcuagggucgcaagaaggcgccaugcauacggcuuuaacgggagcaacugagauacaaacuucgggcacaacgacuauauucgcagggcacuuaaaaugcagguugaaaauggauaaauuaacauuaaaagguaugucuuaugugauguguaccggcaguuucaaauuagaaaaggaaguugcugagacacaacacggcacaguauuaguacaaaucaaauacgaagggaccgacgcaccuuguaaaauaccauuuucgacgcaggaugaaaaaggagugacccagaauggaagacuuauaaccgcgaaucccauuguaacugauaaagagaaacccguaaauauagaagcagagccaccauuuggagaaagcuauauaguuauuggugcuggagaaaaggcccuaaaauuaucaugguuuaaaaagggaagcaguauaggaaagauguuugaggcgacagcgcggggugcucguagaauggcuauucuaggggacacugcuugggauuucggaucaaucggagggguguuuacaagcguggggaagcuagugcaucagauauuuggaaccgcuuaugguguauuguuuucaggcgucaguuggacaaugaaaaucggccuugguguuuugcuuacauggcuuggacuuaauucaagaucaaccucucuuucgaugacguguauagcugugggccugguaacccuuuaccucgguguaaugguucaggcugacuccggcugcguaauuaacuggaaaggacgagaguuaaaaugcgguaguggcauauuuguaacgaaugaaguacacaccuggaccgagcaauacaaauuucaagccgauaguccgaaacgauugucugccgccaucggaaaagccugggaggaaggcguuugcgggauuaggucugcgacuagguuagaaaacauaauguggaaacaaauaaguaacgaauugaaucauauucuguuagaaaacgauaugaaguuuacaguugucguaggugacguagucggcauuuuagcccaagggaagaaaaugauuagaccacaacccauggaacacaaauacucauggaaaucguggggaaaggccaaaauuauaggagcagauguacagaacacgacauucauuauagauggcccaaauacuccugaaugucccgacgaucagagagccuggaacauaugggaaguagaagacuauggauucgguauuuucacaacaaacauuuggcugaaacuuagagauagccauacgcaaguaugugaucaucgcuuaaugagcgccgcgauuaaagacucaaaagcgguccaugcagauaugggauauuggauagaaagugagaaaaacgaaacauggaaacuagccagggcuagcuuuaucgaggucaagaccuguaucuggccaaaaagccauacguuauggucuaacggcguacuagaaagcgaaaugauaauuccgaaaauauauggagggccgauaagccaacauaacuaucgccccgguuauuuuacucaaacggcgggacccuggcaucuugguaaauuagaacucgauuuugacuuaugugaagggacaacuguuguaguugacgaacacugcgguaauagagguccaagucuucggacaacuaccguaacgggcaaaauuauacaugaauggugcuguaggucuuguacacuaccaccccuccgguuuaaaggggaagauggcugcugguaugggauggagauacgacccguaaaagaaaaagaggaaaaucuugucaaaucuaugguaagcgcggguuccggggaaguagauucauucagucugggauuguuaugcauaucaauaaugauagaggaaguaaugcgcagcagauggucgaggaaaauguuaaugaccgggacuuuggcgguuuuccuacuacugaucaugggacaauuaacuuggaacgaucuaauaaggcuauguauaaugguaggagcgaaugcaagcgaccgaaugggcauggguaccaccuaucucgcauugauggcuacauucaaaaugagaccuauguuugcagugggauuacuguuucgacgauuaacuucacgagaagugcuguuacuuacaauagggcuuucgcuuguagcauccguagaacugccaaacaguuuggaagaacucggagauggauuagcgaugggcauuaugauuuuaaaauugcuuacagauuuccaaucgcaucaacuuugggcuacacuacuaagccucacauucauuaaaacaacuuugucccuucauuacgcuuggaaaaccauggccauggugcugucaaucguaaguuuguuuccauuauguuuaucaacaaccagccagaaaacaaccuggcuaccuguacuacuagguucucuaggaugcaaaccucuugcaauguuucucauugcggaaaauaaaauauggggucguaaauccuggccuuugaacgaaggaauaauggccguuggaguaguaagcauccuguuaaguaguuuauugaaaaacgauguaccacuagccggaccacuaaucgcaggagguaugcuuauagcguguuacguaauaagcggaaguucagcggaucuauccuuggaaaaggcagcagaaguuuccugggaagaagaagcugaacauaguggagcuagucacaauauauuaguagagguccaggacgauggaacaaugaaaauuaaagacgaggaacgagacgacacucuaacuauccuuuugaaagcuacgcuacuugccguaagcggaguuuauccuuuaaguauuccagcaacccuauuugugugguacuucuggcagaaaaagaaacagcgguccgguguauuaugggacacuccaaguccgccagaaguggaaagagcuguccucgacgacggaauauaccgaaucaugcaacguggauuacuaggacgcagccaaguaggggugggaguguuucaggagaacguguuccacacgauguggcacguaacgcgaggagcuguuuuaauguaccaaggaaaacgguuagaacccaguugggcuagcgucaagaaagauuuaauuucuuacgggggagguuggagguugcaaggcucauggaauacaggagaggaaguacaggugaucgcagucgagccuggcaaaaauccgaagaauguccagacagccccaggaacguuuaagacaccugaaggagagguuggugcuauagcauuagauuuuaaaccaggaacuagcggaucaccgauugugaacagggaaggaaaaauaguaggacuauacgggaaugggguuguaaccacuucaggaacguacgugagcgcaaucgcccaagcaaaggcuucccaggaaggaccacuaccagaaauagaagacgagguauuuagaaagagaaauuuaacaauaauggauuuacauccagguaguggaaaaacccggcgcuaucucccagcgauagugcgugaagcaauaaaaagaaagcucagaacacuuauacuugccccaacgcgaguggucgcuucagagauggcagaggcauugaaaggaaugccaauaagguaucaaacaacugcuguaaagucugaacauacggguaaagagauuguagacuuaaugugccacgcuacauuuacaaugcgauuguugucgccaguacgcgucccaaauuacaacaugaucauuauggaugaggcucauuuuacugacccaaguucgauugccgcucgugguuauauuucuacgcgaguagggaugggagaggcugcggcgauauuuaugacagccaccccaccagggucaguugaggcauuuccucaaaguaacgcaguaauacaagaugaagaaagagacauucccgaaagguccuggaacucaggauaugaauggauuacugauuucccagguaagacaguaugguuuguaccuucuauaaagaguggaaaugauauugcuaauuguuugaggaaaaaugggaaaaggguuauucaacuuucucgaaaaacauuugacacugaauaucaaaagaccaaaaauaaugauugggauuauguuguuacgacugacauaucggaaaugggggcaaauuuuagagcagacagaguaaucgacccacggcguugucuaaaacccgucauccuaaaagauggaccugagagaguuaucuuagccgguccaaugccgguaaccguugcuagugccgcacaaaggaggggccgaauugguagaaaccauaacaaggaaggggaucaauauauauauaugggacaaccucuaaauaaugacgaggaucaugcucacuggacugaagcuaaaauguuauuagauaacaucaauacaccggaaggaauaauucccgcguuauuugaaccugaaagagagaaaagcgcagccauugacggggaauauagauuaagaggcgaagcuagaaaaacuuucguagaauuaaugaggcgcggagaccucccagucugguugaguuacaaaguugcaucagaaggcuuucaauacuccgauaggcguuggugcuuugauggugaaagaaacaaucaaguucuagaagaaaauauggauguagaaauuuggacuaaagagggcgaacguaagaaacuacguccgcgguggcuugacgcgagaaccuacagcgacccacuagcccuucgggaauuuaaagaauuugcugcugguagaagauccguuucaggcgaucuaauuuuagagauaggcaaacucccacagcauuuaacucaaagagcucaaaaugcccucgauaaccucguaaugcuacauaacucugaacaagguggucgcgcauaucggcacgcgauggaggaauuaccggacacaauugaaacauuaaugcuccuagcuuugauagcagugcugacgggaggaguuacacucuucuuuuugagugggagaggacuuggaaaaacgaguauagggcuucuaugcguaauggcuagcaguguacuuuuguggauggcaaguguagagccgcauuggauagccgcaaguauaauuuuagaguucuucuuaaugguucuacuuauuccugaaccggacaggcagaggacaccucaagacaaucagcuagcauacguagucauaggacuuuuauuuaugauuuuaacaguagcugcgaacgaaaugggacucuuggaaacuacaaagaaagauuuggguauaggacaugucgcuguagaaaaucaccaccaugcuacaaugcucgacguagacuuacaucccgcgucagcuuggacacuuuaugcaguugcuacuacaauaauuaccccuaugaugaggcacacaauugaaaauacaacagcaaauauauccuuaacggccauagcgaaucaggcugcaauauugaugggauuggacaaagguuggccaauaucuaaaauggauauugguguacccuuguuagcccuugggugcuauucacaagucaauccgcugacacuuacagcagccgugcuaauguuaguugcucauuaugcaaucauagggccaggacuccaggcaaaagcaacacgugaggcucagaaaagaacugcggcaggcauaaugaaaaauccaacagucgacggcauuguagcaauagaucucgacccagugguauacgaugcuaaauuugaaaaacaauugggucaaauuaugcuuuuaauauuguguacuucucaaauacuacuuaugcgcacaacaugggcgcugugugaaaguauaacucuagccaccggaccuuuaacuacucucugggaaggauccccgggcaaauuuuggaacacaaccaucgcaguauccauggccaauauauucagagggucauacuuagcuggggcuggccuugcguucucauuaaugaaaucgcuugguggaggucgacgagguacaggagcacaaggugaaacauuaggcgaaaaguggaaaagacaauuaaaucaacuaagcaaaagcgaauuuaacauuuauaaacgauccggaauaauggagguugauagauccgaagcuaaagagggucugaaaagaggagagacuacucgacaugcagucucacgcggcacggccaaacuaaggugguuuguugaaagaaaucuaguuaaaccggaaggaaaaguaauugaccugggauguggaagaggcggcuggaguuauuacugugcaggacuaaagaaaguaaccgaaguaaaaggguauaccaaagguggaccaggacacgaagaaccgaucccuauggcaacauacggcuggaaccuagucaaauuacauucugguaaagauguuuucuuuaccccuccagagaaaugcgacacauuacuuugcgauauuggagaaucaagcccuaacccgacaauagaggaagguagaacacuaagaguauuaaaaaugguagaaccauggcuucgcggcaaccaguucugcauaaagauacuaaaccccuauaugcccucgguaguagaaacccuugaacaaaugcagagaaaacacggaggaauguugguacggaauccucuuagccguaauucuacacaugaaauguauuggguaucgugugggacuggaaauauagugucugcuguuaauaugacaucccgcauguuguuaaauagauucacuauggcgcaucguaaaccuacuuaugaacgggauguagaccugggagcagggacacgacaugucgcaguugagccagaaguggcaaaucuagauauuaucggacaacgcauugaaaacauaaaacaugaacacaaaucaacuuggcacuaugacgaagauaauccguauaaaacaugggcuuaucacgggucuuacgaagugaaaccuuccgguagugcgucgagcauggucaacggcgucgugaagcuauuaacuaaaccuugggacgugauaccuaugguaacucaaauagcuaugacugacacuacacccuuugggcaacaaaggguuuucaaggagaaaguagauacgcgaacuccgaaggccaaaagaggaacagcccaaauaauggagguaacagcacgcugguuguggggguuucuuucuaggaauaagaaacccagaauaugcaccagagaagaauuuacacgcaaagucagaaguaaugccgcuauaggugcaguauucgucgaugagaaucaauggaacuccgcuaaagaagcaguggaggacgaaagguuuugggaucuaguacaaaaagaacgagaacuccauaagcaaggaaagugugcgacuugcgucuauaacaugaugggcaagcgagagaagaaacuuggagaauuugguaaagcaaaagguucucgcgcuauaugguauauguggcuaggugcucgguuucucgaguucgaagcacuuggauuuaugaaugaagaccauugguucagucgugagaacucgcuuucaggcguugaaggcgagggucuccacaaauugggguacauauugcgagauauuucaaagaucccagggggaaauauguacgcagaugauacagcaggaugggacacuagaaucacagaggaugauuugcagaaugaagcacguauuacggauauuauggaacccgagcaugccuuacucgccacaaguauauuuaaguuaacuuaucaaaauaaaguuguuaggguucaaagaccugcaaagaaugggacuguaauggauguaauaucgaggcgagaccaaagaggcucuggccaaguagguacuuacggauuaaauacauucacgaacauggaagcccaacucauuaggcaaauggaaucagaaggaauuuuccugccguccgaguuagagacucaaaauuuagcugaacgaguucuagauugguuagagaaauacggcguggaaagauuaaagcggauggcaauaaguggagaugacuguguaguuaagcccauagaugaccgcuuugcgacugcacugaccgcacuuaacgauauggguaaggucaggaaagacauaccccaaugggaacccucgaaaggguggaaugacuggcaacagguucccuuuuguucacaucauuuucaucaacucauaaugaaagauggacgugaaauuguaguaccuugcaggaaccaagacgaauuagugggacgagcuagaguuagucagggagcaggguggaguuuaagagaaacugcuuguuugggaaagaguuacgcgcaaauguggcaauugauguauuuccauagacgagaccuacgauuagcagcaaaugcaauauguucagcaguuccgguugauuggguaccuacaucgcguacgacauggucgauacaugcacaucaucaauggaugacuacugaagacaugcugaguguuuggaauagaguuuggauugaagaaaauccguggauggaagauaaaacacauguaucguccuggggagaugugccguaucuaggaaaacgugaagaucaauggugcggaucacucauaggacugacagcaagagccacaugggcauccaauauacaaguggcgauaaaucaaguucgaaggcuuauugguaaugaaaacuauuuggacuauaugaccucaaugaaacgguuuaaaaacgaaggugaucccgaaggugcguuaugguaa

SEQ ID NO: 21664 - RNA, 9879 nt, Artificial Sequence
  derived and/or modified CDS sequence (opt6) from DENV-1__GQ199785__SS-prME
uccgucacaaugcuauuaaugcuaaugcccaccgcgcuugcauuucauuuaacaacucgagggggugaaccucacaugauaguuucgaaacaagaacgaggaaaauccuuacuguuuaaaaccagugcaggaguaaauaugugcacauugauagcaauggauuugggagaauuaugugaagauaccaugacguacaaaugcccccguauaacugaaguagaaccagaugauguugauugcuggugcaauacaacugauacgugggugacauacgguaccuguagucaaacaggggaacaccgccgagauaaacgaucuguagcacuagcgccacacguuggauuagggcuagaaacgagagcagaaacuuggauguccucagaaggagcauggaaacaaauccaaaaaguagaaacaugggcauugagacauccaggauuuacgguuauagcacuguuccuugcacaugcaauugguaccucgaucacacaaaaagguauaauuuuuaucuuacuuaugcucguuacuccgaguauggcaaugagauguguaggaauugggucuagagacuuuguagagggucuuucaggagcaaccugggucgauguuguccuggaacacgguucuugcguaacaacaauggccaaagacaaaccuacauuggauauugaacuacuaaaaacugaaguaacaaauccagcggucuuacguaaacuuuguauagaagcuaaaauuucgaauacaacaacagauucucgcugcccgacacaaggggaagccacgcugguugaagaacaagacgccaauuuuguauguagacguacauuuguagaucgugguugggggaaugguugcggccuauuugguaaagguagccuuauaacuugugcuaaauucaaaugcguaacaaaauuagaaggcaaaaucguacaguacgaaaaucugaaauauucuguuauuguuacaguacacacaggcgaucagcaucaaguuggaaaugaaucaacugaacacgguacaacagcaacuauuacgccccaagcucccacgagugagauacaauuaacagacuauggcgcauuaacuuuggacuguucaccaagaacuggguuagauuuuaaugaaaugguauuacuaacuaugaaggaaaaaucuugguugguucacaaacaaugguuucucgacuuaccguuaccuuggaccaguggagcgaguacuagccaagaaacuuggaaucgacaggacuuacuuguaacauuuaagacagcacacgccaagaaacaagaggugguuguacuagggucacaagaaggugcgaugcauacagcucuaacgggcgcuacagaaauccaaacaucaggaacaaccacaauuuuugcgggacacuugaaauguagauuaaaaauggauaaauuaacccuaaaaggaaugucguacgucaugugcacagguaguuuuaaguuggaaaaggaagucgccgaaacgcaacaugggaccguauuagugcaaaucaaguacgaaggcacagaugcaccaugcaagauaccauuuaguacacaggacgagaaggggguaacacaaaauggaagacugauaacagcaaacccaauagucacugauaaagaaaaaccugucaauauagaagcugagccgccauuuggcgaaucauauauagugauaggagcuggugaaaaggcacuaaaauuaucgugguucaagaagggaucgucuauuggaaaaauguuugaagccaccgcgcguggagcaaggagaauggcuauucucggagauaccgccugggauuuugguucaauagggggcguuuuuacaucuguaggaaagcuaguacaccaaaucuuuggaacugcauacggaguauuauucaguggagucucauggacgaugaaaauaggaauagguguccuacugacauggcuaggguugaacucacgcucuacuucguugucaaugacuugcauagcaguuggauugguuacucuauaucuggguguuaugguucaagcagacuccggauguguuauaaacuggaagggaagagagcuaaagugcgguucagguaucuuugugaccaaugaaguacacacauggaccgagcaguacaaauuucaagcugacucaccaaagcgccugucagcagcaauaggaaaagcaugggaagaagguguauguggcauucgaagugcaacacgauuagagaauaucauguggagacaaaucucaaacgaacuaaaccauauacucuuagagaacgauaugaaauucacgguagucgugggagacguaguagguauauuggcucaaggaaagaaaaugauaagaccgcaaccaauggaacauaaauauagcuggaaaaguugggggaaggcuaaaaucaucggagcggaugugcaaaauacuaccuucauuaucgacggaccaaacacuccagaauguccagaugaucaaagggcauggaacaucugggaaguugaagacuauggguuugguauauucacuacuaauauauggcugaaacugcgcgauagcuacacacaagugugugaucaccgucuaaugucagccgcaauaaaagauagcaaagcaguacacgcagacaugggauauuggauagagucggaaaagaaugaaaccuggaaauuagcacgagccucauuuaucgaaguaaaaaccugcauauggccaaaaucacacacauuauggucuaaugguguccuugaaagcgaaaugaucauaccgaaaauauaugggggaccgauaucacagcauaacuaucgaccgggauacuucacucaaacagcaggcccauggcauuuaggcaagcuagaauuggauuuugauuugugugaagguacgacaguaguaguagaugagcacuguggcaaucgcggaccaucgcuaagaacaacaacggucacgggcaaaauuauccaugaguggugcugucgaagcuguacucucccaccucugagguucaagggagaagacgguugcugguacgguauggaaauaaggcccguaaaagaaaaagaagaaaauuuggucaagucgauggugucugcaggaaguggugaaguagacucauucucucuaggcuugcuaugcauaaguauaaugaucgaagaagucaugaggucacgguggucuagaaaaaugcuaaugacagguacccuagcaguauucuuuuuguugaucaugggucaacucacauggaaugauuuaauuagaaguuguauaauggucggagccaaugcuuccgacagaauggggauggggacgacuuacuuagcucuaauggcaacguuuaagaugaggccuauguucgcagucggauugcuguuccgccgguuaaccagcagggaaguuuuacuacuaacaauuggauuaucccuuguugcaucuguagagcuacccaauagcuuggaggaacuaggagauggguuagcuaugggcauuaugauacuuaaauuguugacugacuuucaaagcuaucaacuaugggcaacucuucucagcuugacauuuauaaaaacaacguucucacugcacuacgcauggaaaaccauggcaaugguucucucgauuguaagucucuuaccauuaugccuaucuaccaccagccagaaaacaacuuggcuccccgugcuacuaggaaguuuaggaugcaaaccucuuacuauguucuuaauugcggaaaauaaaauuuggggaaggaaaaguuggccccuaaaugaagguauuauggcuguuggaauaguaaguauacuauugucuagucuucugaaaaaugaugugccauuagccgguccauuaaucgcugguggaauguuaauugcaugcuaugucauaagcgguucgucagcagaucuaucauuagaaaaagcagcugaaguaucaugggaagaagaagcagaacauucaggagcaucucauaauauuuuaguagagguacaggaugacgguacgaugaaaauaaaagaugaggaacgcgaugacacccuaacaauucugcucaaagccacauuguuagcuguuuccgguguuuacccguuaaguauaccggccacucuauucguaugguauuuuuggcagaaaaagaaacaaagaucagggguuuugugggauacaccuagcccaccagaaguagaaagagccguacuagaugaugggauuuacagaauaaugcaaagaggacuucuuggucgaucacaagugggagucggaguauuucaagaaaaugucuuccauacuauguggcacguuaccagaggugcaguauuaauguaucagggaaagagauuagagccaagcugggcuucaguaaagaaagaccuuaucucuuacggaggcggauggagguugcaagguaguuggaacacgggagaagagguacaaguaauugcaguagagccaggcaagaauccgaaaaauguucagacagcaccaggaacuuuuaaaaccccggaaggagaaguaggcgcuauugcguuagauuuuaaaccuggcacuucuggcucaccuauaguuaauagggaaggaaaaauagucggauuauaugguaauggugucguaacaaccagcgggaccuacguaucugcaauugcacaggcuaaagcaucucaggaaggaccauugccugaaauagaagaugagguauuuagaaaacgcaauuuaacgauaauggaccuacaccccggaagcggaaaaacuagaagauaucuaccagcuauaguuagggaagcgauaaaacgcaagcuccguacacuaauacuagcgccuaccagagucguugcuagugaaauggccgaagcacucaagggaaugccuauaagguaucaaacaacggcuguuaaaagcgagcauaccggcagggagauaguugacuugaugugccaugcaaccuuuacaaugaggcucuuaucacccguccguguucccaauuacaauaugauaaucauggacgaagcgcauuucacggauccauccucaauagcagcaagagguuauauaaguacacgaguggguaugggagaagcugcagcaauauuuaugacugcaacacccccugguucaguugaagcguucccgcagaguaaugcagucauucaagacgaagaaagggacauacccgaaagaucguggaacucuggcuaugaauggauaacugacuuuccagguaaaaccgugugguuugugccaucuauuaaaucagggaacgauauugcaaacuguuuaagaaagaauggaaaacgaguaauucaacuaucaagaaaaacuuuugauacagaauaccagaaaaccaaaaauaaugauugggauuacguuguaacuaccgauauaucagagaugggagccaacuuuagagcugaccgcguaaucgauccacgacgauguuugaaacccgugauucuaaaagacgguccagaaagaguaauuuuagcaggccccaugccgguaacgguagcgucagcagcacaaaggcgaggcagaauaggccguaaucauaauaaagaaggugaucaauauauuuacaugggccaaccauugaauaaugaugaagaccaugcccauuggacagaggcgaaaauguuauuagacaauaucaauacaccugaagguauaaucccagcauuauucgaacccgagagagaaaaaucagccgccaucgauggagaauauagauuaagaggagaagcgagaaaaacauucguagaacuaaugcgucggggugauuuaccaguauggcugucauauaaaguugcuuccgagggauuccaauauucggauaggagauggugcuucgauggggaaaggaauaaccaaguuuuggaggaaaauauggacguggaaauuuggacgaaagagggcgagagaaagaaacuacggccaagaugguuagaugcaaggacauauucagacccacuagcgcucagagaguuuaaagaauuugcagcagggagaagaagcguuuccggcgaucuuauuuuagagauagguaaacuuccacagcacuuaacgcagagagcccaaaaugcauuagacaaucucguaauguuacacaacagcgaacaagggggccgugcauaucgacacgcuauggaggaacugccugauacaauagaaacacuaaugcuacuggccuugaucgcaguccugacggguggcgugacacuauuuuuccuaucaggcaagggauuaggaaagacaucgauuggccuucugugcgucauggccucuucugcccugcuuuggauggcuuccgucgaaccacacuggauagcagccaguauaauacucgaguucuuuuuaaugguguuguuaauacccgaacccgauagacagagaacuccacaagauaaccaauuagcguacgucgucauuggccuuuuauuuaugauccucaccguagcagcaaaugagaugggguugcuagaaacuaccaagaaagaucuggguauaggacauguggccguggaaaaucaucaucacgcuacaaugcuggauguugaccugcaucccgccucagcuuggacucuauaugcaguagcgacuaccaucauaacuccgaugaugagacacaccauagagaauacaacggcaaacauuagccuuacagcuauugcaaaucaagcggcaaucuuaaugggcuuggacaaagguuggccgauuucaaaaauggacauaggaguuccucuucuugcucugggguguuauucucaaguuaacccuuuaacuuuaacagcggcaguucucaugcugguggcacauuaugcaauuauagggccgggauuacaggcuaaagcgacacgggaagcacagaaaagaacugcugcaggaauuaugaagaacccuacgguagacggcaucguggcaaucgacuuagauccugugguauacgacgcuaaauuugaaaaacaguugggacaaauaaugcucuuaaucuuauguaccucgcaaauccuucucaugagaaccacuugggccuuaugcgaaucuauuacccuagcuacuggacccuuaacaacauuaugggaagguucuccagggaaauucuggaauacuacaauagcgguaagcauggcaaauaucuucagaggauccuaucucgcgggcgcgggcuuagccuuuucacuuaugaaaucacuaggagguggacgacguggaacuggggcucagggagagacacuaggggagaaauggaaacgucaacucaaccaacuuucuaaauccgaguucaauacguacaaaagaucagguauaauggaaguagauaggagugaagcuaaagagggacuuagaagaggcgagacaacaaaacaugccguaucaagggguacagccaaacuuagaugguuuguagaacggaaucugguaaaaccagaagguaagguaauugaccucgguuguggcagaggaggauggaguuauuacugugcagggcuuaagaaaguaacagaagugaagggauacacaaaaggaggacccggucacgaagaacccauucccauggcaacuuauggcuggaaucucgucaaguuacacagugguaaagaugucuucuuuauuccuccagaaaaaugugauacguuacuaugugauauaggagaaucaucuccaaauccuacaauagaggaaggaagaacacucagaguauuaaagauggucgagccuuggcuucguggaaaccaauuuuguauaaagauucugaaucccuauaugccaucaguaguggaaacauuagaacaaaugcaaagaaaacauggcggaauguuaguaaggaauccgcuaucuaggaacaguacacacgaaauguauuggguaagcugcggaacaggaaauauagucagugccgugaacaugacaaguagaauguugcuaaauagauucacaauggcccaccgaaaaccgacuuacgaacgggaugucgaucuuggcgccgggacgcgacauguggccguagaaccugagguagcaaaucuugauaucaucggccaacgcauagaaaacauuaaacaugagcacaaauccacuuggcacuaugacgaagauaauccuuacaaaacuugggccuaucauggaaguuaugaaguuaaaccuagugguagcgcaagcucaaugguaaacgggguaguaaaacuguuaaccaagccgugggacguuaucccuaugguaacgcaaauagccaugacggauacuacaccuuuuggucagcaacggguauuuaaagagaaaguggauacgagaacaccuaaagcuaaacgugggacagcacagauaauggaagugaccgccaaaugguuaugggguuuucuaagccgaaauaagaaacccagaauuugcacucgagaagaguucacgcguaaaguccgaucaaaugcggcaauaggagcuguuuuuguugacgaaaaucaauggaacuccgccaaagaagcaguagaagacgagagauucugggaucugguacaucgugagagggagcuccauaaacaagguaagugugcaaccugcguauauaacaugauggguaagagagaaaagaagcuaggugaauuuggaaaagccaaaggaucaagagcaaucugguacauguggcugggggccagauucuuagaauuugaagcccugggcuuuaugaacgaagaccauugguuuagcagagagaacucguuaaguggcgucgaaggugaggggcuacacaaacuagguuacauacuaagagacaucuccaagauuccgggugguaauauguaugccgaugauacggcgggaugggacacuagaauuaccgaagaugaucuacaaaacgaagccaaaaucaccgauauaaugaaacccgagcacgcacuucuugcaacaaguauuuuuaaguuaacuuaccaaaacaaggucguaaggguacaaagaccggcuagaaaugggacaguuauggacguaauuagcaggagagaccaaagaggaaguggccaaguugguacuuacggacuaaauaccuuuacuaacauggaagcccagcugauacggcaaauggaaucugaaggaauuuuuagucccuccgaauuggagaccccaaaccucgcugagagaguguuagauuggcuagaaaaacaugggguagaaagauugaaacgaauggcaauaucgggugaugauugugucgugaagccaaucgaugaucguuucgcuacugcucuaagcgcucuuaaugauauggguaaaguccgaaaagacaucccacaaugggagcccucaaaaggauggaaugauuggcaacagguuccuuuuugcucacaucacuuccaccaacuaauaaugaaggacggaagagagauugugguacccuguagaaaucaagacgaacugguugguagggcuagagucagccaaggggcuggcuggucuuuacgugagaccgccuguuuggguaagagcuaugcccaaauguggcagcuaauguauuuucauagaagggaucuaagacuagccgcaaacgcaauauguucagccgugccuguugauugggucccaacaagcagaacaacuuggucuauacaugcucaucaccaauggaugacaacagaggauaugcucucuguguggaacagaguuuggaucgaggagaauccuuggauggaagacaaaacacacauaaguagcuggggagacguaccauauuuagguaagagagaagaccaauggugcgguucauugaucgggcuuacagcaagagcaacaugggcuaccaacauacaaguagccauaaaccaaguucgaaggcugauuggaaaugaaaacuauuuagauuacaugacuucuaugaaaagauucaaaaacgaaucagacccagaaggcgcauugugguaa

SEQ ID NO: 21665 - RNA, 9879 nt, Artificial Sequence
  derived and/or modified CDS sequence (opt6) from DENV-1__GQ199786__SS-prME
aguguaacaaugcuguugaugcuaaugcccacggcacuugcuuuucaccugacgacucguggaggugaaccgcauaugaucguaucuaaacaagaacgggggaaaaguuugcuauuuaaaacaucugcuggugugaauaugugcacuuuaaucgcuauggaccuuggagaacuuugugaagauacuaugacauacaaaugcccaagaauuacugaaacugaaccggaugauguugacugcuggugcaaugcaacggacacuuggguaacauauggaacauguagucaaacaggugaacaucggagagacaaaagaucaguggcauuggcaccucaugucggguugggacuugaaacaagaacagaaacauggaugucuagugagggggcuuggaaacaaauccaaaggguagaaacuugggccuuaagacacccaggcuuuacagugauagcccuuuucuuagcucaugcaauaggcacuagcauuacucagaaagguauaaucuuuauccuuuugaugcuaguaacgccguccauggcuaugcggugcguaggaaucggcucucgcgacuucguagaagggcucucaggagccacaugggucgauguuguucuagaacacgguaguugugucacaacgauggcgaaagacaaaccgacccuggauauagagcuguuaaaaacggagguaacuaauccagcgguauuacguaaacuauguauagaagcgaaaauaucaaauaccacaaccgauucaagguguccaacucaaggugaagcaaccuuaguagaggagcaagaugcgaauuuuguuugucgaagaacuuucgucgacagaggauggggcaauggaugcggauuauuugggaaagguagucuaauaaccugugcgaaauuuaaaugcguuacuaaacucgaggguaaaaucguucaauaugaaaaucugaaauauagcguuauugugaccguacauacaggagaccaacaccaggucgggaacgaauccacagaacacggaacaaccgcuacuauaacgccgcaggcgccaacgacugagauccaacuaacggauuacggagcauuaaccuuagauuguagcccacgaacagguuuggauuuuaacgaaaugguuuuacuuacuaugaaagaaaaaucgugguuaguacacaaacaaugguuucuagacuugcccuuaccguggacaucuggagcaucaaccucacaagaaacauggaauagacaagaccuauuaguaacauuuaaaacugcacaugccaagaaacaggaagucguuguacuuggcucacaagaaggugcaaugcacaccgcacugaccggcgcuacugaaauucaaaccucgggaacaacuacuauauuugcaggacaccucaaauguagacuaaaaauggauaaacuaacauuaaaagguaugucuuacguaaugugcacagggagcuuuaaacuggagaaagagguagcugaaacucaacauggaacgguguuaguucaaaucaaauacgagggcacagaugcuccuuguaaaauucccuuuaguacgcaggacgaaaaaggaguaacacaaaauggucgauuaaucacggcaaauccaauuguaacugauaaagagaaaccgguaaauauugaggcugaaccuccauucggagaaucuuauauaguuauuggagcuggggagaaagcguuaaaauuaucuugguucaagaaagggaguucuauaggaaaaauguuugaagccacggcuagaggagcuagaagaauggccauucuuggugacacagcaugggacuuuggaucuauuggaggaguauucacaaguguugggaagcuaguacaucaaaucuucgggacugcauacgguguucuauuuucagguguaagcuggaccaugaaaauaggaauaggaguucuccuuacuuggcuuggguuaaauucgagaucaacaucccuuaguaugacuugcauugcaguaggauuaguuacauuauaucuuggugugauggugcaagcugauucgggauguguaauaaauuggaaagggcgcgaauuaaaaugcggauccgguauauucguaaccaacgaaguccauaccuggacugaacaauauaaauuccaagcagauagccccaaaaggcugagugcagcaauugguaaagcaugggaagaagguguuugcggcauucggucugcuacacgucuagaaaacauuauguggaaacagauauccaaugaacuuaaccacauacucuuagagaaugauaugaaauuuacaguagucgugggagacguugcugguaucuuggcucaagguaagaagaugauaagaccacagccaauggaauauaaauauucauggaaguccuggggaaaagcgaaaauaauaggcgcagauguucaaaacaccacguuuauaauagauggcccaaacacgccugaaugcccagaugaccaacgagcauggaauauuugggaaguugaagauuauggauucgguauauucacuacgaacauauggcugaaauuaagagauagcuauacucaaguuugcgaccaucgguuaauguccgcggccauaaaagacucuaaagcgguacacgcugauauggguuauuggauugaaucggagaaaaacgaaacguggaaguuagcgagggcuagcuuuauagaagugaaaacgugcaucuggccuaaaagucauacacuuuggucuaacggagucuuagaaagugaaaugauuauaccaaaaauauacggugguccaauaucucaacacaacuaucgaccuggcuauuucacacagacagcaggacccuggcauuuagguaaacuugaacuagauuuugaccuaugugaaggaacaacagucgugguagacgagcauugcggaaaccgagguccaagucuaagaaccacaacuguuaccggcaagauaauucaugaauggugcugccgaucguguacguuaccacccuugcguuucagaggagaagacggauguugguauggaauggaaaucaggcccguuaaagaaaaggaagaaaacuuggugaagaguaugguuagcgcaggcaguggagaaguagacagcuuuucauuagggcuacucugcauaucuauuaugaucgaagaaguaaugagaucuagauggagcaggaaaaugcucaugacaggaacuuuagcaguuuucuucuuauuaauuaugggacagcugaccuggaaugaucuaauucgguuauguauaaugguaggggcaaaugccuccgauagaauggguauggguacaacauacuuggcacugauggcaacguucaaaaugcgaccaauguucgccguugggcuacuuuuucguagauuaacaucacgagagguauuguuguuaacgauuggccuaucacuuguagcuuccguugaauugccuaacucacuugaggaguugggcgauggauuagcgauggguauuaugauccugaaacuacuaaccgacuuucaaagucaccaacuaugggcaacucuucucagucucacauuuaucaaaacaacuuuuagcuuacacuacgcguggaaaacaauggcaaugguacuuagcauaguaaguuuauuuccacuuugcuuauccacgaccucgcagaagacuacuuggcuuccgguacuacuaggcucauugggauguaaaccccuuacgauguuucucaucgcagagaauaaaaucuggggaagaagaucuuggccccuuaaugaaggcauaauggcaguaggcauaguauccauucuacuaucgucauuacuaaagaacgaugucccucuagcagguccacucauagccggggguauguuaauagcguguuauguuauaucagggagcucagcggauuuaucauuggagaaggcugcagaagucucaugggaagaagaagcagaacacaguggcgccucccauaauauacucguggaaguucaagaugacggaacaaugaaaaucaaagaugaagaacgcgaugacacuuuaacaauacuauuaaaggcaacccuacucgccguuagcgguguauauccuuuaucuauaccagcgacauuauuuguaugguacuuuuggcaaaagaagaaacaacguucaggcguacugugggauacuccauccccaccugaaguggaacgagccguauuggaugaugggauauauagaauaaugcagcguggccuauuaggaaggucucagguagggguaggaguguuccaagaaaauguuuuucacacuauguggcauguaacgaggggcgcuguucucauguaccaaggcaaacgauuggaacccucaugggcgagugucaagaaagaucugauaaguuauggaggaggauggcguuugcaaggaucguggaacacuggagaggagguccaaguaauagcaguagagccugguaaaaacccuaagaauguacagaccgcaccugguacuuuuaaaaccccagaaggggaaguaggggcuauugcacuagauuuuaagccagguacuuccggaagcccgauaguuaaucgcgaagggaaaauaguaggccuuuauggaaacggggucgugacuaccucaggaacuuauguauccgccaucgcgcaagcgaaagcaucgcaagaggguccgcuuccggaaaucgaagacgagguuuuccgaaagagaaaucuaacuaucauggauuuacauccugguucagguaagacgcggagauauuuaccagcaauaguaagggaggccauaaaaaggaaauuacgaacacuaauauuagcuccuacgcgcguaguagcuuccgagauggccgaagcccucaaaggaaugccuauaagauaucagacaacagcaguaaagagugaacauacaggcaaagaaauuguugaucuaaugugccacgcuacuuucaccaugagacuauugagcccaguucgcgucccuaauuacaacaugauaaucauggacgaagcacacuuuaccgauccgagcucaauagccgcgcgcgguuauaucaguacgcgagucgguaugggagaagcagcggccauauuuaugaccgcuacaccuccugguuccguagaagcauuuccucaaucaaaugcaguaauacaagaugaagagagagacauaccggagcgcucauggaacagugguuacgaauggauaacugacuuuccuggcaagacaguaugguuuguaccaucuauuaaaucaggaaacgacauagcaaauugccuaaggaaaaacggaaaacgugucauucaguuaagccggaaaacauucgauacugaauaucagaaaaccaaaaauaacgauugggauuaugucguaacaacggauauuucugaaaugggggcaaacuuuagggcagauagaguuauagacccacgacggugccuaaaaccagucauucugaaagacggaccagaacgggucauuuuggcaggccccaugccgguuacuguugcgagcgcugcucaaagacgcgggaggauaggcagaaaucauaauaaagagggugaccaauauauauauaugggacaaccauuaaacaacgaugaggaccacgcacauuggacagaagcaaaaauguuacuugauaacaucaacacuccagaagguauaauuccggcauuauuugaaccagaaagggagaaaagugcagcuauagacggagaauacagacucagaggugaagcaagaaagaccuuuguugagcuaaugcggagaggggacuuaccgguuugguuaucguauaagguugcuucggaaggcuuccaauauucagaccggagauggugcuucgacggggaacguaauaaucaagugcuggaagaaaacauggauguggaaauauggaccaaagaaggugagagaaagaaacuuaggccaaggugguuagaugcucgaaccuauagcgacccucuagcacuccgagaguuuaaagaauuugcagccggaaggcgaucgguuaguggcgacuugauacuugaaauaggaaaacugccacaacaccucacacaaagagcucaaaacgccuuagauaaucuaguaauguuacauaacucagaacaggguggcagagccuauaggcaugcaauggaagaacuaccugauacaauagaaacccugaugcuccuggccuuaauugcgguauuaacaggaggagugaucuuauuuuuccuuaguggccguggguuagguaaaacaaguauaggacuucuuuguguuauggccucgagcgugcuauuguggauggcaucaguugaaccucacuggauagcagcaucaauaauucucgaguucuuucuaaugguacuucuaauacccgagccagaucgucaaaggacuccacaagacaaucaguuagcauacgucguuauuggacuccucuucaugauauugacaguugcagcgaaugagaugggucuucuagagacuacgaagaaagaucuaggaauaggccacguugcaguagagaaucaccaccaugcugcuauguuggacguggaccuucacccagcuucagcauggacuuuauaugcugucgccacgaccauaauaacaccgaugaugagacauacaauagaaaauacaacugccaacauaucacugacagcuaucgccaaccaagcagcaauacucaugggucuagauaaaggguggccaauaagcaaaauggacauuggcguaccucugcucgccuugggaugcuacagucaagugaacccccuuacauuaacagcagcaguucuaauguugguagcgcacuacgcgauuauagguccuggauuacaggcgaaggcgacucgugaagcacagaaacggacugcagccggaauaaugaaaaaucccacagucgauggaaucguggccaucgacuuagacccugugguauacgacgcgaaauuugaaaaacaauugggacaaauaaugcuacuuauuuuauguacgucacaaauucugcugaugagaaccaccugggcacuaugugagucaauuacacuugccacaggcccuuugacgacauugugggaagggucuccggggaaauuuuggaacacaaccauagccguaucuauggcgaauauauuucgaggaagcuacuuagccggugcaggacuagccuucagcuuaaugaagaguuuggguggaggucgucgcgguacaggggcccagggugaaaccuuaggggaaaaauggaaacgucaacuaaaccaguuaagcaaaucagaguucaacacauauaagagauccggaauaauggaaguagauagaucugaggcaaaagagggucucaagagaggggaaacuacuaaacaugccguuaguagggguacagcaaaacuuagaugguuugucgaacggaacuuagugaaaccagaaggaaaggucauagaucuaggaugcggaagaggaggcuggagcuauuauugcgcuggccuaaagaaagugacugagguuaaaggauauacaaaaggagguccaggccacgaggaaccuaucccaauggcuacuuauggauggaaccucgucaaauuacacuccggcaaagacguauucuucauuccaccugaaaaaugugacacgcuguuaugcgauauaggugaaagcucaccuaauccaaccauugaagaagggcguacauugagaguccuuaaaaugguugaaccguggcuaagaggcaaccaauucugcauaaaaauccuuaauccuuacaugccuaguguaguagagacccucgagcaaaugcagaggaaacauggaggaauguuaguucguaacccccuuucucgaaauucuacucacgagauguauuggguuagcuguggcacaggaaauauagucagcgcugucaauaugacaucgcgaauguugcuaaaucgauuuaccauggcgcauagaaaaccaacauaugagcgagacguagaucuaggagcggggacaagacauguagcaguugaaccagaaguagcuaacuuagauauaauaggucaaagaauagaaaacaucaaacaugagcacaaaucgacguggcacuacgaugaagacaacccuuacaaaaccugggccuaucacggaucuuacgagguaaaacccucaggaucagcuagcucaaugguuaacggaguggugaaguuguuaacaaaaccaugggauguaauaccgaugguaacccaaauagcuaugaccgacacuacaccuuucgggcaacaaaggguguuuaaagagaaaguggauacgaggacuccuaaagccaaacgggguaccgcccaaauuauggagguaacugcgaagugguuauggggcuuuuuaaguaggaacaagaaaccgagaauuuguacccgcgaagaguucaccaggaaaguaagaucuaaugccgcaauuggcgcgguauucguagacgagaaucaauggaacagcgcuaaggaagcaguugaagaugaaagauuuugggaucuaguccaucgugagcgagaacuccauaaacaagggaaaugugcuacaugcguuuacaauaugaugggcaaacgagagaagaaauuaggcgaguuuggcaaagcaaaagguaguagggccauaugguacaugugguuaggagcaagauuucuagaguucgaagcccuagguuuuaugaaugaggaucauugguuuaguagagaaaauucguuauccgguguagaaggagaaggguuacauaaacuugguuauauccucagggacauaaguaaaaucccuggaggaaauauguaugccgaugauacagccgggugggauaccagaauuaccgaagaugaccuucagaacgaggcuaggauuacugauauuauggaaccggagcacgcauuauuagcacgaucaauauuuaaacugaccuaccagaauaaaguaguucgcguacaaagaccagcuaaaaauggaacaguaauggauguaauaagcagaagagaucaacgcggaucagggcagguuggcacauauggauugaauacauuuacaaacauggaagcacaauuaaucagacaaauggaaucggaaggcauauuuucucccagcgaguuggaaacucccaaucuagccgagcguguguuagacugguuagaaaaauauggaguagaacgacuaaaacgcauggccauaucuggugaugacuguguuguaaagccgaucgacgauagguucgcgaccgcuuuaaccgcucuaaaugauaugggaaaaguacgcaaggauauaccgcaaugggaaccuucgaaaggcuggaacgacuggcaacagguuccauuuugcagucaucauuuucaccaauuaaucaugaaagacggcagagagauagugguaccgugucgaaaccaagacgaguuaguaggaagggcaagaguaucucagggcgcgggcuggucguuaagagaaaccgcaugccucggaaaaaguuacgcccaaauguggcaacuaauguauuuccacaggagagaucuuagacucgcagcgaaugcaaucuguucagcuguaccagucgacuggaucccaacaucacguacuacauggagcauucacgcucaucaucaauggaugacuacugaagauaugcucagcgucuggaacagggucuggauagaagaaaauccauggauggaagauaaaacccacauuucaagcuggggugauguacccuauuuagggaaaagagaagaucaauggugcggaucuuuaauuggccugaccgcgcgugcaacuugggcuacaaauauacaaguagcgauuaaccaaguacgcagauuaauagggaaugaaaauuaucuagacuauaugacgucuaugaagcgauucaaaaaugaaucagauccagaaggagcucuuugguaa

SEQ ID NO: 21666 - RNA, 9879 nt, Artificial Sequence
  derived and/or modified CDS sequence (opt6) from DENV-1__GQ199787__SS-prME
ucuguaacaauguuauuaauguuaguaccgacugcauuagcuuuccauuuaacaacacgaggaggggaaccucauaugauuguaacuaaacaagaaagagguaaaaguuuauuauuuaaaacaagugccgguguaaauauguguacacugauugcaauggaccuaggagaacucugugaagacacuaugaccuauaaaugcccacgcauaacugaagcugaaccagaugacgucgauugcugguguaaugcgacugauacuugggugacauacggcaccuguagccaaacaggagagcaucggcgagauaaacguagcguagcacuagcaccccauguaggauugggacuagaaacgaggacugagacauggaugucuuccgagggugcauggaaacaaauacaacggguagaaacuugggcucucaggcauccuggauucacaguuauugcauuauuucuggcucaugcaauugggacuagcauuacccaaaaaggcauuauuuuuauauugcucaugcuaguaacgccaagcauggcaaugagauguguagguauagguucgcgggacuucguagaggggcuuucuggggcaacuuggguggacguagucuuggagcauggcagcuguguaacuaccauggcaaaagacaaaccuacccuagacauagagcuacucaaaacagaaguaacuaaucccgcuguucuccgaaaacuaugcauagaagcuaaaauaucaaacacuacuacugauucuagaugucccacacaaggagaggcgacacucauggaggaacaagacgcaaauuuugugugccggcguacauuugucgauagaggauggggaaauggauguggauuauucggaaaaggcagucuaauaacuugcgcaaaauuuaaaugcguaacaaaacucgaaggaaaaauuguacaauaugaaaacuuaaaauacaguguaauuguaaccgugcauacuggugaccaacaccaaguuggaaacgaaucgacggaacauggaaccacugcuacaaucacgccucaagcccccaccuccgaaauucaauuaacggauuauggugcgcuaacguuagacugcaguccgcgcacggguuuggauuucaaugaaaugguccuucuuacuaugaaagaaaaaucaugguugguucauaaacaaugguucuuggauuugccuuuaccauggacaagcggggccucgaccucgcaagaaacauggaacaggcaagaucuuuuaguaacguuuaaaacagcgcaugcuaagaaacaggaaguaguaguacuaggaucacaggaaggagcuaugcauacagcacugaccggagcaacagagauccaaacaagugguacuacgacaauauuugccgggcaucucaaaugcagauuaaaaauggacaaacuuacuuuaaaaggaaugucauacguuauguguacaggaucauucaaacuagaaaaagaaguagcugaaacucaacaugguacagugcugguacagauuaaauacgaaggaacggaugcuccauguaaaaucccuuuuagcacgcaagaugaaaaggguguaauucagaaugggagauuaauaacagcaaaucccaucguuacagauaaagagaaaccagugaauauugaagcagagcccccauuuggagaguccuacauuguaauuggaguuggugagaaggcccuuaagcugucaugguuuaagaaaggaaguaguauaggaaaaauguucgaagcaacugcuaggggcgccagacgcauggcaauucugggugauacugcaugggauuucggaaguauugguggaguauucaccucggucggaaaguuagugcaccagauuuuugguacggcguaugguguauuauuuucuggaguaagcuggacuaugaaaauuggcauagguguauugcuuacauggcuagggcugaauagucgaucaacaagucucaguaugacuuguauagcaguaggauugguaaccuuauaccuaggagucaugguacaagcggacucaggcugcguaaucaacuggaaaggaagggaauuaaaauguggaucuggaaucuucguaacaaaugaaguacacacguggacugaacaguacaaauuucaagcugauucaccgaaaagacuaucggcggcuauagguaaggcaugggaagaaggagucuguggaauuaggucggcaacccguuuagaaaacauaauguggaaacaaauaucaaaugagcuaaaccauauccugcuagaaaacgacaugaaauuuacuguagugguuggggacguggucggaauauuagcucaaggaaagaaaaugaucagaccccaaccaauggagcauaaauauuccuggaagucgugggggaaagcuaaaauaauaggugcggauguacaaaauacaacguucauaauugauggaccaaacacuccagaguguccggaugaucaaagagcuuggaacauuugggaagucgaagauuacggauucggaauauucacuaccaauauauggcuuaaacugcgggauagcuauacucaagcaugcgaccaccgccuaaugucugcagccauaaaagacagcaaagcgguacacgcagauaugggauauuggauagagucugagaaaaaugaaacguggaaacucgcaagagcuagcuucauagaggugaagacauguauuuggccaaaaucgcacacucuuuggagcaaugguguacucgagagcgagaugguaauaccaaaaaucuacgggggaccaauaagucaacauaauuauaggccuggauauuuuacacaaaccgcaggacccuggcaccuaggcaaacuugagcucgacuuugacuuaugugaaggaacaacaguggucguugaugagcacuguggaaaccgaggaccaucucuuaggacaacuaccguaacuggaaaaauuauacacgaauggugcugccgaaguuguacgcuuccuccguuaagauuuaaaggagaagacggcugcugguacggaauggagauucgacccguaaaagaaaaagaggaaaaccuugucaaaagcauggucuccgcugguucaggagaaguugauuccuuuaguuuaggauuauuauguaucucaaucaugaucgaggagguuaugcgauccagguggucucguaaaaugcuaaugacaggcaccuuagcagucuucuuguuauuaauaaugggccaacuuaccuggaaugaucuaauaaggcuuugcauuauggucggagcaaacgcaucugauaggaugggaauggggacgacguacuuagcauugauggcaacuuucaaaaugcgccccauguuugccguaggcuuauuauuuagacgccuaacgucacgugaaguacugcugcugaccauaggucuaucauuaguggcauccguagaacugccaaacucccuagaagaacuaggagauggacuugcaaugggcauaaugaucuugaaauuguuaacggacuuucaaucacaucaauugugggccacacuacuuagucugacuuuuaucaaaaccacuuugucgcuacacuacgcguggaaaacaauggcgaugguuuuaucaauaguaaguuuauuuccauugugucuaucgacgaccucucagaaaacaacauggcuaccaguacucuuaggcagcuuggguuguaaacccuuaacgauguuucugauagcagagaauaaaauuugggguagaaaaagcuggccccuaaacgaagguaucauggccguaggaguaguaucgauccuauuaucaucauuacucaaaaaugauguuccgcuagcaggaccauugaucgcaggcgguaugcuaauagcauguuaugucauauccggaucgagugccgaucuuaguuuagaaaaagcugcagaaguaucuugggaggaagaagccgagcauaguggcgcuagucauaauaucuuaguugaagugcaagacgauggcacaaugaagauaaaagaugaagaaagagacgauacuuugacaauuuuacuuaaagcaacacuucuagccgugaguggaguuuacccuuuaagcaucccagcaacuuuauuucuuugguauuucuggcagaagaagaaacaaagaagugguguacuuugggauacuccaucgccacccgagguagaaagagcgguacuugacgauggcauauaccgaauaaugcaaagaggucucuuagguaggagucaaguagguguagguguauuccaagaaaauguuuuccacacgauguggcacguaaccagaggggccguacucauguaucaagguaaaaggcuagagccgucuugggcgucggucaagaaagacuuaaucucuuaugggggugguuggaggcuucaaggaagcuggaacacuggcgaggaaguacaggucaucgcaguagaaccggguaaaaauccuaaaaauguacaaacagcacccggaacuuucaaaacucccgaaggcgaagucggagcaauagcuuuggauuuuaagccuggaacaagcgggucuccuauugucaauagagaaggcaagaucguaggucuuuacggcaacggaguuguuacaaccuccgggacuuacguaagugcgauagcccaagcaaaagcaucucaagaagguccgcuaccagaaauugaagaugagguauuucggaaaagaaaucuaacaauaauggacuugcacccgggauccgguaaaacacgaagauaucuaccggcaauuguacgagaggccauuaagcguaagcuacguacucuuauacuggccccuacccguguggucgcaucggagauggcggaggcccuaaaaggaaugccgauuagguaccaaacaacagccgucaagucagagcacacgggaaaggaaauaguggaccuuaugugucaugcuacauuuacuaugcgccuacuaucaccuguacguguucccaauuauaauaugaucauaauggaugaggcccacuuuaccgaccccucuucaauagcagccagagguuacaucucaaccagagucggcaugggagaggcagccgcuauauuuaugacggcuacgcccccgggaucgguagaagcauucccccagucaaacgccguuauucaagacgaagaacgggacauuccggaaagaucuuggaauagcgguuaugaauggauaacugauuuccccggaaagacgguuugguuugugccuagcauaaaauccgggaacgauauugcaaauugccuuaggaaaaaugguaaaagagucauacagcugucuagaaaaaccuucgauacugaauaucagaaaacuaagaauaacgacugggacuacguugucaccaccgauauauccgaaaugggggccaauuuucgggccgaucguguuauagacccacgcagaugccuaaaaccaguaauucuuaaagauggaccggaaagaguuauauuagcugggcccaugcccguaaccgucgcuagcgcggcccaacgucggggcagaauaggacgcaaucauaauaaagaaggcgaucaguacaucuauaugggacagccccuuaacaaugaugaagaucaugcacacuggaccgaagcaaaaaugcuauuagacaauauuaauacgccagaaggaaucauaccugcauuguucgagcccgaacgagaaaagucagccgcaauugauggagaauaccgucuuagaggagaagcucguaaaacauuugucgaguuaaugagacgaggugauuuaccaguguggcuaucuuauaaggucgcaucugagggauuccaauauucugaccgcagaugguguuuugauggggaaagaaauaaucaaguuuuagaagagaacauggacguagaaaucuggaccaaagaaggggaaagaaagaaacuaagaccaagaugguuagacgcaagaacuuacagcgacccacuagcuuuacgugaauuuaaagaauuugcugcaggacguagaaguguaucuggagaucuuauauuagaaauaggaaaauugccacaacaccucacacaaagggcacagaaugcauuagacaacuuaguaauguuacauaacuccgaacaaggcggcagagcguauagacaugcuauggaagaauuacccgauaccauagaaacgcuaauguuacuagcauugauugcaguacuuacagguggaguaacacuauuuuucuuaaguggaagagguuuaggaaaaacuagcauaggacuauugugugucauggcaaguagcguacuguuauggauggcuucaguagaaccucauuggaucgcagcgagcauaauacuugaguucuuuuuaaugguacuucuaauuccagaaccagaccgccagcguaccccacaggacaaucagcucgccuaugugguaauagguuugcuuuuuaugauuuugacuguugcggcuaaugaaaugggcuugcuugaaacaacaaagaaagaucuagggauuggccauguugcugucgaaaaucaucaccaugcuacuauguuggauguggaccugcauccugcguccgccuggacuuuauaugccguugcuacuacaauaaucacucccaugaugagacauaccauugaaaauacuacagcgaauauaucauuaacggcgauagccaaucaggcagccauauuaaugggccuagauaaaggauggccuaucucgaagauggauaucggcgugccucuacucgcacuugggugcuauagccaaguaaauccguuaacucucacagccgcugugcuaauguugguugcucacuaugccaucaucggacccggauuacaggcaaaagccacgagggaagcucagaaacgcacugccgccgguauuaugaaaaaucccacuguagacgguaucguugcuauugauuuagauccuguaguauacgacgcaaaauucgaaaaacaacuuggccaaauaauguugcugauacuauguacgucacagauccuauuaaugcgaacgaccugggccuuaugugaaaguauaacacuugccacagggccuuuaacaacacucugggaaggaucaccugguaaauucuggaacaccacgauugcggugaguauggccaacauauuccgaggcucauaccuagcuggagcaggucuagcuuucucuuuaaugaaaucgcuugguggagggagaagaggaacuggugcacaaggcgaaacccugggggaaaaguggaaaagacaguuaaaccaauuauccaaaucggaguucaacauauacaaacguuccgggauuauggaagucgacagaagcgaagcaaaggaagguuugaaaagaggagagaccacaagacacgcuguaucaaggggaacagccaaacuaagaugguuugucgagcgaaaccuagucaaaccugaagguaaaguaauagaucuuggauguggcaggggaggauggucauacuacugcgcaggacuaaagaaaguuaccgaaguuaaaggauauacgaaagggggaccaggacaugaagaacccauaccaauggcgacuuauggcuggaacuuaguuaaacuacauucagguaaagauguauucuucacgccaccagaaaagugugauacgcuauugugugacauaggagaaucuucgcccaauccuaccauagaagaaggaagaacgcuucggguauugaaaaugguagaaccauggcuacgagggaaucaauuuuguauuaagauucugaauccuuacaugccauccguuguugaaacucuggaacaaaugcaacgaaagcacggaggcaugcuaguaaggaacccacuaucgagaaauaguacacacgagauguauuggguuagcuguggaacgggaaauaucguuucagcagucaacaugacuucucgcaugcuacuaaacagauucacaauggcgcauagaaaaccgacguaugagagagauguagaucuaggugccggcaccagacacguagcaguagaaccggagguggcaaauuuagacaucauugggcaaagaauugaaaacauaaaacaugaacacaagagcaccuggcauuacgaugaagauaacccuuauaaaacaugggcguaucacggaaguuaugaaguaaagccuuccggaagugcuucauccaugguaaauggcgucguuaaacuuuugaccaaaccgugggaugucauccccaugguuacacaaauugccaugacagacacaacacccuuuggacaacagagggucuuuaaggagaaggucgacacucgaacaccuaaagcuaaaagagguacggcacaaauaauggaaguaacagcuagauggcuauggggauucuuaucgcguaauaagaaaccuaggauuuguacccgagaagaguuuacucguaaaguuagaucaaacgccgcaauaggagcaguauucguagaugaaaaucaguggaacucagcaaaagaggcuguugaggaugagcgguuuugggauuuaguccaaaaagaaagagaauuacacaagcaaggaaaaugugcgacguguguauauaacaugaugggaaaacgugagaagaaauuaggagaguucggaaaggcuaaagguagccgggccauaugguacauguggcugggcgcuagauuccucgaguucgaagccuuaggcuuuaugaaugaagaucacugguuuucaagagaaaauagcuuaagcgggguugaaggagaaggccuacacaaacuaggauauauauuacgcgacauaucaaaaaucccggguggaaacauguacgccgaugauacagccgggugggacaccagaauaacagaagacgaucuacaaaacgaagcuaaaauuacagauauuauggaaccggaacaugcauuacuagccacgucaaucuucaaacuaacuuaccaaaauaaagucguaaggguucaaagaccagccaaaaauggaacgguaauggacguaauaucacgaagagaccagagaggaucaggccaaguaggaacguauggauuaaacacauuuacaaacauggaagcgcaacugaucaggcaaauggaaucggaagggauuuuucuuccaucugaacucgaaacaccgaaucucgcagaacgaguucuagauuggcuugaaaagcauggaguugagagauugaagcgaauggccauaagcggcgaugauuguguagucaaaccuauugaugauagguucgcgacugcauuaacggcucuaaaugauaugggaaaaguaagaaaagauauaccucaaugggagcccucgaaagguuggaaugauuggcaacagguacccuucuguagucaccacuuucaucaacuaauaaugaaagauggaagagagauuguaguucccuguagaaacgaagaugaguugguuggccgagcaagggucagccaaggagcagguuggagccuucgagaaacggcaugccugggaaaaucguaugcgcagauguggcaguugauguauuuucauagacgagacuugagauuagcagcaaacgccauuuguucagccguaccgguagacuggguacccacaucucgaacaacuugguccauacaugcacaucaucaauggaugaccacagaggacauguugucuguuuggaauagaguguggauagaggaaaauccuuggauggaagacaagacucacguaagcaguuggggugauguuccuuaucucggaaaacgagaggaucaaugguguggaagccuaauuggucuuacggcacgcgccacuugggccagcaacauccagguagcuauaaaucaggucagaagauuaauagggaacgaaaauuaucuugauuauaugacaaguaugaaaagauuuaaaaacgaaggagauccagaaggcgcccugugguag

SEQ ID NO: 21667 - RNA, 9879 nt, Artificial Sequence
  derived and/or modified CDS sequence (opt6) from DENV-1__GQ199788__SS-prME
ucaguaacuaugcuacucaugcuaaugccuaccgcauuagccuuccacuuaaccacacgaggcggcgaaccgcauaugauuguaucaaaacaggaacgagggaaaagucuauuauuuaaaacgagcgcgggcguuaacaugugcacacuaauagcgauggacuugggagaauuuugcgaagauacaaugacauauaaaugcccacggauaaccgaagcagaaccggacgauguugauuguugguguaaugcaacugacacuugggugacauauggcacaugcucccaaacaggugaacaucgcagggauaaacgaucuguagcacuugcgccgcacguuggccucgggcuagaaacgcgaacagaaaccuggaugagcucagaaggugccuggaaacaaauacagagaguugaaacuugggcuuuaagacacccuggauucacggucauagcguuguuccuugcacacgcaauaggaacaaguauaacacaaaaaggcauuauauuuauacuacuaaugcuagucacuccaaguauggccaugagguguguuggaauagguagccgagauuucgucgagggauuaucaggagcgacauggguugacguuguauuagaacauggcuccugcgucacaaccauggccaaagacaaaccaacauuagauauugagcuacucaaaacagaagucacuaaucccgcaguacuuagaaaacuuuguauugaggcaaaaauuuccaauacuacaaccgauucgagaugcccaacucaaggagaagcaacucuaguugaagaacaagaugcuaacuucgucuguagacguacuuucguagaucgugguuggggcaaugguugcggacuauucgguaaagggucucuuauaacaugcgcaaaauuuaaauguguaacgaaacucgagggaaaaacagugcaguacgagaacuuaaaauauagcguuaucgugacuguacauacuggcgaccagcaucaggucggaaaugaaucaaccgaacacgguaccacugcuacaaucacgccgcaagcacccuccacagaaauacaauuaacggauuacggagcucuaacccuagacuguaguccacgaacuggcuuggacuuuaaugaaauggucuuacuaaccaugaaagagaaaagcugguuaguccacaaacaaugguuccuagauuuaccauugccguggaccucaggagcuagcaccucgcaggaaaccuggaauagaaaagaucuacucgugaccuuuaaaacugcgcacgcuaagaaacaggaagucguuguauuaggaagccaggaaggagcgaugcauacggccuuaacaggugcuaccgaaauacaaacaaguggcacuacuacuauuuuugccggacaucuaaaaugcagacuuaaaauggacaaguugacauuaaaaggaauguccuauguaaugugcacaggcucuuuuaaauuagaaaaagaaguagcugaaacgcaacacggcacaguuuuagugcagauaaaauacgaaggaacagaugcuccaugcaaaauuccauuuucuacacaggacgaaaaaggaguaacacaaaauggaagacuuaucacggcgaauccaauaguaacagacaaagaaaaaccugugaauauugaagcggaaccaccauuuggagaaucuuauauagucauaggcgcuggugaaaaagcauuaaaauuaucuugguucaagaaaggaucaucaauuggcaaaauguucgaagcuacggcacguggagcacggagaauggcuauauugggggacacugcaugggacuuuggguccaucggaggaguauucacaagcgucggaaaauuagugcaccagaucuucggaacagcauacggaguacuauucuccggggugaguuggacaaugaaaauagguaucggaguacuuuugacauggcucggucuuaauucgagaucaacguccuuaucuaugacauguauagccguaggacuugucacacuauaucuuggugucaugguacaagcggacagcggguguguaaucaacuggaaaggaagggaauuaaaauguggaagugguaucuucgugacaaacgaggugcacacguggacagaacaauauaaguuucaagcugauagucccaaacgauuaagugcugcaauaggaaaggccugggaagaagggguauguggcauacgaagugcgacuagacuagaaaauauuauguggaaacaaauuucaaaugaauuaaaucauaucuugcuugaaaacgacaugaaguucaccguaguaguuggugacguggcgggaaucuuagcucaaggaaagaaaaugauacgaccccaacccauggaguauaaauacaguuggaaaagcuggggaaaggcaaaaaucauuggugcugauguucaaaauacaaccuucauaaucgauggcccaaauacuccagaauguccagacgaccagagagccuggaauauuugggaaguagaagacuauggauuuggcauuuucacaacaaauauauggcuaaaacucagagauaguuauacgcaagugugcgaucaucggcuaaugucugcggcuauaaaagacucuaaagcaguucaugccgauaugggcuacuggauugaaucggagaaaaaugaaaccuggaaauuagcaagggcaucauuuauagaaguaaaaacaugcaucuggccaaagucacacacauuauggucgaacggaguacuggaaucagaaaugaucaucccuaagauauauggugguccgauuucgcaacauaauuacaggcccggauacuuuacucaaacagcaggaccguggcacuuagguaaguuagaacuagauuucgaucucugcgaaggaacuacaguugucguugaugagcauugcgguaauagggguccuucccuccgcacaacaacuguuacgggaaaaauaauucacgaguggugcuguagauccugcacauugcccccauuacguuuuaaaggagaagaugguuguugguauggaauggagauacgcccgguuaaggagaaagaagaaaauuuaguaaaaucaaugguaucggcuggcaguggugaaguugauuccuucucauugggguuacucugcauaucaauaaugauagaggaaguaaugaggucgagguggaguagaaaaauguuaaugacagggacauuagccguauucuuucuucuaaucaugggccaguugacuuggaacgaccuaauaaggcucugcauaaugguaggcgcgaacgcauccgaccguaugggcaugggaacaaccuaucuagcuuuaauggcuacuuucaagaugagaccaauguucgcuguaggauuacuauuuagacgacuaacaucgagagaaguacuauuauugacaauaggacucagucuaguugcaagcguagaacuaccgaacucacuagaagaacugggagauggauuggcgauggggauaaugaucuugaaauuacugacugauuuucagucucaucaauugugggcaacuuuacuuaguuuaacuuucauaaagacuacauuuagucuccauuaugccuggaaaacuauggcuaugguucuaucuauaguuagcuuauuuccguuaugcuuaucuacuaccucacagaaaacuacuugguuaccaguacuucuaggaucauuaggaugcaaaccguugacaauguuccuaauagcagaaaacaagauaugggguaggaaaucuuggccacuaaaugaaggaauaauggcuguuggaauaguaucuauacuccuaucgucacuauuaaagaacgacgugccccuagcggggccacuuauugcaggagguaugcuuaucgcaugcuauguuauuucaggaaguucggcagauuuaagucuggagaaagcagcugaaguaucuugggaagaagaggcugaacacagcggugcuucucacaauauuuuaguagaggugcaagaugacgguacgaugaaaauaaaagaugaagaacgagacgauacccucacgauucugcuaaaagcuacguuacucgccguaaguggagucuauccacuaaguauuccugcaacauuauuuguaugguacuuuuggcaaaagaagaaacaaagaagugguguauuaugggauacuccuaguccuccggaaguagaacgagcaguucucgacgauggaaucuauaggaucaugcaacggggucuguuaggcaggucucaagugggugugggaguguuccaggaaaauguuuuucauacgauguggcacgucacaaggggagccguacuaauguaucaggguaaaagacuugagccaucgugggcgucaguuaagaaagaccucauuaguuauggaggcggauggagacuccaaggaagcuggaauacuggugaggaagugcaaguuauagccguagaaccagggaaaaaucccaaaaauguacagaccgcuccuggcacauuuaaaaccucugagggagaaguaggugcaauagcgcuugacuucaagccaggaacaaguggaaguccuauuguaaauagagagggcaaaauugucgguuuguauggaaacgguguggucacaacguccggaacuuauguaucugcgauugcacaagcaaaagcaucgcaagaggguccuuuaccagaaaucgaagacgaaguuuuucguaagagaaaucuaacaauuauggaccuucacccaggaucagggaagacucgacguuacuugccagcuauugugcgcgaagcaaucaaacguaaacuucguacccuaauucuagcgcccacucguguaguggcgucagaaauggcggaggcuuuaaaggguaugccuauaagguaucaaacuacugccgugaaaucagaacauacgggaaaggaaauuguagacuuaaugugucaugcgacauucacuaugcgauuacuaagcccaguuagaguaccaaacuauaauaugaucauaauggacgaagcacacuucaccgauccuaguucaauagccgcaagagguuauauaucuacaaggguagggaugggggaagcagccgccauuuuuaugacugcaacgccgccgggcagcgucgaggcuuuuccacagucaaaugcugucauucaagacgaagagagggauauaccggaacgaucuuggaacucaggcuacgaauggauuacagacuuuccuggaaagaccguuugguuuguuccuucuaucaagucaggcaaugauauugccaauugccucaggaagaauggcaaaagagucauucaacuuaguagaaagacauuugauaccgaauaucagaaaacaaagaauaacgauugggauuacgugguaacaacugauauuucagaaaugggagcaaauuuccgugcggaucgugucauagacccuagacgguguuuaaaaccagugauacuaaaggacggaccggagaggguuaucuuggcaggaccaaugccagucacagucgcuuccgcagcucagagacgagggagaaucgggaggaaccacaauaaagaaggggaucaauacauauacaugggacagccauuaaauaacgacgaggaucacgcacauuggacugaagcuaaaauguugcuugauaauauuaauacgccagaaggcauaauacccgcauuauuugagcccgagcgagagaagucugcggcaauugauggagaguacagauuaagaggcgaagcaaggaagacuuuuguggagcuaaugcguagaggagaccugccaguuugguuaaguuacaaaguugcuucagagggauuucaauauucagauaggcgaugguguuuugauggagaaaggaauaaucagguacuagaagaaaauauggacguagagaucuggacaaaggagggagaacgaaagaaauuacguccacgaugguuagaugcucgcacauacagcgacccuuuagcacuucgagaauuuaaagaguucgcugcgggucgucggaguguaucgggggaucuaauuuuggaaauaggaaaauugccgcagcauuuaacccaaagagcacaaaaugcucuugauaacuuaguaaugcuacauaacuccgaacaaggcggccgagcauaucgacaugcaauggaggaguuaccagacaccauagaaacauuaauguuauuggcucuuauagcaguacuaacgggaggagucacauuauuuuuccuaucuggccgaggacuugguaaaaccagcauaggauuacucugugucauggcuucaagcguacuccuauggauggccagcguggaaccucauuggauagccgcuucaaucauucuagaguucuuucuuaugguuuuauugauaccagaaccagauagacaacggacuccacaagauaaccagcuugcauauguaguaaucggucuucucuuuaugauacuaacgguggcugcgaacgagaugggacugcuugaaacaacgaagaaagaucuagguaucggacauguagccguugagaaucaucaccaugcagcaauguuagacguugacuuacacccagcaucagcguggacauuauaugcaguagcaacuacaaucauuacacccaugaugagacauacuauugaaaacacaacagccaauaucucccucacggcaauagcaaaccaagcagcaauacuuaugggucuugauaaaggguggccgauaucaaaaauggauaucgggguaccacuguuggcacuagguugcuauagccagguuaauccacugacauuaacagcagccguccugauguuagucgcgcacuacgcaauaauagguccgggcuuacaagcaaaagcuacuagagaagcucagaaacguacugcggcaggcauuaugaagaacccuacaguugacggaauuguagcuauugauuuggacccuguaguuuaugaugccaaauucgaaaaacaacugggacagauaauguuauuaauucuauguacuagccagauacuccuaaugcggacgacgugggcuuuaugcgaauccauaacucucgcgacuggcccgcuuacaacguuaugggaagguagcccagggaaauucuggaauaccacgauagcaguauccauggcaaacauuuuucgugguagcuacuuggcuggugcuggauuggcuuuuucguuaaugaagucacuagggggaggcagacgugguacgggagcacaaggugaaacauuaggagaaaaguggaaaaggcaacucaaucaacucucaaaaucagaauuuaauacguacaaaagaagcggaauuauggagguagauaggagugaagccaaggaaggccucaaacggggugagaccacgaaacacgcugugaguagaggcacugcaaaguugcggugguuuguugaaagaaauuuggucaagccugagggaaaaguuaucgauuuaggguguggaagggguggaugguccuauuauugugcagguuugaagaaagugaccgaaguuaaaggauacaccaaaggcggcccuggucacgaagaaccuauacccauggccacuuacgguuggaaucuagugaaauuacauucaggcaaagauguguuuuucauacccccugaaaaaugugacacucuucuaugugacauuggggaaucgaguccaaauccaacaauagaagaaggcagaacucuacguguucucaagaugguagaaccuugguuacgaggcaaucaauuuuguauaaaaauucuuaauccuuauaugccaucagucguggaaacacuugagcagaugcagcgaaaacacggcgggauguugguacgcaauccacuaucuagaaauagcacccaugagauguacuggguaucaugugggaccggaaacauugucucagcagucaauaugaccucucguaugcuucuaaacagauuuacuauggcacaucgcaaacccacguaugaacgagauguagaccuuggggcuggcacacggcauguagccguagagcccgaagucgcuaaccucgauaucaucggccaacgaaucgaaaacauaaaacaugaacacaaaucaacauggcauuacgacgaggauaacccuuauaaaacgugggccuaucaugguagcuacgaaguaaaaccaucggguucggcaucaagcauggugaacggugucguaaaacuacuaacgaagccgugggauguaauaccgaugguaacgcaaauugcaaugacagauacaacaccguuuggucaacaaagaguguucaaagagaaaguugauacuagaacuccaaaggcuaaacguggcaccgcccaaauaauggaggugacagccaaaugguuguggggauuucuaagcaggaauaagaaaccuaggauaugcacaagagaagaguucacucgcaaaguacgcagcaacgcagcaauaggugcuguauucguagaugagaaucaguggaacucagcaaaagaggcgguugaggacgaaagauucugggacuuaguacauagagagagggaauuacacaaacaagguaagugcgcuacuugcguauacaauaugaugggaaagagagagaagaaauuaggggaguucgggaaggcaaaagguucccgggcuauaugguacauguggcuuggugcuagauuucuugaguucgaggcucuaggauuuaugaaugaggaccauugguucucaagggaaaauagucugaguggaguagagggcgagggacuucauaaacuagguuauauuuuacgugacauaagcaaaaucccaggggguaacauguaugcagacgacacugccggcugggacacccgaauaacugaggaugaccuacaaaacgaagcuaaaauuacagacaucauggaaccggaacacgcacuccuggcuaaaucaaucuucaaauuaacuuaccaaaacaaagucguacgaguucagaggccagcuaagaacgguaccguaauggauguaauaucgagaagagaucaaagaggguccggucaaguaggaacauacggucugaacacauuuacgaauauggaagcccaauuaauucggcaaauggaaagcgaagguauuuucucaccuucugaacuagagaccccaaaucuagcacggaggguuuuagacuggcucgaaaagcacggaguagaaagacucaaacgaauggccaucucaggagacgauugcgucguaaagccgauagaugauagauuugcuacggcauuaaccgcacugaaugacaugggaaaaguaagaaaagacauaccucaaugggagccuaguaaaggguggaaugauuggcaacaaguucccuuuuguagccaccauuuucaucaacucauuaugaaagacgggcgugaaauuguugucccaugucgaaaucaggaugagcuaguggggagagcgagagugucucaaggagcggguuggagcuugagagaaacagcuugccuugguaaaagcuacgcacagauguggcaacuuauguacuuccaucggcgagaccugagauuagcagcuaacgcaauuuguucugccguacccguagacuggguacccacaagucgaacaacuuggucaauacaugcacaccaucaguggaugacuacagaagauaugcuuucgguauggaauagaguuuggauugaagagaauccauggauggaagauaagacgcauauaagcaguuggggagauguaccauaccuuggaaagcgagaagaucagugguguggaucauuaaucggacuuacagcgagagcaacgugggcuacgaacauacaaguugcgauaaaucagguucguagacuuauuggaaaugagaacuauuuggauuauaugacaucaaugaaaagauucaagaaugaauccgaccccgaaggcgcuuugugguaa

SEQ ID NO: 21668 - RNA, 9879 nt, Artificial Sequence
  derived and/or modified CDS sequence (opt6) from DENV-1__GQ199789__SS-prME
ucuguaacuaugcuucugaugcuuaugcccacugcguuagcguuucauuuaacuacuagaggcggggaaccucacaugaucguuucuaaacaagaaagagggaaaucacuucuauuuaaaacaagugcaggggugaacauguguacuuuaaucgcaauggaucuaggggaauuuugugaagauacuaugacuuauaaauguccaaggauaacugaagcagaaccugacgauguugauuguuggugcaacgcaacagauaccuggguuacauauggaacuuguucgcaaaccggugaacacaggagagacaaacgaucuguugcguuggcuccccauguaggauuagguuuagaaacaagaacagaaacauggaugaguagugagggugcguggaaacaaauucaaaagguggaaacaugggcacuuagacacccgggauuuacuguaauagcccuguuuuuggcucaugcuaucggcacgucuauaacccaaaaaggaauaauuuucauuuuauugauguuaguaacaccgaguauggcaaugagaugcgucggaauagguagucgugacuucguggaaggacuuucaggagcgacauggguagauguuguauuagaacauggauccugcguuaccaccauggccaaagauaaacccacauuggacauugaguuacuaaaaacagaaguaaccaauccagccguuuugagaaagcuaugcauugaagccaaaaucaguaacacaacuacagauagucggugcccgacucaaggagaggcuacuuuaguagaggaacaagacgcuaauuucguuugcagacguaccuucguagaucgugggugggguaauggaugugguuuguuuggaaaaggauccuuaaucacgugugcaaaauuuaaaugugucacuaaacuagagggcaaaacaguacaacacgaaaaucuaaaauacucaguuauaguuaccgugcacaccggcgaccaacaucaagucggaaacgagucaacggagcacggcacaacagcuacaauaacaccucaagcaccaucaacagagauacagcuaacggacuacggcgcacuuacucucgauugcucacccagaacuggcuuagauuuuaacgaaaugguauugcuuaccaugaaagagaaaaguuggcugguacacaagcaaugguuucuagauuuaccuuugccuuggacuucuggcgcaucaacuagccaagaaacguggaauagaaaagaccuuuuaguaacauuuaaaacugcacaugcaaagaagcaggaaguaguugugcuaggaucacaagagggugcgaugcacaccgcacuaacaggagcgacagaaauacaaaccaguggcacuacaacaauauuugcuggacauuugaaaugucgacugaaaauggacaaauugacauuaaaaggcaccucauacgugauguguacugggagcuuuaaacuggaaaaagaagucgcugagacacaacauggaacuguucucgugcagauaaaauacgaaggaaccgaugcgccguguaagauacccuucucaacucaggacgagaaagggguaacgcaaaacggaaggcugaucacugcuaauccuauugucacagauaaagagaaacccgugaacauugaagcggaaccaccauucggcgaaucguauauugucauaggagcaggggaaaaagcucuaaagcugaguugguucaagaaaggaucuagcauuggaaaaauguucgaggcaaccgcaagaggagcgagacgaauggcaauauugggugacacagcaugggacuucggcucaauaggcggcguguucacgagcguaggaaagcuggugcaucaaaucuuuggaacggcauacggaguuuuguuuagcggaguuucauggacaaugaagauugguauuggaguguuacuaaccugguuaggucuaaauucgaggaguaccagccuuagcaugaccuguauugcaguagggcuaguaacacuauaucuagguguuaugguucaagcagauagcgggugcguaaucaauuggaaagguagagaacuaaagugcggaaguggaauauucguuacuaaugaaguucauacuuggacagaacaauauaaauuucaagcugacucaccaaagagauuaucagccgccaucgggaaagccugggaagaaggcguaugcggaauacgaucugcuacucgcuuagaaaauauaauguggaaacaaauaaguaaugaacuaaaccauauccugcuugaaaacgacaugaaauuuacaguagucguuggugauguugcagguauacuagcacagggcaagaaaaugaucagaccgcaaccuauggaauauaaauacucuuggaagaguuggggaaaagcaaaaauaauaggagcagacgugcagaacacaacauucauaauagauggaccgaauacuccugaaugcccggacgaucaaagagccuggaauauuugggagguggaagacuauggguuugguauauucacuacaaacaucuggcuaaagcugagagacucauauacucaagucugugaucacagacucaugucugcagcuauuaaagauagcaaggccguccaugcugacaugggcuauuggauagaauccgagaaaaaugaaaccuggaaacuggcuagagcuucauuuauugaagugaagacuugcauuuggccgaaaagccauaccuuauggucaaacgggguauuagaaucugagaugauaauucccaaaauuuacggugggcccacaagucagcacaacuauaggccagguuacuucacccaaacagcuggaccauggcaccugggaaaguuagaguuagacuucgaucuaugugaaggcacaacaguagucguugacgaacacugugggaaccgagggccuucauuaagaacgacaacuguaacugguaaaaucauucaugaaugguguugucguucauguacacuuccacccuuaagauucaaaggagaagauggcuguugguauggcauggaaauaaggccuguaaaagaaaaagaggagaaucuuguaaaaagcaugguauccgcagguucuggagaaguugauaguuucagucuugguuuguugugcauaucgauaaugaucgaagaaguuaugcgaucuagaugguccaggaaaauguuaaugaccggaacccuagcaguauucuuucugcuuauaaugggacaacuaaccuggaacgauuuaauuagauuaugcauuaugguaggagcaaaugccuccgauagaaugggaaugggaacuacuuaucuugcgcuuauggcuacauuuaagaugcgaccaauguuugcaguugguuuacuauuucgcagauuaacaagucgagaaguucuauugcuaacgauaggacugucucuuguagcguccgucgaacuaccaaacucguuagaagaguuaggggauggauuggcaaugggaauaaugauacucaaguuauuaacagauuuucaaucucaucagcugugggcaacgcuauuaaguuugacauucauuaagacuacuuuuagucuucauuaugcauggaaaaccauggcaaugguacuaucaaucgugagcuuguuucccuugugcuugucaacgacuagccagaaaacuacuugguuacccguauuacuugguucucuaggcugcaagccgcucacuauguuucuaauagccgaaaauaaaauauggggcagaaaaucguggccuuugaaugaaggcauuauggccgugggaauaguauccauucuauuauccucauugcucaaaaaugacguaccccuagcggguccauuaaucgcuggggguaugcuaauagccugcuacguaaucagcgguucaucagcagauuuaucacuggaaaaagcagcagaaguuagcugggaagaagaagccgagcauucgggagccagccacaauauucucgucgaaguucaagaugauggaacaaugaagauuaaagacgaggaacgagaugacaccuugacuauuuuacuuaaagcaacacuccuugcugucucuggagucuacccacuaucaauuccugcaacucuauucgucugguauuucuggcaaaagaaaaagcaacgguccgguguccucugggacacaccaucucccccagaaguugaacgugccguauuggaugaugguauuuauagaauaaugcaaagggguuuacucggaaggucccaaguaggagucggugucuuccaggagaauguauuucauacaauguggcacguaaccaggggagccguauuaauguaucaggggaagagacuggaaccuucaugggcaucuguaaagaaagacuuaauuucauauggaggcggauggagacugcaaggcagcuggaauacgggggaggaaguucaaguaaucgcaguagaaccaggaaagaaccccaaaaauguacagacugcgccagggacauucaaaaccagugagggagaaguuggcgccauugcuuuagauuuuaaaccaggcacaaguggaucgcccauagucaaucgagaagggaaaaucguugggcuauacgguaauggaguugucacaacaaguggcaccuauguaucagcaaucgcacaggcaaaagcaucgcaggaaggaccacucccagaaauugaagaugaaguuuuuagaaaaagaaaucugacaauuauggacuuacauccaggaucaggaaagacuagaagguauuugccugcaauaguaagggaggcaauaaaaaggaaacugagaaccuugauacuagcccccacaagagucguggcgucagaaauggccgaagcauuaaaagggaugccaauaagauaccaaacuacagcagugaagggcgaacauacgggaaaggagaucguggauuuaaugugucaugcuaccuuuacuaugcgucuauuaucuccuguacgcguaccaaauuauaauaugauaauuauggaugaagcccacuuuaccgauccuucaaguauagcggcacgaggauauauaaguacacggguuggaaugggagaggcggcugcuauauucaugaccgcuacaccuccaggaucaguugaagcauuuccacaaaguaaugcaguuauccaagacgaagaaagagauauaccugaaagaucguggaacucaggauaugaauggauaacagacuuuccaggaaaaacggugugguucguaccaagcauuaaaaguggaaaugauauugcaaauugucuuaggaaaaauggaaagagaguuauacaacucucgcguaaaacauuugacacugaguaccagaaaacuaaaaacaaugacugggauuacguuguuacuacagauauaagugaaaugggagccaauuuuagggccgauagaguuauagauccuagacgauguuuaaaaccaguaauauuaaaagacggaccugaacgagucaucuuagcgggacccaugccuguuacgguagcaucagccgcgcaaagacguggcaggauuggccgaaaucauaauaaagagggggaucaauacaucuauaugggucaacccuugaacaaugaugaagaucaugcccauuggacggaggcaaaaauguuacuugauaauauuaacaccccugaagggauaauccccgccuuauucgaaccagagagggaaaaaucagcugcaauagacggcgaauacagauugagaggagaagcuagaaaaaccuuuguggaguuaaugagacgaggggaucugccaguauggcuuuccuacaaaguagccucggaaggauuucaauauagugaucgcagaugguguuucgauggagagcguaauaaucaaguacuugaagagaauauggacgucgaaauauggacaaaagagggggaacggaagaaacugcgaccacgcugguuggaugcuagaaccuacucugacccacuggcguuacgagaguuuaaagaauuugccgcuggacgacgaaguguuaguggugacuuaaucuuagaaauagguaaguugccucaacauuugacucaaagggcacagaaugcccuagauaaucucgugauguuacauaacuccgaacaaggagggagagccuaucgucaugcgauggaagaacugccagauacaauagaaacucuuaugcugcuagcuuugaucgcuguuuuaacaggaggcgugacacuauucuuuuuaagcggucgggguuuaggaaaaaccucuauaggacuauuaugcgucauggccucgagcgcucucuuauggauggcuucuguagagccacauuggauagccgcgucuaucauacucgaguucuuuuugaugguucuuuuaauccccgaaccggacaggcaaagaacaccacaagauaaccaauuagccuauguagucauuggucuacuauuuaugauacuuacgguagcugcuaacgaaaugggauuacuagaaaccaccaaaaaggauuuaggaaucgggcauguagcgguugaaaaccaccaucaugcggcuauguuagauguagaucuacacccggcuuccgcauggacgcuguaugcgguagccacgacuauaauuacuccgaugaugagacauacaauagaaaauacuacggcaaauauaagccuaacugcuaucgcuaaucaggcugcgaucuugaugggauuagauaagggauggccuauuaguaagauggacauaggaguuccacuacuggcauuggggugcuauucacaagucaacccucuaacccuaacugcugcgguauugauguuaguagcccacuacgcaauuauuggaccgggccuacaggcaaaagcuaccagagaagcucagaaaaggacagcggcuggaauuaugaagaauccaacuguagaugggauaguagccauagaccuagacccaguagucuacgaugcaaaauucgaaaaacaauuggggcagaucauguuguuaguuuugugcacgucacaaauccuuuugaugaggacgacaugggcgcuuugugaaucaauaacauuagcuacagggccacuaacaacacuuugggaaggaagcccuggaaaauucuggaauacaacgauagcugugagcauggccaacauuuuccggggaaguuaucuagccggugcagguuuagcauucucuuuaaugaaaucgcuuggagguggucggagagggaccggugcacaaggcgagacguuaggugaaaaauggaaacggcaauugaaucaauuaucaaagagcgaauuuaauacauauaaaagauccggaaucauggaaguagaccgaucagaggcaaaagaaggguuaaaacguggugaaacaacuaagcaugccguaucacgagguacagcuaagcucagaugguuuguagaaagaaacuuagugaaaccagaggguaaaguuauugauuuaggauguggcaggggagguugguccuacuauugugcugggcuuaagaaagucacagaaguaaaaggguauacuaaaggagggcccggacacgaagaaccaaucccgauggcaacguacggauggaauuuaguuaaacugcauucaggcaaggauguauuuuucauaccucccgaaaaaugugacacauuauuaugcgacauaggcgagaguucaccuaauccaaccaucgaagagggacgaacccuaagaguuuuaaagaugguggaaccauggcuccgcggaaaucaguucugcauaaaaauuuuaaauccuuacaugccuucagucguggaaacccuagaacaaaugcagagaaagcauggugguauguuaguuagaaacccacuuucuagaaauagcacgcaugaaauguacuggguuuccuguggcacagguaauauagugucagccgucaacaugacaucaagaaugcuauuaaacagauuuacaauggcucaucguaaacccacuuacgaacgagauguugacuuaggagcugguacacgacaugucgcaguugagcccgaagucgccaacuuggauauuauaggacaacguauugaaaacauuaaacaugaacauaaaucuaccuggcauuaugacgaggauaauccuuauaaaaccugggcuuaucacgguaguuacgaaguuaagcccucugguagugcaucaucaauggugaauggagugguaaaauuacugaccaaaccuugggacguuauaccuauggucacccaaauagcaaugacagacacuacgccuuuuggucaacaaaggguguuuaaagaaaagguagacacuagaacaccuaaagcgaaacguggcacugcccagauaauggagguuacagcgaaauggcuauggggguuucuuaguagaaacaagaaaccccgaauuugcacacgggaagaauuuacaagaaaaguaaggucuaaugcagcuauuggagcaguguuuguagaugagaaccaguggaauagcgcuaaagaggcuguagaagaugagagguuuugggauuuaguucacagagaaagagaguugcauaaacaagggaaaugcgccacaugcguuuauaacaugaugggcaaaagagagaagaaauuaggcgaauuugguaaagccaaagguucucgcgcaauaugguacauguggcuaggugcacgcuuucuagaauuugaagcucugggauuuaugaaugaagaucacugguuuucacgagagaauaguuuaagugguguugagggagaaggacuacacaaacuagguuacauauuacgcgauauuucgaaaauacccggagguaauauguacgccgaugacacagcaggcugggacacaaggaucacugaagaugaucuacaaaacgaggcaaaaauaacagauauaauggagccagagcaugcacuacuggcaaagucaauauucaaacuuacguaccaaaauaaagucguucgagugcagagacccgccaaaaaugguaccgucauggacguaauuucacgccgugaucaacgaggaucaggacaagucggaacauauggauuaaauacauuuacaaauauagaagcacaacuaauaagacaaauggaaagugaggaaauuuucaguccgagugaacuggagacaccaaaucuagcagguaggguucuggauugguuggagaaacaugguguggagaggcuaaaaaggauggcuauaucuggagaugauugcguagucaaaccaauagaugauagauuugccaccgcacuaacggcacugaaugacaugggaaagguaaggaaagauauaccgcagugggaacccucuaaagguuggaaugauuggcaacagguuccguuuuguucacaccacuuccaucaguuaauaaugaaagaugggagagagauaguagucccaugucgaaaucaagaugagcuaguugguagagcaagagugagucaaggagcaggcuggucacuuagagaaacggcauguuuaggaaaaagcuacgcgcaaauguggcaguuaauguauuuucacaggagagaucuucgacucgcagcaaacgcaauuugcuccgcaguaccuguagauuggguuccgacaaguagaacuacuuggaguauucaugcgcaucaucaauggaugacgaccgaagauaugcuuucaguauggaacaggguuuggauugaggagaauccauggauggaagacaagacgcauauuucaagcuggggcgacguuccguaccucgguaaacgugaggaccaaugguguggaucuuugauaggacuuacagcacgagcgacgugggcaacaaauauccaaguugcgauaaaucaagugagacgauuaauugguaaugagaacuauuuagauuauaugaccaguaugaaacgguucaaaaaugaaucagaucccgagggagcuuuaugguag

SEQ ID NO: 21669 - RNA, 9879 nt, Artificial Sequence
  derived and/or modified CDS sequence (opt6) from DENV-1__GQ199790__SS-prME
ucuguaacaauguuauuaauguuaaugccaacggcuuuagcuuuccacuuaacgacgcggggaggagaaccucauaugauaguaacgaaacaagaaagggguaagucauuauuauuuaaaacuucugcuggagugaauauguguacucuuaucgcuauggaucuaggagaacucugugaggauacgaugacauacaaguguccgagaaucacggaggcagaaccugacgacguagacuguuggugcaaugcaacugauacauggguaacauaugguaccugcucacaaacuggagaacaucgacgugauaaaagaucuguagcauuggcgccccacgucggacuaggucuggagacaagaaccgagacauggaugaguagcgaaggugccuggaaacaaauucagaggguagaaacuugggccuuacggcauccuggauuuacugucauagcguuauucuuggcacacguaauugggacuagcauaacacaaaaaggaauaauauuuauucugcucauguugguuacaccuaguauggcaaugcgaugugugggaauuggauccagggauuuuguugagggacucagcggagcuacauggguugauguaguuuuggaacacgggucuuguguaaccacaauggccaaagacaagccuacacuggacauugaguuacucaaaacagagguaacaaaucccgcuguccuacgaaaacuuuguauagaagccaagauuaguaauacaacuacagauucacgcugcccgacccagggggaagcuacauuaauggaagaacaagaugcuaauuuuguuuguaggcgaacauucguggaucgcggaugggguaacggauguggacuauuuggcaagggaaguuuaauaacgugcgccaaauuuaaauguguaacuaaacuggaggguaaaaucguucaauacgaaaacuugaaauacaguguaauaguaaccguucacaccggggaccaacaccaaguagguaaugagucuacagaacaugguacaacggcuacaauuacaccgcaggcuccgacuuccgaaauacaauuaacagacuauggagcacucacuuuagauuguagcccaaggacaggucuagauuuuaaugaaauggugcucuugaccaugaaagagaaaagcuggcuaguucacaaacagugguucuuagauuuaccuuugccauggacguccggcgccucaacuucucaagaaacuuggaacagacaagauuuacucguaaccuucaaaacggcucaugcgaaaaagcaagaaguagugguucuagguucacaagaaggugcaaugcauacggcucuuaccggagcaaccgagauacaaacaucugggacuacuacaauauucgcaggacaccugaaaugucgcuugaagauggauaaguugacguuaaaagggaugagcuacgucaugugcacagguucuuucaaacuagaaaaagaaguagccgaaacacagcacggcaccguauuaguacaaauaaaauaugaagguacagacgcgccauguaaaauaccauucuccacgcaagacgaaaaagguguaacucaaaacgguagauugauaacugcuaacccaauuguuacugacaaagaaaaacccgucaacauagaggcggaacccccguuuggugaaaguuacaucguaauaggagcaggagaaaaagcacuaaaacuaagcugguucaagaaggguaguaguaucggaaaaauguucgaagcaacggcaagaggagcacgaaggauggcaauacucggagauacagcaugggauuucggaucuaucggggguguguucacaaguguaggcaaguugguucaccaaauuuuuggaacugcguauggaguuuuguucucugggguaucauggacuaugaaaauaggaauuggaguucuccuaaccugguuaggacuuaauaguaggagcacgucacucuccaugacauguauugcagucggauugguaacauuauaucucggggugaugguccaagcagauucaggaugcguaauuaauuggaaaggaagagaacuuaagugcggaagcggaauauucgucacuaacgagguacauaccuggaccgaacaauauaaauuccaggcagacucaccgaaacgauuaucugcggcaauaggaaaggcaugggaagagggcgucugcgggauucgcucggcgacucgucucgagaacauaauguggaaacaaaucucaaacgaauuaaaccauauucugcuagaaaaugauaugaaguuuacuguuguaguaggagauguuguagggauacuagcgcagggcaagaaaaugauaagaccacaaccaauggaacacaaauauucuuggaaaucaugggguaaagcaaaaauaauaggagcagaugugcaaaauacaacauucauuauugaugggccuaacacaccugagugcccagaugaucaaagagcuuggaauauaugggagguagaagauuacgguuuuggaauauuuacaacuaacauuuggcuaaaacugagggacucccacacgcaaguuugcgaccauaggcuaaugagcgccgcgaucaaagacagcaaagccguccacgcagacaugggauacuggauugaaucggagaaaaaugaaacguggaaacuagcaagggcgagcuuuauagaagugaagacaugcauauggccuaaaagucacacacuuuggagcaacgguguccuugaguccgagaugaucauaccgaaaauauacggggguccaaucucucaacacaauuaucguccuggauauuuuacacaaacagcaggcccauggcaccuagguaagcucgaacucgacuucgaccugugugaggguaccacuguuguggucgaugaacauugcggaaauagaggaccuaguuuaagaacuacaacgguaacagggaagauaauucacgaauggugcuguagaaguugcaccuuaccacccuuacgguuuaaaggagaagacggaugcugguaugguauggaaauuagacccguuaaggagaaggaagaaaauuuaguuaaaagcauggucagcgcaggaaguggggaaguagacucauuuucgcuagguuuacucugcauaucaauaaugauagaagaagugaugaggucacgguggucaaggaaaauguuaaugacuggaacauuggccguguuuuuauuacuuauuaugggacaguuaacuuggaaugacuugaucagauugugcauaaugguaggcgcgaaugcaucagaucguaugggcauggggacgaccuauuuggcccuaauggccacuuuuaaaaugagaccaauguucgcgguaggccuauuauuucggcgauuaaccucaagagaaguguuguuauugacaauaggcuuaaguuuagucgcguccguugaauugccaaauaguuuggaggaguuaggcgaugggcuagcaauggguauaaugauuuuaaaguugcuuacugauuuucagucgcaucaacugugggcaacgcuacuuaguuuaacguucauaaaaaccacacugucccuacacuacgccuggaaaacgauggcgaugguauugaguauagucucccuguuuccauugugccuuagcacaacaucgcagaaaacuaccuggcuacccguacuacugggaagccuaggcuguaaaccccucgcaauguucuugauagccgaaaauaaaauuuggggccgaaaaucuuggccuuugaaugaaggcauuauggcgguuggcgucgucuccauauuacucagcucgcugcuuaaaaaugacgucccucuagcgggcccacucauagccggagguaugcuaauugcuuguuauguaauuagcgguucgagugcagaccucucucucgaaaaagccgcagaaguaagcugggaggaagaggcggagcacucuggugcgucacacaacauccuuguggaaguccaagacgacggaaccaugaaaauaaaagaugaagaacgggacgacacuuuaacuauucuucuaaaagcuacauuauuagcuguaucaggaguauaucccuuauccauuccagccacauuguucguaugguauuuuuggcaaaagaagaaacaaagaucuggaguccuuugggacacaccguccccuccugaaguagaacgagcuguucuagaugacggaauuuaucgaauuaugcaacggggacuacucggucgaucucaaguagguguaggugucuuccaagaaaacguguuucacacuauguggcaugugacuaggggagcagucuuaauguaucaaggaaaacgucucgagccuagcugggccuccgucaagaaagacuuaauaaguuacgguggaggauggagacuacaagguagcuggaauaccggagaagaaguucaagucaucgcaguagagccaggcaaaaaucccaaaaauguacaaacggcgccugguacguucaaaacgccagaaggcgaaguaggcgcaaucgcccuagacuuuaaaccagggacaagugguagucccaucgugaauagagaagguaaaaucgucgguuuguacggaaaugggguugugacaacguccggcacuuacgucuccgcaauugcucaagcaaaagcaucacaagaaggcccacuaccagaaauugaagacgaaguauucagaaaaagaaacuugacuauaauggauuugcacccggggucuggaaaaacaaggagguauuugccagcaauaguaagggaagcuauuaaacgaaaauuaagaaccuuaauccucgcaccaacucguguggucgcaucugagauggcagaagcucuaaaaggaaugccaaucagguaccaaacaacagcagucaaaucagaacauacuggaaaagaaauaguagauuugaugugucaugcaacauuuacgaugagacuucuaagcccaguaagaguaccaaauuacaacaugauuauaauggaugaggcacacuucacugaucccuccaguaucgcggcuagaggauacauuucuacgcgaguugguaugggugaggcggcagcaauauuuaugacggccacgccgccaggaagcguagaagccuucccacagaguaaugcuguuauacaagacgaggaacgggauauaccagaaagaucauggaacucaggcuaugaauggauaacggacuuuccaggaaaaacgguaugguucguaccaaguauuaaaucuggaaacgauauagcaaauugcuugaggaaaaacggaaagcgcgucauacaacucucaagaaagacauuugacaccgaguaucagaagaccaaaaacaaugacugggacuacguaguaacaacagacauaucggaaaugggggcaaacuuucgugcggaucgcguaauagacccacgucgaugccuaaaaccaguaauauuaaaagacgguccugaacgaguaauauuagcagguccgaugccgguuaccgucgccucagcagcacaaagaaggggacguauuggacgcaaucauaacaaagagggagaccaauauauauacaugggccaacccuuaaauaaugacgaagaucacgcacauuggaccgaagccaagauguuacuggauaacauaaauacuccggaaggaauaauuccggcacucuucgaacccgaaagagaaaaauccgcugcaaucgacggagaguaccgacucagaggggaagcccgaaaaacauuuguugaacuaaugaggaggggagacuuaccugugugguugucauauaagguggcaagugaaggcuuccaauauagugacagaaggugguguuucgauggcgagagaaauaaucaggugcuugaagaaaacauggacguugagaucuggaccaaagagggcgaacguaagaagcuccggccccguugguuagaugcuaggacuuauagugacccuuuagcacuucgugaauuuaaggaguuugccgcaggucgcagaucuguuucuggcgaucuaauauuagagauagguaaacuaccucaacaucucacacagagagcucagaacgcgcuagauaauuuagucaugcuucacaauucagaacaaggcgguagagcuuaucggcaugcaauggaagaauugccugacacaauugaaacauugauguuguuagcauuaauagcuguacuaacaggggguguaacacuauuuuucuuaaguggcaggggacucgggaaaacaucuauuggccuucuaugugucauggccagcagcguccuauuauggauggccucuguagaaccucacuggauugcagcuucaauuauucuagaauuuuuccuaaugguauugcuuauaccagaaccagacagacaacgaacaccacaagacaaucaacuagcguacgucgugauagggcuuuuauuuaugauucuuaccgucgcagcuaaugaaauggguuuacuagaaacaacuaagaaagaucuggggauaggucauguggcagucgaaaaucaccaucaugcaaccauguuagacgucgaucuccacccagcgagcgcuuggaccuuauaugccguugcaacaacgauuauaacgccaaugaugagacacacaauugaaaauacaacagccaauauuucacuaacagcuauagcuaaccaagcagcaauauuaaugggacuagauaaaggauggccgauaagcaaaauggacauaggggugccguugcuugcauuaggauguuauagucaaguaaauccguugacgcugacagcugccguacucauguuaguagcacauuacgcaauuauagggccagggcuacaagcaaaagcuacacgugaagcgcagaagcgaaccgcagcggguauuaugaaaaaucccacaguggaugguauagucgcuauagaccuagauccggugguauaugacgcuaaauucgaaaaacaauugggccagauuauguugcuaauauuguguacaagucaaauucuucucaugagaaccacuugggcacuuugcgagaguauaaccuuagccacagguccgcuuacaaccuuaugggagggcucccccgguaaauuuuggaauacgacuauagccguaucaauggcuaauauauuucguggaucuuaccuagcaggagccggacuugcuuucaguuuaaugaaaucacuagggggaggccggagaggaaccggugcacaaggugaaacucucggcgaaaaauggaaaagacaacuuaaucaacugagcaagagugaauuuaauauauauaaacgcagugguauuauggaggucgauaggagcgaagcaaaagaaggacuaaaacgaggagaaacgacgcgacacgcggucagccgaggaacugcaaaacuacgaugguuuguugaaagaaauuuaguuaagccugagggaaaaguuauugacuuaggaugcggacguggugguuggucuuacuacugcgcgggacuuaagaaagucacugaagugaaaggguacacaaaggguggcccuggacacgaagaacccauaccgauggcaaccuacggauggaacuuaguuaaguuacacucaggcaaagacguguucuuuacgccaccagaaaaaugcgacacuuuacuaugcgauaucggcgaaucaucaccaaauccgacuauagaggagggucguacacuuagaguguugaaaaugguagagccuugguugcgaggcaaucaauuuuguauaaagauucucaacccauacaugccauccguuguagaaacauuagaacaaaugcaacgaaaacauggagggaugcuuguuagaaaccccuugucacgaaauagcacccacgagauguacuggguguccugugggacaggaaauauuguuagugcggugaacaugacuucgcguaugcugcugaacagauuuacaauggcucacagaaaaccgacauaugaacgagauguagaccuaggcgcuggaacacgucauguagcaguagaaccugagguagcuaaccuagauauaauuggucagcgcauagaaaauauaaagcaugaacauaaaagcaccuggcauuaugaugaagauaauccuuauaaaacuugggcauaucaugguucguaugaaguuaagccaagcggaagugcaagcucaauggugaacggagucguuaaacuauuaacaaaaccaugggauguaauaccuauggugacacagauagcaaugacagauacaacgccauuuggucagcagcgaguauuuaaggaaaaaguagacacccgaacgccgaaggcuaaacgugggacagcacaaauuauggaagugacagcuaggugguuauggggauuucuaucaaggaacaagaagccccgaauuugcacuagagaggaguucacucggaagguacgaucaaacgccgcuauaggagcuguauuuguagaugaaaaucaauggaacucugcaaaagaagcuguugaagacgagcgauuuugggacuuaguacagaaagaacgugaauuacauaaacaaggaaaaugcgcgacauguguguauaauaugaugggcaaaagggagaagaaacuaggugaguucgguaaagcaaaaggcagccgagcuauaugguacauguggcugggugcaagauuucuagaguuugaagcgcuaggauuuaugaaugaggaccauugguucagcagggaaaauucacuaucggguguagaaggagaggguuuacauaaacuuggcuacauccuaagagacauaaguaaaaucccaggagguaacauguaugcagaugauacagcaggcugggauacgagaaucacagaagaugauuuacaaaacgaagcacggaucacagacaucauggaaccugaacacgcacuacuggcuacauccauuuuuaaacugacuuaccagaacaaaguaguaagaguacagcguccagccaaaaacgggacaguaauggaugugauauccaggagagaucaacgugguucaggacaagucggcacuuacggacuuaauacauuuaccaacauggaagcccaauuaauaaggcagauggaaagugagggaaucuucuugccgagcgaacuagaaacacagaaucuagcggaaagaguuuuagacuggcuggagaaauaugggguagaaagacuuaaacggauggcuauuaguggugaugacuguguaguuaaaccuauagacgacagauucgcgacugcacuaacagcguuaaaugauauggggaaaguaaggaaagacauaccacagugggaacccaguaagggauggaaugacuggcaacaaguuccauuuuguucucaucauuuucaccaacugaucaugaaggauggccgugagaucguggugccauguagaaaccaggaugaauugguuggucgggcacggguuucccagggagcaggguggagccuacgugagacagcguguuuaggaaaaucauaugcacaaauguggcagcuaauguauuuucauagaagagaucuuagacuagcagccaaugcaaucuguuccgcagugccgguugauuggguccccacaucaagaacaacuuggucuauucacgcgcaucaucaguggaugacgacggaagacaugcucucgguauggaaucgcguuuggauugaggaaaauccuuggauggaagauaaaacccacguuucguccuggggcgaugucccauauuuggggaagcgagaagaccaguggugcggcagcuuaauagggcuuacggcgcgagcgacuugggcaagcaauauucagguagcuauaaaccaaguucgaagauuaauaggaaacgaaaauuauuuggacuauaugacaucuaugaagagauucaagaaugagggggacccugaaggggcacuaugguag

SEQ ID NO: 21670 - RNA, 9879 nt, Artificial Sequence
  derived and/or modified CDS sequence (opt6) from DENV-1__GQ199791__SS-prME
agcguaacaauguuauuaaugcugaugccuaccgcauuagcguuccaucucacuacucgugguggagaaccacacaugauaguuacaaaacaagaacgugguaaaaguuuacuauucaaaaccagugcuggaguuaauauguguacauuaauagcgauggaccuuggugaacuaugugaagauacaaugacauauaaaugcccccgaauaacugaagcagaaccugaugacguagacuguuggugcaaugcaacugacacguggguaaccuacggaacguguagccaaacaggagaacaucggagagacaaaagaucaguugcacucgcuccgcacguuggauuaggauuagaaaccagaacagaaacauggaugucgucagaaggagcuuggaaacaaauucaacggguagaaacuugggcauugaggcauccaggguucacaguuauagccuuauuccuagcacaugcuauagggacuagcauaacccaaaaaggcaucaucuuuauauuguuaaugcuaguaacuccuaguauggcuaugagaugcguuggaauugggagcagagacuuuguagaaggacuuagcggagcgaccugggucgaugucguguuggaacauggauccugcgugaccacaauggcgaaagauaaaccuacuuuagauauugaauuacuaaaaacugaaguaacaaauccagcaguauuaagaaaacuuuguauagaagcgaaaauuaguaauaccacuacagauucaagauguccaacucaaggcgaagcaacauuaauggaagaacaagaugccaacuuuguaugcaggagaacuuuuguagacagaggaugggguaacgguuguggguuauuugguaaaggaagccuaauuacuugugcgaaauucaaaugcguaacuaaauuagaaggaaaaauuguacaauacgaaaacuuaaaauauucgguuauaguaacaguacacacaggagaucaacaccaagucgggaaugaaucaacagaacaugguacaacagccacaauuacaccucaagccccaacauccgagauccaauuaaccgacuauggagcauugacucuagacugcucuccccgaacaggcuuggauuucaaugagaugguacuacuuaccaugaaagagaaaucaugguuaguacacaaacaaugguuucuagacuugccgcugccguggacgucgggggcaucgaccucgcaggaaacauggaacagacaggaccuauuagucacuuuuaagacagcacaugcaaagaagcaagaaguuguaguacucgggucucaagagggggcaaugcauacagcuuuaacaggcgcuacugaaauacagacauccggaacaacuaccauauuugcugggcaucugaaaugcagauuaaagauggauaaacugacauuaaaaggaaugucauacgugauguguacugguuccuuuaaguuagaaaaagaaguggccgagacgcaacauggaacagugcuaguucaaauaaaauaugagggaacggacgccccaugcaaaaucccauuccuaacccaagacgaaaagggggugacgcaaaauggucggcuuauaacggcgaauccaauugugacagacaaggaaaagcccgucaauauugaagcugagccaccguuuggggaaucuuacaucguaauaggggcgggugagaaggcuuuaaaacucuccugguucaagaaagguagcucaauaggcaaaauguucgaagccacagccaggggcgcuaggcgaauggcaauauuaggcgacacagcgugggacuuugggaguauaggugggguauuuacaaguguagguaaauuaguacaucaaauauuugguacagcauacgguguuuuauucucaggaguaaguuggacaaugaaaauaggaauaggaguguugcugaccuggcucggacucaacuccagaucaacaucguuaucaaugacauguaucgcaguaggcuuagucacucuauaucucggagugauggugcaggcagacucuggcugcguuauuaauuggaaaggacgugaacuaaaauguggcucagguauuuuugugacaaaugaagugcacacuuggacggaacaauauaaguuccaggccgauucgccaaaaagacuaagugccgcaauaggaaaagccugggaagaggggguauguggcauacggucggcgacuagauuagagaacauaauguggaagcaaauaagcaaugagcuaaaccauauacucuuggaaaacgauaugaaauuuacaguaguaguuggugacguuguugggauauuagcucaaggaaagaagaugauuagaccccaaccuauggaacacaaguacucauggaaaagcuggggcaaagcuaagauaauaggcgcagauguucaaaacacaacuuucauaauugacggcccuaauacgccagaauguccugaugaucaaagagcuuggaauauaugggaaguagaagauuauggcuucgguaucuucacuacuaauaucuggcuuaaacuaagagauaguuauacacaagucugugaccauagacuaaugagugcagcuauaaaagacucaaaggcaguccacgccgacaugggauauuggauugaaucagagaaaaaugaaacuuggaaguuggcuagagcaucauucauagaaguuaaaaccuguauauggccaaagucacacacauuauggucaaaugguguacuagaaucagagaugauuaucccuaaaauauacgguggaccgaucucccaacauaauuaucgucccgguuauuuuacucaaacugccggaccauggcacuuagguaaguuagaauuagauuucgaucuuugugaaggcacgacgguuguaguagaugaacacugugguaaucggggacccagcuuacguacaacaacuguuacuggaaaaauaauucaugaauggugcugcagaaguugcacauugccuccacuaagauuuaaaggugaagauggauguugguaugguauggaaauccgaccgguaaaagaaaaggaagagaaucuuguuaagagcaugguuuccgcggggucaggagaaguagacuccuuuagccuaggauuauuauguauuucgauaaugauugaggagguaaugaggaguagauggagccgaaaaauguugaugacaggcacuuuagcuguguuuuuacuccuuauaaugggucaguugacuuggaacgaucuaauuagguugugcaucaugguuggagcuaacgcguccgauagaaugggaauggguacaacauauuuagcccuaauggcaacguuuaaaaugaggcccauguucgcgguuggacuuuuauucaggaggcucaccagucgagaaguucuguuacugacuaucggguuaagccuaguagcaucaguugaacugccaaauaguuuggaagaauuaggcgauggacucgcgauggguauaaugauauuaaagcuacuuacagauuuucagucacaucaacuaugggcgacauuacuuagcuuaacuuuuauaaaaacaacguugucucuccauuaugcauggaaaacuauggcaaugguuuuaagcauaguaucacuauuuccacugugucuuucaacaaccucucagaaaacaacauggcuuccaguucuccugggaucauugggauguaagccucuaaccauguuucucaucgcagaaaauaaaauauggggucggaaauccuggccguugaacgaggguauaauggccgucggcguaguuucuauauuacuaaguucacuauugaagaacgacguaccauuggccggaccacucaucgccgguggaaugcuuauagcuuguuaugucauuaguggaagcucugcugaucuaagccuagagaaagcagccgaaguguccugggaagaggaagcugagcacucgggagcgucacacaacauccuaguagagguucaagacgacgggacaaugaaaauaaaagacgaagaacgggaugauacgcuaacaauucuacuuaaagcgacacuacucgcaguaagcggaguauacccacuaaguaucccugcuacauuauuuguaugguauuuuuggcagaagaagaaacagaggaguggaguacugugggacacuccaagcccaccagaaguagaacgugcaguucuggaugacggcauuuauaggauaaugcaaagagggcuauuagggaggagucaagugggggucggggucuuccaagagaauguguuccauacuauguggcaugucacuagaggagcaguauuaauguaucaagguaagagauuggagcccucaugggcgagugucaagaaagaccuaauauccuacggcgguggcuggcgacuacaggguaguuggaauaccggagaagaaguacagguaaucgcaguagaaccuggcaaaaauccgaaaaacgugcaaacagccccgggaacuuuuaaaacaccggagggugagguuggcgccaucgcacuagacuuuaaaccugguacgucgggaucccccauaguaaacagggaaggaaaaauuguaggacuauauggcaacggaguagucacaacaucgggaaccuauguaucagcgaucgcucaagcuaaggcgucacaagagggcccauuaccagaaauagaagacgaaguauuccgcaaacgaaaccuuacuauaauggauuuacauccaggcagcgguaagacccgaagauaccuucccgcaauaguccgcgaagccauuaaacgcaaguuacgcacguuaauauuagccccaacacgaguaguggcaucugaaauggccgaggcuuugaaggguaugccgauacgcuaccaaacuacugcaguaaaaucagaacauacaggaaaagaaaucguugauuuaaugugucacgccaccuuuacuaugcggcuuuuguccccaguaagaguaccaaauuauaacaugauaauuauggaugaggcucacuuuacagauccgucaucgauugcagcuagggguuauauaucaacacgagugggaaugggcgaagcagcagccaucuucaugacggcaacucccccugggucgguagaggcuuuuccucaaucaaaugcaguuauccaagaugaagaaagagacauaccagaacguaguuggaauagcgguuaugaauggauaaccgacuuuccagguaagacuguaugguuugucccuaguauuaaaucaggaaacgacauagcaaauugucuuaggaagaaugggaaacggguuauccaauugucucgaaaaaccuuugauacagaguaucagaaaacgaaaaauaaugauugggacuacguggucacgacugauauaagcgaaaugggugccaauuucagagcggaccgagugauugauccacgaaggugucuaaaaccuguuauucuaaaagaugggcccgaacgggucauacuagcaggacccaugccaguuaccguagcuagugcggcucaaaggaggggucgcauuggaagaaaccacaauaaagaaggcgaccaauauauauauauggggcaaccguugaauaaugacgaggaucaugcucauuggacagaggccaagaugcuauuagauaauauuaacaccccagaagguauaaucccggcccucuuugaacccgaacgggaaaaaucagcugcaauagauggggaauaccgucuccgaggagaagcuagaaaaacauucguugaacuaaugagacgaggggaucugccugucuggcuuagcuacaaaguggcaagcgaagguuuucaauacucagacagacgauggugcuucgacggugaacgaaauaaucaggucuuagaagaaaacauggaugucgaaauuuggacgaaagagggagaaagaaagaaauugaggccucgcugguuggacgcaaggacguauucggauccuuuagcucuuagagaguucaaagaauuugccgcgggccgccgaagcguauccggagacuuaauacuugaaauuggaaaacuaccccaacauuugacacaaagagcgcaaaacgcccuugauaacuuagucaugcuccauaauagcgaacaagguggacgugcauauagacacgcaauggaagaauugcccgauacaauagaaacacucaugcucuuggcucucauagcgguguugacaggcggaguuacucuauucuucuuauccgggagaggacuaggcaaaacuuccaucggcgugcuuugcgugauggcuucaucaguacuucuuuggauggcgaguguugaaccgcacuggauugcagcaucaauuaucuuagaguucuuucuaaugguucuuuuaauuccagaaccugaucgacaaagaaccccucaagacaaucaauuagcuuacguagugaucgggcuacuuuuuaugauacucacaguagccgccaaugaaaugggccucuuggagaccacaaagaaagauuuaggcauaggacauguagcaguugagaaccaccaccaugcaacuauguuagacguggauuuacaccccgcaagcgccuggacacuuuaugccguugcuaccacaauuauuacgccuaugaugagacauacgauugaaaacacaacagcuaauauuaguuuaacagcuauugcaaaucaagcagcaauauuaaugggacucgauaaaggauggccgauuaguaaaauggauauaggaguaccucuguuagcgcuaggauguuacagccaagucaauccacuaacacugacagcggcgguauuaauguuagucgcgcacuacgcuauaauaggaccaggucuccaggcaaaggcaacgcgagaggcacagaaaagaacugcugcuggcauuaugaaaaauccaacgguagauggcaucgucgcgauugaucuagauccaguaguauacgacgcaaaauucgaaaaacaacuugggcaaaucauguuguuaauuuuauguacuucgcaaauuuuauuaaugaggacuacaugggcucuaugugaaucuaucacgcuagcuacagggccucuuacaacccuaugggaaggcaguccagguaaauucuggaauacuaccauugccguaucaauggcaaacaucuuucgugguucguauuuagcgggagccgguuuggcauuuucucuuaugaagucauuggguggagguaggagaggaaccggggcgcaaggagagacguugggagagaaauggaaacgucaacuuaaccaguugaguaaauccgaguucaauauuuacaagagauccggaauuauggaaguggauaggucagaagcaaaggaaggucuaaaaagaggggaaacuacucgccaugcagucucaagaggaacggcuaaauuaagaugguuuguagagagaaaucuuguaaaaccagaagggaaggucauagaccuuggcugugggcguggcggaugguccuacuauugcgcaggucuaaagaaaguuacagagguaaaagguuauacaaagggagguccaggacaugaagaaccgauuccuauggcaacguacggguggaaccucgugaaacuacacagugguaaagacguauucuuuacaccaccggaaaaaugugacacuuuauuaugugauauaggagagagcagucccaauccuacgauagaagaaggaagaacacuccguguacucaaaaugguggaaccauggcuuagggggaaucaauucuguauuaaaauauuaaauccuuacaugccuuccgucguggagaccuuggaacaaaugcagcggaagcacggagggaugcuaguuagaaauccucuaaguagaaauuccacucaugagauguacugggucaguugcggaacuggaaacauaguaagcgcgguuaauaugacuucccgaauguuguuaaauagauuuacaauggcacauagaaaaccaacauacgaaagagacguggaccuaggugcaggaacuagacacguggcuguagaaccagaaguagcgaacuuggacaucaucggacaacgaauugagaauauaaaacacgagcauaaaucaacauggcauuaugacgaagauaauccguauaagacaugggccuaucacggauccuacgaaguuaaaccuucagguucagcuagcagcaugguaaacggaguagucaaacuacuuacuaaaccuugggauguuauaccuaugguaacacaaauagccaugacagacacgacacccuuuggccaacaacggguauucaaagaaaaaguagauacucguacaccaaaagcuaaacgcgguacagcccaaauaauggaaguuaccgccagguggcuuuggggauuccugagccgaaauaagaaaccucguauuuguacacgugaagaguucacaagaaaaguuaggagcaaugccgcgaucggugcgguuuucguagaugaaaaccaguggaacucagccaaagaggcugucgaggacgaaagauuuugggaccugguucaaaaggaacgagaacugcauaaacaagggaaaugugccacauguguguauaauaugaugggaaagagggagaagaaauugggcgaauuugguaaagcaaaaggauccagagcgauaugguauaugugguuaggggcaagauuccuugaguuugaagcucucggguucaugaaugaagaucacugguucucgagagaaaacagucuaucuggaguugagggagagggguuacauaaacuuggguauaucuugagagacauaucuaaaauucccggagguaauauguaugccgacgauacagcugguugggacaccagaauuaccgaggaugaucuccaaaacgaagcaaaaauaacagauauaauggaaccugaacaugcccuuuuagcaacaucaauauucaagcuaacguaucaaaacaaaguggugcggguccagaggccagccaaaaacgggaccguuauggauguaaucucgaggagggaucaacgagguucaggacaaguugguacauaugguuuaaacacauuuacgaauauggaagcucaauugauaagacagauggaaucagaaggaaucuuucucccgucagaauuagaaacacccaacuuggccgaaaggguuuuagauugguuagagaaauaugguguugagagacugaaaagaauggcaauauccggugaugacuguguaguuaaaccgauagaugaucgcuuugcaacagcacuaacagcauuaaaugauauggguaaagugcguaaagauauaccacaaugggaaccaucaaaggguuggaaugauuggcaacaagugccuuucugcucgcaccauuuccaucaauuaaucaugaaagaugguagagaaauaguuguaccgugcagaaaucaagaugaauugguugggagagcccgaguuucacaaggagcaggauggucacuaagggaaacagcaugccuaggaaaaucauaugcgcaaauguggcaacuaauguauuuucacaggcgggaucucagauuagcagccaaugcgauuuguucagcagugccuguagauuggguaccaacgucuagaacaacuuggaguauccaugcucaucaccaguggaugaccacagaagauaugcuaagcguuuggaauaggguauggauagaggaaaauccuuggauggaggauaaaacccauguaaguucuuggggagauguaccguaccugggaaaaagagaagaucaauggugugguucucucaucggccuuacggcgcgugccacaugggcaucaaauauccagguugcaauuaaucaaguaagacgccuaauaggcaaugaaaacuaccucgacuauaugaccagcaugaaacguuuuaagaaugagggugauccugaaggagcuuucugguag

SEQ ID NO: 21671 - RNA, 9879 nt, Artificial Sequence
  derived and/or modified CDS sequence (opt6) from DENV-1__GQ199792__SS-prME
ucaguaaccauguuguuaauguuaaugccgacagcucucgcauuucacuuaacaacaagagggggcgaaccccauaugauuguuucaaaacaagaacguggaaaaucccuauuauuuaaaacaagcgccggagucaauauguguacgcucauagccauggaccuuggugaacuaugugaagacacuaugacauauaaauguccacgaauuacagaagcugagccugacgacguugauuguugguguaaugcuacugacgccuggguuacguaugguacuuguagccaaacuggggaacacagacgagauaaacgaucaguagcacuagcaccgcauguggggcugggucuagaaacucguacagagacauggaugucgagcgaaggagcuuggaaacagauacaaagaguagaaacaugggcacuaagacacccaggauucacaguuauagcucuauuucuagcccaugcuauagguaccaguauaacucagaaaggaauaauuuuuauucuucuaauguuggugacuccuaguauggcgaugcgauguguuggaauugggucacgagauuuuguugaaggucugagcggagccacguggguggaugucgucuuagaacaugggucauguguaacuacaauggcaaaagacaaacccaccuuagauauagaguuacuuaaaaccgaagugacaaacccugcaguuuuaaggaaacuaugcauagaagcgaaaauaucgaacaccaccacagauucccguugucccacgcaaggagaagcaacucucgucgaagaacaggacgcgaauuuuguauguagacgcaccuuuguagaucgaggauggggaaauggaugcggucuauuugguaaaggcucauuaauaaccugcgcuaaauucaaaugugucacaaaauuagaagguaaaauaguacaauacgaaaaccugaaauacuccgucaucgugacaguucauacaggugaccaacaucaaguagggaacgaaaguacggagcacggaacuacagcaacaaucacuccucaagcuccaacaacagaaauacaacuaaccgauuauggagcacuaacacuggacuguaguccccgaacagguuuagacuuuaaugaaaugguacuauuaacaaugaaagagaaaaguuggcucguucauaaacaaugguuuuuggaucucccauuacccuggacuagcggugcgaguacgucgcaagagacuuggaaccgacaagacuuacugguuacauuuaagacagcucaugccaagaaacaagagguggugguccucgguagccaagagggugcaaugcauacugcguugacaggagcaacugaaauucaaacuucgggaacaacaacaauuuucgcagggcacuuaaaaugccgacuuaaaauggacaaacugacuuuaaaaggcaugagcuauguaauguguacaggaucuuuuaaacucgaaaaggaaguagcggagacacaacacgguacagugcugguacaaauuaaauaugaagguacggaugcaccauguaagauuccguuuucgacucaggaugaaaaagguguaacacagaacggaagacuuauaacagcaaauccgauuguaaccgacaaagaaaaaccagucaauauagaggccgaaccuccuuucggugaaucauauaucguuauaggagcgggagaaaaagcccugaaacuuucaugguuuaagaaaggcagcucgauuggaaaaauguucgaagcaacugcaagaggagccaggaggauggcaauacuaggagacaccgcaugggacuuugguucaauuggaggcgucuuuacgucagucgggaagcugguucaucaaauauuugggacugccuacgggguucuauucucagguguaucuuggaccaugaagaucgguauugggguuuuacucacauggcugggacuaaauucuaggucaacauccuuaucaaugacuuguauagcuguuggacucgucaccuuauaucuuggaguuaugguucaagcagauucgggauguguaauaaauuggaaagguagggaguuaaaaugcgguuccggaaucuucgugacaaacgagguccacacauggacagaacaauauaaauuccaagccgacucaccaaaacguuugucagcagccauugggaaggccugggaggagggaguuuguggaauuaggucagcaacgagauuagaaaauauuauguggaaacaaauaucuaacgaacuaaaccacauucuguuagaaaaugauaugaaacuuacgguaguuguaggagacguugcagguauauuaggucaaggcaaaaagaugauuaggccucaaccgauggaauacaaguacuccuggaaaucauggggaaaagcgaagauuauaggcgccgaugcucaaaauacuacauucauuaucgacggaccaaacacaccggaauguccagaugaucaacgagcguggaacauuugggaaguagaagacuauggcuuuggaauauucacaacaaauauaugguuaaaacucagagauaguuauacacaaguaugugaucauagacuuaugucggccgcaauaaaggauaguaaagccgugcaugccgauaugggauauuggauagaaucagagaaaaacgaaacauggaagcucgcaagagcuagcuucauagaaguaaaaacauguaucuggccaaaaucgcauaccuuguggagcaaugggguacuggagagcgagaugauuauaccgaaaauauauggugggccaauaagucaacacaacuaucggccgggauauuuuacucaaacugcaggcccauggcauuuaggaaaacuagaacuagauuuugauuugugugaagguacaacuguaguuguugacgaacacuguggcaaucgaggaccaaguuugcggacgacaacagucacaggaaagauuauccacgaauggugcugccgcucguguacauuaccaccuuugagauuucguggagaagauggcugcugguacggaauggaaauuagaccaguaaaagaaaaagaagagaaucuuguaaagaguaugguaucagcugguucaggggaagucgauaguuucucguugggucucuuaugcaucaguaucaugauagaggaagucaugaggucacgcuggucgagaaagaugcucaugacggguaccuuggcuguauucuuuuuacugaucaugggccaauuaacauggaacgaucuaauacgucuauguauuaugguaggugcgaacgccuccgacaggaugggaaugggcacaacuuauuuggcauugauggcaacauuuaagaugcggccuauguuugcaguuggauuacuguuuagaagacuaacuagcagggaaguacuacucuuaacaauaggauuaucauuagucgcgagugucgaauugccaaacaguuuagaagaguuaggugauggacuggccauggguauuaugauucuuaaacuccuaacagauuuccaaucgcaccaauuaugggccacuuugcugaguuuaacauuuauaaaaacuacuuucucauuacauuacgcauggaaaacgauggccaugguacuaucaauuguaucacuauucccccuaugucuaagcacuacaucacagaaaacuaccuggcuuccuguacuuuuagguagcuuaggauguaagccucuuacaauguuccugauagcagagaauaaaauauggggaagaaagagcuggccauuaaaugagggaauaauggcaguuggaauaguuaguaucuuauuaaguagccuucucaaaaaugacguaccacuagccggaccgcuaauugcuggagguauguuaauagccugcuauguuauuucaggaucuagugcagauuuaucgcuggaaaaggcggccgaagucagcugggaagaggaagccgaacauucuggggcgagucauaauauauuaguggaaguacaagacgacgggacgaugaaaaucaaggacgaggaaagagaugauacauuaacaauccuacuaaaagccacucuucuagcuguaagcgguguauacccuuuaucaauucccgcgacucuguuuguuugguauuucuggcagaaaaagaaacaaagaagcggagugcuuugggauacuccaucaccaccggaagucgaaagagcaguuuuagacgauggcauuuaucgaauuaugcaacgugggcuuuugggucgaucacaggugggaguuggggucuuucaagagaauguuuuucauacuauguggcacguaacaagaggggcuguauuaauguaucaagggaaaaggcucgagccaaguugggcuagugugaagaaagauuugauaucauaugguggcggcuggagauugagaggaaguuggaauaugggagaagagguccaagugauagcuguagaacccgguaaaaaucccaaaaacguccaaaccgcuccaggaacuuuuaaaacaccggaaggggaaguuggagcaauagccuuagauuuuaaaccuggaacuucugggagucccauuguaaacagagaagggaagaucguaggacuguauggaaaugggguggucacuacaaguggaacuuaugucucagccauugcgcaagcuaaagcaucucaagaaggcccccuuccggagauagaagacgaaguauuuagaaaacguaaucugacuaucauggauuuacacccagguagugguaaaacacggcguuaccuuccggccauuguccgagaagcuaucaaacguaaauuacguacucuuauauuagcucccacaagaguaguggcaucagaaauggcagaagcacucaaaggaaugccgauacguuaucagacgacagcuguaaaauccgaacauacagggaaagaaauaguggacuuaaugugucaugccaccuuuaccaugagauuacuaaguccugugagagugcccaauuacaacaugaucaucauggaugaagcucauuucacagauccauccuccaucgcggcaaggggauauauuaguacacgaguagguaugggagaggcagcagcaauauucaugacagcaaccccaccaggaagcguagaagcauuuccgcagucaaaugccgucauccaagaugaggaacgggacaucccagaaagauccuggaacuccggcuaugaauggaucacugacuuuccugguaaaacagugugguucguaccgaguauaaaaucaggaaacgauauagcaaauugccuaaggaagaaugguaaacguguaauucaauugucgagaaagacuuuugacacggaguaccagaaaaccaaaaauaacgauugggauuauguaguaacuacggacauaucugaaaugggugcaaauuuuagggccgacagggucauagacccucgaagaugucucaagccaguaaucuuaaaagaugguccagaacgaguaauauuagcaggaccuaugccagugacgguggcuucagcggcucaacguagagggagaauagguagaaaucauaacaaagaaggagaucaguacauauauaugggccagccguuaaauaacgacgaggaucaugcccacuggaccgaagcaaaaaugcuacuagacaauaucaauacaccggaggggaucauuccggcacuuuucgaaccugaacgugagaaaagugcggcgguugacggagaauaucgacuaagaggugaggcccgaaaaaccuuuguagaauuaaugagacguggcgaucuacccguaugguuaucuuacaaagucgcgucagaaggauuucaauauagcgacagacguuggugcuuugauggggagcggaacaaccaaguauuagaggaaaacauggaugucgaaaucuggacgaaagagggugaacguaagaaacucaggccccguugguuagaugcacguacauauagcgauccacuugcucuaagagaauuuaaggaauuugcagcaggucguagaucagucucaggagauuuaauccuagaaauaggaaaacuaccacaacaucuuacacagagggcacagaacgcauuagauaauuuaguuauguuacauaauucugaacaaggagguagagcguacagacacgcaauggaggaacuacccgacaccaucgaaacauugaugcuacuagcucuuauugcgguauuaacaggcggcgucacccuauuuuucuugucaggacggggauuaggcaaaacgaguauaggcuuacuauguguaauggcuucaagcguccuacuuuggauggcgagcguggaaccgcauuggauagcagcaucaauuauccuugaguucuucuuaaugguucugcuuauaccagaaccagaccgacaaaggacaccccaagauaaucaguuagccuacguagucaucggucuuuuguuuaugauacugacugucgcugcaaacgaaaugggacuccuagagacaacuaagaaagaucucggaaucggacacguugcuguagaaaaucaucaucaugcugcuaugcuugacguggauuuacacccugccagcgcuuggacacuauacgcaguggcaaccaccauaauaacgccuaugaugcggcauacaauagaaaauacuacagcaaacauuucguugaccgccauagcaaaucaagccgcaauauugauggguuuggauaaaggauggccaauuaguaaaauggauauagggguaccccuucuagcguuaggauguuacagucagguaaauccguuaacacuaaccgcugcaguuuuaaugcuuguagcccauuacgcaauuaucgguccuggguuacaagccaaagccacccgagaagcucaaaaacggacagcugccgggauaaugaaaaauccuacuguugaugguauaguagccauagauuuagacccaguaguauaugaugccaaguuugaaaaacaauuaggucaaauaaugcuauuaauacuuuguacuucgcaaauccuguuaaugagaacaacuugggcgcuuugcgaauccaucacuuuagccacagggccucuuaccacauugugggaaggcaguccagguaaauuuuggaacacuaccauagcggucaguauggcuaauaucuuucgcgggucguacuuagcuggagcaggucuagcguuuucucuuaugaaaucacuaggaggugggcggagaggcacaggcgcacaaggcgaaacucucggugagaaauggaaaagacaacugaaccaguugucuaagagugaguuuaacacuuacaagagaucaggcauaauggaaguggaucgcucagaagcgaaagaaggauuaaaacgaggugaaacaacuaaacacgcuguauccagagguacugcaaaguugagaugguucguggaaaggaaccuaguaaagccagaaggcaagguaauagaccugggauguggcagaggcggcugguccuauuauugugcgggccuaaagaaaguaacagaaguuaaaggauauacaaaagguggaccaggccaugaagaaccaauaccgauggcuacguauggauggaaccucgucaaacugcauagcgggaaagacguauuuuucaucccucccgaaaaaugcgauaccuuauuaugugacaucggcgaaucaucaccuaauccaacaauagaagaagguaggacacuacgaguacucaaaaugguagagccauggcuaagggggaaucaauucugcauaaaaauacuaaacccuuauaugccuucaguaguugaaacucuugaacaaaugcaaagaaaacacgguggaauguuggugcgaaaucccuuaucuaggaacaguacucaugaaauguacugggucuccugugguacaggcaauauaguaucagcaguaaauaugacaagucggauguuauuaaauagauuuacuauggcgcacagaaagccgacauaugaaagagauguagaucuaggcacagggacucggcacguagcugucgaaccugagguggccaaucuggacaucauaggacagagaauagaaaacauaaaacaugaacauaaaucaacguggcauuaugacgaagauaacccguauaaaacaugggcauaucacgguaguuaugaaguaaaacccuccggaagcgcuaguagcaugguaaacggcguaguuaaacuacugaccaagccaugggauguaauaccaaugguuacacaaauagcgaugacggauacuacgccauucggacagcaaagagucuuuaaagaaaaaguggauacacgaacuccaaaagccaaaagaggaacagcgcaaauaauggaagugaccgcacgguggcuuuggggauuucuuucgcgaaauaagaaaccacguauuugcacaagggaagaguuuaccaggaagguaaggaguaacgcugcuauuggugcuguauuuguagacgaaaaccaauggaacagugcaaaagaagcagucgaagacgaaagauuuugggaucuaguccauagggaaagagaacugcauaaacaaggaaaaugcgcaacauguguauauaacaugaugggaaagagagaaaagaaacuuggugaguucggcaaagcuaaagggucgagagcuauuugguacauguggcugggugcaagauuucuagaauuugaagcacuggguuuuaugaaugaagaucacugguucagucgagaaaacaguuuaagcggagucgaaggagaagguuuacauaaacuagguuacaucuuacgagacauaucaaaaauacccgguggaaauauguaugcagaugauacugccggcugggauacucgaauaacggaggaugacuugcagaaugaggccaaaauaacagauauaauggaaccagaacaugcacuucucgcgaaagcaauuuuuaaacuaacauaucaaaauaaaguagugaggguacagagaccugccaaaaaugguacuguuauggaugucauaaguagacgagaucaacgugggaguggacaaguugguacauaugguuuaaacacguucacgaacauggaagcccaguuaauucgccaaauggaaagugaagggauuuucaguccgucggaauuggagacuccaaaccucgcggagcgcgcucucgauugguuggagaaauacgggguggaaagauuaaagagaauggcuauaagcggcgaugauugcgucguaaagccgaucgaugaccguuucgcuacagcauuaacagcguugaacgauaugggaaagguaaggaaagacauaccccagugggaaccaucaaaagguuggaaugacuggcaacaagucccguuuuguucacaucacuuucaucaacucauaaugaaggacggcagagaaauagugguaccaugucguaaccaagacgaauuggucgggagagcucgaguaagccaaggagcaggauggagccuacgggaaacagcgugucuugguaaaaguuacgcacaaauguggcaauuaauguauuuccauagaagggacuuacgauuagcagcgaacgcaauauguagugcgguacccggagauuggguacccaccagucggacaacauggucaauucacgcucaccaccaauggaugacaacggaagauaugcuaagcguuuggaaucgugucuggauagaagaaaaccccuggauggaagacaagacacauauaagcagcugggaagaugucccguaccucggaaaacgcgaagaccagugguguggcagucucauuggccuaaccgcacgagcaacuugggcuacaaauauacaaguagcaauaaaucaagugcgaagacuaaucgguaaugaaaauuauuuagacuauaugaccagcaugaaacguuuuaaaaacgaaagugauccggaaggagcauuaugguga

SEQ ID NO: 21672 - RNA, 9879 nt, Artificial Sequence
  derived and/or modified CDS sequence (opt6) from DENV-1__GQ199793__SS-prME
ucuguaacuauguuauuaauguugaugccuacagccuuagcguuccaucugacaacccgaggaggugaaccucacaugaucguaacuaaacaagaaagagggaaaucacucuuauuuaaaacaucugcaggaguaaauaugugcaccuuaauugcuauggacuugggagaacuaugugaagacacgaugacauauaaaugcccacggauaacugaagcugaaccagaugauguugauuguugguguaaugcaacugauacguggguuacuuacggcacguguucucaaacaggcgaacauaggagagauaaacguuccguagcccucgcaccgcacgugggccuaggucuggaaacaagaacagagacguggaugucuucagaaggagcguggaaacaaauccaaaggguggaaacaugggcauugagacauccgggcuuuacaguuauagcgcuauuccucgcacaugcaauaggcacaagcauaacacagaaagggauuauauucaucuuacuuaugcuagugacaccgucgauggccaugcgaugcguaggaauugguagucgggauuuuguagagggcuuaagcggcgccaccuggguagacguuguauuagaacauggcucaugcgucacaacuauggcuaaagauaaaccaaccuuagauauagaacugcuaaaaacggaagucacaaauccugcggucuugcgaaaacugugcauugaggcgaaaauaaguaauacgacaaccgauagcagaugcccaacacaaggagaagccacucucauggaagaacaagaugcaaauuuuguaugcagacguacguucguagaccgggguugggguaauggguguggauuauuugguaaagggucauuaauuacuugcgcuaaauuuaaauguguaaccaaauuagaaggcaaaauagugcaguaugagaaccuuaaauauagcguaaucgucaccguccauacaggggaucaacaccagguuggaaaugaaagcacagaacaugguacaacugcgacuauaacgccccaagcaccgacgucagagauucaauuaacugauuauggagcacucacccuggauuguucaccacgaacuggacuggauuucaaugaaaugguauugcucacaaugaaagagaaaucauggcuaguacauaaacagugguuucucgaccuucccuuaccauggacaaguggggcaaccaccucgcaagaaaccuggaacaggcaagacuuacucguaacguucaaaacggcccaugcuaagaaacaagagguaguggucuuagguucccaagaaggugcuaugcauacugcccuaacgggcgcuacagaaauucaaacuucaggaacaacaacaauauuugcuggacaccugaaaugucgauuaaaaauggauaaacucacacuuaaagguaugucauacguuauguguacugggucguuuaaauuagagaaagaaguagcugaaacucaacacggaacuguuuuaguccaaaucaaauaugaaggaacagaugcaccuugcaaaauuccuuuuucuacgcaggaugaaaagggcgugacucagaacggcagauugauaacagccaacccaauagucacagauaaagaaaaaccuguaaacauagaagcagaaccgccauuuggagaaaguuacauuguaaucggcgcgggggaaaaggcuuuaaagcucuccugguuuaagaaaggcagcucgauaggaaaaauguucgaagccacugcgcguggugcacgaagaauggcuauacuaggagauacugcgugggauuucggaagcauuggaggaguauucacguccguaggaaaacugguacaucaaauuuuugguacugcauacggcguccuauucaguggcguaucuuggacgaugaaaaucggaauuggggugcuucugacauggcugggacuaaacucgcguuccacuucgcuaucaaugacaugcauagcagucggacuuguaacgcuguaccuugggguuaugguucaagcugacagcggaugcgugaucaauuggaaagggagagaauuaaaguguggauccgguauauucguaacgaaugagguucauacguggacagaacaauauaaguuccaagcagauucuccgaaaagauuaagugcugcaauuggcaaggcuugggaagaggguguguguggaauacggucagcaaccaggcucgagaauauaauguggaaacaaauaagcaacgaacugaaccacauucuuuuagaaaaugacaugaaauuuacugugguaguaggagauguaguagguaucuuagcucaaggaaagaaaaugauaagaccacagccuauggagcauaaauauaguuggaaaucauggggcaaagcgaaaauuauaggugcagauguacagaauacuacauucauaauagauggaccaaacaccccugaaugucccgacgaucagagagcuuggaacauuugggagguagaagacuauggauucggcauauuuacaacaaauauaugguugaaauuaagggauagcuauacucaaaugugugaccacaggcugaugucagcggcaauaaaggauagcaaggcuguccacgcagauaugggcuacuggaucgaaucagagaaaaaugagacauggaaauuggccagagcuucuuuuauagagguaaaaacuugcauauggccgaaaucccauacacuauggaguaacggaguacucgaaucagaaaugauaauaccgaaaauuuacggaggaccuauuucgcaacauaauuauagaccagguuacuuuacacaaacagcaggccccuggcaucuggguaaacucgaacuugauuuugaccuaugugaagguacuacaguaguaguugacgaacauuguggaaaucgcgguccaucguuacgaaccacuacgguaacaggaaaaauuauccaugagugguguugcaggucguguacccucccaccgcuaagauuuaaaggugaagacggaugcugguauggaauggaaauucgaccgguuaaagagaaagaagagaauuuggucaaaucaauggucucugccggaucaggugaaguagacucuuuuucauuaggacugcuaugcauaaguauaaugauagaggaaguuaugagaucaagauggagccguaaaaugcucaugacgggcacuuuagcuguauuccuguuauuaauaauggggcaacucaccuggaacgacuuaauaagacuauguauaaugguuggugcuaaugcaagcgaccguauggggaugggaacgacguaccuugcgcuuauggccacuuuuaaaaugagaccgauguuugcagucggccuauuauuccguagauuaacaucaagagaaguucuacuccuaacuauagggcuuaguuuaguagcaaguguggaacuuccaaauucauuagaagaacuaggagacggacucgcaaugggaauuaugaucuuaaaacugcugacagauuuucaaucccaucaguugugggcaacauuauugagucucacguuuaucaaaacuacauugagcuugcauuacgcauggaaaacaauggcuauggugcuaagcauaguaucgcuguuuccauugugucuuucaacaacaucccagaaaacaacauggcuaccaguacuacuaggcucgcuuggguguaaaccauugacuauguuucuaauaacugaaaacaagauauggggucguaagucauggccucuuaaugaaggaauuauggcaguaggagucguaucgauccuacugucaucuuuacuaaagaaugacgucccccuagcaggucccuuaauugcaggaggaauguugauagcuuguuacgucauaucgggaagcagugcagaucuaucccuagaaaaagcagcagagguauccugggaagaagaggcagagcauagcggcgcaagucacaauauacucguagagguacaagaugacgguacuaugaaaauaaaagaugaagagagggacgauacauuaaccauauugcuaaaagcaacauugcucgcuguaagcgguguauauccacuaucgaucccagcgacccuguuuguaugguacuuuuggcagaagaagaaacaaaggucagggguccuaugggauacaccaucacccccugaaguugaaagagcgguacuagaugacggaauuuaucgaauuaugcaaaggggacuacuggggcgcucucaagugggcguuggcguuuuucaagaaaauguguuccacacuauguggcacguuacaagaggugcgguccuaauguaucaaggaaaaagacuggaaccaucaugggcaucugucaagaaagaccucaucucauauggaggaggauggagacugcaaggaagcuggaaugcaggggaagaaguccaaguaauugcaguggaaccaggcaaaaacccuaaaaauguucaaacugcaccugguaccuuuaaaacuccggagggagaagucggugccauagcacuggacuuuaaacccgguacguccgggucacccauaguuaaccgagaaggaaaaauaguaggccucuaugggaacggagucguaacaacaagugguacuuacguaucagcuauagcgcaggcuaaagccagucaagaggguccacucccggagauagaagaugaaguuuuuagaaagcggaacuuaacgauaauggaucuacacccaggauccgggaagacuagacgauaccucccugcaauagugagagaagcgaucaaaagaaaauugcguaccuuaauucuggcaccgacaaggguaguagcuucggagauggcagaggcacuuaaaggcaugccaaucagguaccaaacgacugcggucaaaagcgaacauacagguaaagagauuguagaucuaaugugccaugcaaccuuuacaaugagauuauugucucccguaaggguuccaaacuacaacaugaucauaauggaugaggcucauuucacggacccuaguucuaucgcagcgagaggcuauauuucuacuagaguaggaaugggcgaagcagcagcuaucuucaugacggcaacgccuccagguagcgucgaagcauuuccgcaaucgaacgcugugauacaggaugaagaaagagauauuccugaaaggaguuggaauaguggucacgaauggauaacagauuuuccgggaaaaacugugugguucguaccaucaauaaaaucuggaaaugauauagcaaauuguuuaaggaaaaacggaaaaagaguaauacaacuaagucgaaagacuuucgauaccgaauaucagaaaacgaaaaauaaugauugggacuauguuguaacaacugauaucucugagaugggugccaauuuucgagcagacagaguuauagauccgcguaggugcuuaaaaccgguuauacuuaaagauggcccugagaggguaauauuagcuggaccgaugccaguuacaguagcaagugcagcacagagaagggguagaauuggacguaaucauaauaaggagggugaucaguauauuuauaugggacaaccucuaaauaaugaugaagaccacgcacacuggacagaagcgaaaaugcuacuagauaacauuaauacaccggaaggaaucauaccugcccucuucgaaccagaaagggagaaaagugcggcuauagacggcgaauauagacuaagaggcgaagcuaggaagacguuuguugaacuaaugagaagaggagacuuaccuguaugguuaucauauaaaguagcaucugaaggauuccaauauagugacaggagaugguguuuugauggcgaaaggaauaaccaagugcuagaggaaaauauggacguagaaauauggacaaaggaaggagaaagaaagaaacuaagaccccguuggcucgaugcgaggacuuauucugauccauuagcauugcgugaauuuaaggaauuugcagcggggcgaaggucuguaagcggagaucuaauucuagaaaucgguaaguuaccacagcacuuaacucaaagggcacagaaugcccucgauaauuuaguuaugcuucauaacagugagcaagggggcagagcguaucgacacgcaauggaggaauugccagauacaauagaaacccuaaugcugcuugcauuaauugcuguuuuaaccggaggcguaacgcuguucuuucuaucgggacgaggacuuggaaagaccaguauuggucuacuuugcguaauggcuagcuccguacuauuauggauggcaagcguugagccacauuggauugcugcguccauaaucuuagaauuuuuccucaugguucuguugauaccagagccggaccgccaaagaaccccgcaggauaaccagcuagcauauguuguaauaggacugcuauuuaugauucuaaccguagcagcuaaugaaauggggcuccuugaaaccacuaaaaaggaucugggaauaggacauguggccguugaaaaccaccaucaugcgaccauguuagauguagaucuacaucccgcgucugcguggacacuauacgccguagcaacaacaauuauuacaccaaugaugcgacacacuauugagaacacuaccgcgaacaucaguuuaacagcuauagcuaaccaagcggcgauacuuaugggauuagacaaaggcuggccaauuucuaaaauggacauaggaguuccauuacuugcauugggauguuauagucaaguaaaucccuuaacguuaacugcagcuguuuuaauguuaguagcgcacuaugcgauaaucggcccggguuuacaagcaaaggcuacgagagaagcccagaaaagaacagcagcaggaauaaugaagaauccgacaguggauggcauuguagccauugaucucgacccgguaguuuaugacgccaaauucgagaaacaacugggacaaaucaugcuauuaauauuguguacaucucaaauacuauuaaugagaacaacuugggcgcuuugugagaguauaacauuagcaacugggccucuuacaaccuuaugggaggguaguccaggcaaguucuggaacaccacaauagcagugaguauggccaacauauuucgggguaguuacuuagccggagcagguuuagcguuuucauuaaugaaaagccucggcgguggacgucggggaacaggagcucaaggcgaaacauuaggcgaaaaauggaaaagacagcucaaucaacuuucaaaaucagaauuuaacaucuacaagagaaguggaauaauggaaguagaucgaucagaagcaaaggaaggccucaagagaggagaaacuacucgacacgcaguuucaagaggaacugcaaaacugaggugguucguagagagaaauuuaguaaaaccagaagggaaagugauagacuuaggauguggacguggaggcuggucguacuacugcgcaggucuuaagaaagucacagaaguaaagggcuacacgaaggguggaccgggacacgaggaaccgauaccaauggccacuuauggauggaaucucguuaaacugcauucuggaaaagauguauuuuucacacccccggaaaaaugugacacacuauuaugugacauaggugaaucgucacccaauccgacgauagaggaaggccgcacacuccgcguacugaaaauggucgaaccguggcuuagaggaaaucaauuuugcauaaaaauacucaauccuuauaugccaagcgucguagaaacacucgagcagaugcaaagaaaauaugguggaauguugguaagaaacccucucucacgcaauagcacucaugaaauguacuggguuucaugugguacagguaacaucguaucagcaguuaauaugacaucccgcaugcuguuaaacagauucacgauggcacaucgaaaaccaaccuacgaacgugacgucgauuugggggcagguacgagacacguggcaguagaaccugagguggcuaacuuggauauaaucggacaaaggauagagaacauaaaacacgaacauaaaaguacuuggcauuaugacgaagauaauccauauaaaaccugggcguaucaugggucuuaugaagucaaacccaguggguccgcaaguuccauggucaacgguguuguaaaacuccuuacuaagcccugggacguuauacccauggucacacaaauagcaaugacagacacaacccccuuuggacaacaaagaguauuuaaagagaaagucgacacaaggacaccuaaagcuaaaagaggcacagcucagauaauggaaguaacagcuaggugguuauggggauuuuugucacgcaacaagaaaccgagaauaugcacucgggaagaauuuacucgcaagguuagauccaaugcagcaauaggcgcaguuuuuguagacgagaaucaauggaacucagcuaaagaagcgguugaagacgaaagauuuugggaucugguucagaaagaacgugaacuacacaaacaagguaagugugcaacuuguguguauaacaugaugggaaaaagagagaagaaauugggagaguuugggaaagcaaaaggaucaagagcaaucugguauaugugguuaggcgcucgauuccuagaguuugaggcacuuggauucaugaaugaagaucacugguuuucuagggaaaacucacuaaguggaguagaaggagaaggcuugcauaaacuuggcuauauauuaagagacauaaguaaaaucccuggagggaacauguacgcagacgacacugcaggaugggacacuagaauaacagaggaugaucuucagaaugaagcgaaaauaacagauauaauggaaccggaacaugcccuuuuagcuacuucaauuuuuaaguuaacguaucaaaauaaggugguacgaguucaacgacccgccaaaaacggaacagugauggacgugauaucacgaagagaccagagaggaaguggccaagucgggacuuauggacuaaacaccuucacgaacauggaagcacaauuaauucgacaaauggaaagcgaggguauauuuuuaccgagcgaacuagaaacaccaaaccuagcugaaagaguucuagauuggcuagaaaaauacggaguugaaagauugaaaagaauggcaauaaguggggaugauugcgugguaaaaccuauagaugacagauucgcaacagcuuugacugcccuaaaugacauggguaaaguucggaaagauauuccucaaugggagccaucuaaaggauggaaugauuggcagcagguuccguuuugcagccaucauuuccaucaauuaauuaugaaagauggucgagagauuguugugccaugcaggaaucaggaugaacugguaggcagagcaagaguaucacagggggcuggauggucacuacgggaaacugccuguuuaggcaaaucuuacgcccagauguggcaauuaauguauuuccaccguagagauuuaagacucgcagcaaacgcaauuuguucagcaguuccaguagacuggguucccacuucucgcacuacuuggaguauacacgcacaucaccaguggaugacaacggaagauaugcucucugucuggaauaggguauggaucgaagaaaaccccuggauggaagauaaaacacacgucuccucauggggagauguaccguaucuugguaaaagagaagaccaaugguguggcucucuuauuggccuaacugcuagggcaacaugggcaucgaacauacagguggcgauuaaccaaguuagacgauuaauaggaaacgaaaacuauuuagacuauaugacuucaaugaaaagauuuaaaaaugagggggauccugaaggagcccuaugguaa

SEQ ID NO: 21673 - RNA, 9879 nt, Artificial Sequence
  derived and/or modified CDS sequence (opt6) from DENV-1__GQ199795__SS-prME
agcguaacaauguuacucauguugaugccaacagcacuagcauuucaccuuacaacgagagggggcgaaccgcauaugauaguaucgaaacaagaacgcgguaaaagucuguuauuuaaaacauccgccggaguaaauauguguacgcucauagcaauggaccuaggugaauuaugugaagacacuaugacauauaaauguccgcgcauaacggaaacagaaccagacgauguagacugcuggugcaaugcaacagacacgugggugacuuaugguacuuguagucaaacaggcgagcaccguagagauaaacggagcguugccuuggccccacacguaggucuuggccuagaaacaagaacugaaacauggaugaguuccgaaggagcuuggaaacaaauucaaagaguagaaaccugggcauuaagacauccaggguuuacagugaucgcccuauucuuagcucaugccauagggacaaguauaacucagaaaggaauuauuuucauccugcuuaugcucguuacaccuucuauggcaaugcgaugugucggaauuggaucccgugauuucguagagggacuuaguggggcuacauggguugacgugguacuagaacacggaucgugcguaacaacaauggcuaaagauaaacccacccuugauauagaauuacuaaaaaccgagguuacaaauccagcaguuuuacguaaacucuguauagaagccaaaauaaguaauacaacuacggauucacguugcccuacacaaggagaagccacacuuguagaggaacaagacgcaaauuuuguguguagaagaaccuuuguggaccgcgggugggguaacgguuguggauuguucgggaaaggcucacuaauaacgugugcaaaauucaaauguguuacuaaacuugaaggaaaaauaguacaguacgaaaaccugaaauacucggucauugugacuguacauacuggagaccaacaccaaguaggaaacgagaguacagagcacggaacuacagcuacuauuacuccccaagccccgacaacagaaauccagcuaacugauuacggagcguugacccucgacugcucaccucguacaggucuugacuucaaugaaaugguacuucuaacaaugaaagaaaaaucauggcuaguacauaaacaaugguucuuagacuuaccucuucccuggacauccggugcaaguacaagccaagagacuuggaauaggcaagauuuguuagugacuuuuaaaacagcgcaugccaagaaacaagaaguuguaguucuuggaagccaagaaggcgcaaugcacaccgcucuuacaggugcuacagaaauucagacuagcgggacaaccacaauauucgccggccaccucaaaugucgguugaaaauggauaagcugacguugaagggaaugucauauguuaugugcacgggaucuuucaaacuagaaaaagagguggcagagacacaacacggaacaguucugguacagauaaaauacgaaggcacagacgcuccaugcaaaauccccuuuucaacgcaagaugagaaaggaguuacacaaaaugggcgacuuauuacggccaacccuauaguaacugauaaagaaaaaccgguuaacauagaggccgaacccccuuuuggagaaucauauauuguuauaggcgcuggagaaaaagcguuaaaacuaaguugguuuaagaaagguuccagcauugguaaaauguucgaggcuacagcacgaggugcaagaagaauggcaaucuugggagacaccgcaugggauuuugggucuauaggaggcguauucaccagcguaggaaagcugguacaccaaauauuuggcacggcuuacgggguacuauuuucagguguaaguuggacaaugaaaauuggcauagguguauuauugacgugguuaggucuaaacagucguucaacuagcuugucaaugacaugcaucgcgguuggcuuggugacgcuauacuuagggguuaugguacaagccgauagugguugcguuauaaacuggaaaggacgugaauugaaauguggaucagguauuuucguaacuaaugaaguucauacauggacagaacaauauaaguuucaagcugauagcccgaaacgucuaagugccgcaauuggaaaggcuugggaagaagggguguguggaauacguagugcuacgcgcuuagaaaauauaauguggaaacaaaucagcaacgaguuaaaucacauauuacuagaaaaugauaugaaguuuacaguaguagugggugauguagcagguauacuggcucaaggcaagaaaaugaucagaccacagccgauggaguauaaguauucguggaagucuugggguaaggcgaagauaauaggggcggauguacaaaacacaacuuuuauaauagacggucccaauacccccgaaugcccugaugaccagcgagcguggaauauuugggaaguagaagacuauggauuugguauuuuuacaacuaacauauggcucaaauuacgcgauagcuauacacaggucugugaucauagacuaaugucagcagcuauuaaggauucuaaggcagugcacgcagacaugggcuauuggauagagucagagaaaaaugagacauggaaauuagccagagccucauuuauugagguaaaaacaugcauauggccuaaaagucauacucuauggucaaacggagucuuggaaagcgaaaugauaauuccuaaaauauaugggggacccaucucccaacauaacuauaggccaggauauuuuacgcaggcggcagguccauggcauuuagguaagcuagaacuagacuucgauuugugugaagguacuacaguugucgucgacgagcauugugguaauaggggaccaucacuuaggacaaccacuguuacaggcaaaauaauucaugaauggugcuguagaaguugcacacuuccaccuuuaagauucagaggugaagauggcuguugguaugggauggaaauucguccggugaaggaaaaagaagaaaaucucguuaaaucaaugguaucagcagggagcggagaaguagauaguuucucccugggacuuuuaugcauaaguauaaugauugaagaggugaugcggagcagauggucacgacggaugcugaugacgggaacuuuagcggucuuuuucuuacugaucaugggucaacuaacuuggaaugaccuuauaagacuaugcauaaugguaggcgcaaaugcuucggaucgcaugggaauggggaccacauauuuggcccuuauggccacguuuaaaaugagaccuauguuugcuguaggccuacuauuuagaagauuaacgaguagagaaguacuuuuguuaacaauaggacucucucugguggccagcguugaacuuccgaauagucuggaagaacucggagauggcuuagcgaugggaauaaugauacuuaaauuguuaacggacuuucagucgcaucaguuaugggcuacauuacuaagccuuacauuuauaaagacuacuuuuagccuacacuacgcuuggaaaacuauggcuaugguacucucaaucguaucauuauuuccacuuugucugaguacuacaucacaaaagacuaccuggcucccaguccuucugggaucacuaggcuguaaaccuuugacuauguucuugauugcagaaaauaaaaucuggggacgacgcuccuggccuuuaaaugaggggauaauggccguugggauuguuucuauacuucuaucgagucugcugaaaaaugaugugccauuagcaggaccuuugauagcuggagguaugcuaauugcauguuacgucauuaguggaaguuccgcugaucuuaguuuagaaaaagcagcggaaguaaguugggaagaagaagcagaacauucuggagcgagucauaauaucuugguagagguacaagacgauggcacuaugaaaauaaaagaugaggagagggacgauacucuuacaauucuucugaaagcaacacuucuagcaguaucuggaguauacccacugagcauaccggcaacauuauuugucugguauuuuuggcagaaaaagaaacaaaggucaggugugcucugggacacaccuucaccuccagaagucgagcgugcaguauuagacgauggcauuuaucggauuaugcagagaggauuguuagguagaucgcaaguuggaguaggaguauuucaggaaaacguuuuucauaccauguggcauguaacuagaggggccguuuuaauguaucagggaaaacgcuuagaaccaaguugggcaagugucaagaaagauuuaaucucauaugggggagguuggcgguuacaggggucauggaauacgggagaggagguccaaguuauagcaguagagccuggcaaaaacccgaaaaauguacaaacugcaccaggcacauucaagaccccagagggugagguaggugcaaucgcguuagauuuuaaaccugguacgaguggaaguccaauagugaauagagagggaaaaauaguagggcuauauggcaacgggguaguuacgacuagcggcacauauguuuccgcaauagcacaagcgaaggccucacaagaagggccguuaccggagauagaggacgagguauuucgaaaaaggaaucugacaauaauggacuugcauccugguucuggaaaaacaagacguuaucugccagccauagucagagaggcuauaaaaagaaaauuacgcacauugauacuagcaccaacacgagugguggcguccgaaauggcugaagcccuaaaagguaugcccauucgcuaccaaacaacagcaguaaaaucagaacacacugggaaagaaauaguugaucugaugugucaugcuacguucacuaugcgacugcucagcccuguacgagugccaaauuacaauaugauaauuauggaugaagcacauuuuacagauccaucuucaauugccgcuagaggauauauuucaacgcgaguugggaugggugaagcggcugccauuuuuaugacagcaaccccgccuggauccguagaagcauuuccacagaguaacgcaguuauacaagacgaggaaagggauaucccagaaaggucauggaauaguggauaugaguggauuacagauuuuccagggaaaacugugugguuuguacccucaauuaaaagcgguaacgauauugccaacugucuaaggaaaaauggaaaacgaguaauacaauuaaguagaaagacguucgacacagaauaccagaaaaccaaaaacaacgauugggauuacgucguuaccacugauauaucggagaugggugcuaacuuccgcgcggacagaguaauagauccaagaagaugucugaagccaguuauauugaaagauggcccagaaaggguuauacucgcaggaccaaugccaguaacgguugcuucugcggcccagagacgagguagaauaggucguaaccacaacaaagaaggagaccaauacauuuacaugggacagccgcuaaauaacgacgaagaccaugcacacuggacagaggcuaaaaugcuauuagauaauauuaacacucccgaaggaauuauuccugccuuauuugaacccgagcgugagaagucagcugcaauagauggggaauaccguuugagaggagaagcacgaaaaacauuuguugaacucaugaggcguggagaucuaccuguauggcuaagcuauaaaguagcuucagaaggcuuccaauauagugaccgccgaugguguuuugacggagaacgaaauaaucaagugcuagaagaaaacauggauguugaaaucuggacgaaagaaggggaaaggaagaaacuaagaccccgaugguuggaugcacggacguacuccgacccgcuugcguuaagggaguuuaaggaauuugcagcagguagacggucaguuucaggagaccuuauucucgagaucggaaaguugccacaacacuuaacacaaagagcacaaaacgcauuagauaaucuagugaugcuacauaacagugagcaaggaggacgagcauaucgacaugcuauggaagaauuaccugauacuauagaaacauuaauguuacucgcacugauagcgguucuaacagggggcgugacacucuucuuuuuaucagggcgaggucuaggcaaaaccaguauagggcugcuuuguguuauggcaaguagugugcuauuauggauggcaucaguugaaccgcacuggauagcggcaucuaucaucuuagaauuuuucuugaugguuuuacuaauaccugaaccagacagacaaagaaccccgcaagacaaccaacucgcguaugucguaauaggucuguuauucaugauucugacaguagcugcuaacgaaaugggacuccuagaaaccacgaagaaagaucuaggcauaggucacguagcaguagagaaucaucaccacgcagcaaugcuggauguugaucuucacccugcgucagcuuggacacuguaugcgguagcaacaacgauaaucacaccgaugaugcgacacacuauagaaaauacaacagcaaauauaucacucacugccauagccaaccaagccgcuauauuaaugggauuagauaaagguuggccuauaucaaaaauggauaucggaguaccacuauuggcacuaggcuguuacucucaaguaaacccacuaacuuuaacagccgcugucuuaaugcucguagcacacuaugcuauuaucggaccaggccuacaagcaaaagcuacaagagaagcucagaaaagaacagcugcuggcaucaugaagaacccgaccguagacggcauaguggccaucgauuuggauccgguuguauacgaugcuaaauuugaaaaacaguuagggcagaucauguuauuaaucuuauguaccucccaaauccugcuaaugagaacaacaugggcgcugugugaaucgauuacauuagcuaccggcccguugacuacuuuaugggaaggaaguccggguaaauuuuggaacacuacaauugcggucuccauggccaauauuuucagagguuccuacuuagccggagcaggguuggcauuuucgcuaaugaaaucccuaggggguggucgucgcggaacuggggcgcaaggagaaacauugggggaaaaauggaagcggcaacuaaaucaauuaucaaaaagcgaguuuaacacuuacaaacguucugguaucauggaggucgaccgaucagaagcaaaagagggccucaagcguggagaaacaacuaaacacgcuguuucccgagggacggcuaaacuaaggugguucgucgagaggaaucuagucaaaccagaggguaaaguuauagaccucggaugcggccgcggcgguuggucguauuauugugcaggacuuaaaaagguaacagagguuaaagguuauacuaaaggugguccaggucacgaagacccaauaccuauggcaacauauggauggaaucuagugaaguuacauucaggaaaagaugucuuuuucauaccuccagaaaaaugugauacuuuacuuugugacauaggcgagucaucgccaaaccccacaaucgaggaaggcagaacacuacgaguucuaaaaaugguagagccuuggcuuagaggaaaucaauucuguaucaagauauuaaauccauacaugccuucaguuguagagacacuugaacaaaugcaacguaaacauggugggauguuaguucgaaauccuuuaucuagaaauuccacacaugaaauguacuggguaucaugcggaacaggaaauaucgucucugcagugaacaugacuagccgaauguuauuaaaucgauucacaauggcgcaucgcaagcccacguacgaaagagacguugaccuaggagcuggaacccgacauguggccguugaaccugaaguagccaauuuagacauaauuggacagagaauagaaaauauaaagcaugaacauaaguccacauggcauuacgaugaggauaacccguauaaaacaugggcuuaucauggcucuuacgaagucaaacccagcggauccgccucgagcauggugaauggcguaguaaaauuacuuacgaagccuugggauguaauaccaaugguuacgcaaauagcuaugacggauacaacgcccuuuggccaacagagaguauuuaaggaaaaaguagauacuaggacuccaaaagcaaaacgagguacugcucaaauuauggaagucacugcaaaaugguuguggggauuuuuaucgcgcaauaaaaagcccagaauauguacacgcgaagaauuuacgcgaaaagugcguucgaacgcugcgaucggcgcaguguuuguggacgaaaaucaauggaacucggcaaaagaagcagucgaagacgaaagauucugggauuuaguacacagggagagagaauuacauaaacaaggaaagugcgcuacuuguguauacaauaugaugggcaagcgcgagaagaaauuaggcgaguucgguaaagccaaagggagcagagcuaucugguauaugugguugggagcuagauuuuuagaguuugaagcgcucggcuuuaugaaugaagaucauugguucaguagggagaacucacuauccggaguagaaggugaagggcuccacaaguugggcuacauauugagagacaucucaaaaauuccuggaggcaauauguacgcagaugacacggcaggaugggacacacgaauaacggaggaugaucugcaaaaugaagcaagaauaacagauauuauggaaccagaacaugcacuucuugcaaagaguauuuuuaagcuaacauaucaaaauaagguaguucguguucagcgaccugcuaaaaaugguacaguaauggaugucauaagucgaagagaucaacgcgguaguggacagguagggacuuacggacuaaauacuuuuacaaauauggaagcacagcucauaaggcagauggaaucagaagguauauucuccccauccgaauuagaaacaccuaacuuagcagaaagaguuuuagacuggcuggaaaaauacggagucgagagacuuaagaggauggcaaucucuggugacgauuguguaguaaaacccauugaugaccgauuugcgacugcucucaccgcgcuaaaugacaugggcaagguucgaaaggauauaccacaaugggaaccaucaaaaggcuggaacgauuggcaacaaguucccuuuuguucacaccacuuccaccaacuaauaaugaaagauggaagagagauuguaguuccaugccgaaaccaagacgagcuagucggacgugcaagagucucucaaggggcaggauggagucuacgggagaccgcaugccuugguaaaucauaugcccaaauguggcaauuaauguauuuucauagacgggauuugcgacuagcggcuaacgcaauauguucagcaguaccuguugacuggauucccacgucucgcacuacauggagcauacaugcacaucaucaguggaugaccacugaagacauguugucaguuuggaauagagucuggauugaagaaaacccauggauggaggauaaaacgcauauaaguaguuggggagacguaccguacuuggguaaaagagaagaccaguggugugguagcuugauuggauuaacagcucgagcaacaugggcaaccaauauucaggucgcuauaaaucaagugaggcgacuuauaggcaacgaaaauuaucuagacuacaugaccagcaugaagcgauuuaaaaaugagucagauccagagggggcucuuugguga

SEQ ID NO: 21674 - RNA, 9873 nt, Artificial Sequence
  derived and/or modified CDS sequence (opt6) from DENV-1__FJ882547__SS-prME
aguguuacgauguugcuaauguugaugccaacagcguuagcuuuccaucuuacgacacgggguggugaaccucacaugauugugucuaaacaagaaagaggaaaaagucuacuguuuaaaacaagugcugggguuaauaugugcacacuaauagcaauggaccuaggagaauugugcgaagacacuaugaccuauaaaugcccgagaauaacggaagcggaaccugaugauguggauuguuggugcaaugcaacagacacuuggguaacauaugguacuugcagccaaacaggggaacaucgaagagauaaaagaagcguagcauuagcaccacacgugggacuaggucuugaaacuagaacagaaacauggaugagcuccgaaggagcuuggaaacaaauacaacgaguggaaacuugggcgcugagacacccuggguucacaguaaucgcacucuuccuagcacacgcgauaggaacguccauaacacaaaaagguauaauauucauccuacucaugcucguaacuccaucaauggcuaugcgauguguugguaucgggucacgagacuuuguagaaggguuaaguggagcaacguggguugauguaguucuagaacauggaucgugcguaacaacaauggcaaaagacaaaccaacguuagauauagaacucuuaaaaacagaaguuacuaaucccgcuguacuaagaaaacuguguauugaagcgaaaauuucgaauacaacgaccgauucccgcugucccacacaaggugaagcgacucuaguagaagaacaagacgcaaacuuuguuugucgacgaacauuuguugacagaggauggggaaacgggugcggucuauucgguaaagggagccuaauuacuugugcgaaauuuaaauguguuaccaaauuagaaggcaaaauagugcaguaugaaaaucuuaaauauagugugauagucacaguucauacuggagaucaacaucaaguagguaaugaaaguaccgaacauggaacuacagcuacuauuacgccgcaggcuccaacaacagaaauccaauuaacggacuacggugcacuuacacuagauuguucaccccgaacuggacuagauuuuaaugaaaugguccucuugacaaugaaagaaaaauccugguugguucacaaacaaugguuuuuagaucuaccacugccauggacaucaggugcguccacaagccaagagaccuggaauagacaagacuuacucguaaccuucaaaacugcacaugccaagaaacaagaaguaguagugcucggaagccaagagggggcaaugcacaccgcgcuaacaggcgcuacagaaauccagacaucagguacaacgacaauuuucgcgggccauuuaaaaugcagguugaaaauggauaaauuaacucuuaaagguaugaguuauguaaugugcaccgggagcuuuaaacuagaaaaagaagucgcugaaacgcagcauggaacaguccuagugcaaaucaaauacgaaggcacugacgcuccauguaaaauacccuucaguacucaggacgaaaaagguguaacacaaaacgggagacucaucacagcuaacccaauugucacagacaaggaaaaaccaguaaauauugaggcggaaccuccuuuuggagaaaguuacauaguaauuggagcuggagaaaaagcguugaaauuaucuugguuuaagaaaggaaguagcaucgggaaaauguuugaagcuacugcacgcggcgccaggcggauggcgauucuaggggauacugccugggacuuuggaucaaucgggggaguuuucacgaguguugguaagcugguacaccaaauauuuggaaccgcuuacggaguuuuguuuaguggagucagcuggacgaugaaaauaggaauagguguacucuuaacuugguuaggacuaaauucgagguccacuucacuuaguaugacguguaucgcuguaggucugguaacucuauauuuagggguaaugguccaggccgauucgggaugcguaauaaauuggaaaggucgggaacuaaaaugcgggucagguauauuugugacgaaugaaguucauacuuggacagaacaauauaaguuccaagccgacucuccaaaaagguugagugcggcgauugguaaggcuugggaagagggcgugugugguauucgauccgcaacgcgucuagaaaauauuauguggaaacaaaucucuaacgaacuaaaucacauauuacuagaaaacgacaugaaacuaaccgugguaguaggugacguagccgguauacuuggucaagguaagaaaaugauaagaccucagccuauggaguauaaauacucuuggaaaucguggggcaaagcaaaaauuauaggcgcagaugcccaaaauacgacuuucauaauagacgguccuaacacgccugaauguccagaugaucaacgagccuggaauauuugggaaguugaggauuacgguuuuggaauuuucaccacaaauauaugguuaaaauuaagggauuccuacacacaaguuugugaccaucgguugaugucugccgcaauaaaggauuccaaagcagugcacgcugauaugggauauuggauugaaucagagaaaaaugaaacauggaaacuagcuagagcaucguuuaucgaaguaaagacgugcauuuggccaaagagccauacacuauggaguaaugguguguuagaaucagaaaugauaaucccgaagauauaugggggucccauaucucaacauaauuauagacccgguuacuuuacacaaacagcagggccauggcacuugggaaaacuagagcucgauuuugacuugugugaaggaaccacaguuguuguagacgaacacugcgguaacaggggaccaucucuuaggacaacuacaguuacagggaaaauuauucaugaauggugcugccgaucauguacucugccaccuuuacgguuucgcggugaagaugguugcugguaugguauggagauccgaccaguaaaagagaaagaagaaaaccuaguaaaaagcaugguauccgcuggaucaggagaaguagacaguuuuagcuuaggauuacucuguauaagcauuaugauagaggaaguuaugcgauccagauggaguaggaaaaugcuaaugacuggcacgcuagcuguauuuuuccuacucauaaugggacaacuaaccuggaaugaucucauccgcuuaugcauaauggucggugcgaaugcauccgaucguaugggaauuggaacuacuuaucuugcacuaauggcuacguuuaaaaugcgucccauguuugcaguaggucuuuuauucagacgacugaccucaagagaaguauuacuuuugaccauugggcuaucacuuguagcaucuguugaacuaccaaacucucuagaagaacucggugacggguuagcaauggguauaaugaugcuaaaauuacuuacagacuuucagagccaucaacuuugggcuacuuuacuaucucugacuuucauaaaaacgacauuuagucuacauuacgcguggaaaacgauggcuaugguauuaagcauagugagucuuuuuccauuaugucuuucgacuacaucgcaaaagacaacgugguuaccgguauuacugggaucauuaggaugcaagccauuaacgauguucuuaaucgccgaaaacaaaauauggggccgaaagucguggccguugaacgaaggaauaauggcagucggaaucguaucuauucuucuguccucguuauugaaaaaugacguaccgcuagcagguccacuaaucgccggugguauguuaauugcaugcuauguaauaucuggauccagcgcagaucuuucauuagaaaaagcggcggaaguaagcugggaagaagaagcagagcauucuggggcgucccauaacauacugguagagguacaagacgaugguacgaugaaaaucaaggacgaggagagggacgauacgcuaaccaucuuacuaaaagcuaccuugcucgcaguuagcgguguguauccacuuucaaucccagcuacucuuuuuguaugguacuucuggcagaagaagaaacaaagaagugguguacuaugggacacuccgucacccccugagguugaaagggccguacuugaugauggaauuuacagaauaaugcagagaggucuacuaggaagaucacagguagguguaggugucuuucaagaaaauguauuucauacuauguggcaugucacccguggcgccguucuuauguaccaagggaaacgacuggagccaucgugggcgucaguuaagaaagauuuaauaaguuacgguggaggcuggcgucugcgagguucguggaacacaggugaagaagugcagguuauagcaguugagccaggcaaaaauccgaaaaauguacaaacagcaccugggacauucaaaaccccagaaggagaaguaggugccaucgcacuagauuuuaaaccuggaacuucagguaguccaaucguaaaucgagagggaaaaauaguaggucuuuauggaaauggaguuguuacuacgagcgguacauauguaucagcaauagcacaagcuaaagcgucccaggaggguccccuaccagagaucgaggaugaagucuuccgaaagcguaaccuaacuauuauggauuugcauccagguagcggaaagacacgacguuaucuacccgcuaucgugagagaagcaauaaaacguaaauuaagaacgcuaauacucgcaccaacuagagucguugcuucugaaauggcugaggcuuuaaagggcaugcccauacgcuaccagaccacagccguaaaaucagaacacacagggaaggaaauagucgaccuuaugugucaugccacauuuacaaugagguuauuaucgccagugagaguaccuaauuacaauaugauuauuauggacgaagcgcauuucacggacccaaguaguauagcagcccgagguuauauaucuacaagaguggguaugggugaagcagcggcuauauucaugacagcaacaccgccaggaucgguugaggcuuuuccucaauccaaugcagugauacaggacgaagaacgugauauuccggaaaggagcuggaacucaggauacgaauggauaacagauuuccccggaaaaacuguaugguucguuccaagcauuaagucaggaaacgacauagccaauugucuacgcaaaaauggcaaacgugugauccaacuaaguagaaaaacauucgacacggaauaccagaaaaccaaaaacaacgacugggacuaugucguuacaaccgacauuucugagaugggugcuaauuuucgggcggaccgagucauagaccccaggagauguuugaaacccgugauauuaaaagaugguccggaacguguuaucuuggccggaccaaugccugugacuguugccagugcugcacagaggcgagggcgcauuggacgaaaucacaauaaggagggagaucaauacauuuauaugggacaaccucuaaacaaugaugaagaccaugcacacuggaccgaggccaaaaugcuccucgauaacauuaauacaccagaagggauuauaccagcuuuauucgaaccugaaagagaaaagucagcggcaguagacggagaauauagauugcguggugaggcccguaagacguucguggaacugaugcggcggggagaucuucccguaugguuauccuacaaaguugccagcgaaggauuucaguauagcgaucgacguugguguuucgauggcgaacguaauaaucaagugcuagaagagaauauggacguagagaucuggacaaaagaaggugaagguaagaaacuacgaccaaggugguuggaugcgcgcacauauucugauccauuagcccuucgugaauuuaaagaauuugccgcagguaggagaucugucagcggagaccucauacucgaaauaggcaagcuaccgcaacauuugacgcaaagagcgcagaacgcucucgauaauuuaguaaugcuacacaauagcgaacaagguggacgagcauauagacacgcaauggaagaacuacccgauacgaucgaaacauuaaugcuacuugcacuuauugcaguguugacaggcggagucacgcuguuuuuccugucagggaggggauugggaaaaaccagcauuggguuauugugcguuauggcaucuuccguccugcuguggauggcaaguguagaaccgcacuggauugcggcuuccauaauucucgaguucuuucucaugguacugcuuauuccugagcccgaccgacaacggacaccacaagauaaucaauuagcguauguaguaauagguuuacucuucaugauacuuacugucgcagcgaaugaaaugggguuguuagaaacaacgaagaaagaucucggaauagggcauguugcuguggaaaaccaccaucaugcagccaugcuggauguugaucuucauccagcuucagcauggacccuauaugcuguugcaacgacaaucauaacuccuaugaugaggcauacuauagagaacaccacagcaaacauuucccugaccgcuauagcuaaucaagcagcaauuuuaaugggacuugauaaaggauggccaauuaguaaaauggacaucgguguccccuuauuagcucugggguguuauucgcaagucaacccacuaaccuugacggccgcuguuuuaaugcuaguagcacauuaugcuaucaucggucccgguuugcaagccaaagcgacaagggaagcucaaaaacguaccgcagcuggaauaaugaaaaauccaacuguagaugggauugucgcgaucgaccuugauccuguuguauaugaugcaaaguuugaaaaacaauugggacagauaaugcuguuaauucuauguacuucucaaauauuacuaaugcguacuaccugggcacuuugcgagaguauaacacuugcaaccggacccuuaacuacauugugggaaggaagcccaggcaaauuuuggaacacuacuaucgcaguuucuauggcuaauauuuuccgcggcucauaccuagccggugcuggcuuagcuuuuucacuaaugaagucauuaggaggaggacgaagagggaccggcgcucaaggcgaaacauuaggugagaaauggaaacggcaacuaaaucaacucucaaaaucugaauuuaacacuuauaaacggucugggauaauggaagucgaccggagcgaagcaaaagaaggguuaaaaagaggagaaacuacaaaacacgccgucucaagaggcacagcgaaacuuagaugguuugucgaacgaaacuuagucaaaccugaaggaaaaguaauagaucuagguuguggacgaggcggauggaguuacuacugcgcaggucuuaaaaagguaacagaagucaaaggguauacaaaaggugguccugggcaugaagaacccauaccuauggccacuuauggcuggaaucucguuaaauuacauucgggaaaagacgucuucuuuaucccuccagagaaaugcgauacucuauuaugcgauaucggugaaucuucaccuaacccaacaauagaagagggcaggacuuugaggguguugaaaaugguggaaccuuggcugcgugguaaccaauucuguauuaagauauuaaauccuuauaugccaagcguuguagaaacucuagaacaaaugcaaagaaaacacggugguauguuggugagaaauccauuaucuagaaauucaacucaugaaauguacugggucucuugugguaccgguaauauaguaagcgcaguaaauaugacaaguagaaugcuuuugaaucgauuuacuauggcacauagaaagccaacauacgaacgagaugucgauuugggaacaggaacgcgacauguagccguagaacccgaaguggcaaauuuggauauaauaggccagcggauagaaaauauuaagcaugagcauaaauccacauggcacuaugaugaagauaacccauauaaaaccugggccuaccacggaaguuacgaagugaagccuuccgguagcgccaguagcaugguaaacggcguugugaaauuacugacaaaacccugggauguaauuccaaugucuccaaucgcaaugacggacacgacacccuuagcacaacggguauucaaggagaaaguagauacccgaacgccgaaagcaaagaggggcaccgcccagaucauggaggugacugcucgguggcucuggggauuuuuaucaaggaauaagaaaccgagaauuuguacaagagaagaauuuacucguaaaguucgauccaacgccgcaauaggggcaguauuuguagacgaaaaucaauggaacucggcuaaagaagcgguugaagaugaaagguucugggacuugguacauagagaaagagaauugcauaaacaaggaaaaugugcuaccugcguuuauaauaugaugggaaaaagagagaagaaauugggcgaauuugggaaagcaaaaggaaguagagcuauuugguauauguggcuuggagcaagauuuuuagaauuugaggcauuaggguuuaugaacgaagaucacugguucucgcgagaaaauucucuaucaggugucgagggggagggucuucauaaauuagguuauauacuaagagauauuucuaagaucccgggaggaaauauguacgcagacgacacagcaggaugggauaccagaauaacugaggaugauuuacagaacgaagcgaaaauaaccgacauaauggaaccugaacacgcccuucuggcaaaagccauuuuuaaauugacauaucagaauaaaguuguacgcguacaaaggccagccaaaaauggaacgguaauggaugucauuucaagaagggaccaaagagggucaggucagguugggacguauggcuuaaacacauuuacgaacauggaagcacaguuaauuagacagauggagagugaagaaauauucucacccagcgaacuugagacaccaaacuuagcagaacgugcccuagauugguuagaaaaauacggaguggagagacuaaaaagaauggcaaucuccggagaugauugcgucgucaagccuaucgaugacagguuugccaccgcuuuaacagcucugaacgauaugggcaagguaagaaaggauauuccacagugggaaccaucaaaagguuggaaugauuggcaacaggucccauuuugcucacaucauuuccaucagcucaucaugaaggauggacgagaaauaguuguaccaugccgaaaucaggaugagcuagucgguagggcuaggguaucucaaggagcugguuggucuuuaagagaaacagccuguuuaggaaaaucauacgcccaaauguggcaauuaauguacuuucauagaagagacuuaagauuggcagcgaacgcaauaugcuccgcagugccaguggauuggguaccuacgucaagaacaacauggucgauacaugcacaccaucaauggaugacuacagaagauauguugucagucuggaauagaguuuggaucgaagaaaauccauggauggaggauaaaacccauauaagcucaugggaggauguuccguaucuaggcaagcgagaagaucaauggugcgggucacugaucggucuaacagcaagagcaacgugggcaacuaauauacaaguagcaaucaaucagguuagaagauuaauugggaaugagaauuauuuggauuacaugacuagcaugaaaagauucaagaaugaaucggacccagaaggagcauuaugguaa

SEQ ID NO: 21675 - RNA, 9879 nt, Artificial Sequence
  derived and/or modified CDS sequence (opt6) from DENV-1__GQ199797__SS-prME
ucuguaacuauguuacugaugcugaugccgacagcauuggcguuucauuuaacaacgagagggggagagccccauaugaucguauccaaacaagaacgggguaaaucuuuauuauuuaaaacaucagcaggaguaaacauguguacacugauagcaauggaucugggggaauuuugugaggauacgaugacauauaaaugcccaaggauuacagaggcagaaccagaugacguggauugcugguguaacgcuacagacacauggguuacauaugggacguguucgcaaaccggggaacaccgccgugauaaacgaagcgucgcucuugcgccccaugucgguuugggguuggaaacucgaaccgaaacauggaugucaagugaaggggcauggaaacaaauucaaaggguagaaacaugggcuuugcgacacccaggauucacggugauugcuuuauuucuagcacaugcaauaggaacaaguauaacacaaaaaggcauuaucuucauauugcuaaugcuuguaacuccuucuauggcgaugcgauguguagguauaggaucacgcgauuuuguugaaggauuaucuggagcgacuuggguugacguuguacuugaacauggaagcugugucacgacuauggcaaaagacaaaccaacucuggauaucgaauuauugaaaacugaagugacuaaucccgcggucuuaagaaaauuaugcauagaagcgaaaauaagcaauaccacgacagacaguagaugcccgacucaaggagaggcgacacuuguggaagaacaagacgcaaacuucguuugcagaagaacuuuuguggauagaggauggggaaauggaugugguuuauuuggcaaaggauccuuaauuaccugugcuaaauuuaaaugcguaacuaaacuagaaggaaaaacgguacaauacgagaauuugaaauauaguguuauaguuacaguccacacaggugaucaacaccaaguagguaacgaaucuaccgaacaugggacuacggcaacaauuacaccccaggcaccauccacugaaauacaacugacagauuacggagcacucacauuagauugcucaccaagaaccggacuggauuuuaaugaaaugguauugcuaacgaugaaagagaaaaguugguuaguucauaaacagugguuuuuagacuuaccacucccuuggacaaguggagcgucuacuucucaggaaacauggaaccggaaagacuuauuagucacguuuaaaaccgcacaugccaagaaacaggaaguaguaguauuagggucucaagaaggagccaugcauacugcauuaacuggggcuacugaaauacagaccagcgggacaacaacaauauuugcaggacacuugaaauguaggcuaaaaauggacaaacuaacgcuuaaagguaugucuuauguaauguguaccggcagcuucaaauuagagaaagagguagccgagacccaacacggaacgguauuagugcaaauaaaauacgaaggcacagacgccccuugcaaaauaccguucucaacccaagaugaaaaagguguaacgcaaaacggccguuugauaacugcuaaucccauagucaccgacaaagagaaaccaguuaauauugaagcagaaccaccguuuggcgaaucuuacauaguaaucggggccggugaaaaggcuuuaaaacugucaugguuuaaaaagggaaguagcauuggaaaaauguuugaagccacagcacguggagcucguaggauggccauuuuaggggauacagcuugggauuuugggucuaucggaggaguuuucacuucaguagggaagcugguucaucaaauauuuggaacggccuauggcguauuauuuucuggggucucauggaccaugaaaauagguaucgggguauugcuuacaugguuaggucuaaauucucgauccacgucgcucucaaugacguguauagcaguaggguugguuacgcucuacuuagguguaaugguucaggcagacuccggcugcgucauuaauuggaaaggaagggagcuaaaaugcggaagcgggauauuuguuacuaaugaggugcacacguggacugaacaguauaaauuucaagcugacucacccaaaaggcuaucggcggcaauugggaaagcaugggaagaaggaguauguggaauaagaagugcuacaagguuagaaaacauaauguggaaacaaauaagcaaugaacuaaaucauauacugcucgagaaugacaugaaauuuacgguugugguaggugacguggcaggaauauuagcacaggguaagaaaaugauaagaccucaaccaauggaauauaaauauuccuggaaaucauggggcaaagcaaaaauuauaggagcagacguacaaaauacaacuuucaucauugacgggccuaauacaccugaauguccagaugaucaaagagcuuggaauauuugggaaguggaagauuauggauuuggaauauuuacuacaaauauauggcuuaaauuaagagauaguuauacgcaagugugugaucacagacuuaugucagccgcuauaaaggacucaaaagcaguacacgcggauaugggcuauuggaucgaaagugaaaagaacgaaacuuggaaacuugcacgagcaucguucauagagguaaaaaccugcauuuggccaaaaucccacacauuauggucaaauggcgugcucgagucggaaaugauaauucccaaaauuuacgguggcccaauuucacaacauaacuauagaccuggguauuucacccagacugcaggaccuuggcacuuaggcaaacuggaauuagacuucgauuugugcgaaggaacuacuguaguuguagacgagcauugcgguaauagagggccaucauuacgcacaacaaccguaaccggcaagauaauacacgaauggugcuguaggucuugcacgcucccuccacuacguuuuaagggugaggacggauguugguauggaauggagauucggccaguaaaagaaaaagaagaaaauuugguaaagucaauggugagugcgggcagcggggagguagauaguuuuucuuuaggauugcuuuguaucuccaucaugauugaagaagugaugcgcucaagguggucccgaaaaauguuaaugacuggaacacucgcaguuuucuuuuuacuuauaaugggacaacucacguggaaugaccuaauucgccuaugcauuauggucggugcaaaugcaagcgauagaauggguaugggcacuaccuacuuagcucucauggcgacauuuaaaaugagaccgauguuugccguaggauuauuauuucgacgccuaacauccagagaaguauuacuuuugacaauaggguuaucuuuaguggcauccguagaacucccaaauagcuuggaagaguuaggagacggauuagcgaugggaauuaugauacucaaauugcucacagauuuucaaucucaccaacuaugggcuacacuuuugucacuaaccuuuauaaaaacaacauuuucguuacauuacgcauggaaaacuauggcaaugguccuuaguauuguaagccucuuuccucuuugccucaguacgacaucacagaaaacuaccuggcugccaguacuauuaggaucacugggcuguaaaccuuugacuauguuccuaaucgcagagaauaaaauuuggggucgaaaaaguuggcccuugaacgaaggcauuauggcuguuggaauaguaucaauucuuuuaucuucacuauuaaagaacgacgugccucuagcagguccauugauagcaggggguaugcuaauagccuguuauguaauaucuggaucgagcgcugaccuaagccuugaaaaagccgcagaggugaguugggaagaagaggccgaacacucaggagcgucacauaacauacugguagaaguucaagaugaugggacgaugaaaauaaaggaugaagaaagggaugauacgcuaacuauccuguugaaagcaacacuacuagcaguaucagguguauauccgcuuucaauacccgccacacuuuuuguuugguacuuuuggcagaagaagaaacaacgaagcggcgugcuaugggacacgccuagcccaccagaaguagaaagagcaguuuuggacgacggcauauacagaauaaugcaaagaggcuuauuggguagaucccagguaggcguuggagucuuucaagaaaauguuuuucauacuauguggcacgugacacgaggagcagucuuaauguaucaagguaaaagacuagaaccaucaugggcgagugucaaaaaggaucugauuuccuaugggggcggauggagacuccaggguuccuggaacaccggagaagaaguacaaguaauagcagucgaacccggcaaaaaucccaaaaauguucaaacugcaccaggcaccuucaagacaucugaaggcgaagucggagcaauugcauuagauuucaagccuggaacaaguggcaguccaaucguuaaucgagaaggaaagauuguaggcuuauauggaaauggugugguuaccacuagcgguacguacguauccgcaauagcccaggcaaaggcuucacaggaaggaccacuccccgaaauugaagaugaaguguucaggaagaggaaucucacaauaauggaccuacacccugguuccgggaagacgagacgauacuuaccugcaauaguuagggaagcaauaaaacguaaauuacggacuuugauacucgccccaacuagaguaguagcaagugaaauggcggaagcacuaaaaggaaugcccauacguuaccaaacaacagccguaaagucagaacauacaggaaaggaaauaguagaucuaaugugucaugcaacauucacuaugcggcuauuaagcccgguacgagugccuaauuacaauaugauaauuauggacgaagcucauuucacagauccgagcaguauagcagcgcgaggguacauuagcacucgagugggaaugggcgaagcagccgcgaucuucaugacggcgacacccccaggcaguguagaagcauuuccucaaucgaacgcggucauucaggacgaagaaagagauauuccggagcggagcuggaacucugguuaugaauggauuaccgacuuccccgguaaaacaguuugguuugucccuaguauuaaauccggaaacgacauugccaauugucuuaggaaaaacgggaagcgaguuauccaguuaucuagaaaaacauuugauacagaauaucagaaaaccaaaaauaaugauugggacuacguaguuacuaccgacauaucagaaaugggagcgaacuuucgugcggaucgcgucauagacccacgccgauguuuaaaaccaguaauauuaaaggauggacccgagaggguuauuuuagcaggaccuaugccugugacaguagcaagugccgcccaaaggcgcgggcgaauaggacgcaaucacaauaaggaaggagaccaauauauuuauaugggacaaccacugaacaaugacgaggaccaugcacacuggacagaagcuaaaaugcuacuagacaauauuaacacuccagaaggaaucauuccggcacuguucgaaccagaacgugagaaaucagcagcaaucgauggugaauacagauugcgaggugaagcacgaaaaacuuuuguugaguuaaugcgcagaggagaucuccccguuugguuaucauauaaaguagccuccgaggguuuucaauauucugaucgccgaugguguuuugacggagagcgcaacaaucaaguguuagaagaaaauauggauguugaaauauggacaaaggagggagaaaggaagaaacuacgcccaagaugguuagaugcacggacauacucggacccuuuagcacuaagagaguucaaagaauuugcagcaggacguaggucaguaucaggggaucucauucucgaaauaggaaagcucccacagcaccucacgcaacgcgcacaaaacgcacuagauaauuuaguaauguuacauaauucggagcagggaggcagagcguacaggcaugcaauggaagaacuuccugauacuauagaaaccaugaugcuccuagcguuaaucgcagucuuaacugggggaguaaccuuguuuuuccuaucuggcagaggacuuggaaaaacaucgauaggacuguuaugcguuauggcuuccaguguucuacuguggauggcuuccguagaaccacacuggauagcggcgucaauuaucuuagaauuuuucuuaaugguauuguuaauccccgagccagauaggcaaaggacuccacaggauaaccaguuggcauacguagugauuggacuauuauuuaugauacuuacuguugcggcgaaugaaaugggauuacuugagaccacaaagaaagaucuaggcaucggucauguggccgucgagaaccaccaucaugcagcaaugcuagacguugaccuucauccagcuagugcauggacucuuuaugcgguagcuacuacuauaauaacuccaaugaugagacauaccauugagaauacgacggcuaauaucucccuuacagccauagccaaucaagcagcaauacuuaugggacuggauaaagguuggccgauuucaaaaauggacauaggcgucccacuacucgcauuaggaugcuauucacaaguaaauccacugacuuuaacugccgcuguuuuaauguuaguagcacauuacgcgauaaucggaccgggauugcaggccaaagcaacacgagaagcucaaaagcgaacugcagcagggauuaugaaaaacccuacugucgacggaauaguagccauugacuuagacccagucgucuacgaugcuaaauuugagaagcaacuaggucaaauuaugcuacugauauuauguaccagucaaauauuauuaaugagaacuacaugggcacuuugugagagcauaacauuggcgaccggucccuuaacuaccuugugggaaggaucaccuggaaaauuuuggaauaccacaauagcgguuucuauggcaaacauuuuucgugggucauaccuagcuggagcagggcuagccuucucauuaaugaagucuuuaggagggggccgccgagguacgggagcacaaggggaaacacucggagaaaaguggaaaagacagcugaaccaacuuaguaaaagcgaguucaacacguauaaaagaucagggauaauggaaguagaucgaucugaagcaaaagaaggguuaaagcgaggagaaacuaccaaacaugcaguaucgcgaggaacugccaaauugcgcugguuugucgaaagaaacuugguaaaaccagaaggcaaagucauugauuuagggugugggcgaggcggauggaguuauuauugugcaggguugaaaaagguaacagaaguaaaaggauauaccaaaggcggaccaggucaugaagaaccaauaccuauggcaacguauggguggaaccuaguuaaauuacacucaggaaaggacguauucuuuauaccaccagaaaagugcgacacacuauuaugugauaucggagaaaguucaccaaaucccaccaucgaagaaggucguaccuuacgagugcuuaagaugguugaaccauggcuaagaggaaaucaauucuguaucaaaaucuuaaauccguacaugccuuccguaguggaaacuuuagaacagaugcaacguaaacacggaggaauguuaguuaggaacccucucaguagaaacaguacgcaugaaauguauugggugucuugugguacgggcaacauagucagugcgguaaacaugacuuccagaaugcuuuuaaauagauucacaauggcgcacagaaaaccaacuuacgaacgggauguugaucucggggcaggaacgcgacacguggccguagagccagaaguggcaaauuuagauauuauaggacaaagaauagaaaauaucaaacaugaacauaaaaguaccuggcacuacgacgaagauaauccauacaaaacaugggccuaucauggauccuacgaaguuaaaccuucagguagcgcaaguagcaugguuaaugggguggucaaacuucugacaaaaccuugggacgugauaccaaugguaacucagauagcgaugacagacacgacaccuuuugggcaacaaagagucuucaaagaaaaaguugauacgcgcacuccuaaagcaaaacgagguacggcucagauaauggaaguuacagcaaaauggcugugggguuuccuuucaagaaauaaaaagccaagaauuugcacccgagaagaauuuacaagaaaaguuagguccaacgcugcaaucggagcggucuuuguugaugaaaaccaauggaacagcgcaaaagaagcaguugaagaugagcgauuuugggaccucguacacagggaacgugaauugcauaagcaagguaaaugugcuacgugcguauauaauaugaugggaaagagagaaaagaaacugggugaguucgguaaggcgaaaggcagucgggcgauuugguacaugugguugggagcucgcuuccuggaauuugaggcacuuggauucaugaaugaagaucacugguucucgagagaaaacucauuaucagguguggagggagagggauuacacaaacugggcuauauauugagagacaucucaaaaauuccaggagggaauauguaugcggacgauaccgcugguugggacacucgaaucacugaagaugaucuccaaaacgaagccaagaucacagauauaauggaacccgaacaugcucuacucgcaaagaguauauucaaauuaacauaucagaauaagguagugcgcguccaaagaccagccaaaaacggaacaguuauggacguuaucucgaggagagaucaacgagggaguggacagguugguacauauggcuuaaacacauuuacaaauauggaagcccaacucauacggcagauggaauccgaagguauuuuuagcccauccgaacuugaaacacccaaucucgcuagaagaguucuagauuggcuagaaaaacauggaguugaaagauuaaaaaggauggcaauaucaggagacgacugcguagugaaaccuauugaugacagauucgcaacugcacugaccgcauuaaaugauaugggcaaaguacgaaaagauaucccccaaugggagccgucgaaagguuggaaugauuggcagcaagucccuuuuuguucgcaccauuuucaucaauuaauaaugaaggauggacgcgaaauuguaguaccaugcagaaaucaagacgaauugguugggagagcccguguuucgcaaggugccggguggagucuuagagaaacugcgugucuagggaagucuuacgcgcaaauguggcaacuuauguauuuccacaggcgagauuuaagacuggcagcuaacgcuauuuguucggcgguacccgucgauuggguaccaacuucacgaacaacuuggucgauacaugcccaucaucaguggaugaccacagaagauauguugagcguguggaauagaguauggauugaagaaaauccguggauggaagauaagacacacauaucuucauggggagacguaccguaucuaggcaagagagaagaucaguggugcgguagucuaauaggacuuacagcaagagcuacuugggcaacaaacauacagguggcaauuaaucaaguaagaaggcugauaggaaaugaaaauuaccuggacuacaugacuagcaugaagagauucaaaaacgaaucagacccagaaggugcuuuaugguga

SEQ ID NO: 21676 - RNA, 9879 nt, Artificial Sequence
  derived and/or modified CDS sequence (opt6) from DENV-1__GQ199799__SS-prME
agcguaaccauguuacugauguuaaugccaacugcauuggcguuccaucucaccaccagagguggagaaccacauaugauuguaucaaaacaagaacgagggaaaucgcuauuauuuaaaacaucagcaggaguaaacaugugcacgcugauugcgauggaucuaggagaauuuugugaggauacaaugacguacaaaugucccagaaucacagaggcagaaccagaugacguugauuguuggugcaaugcgacugauacauggguaaccuacgguacauguucucaaacaggcgagcauagaagagacaaacguuccguggcgcucgcaccgcacguuggacuaggguuagaaacuagaacugaaacauggaugucaagcgaaggagcuuggaaacaaauucaaagaguggaaacgugggcgcuucgacaucccggcuuuacagucauagcauuauuucuagcacaugcaauaggcaccaguauaacucaaaaaggaauuauuuucauacugcuaauguuagucacacccagcauggcuaugagaugcguaggaauuggaaguagagauuucguugaagggcucucaggugcuacuuggguagauguugucuuagaacaugguucuugcgugacaacgauggcaaaagacaaaccaacauuagacauagaacuacugaaaacagaaguuacgaauccggcuguuuuacgcaagcugugcauagaagcaaaaauaagcaauacaacaacugauagcagauguccgacacaaggagaggcaacucuaguagaggagcaagaugcaaauuuuguaugcagacggacguuuguagaucgagguugggguaacggaugcggccuauucgggaaagguucauuaauuacaugugcaaaauuuaaauguguaacuaaauuagaagguaaaauuguacaauaugagaauuuaaaguacuccgucauagucaccguacauacgggagaccaacaucaaguuggaaaugaaucaacugaacacgguaccacagcuacaaucacgccucaagcgccgucaacggagauacaacugacggacuauggagccuuaacuuuagauugcagcccaagaacuggauuagauuucaacgaaaugguauuacucacgaugaaggagaaauccugguuaguucauaaacaaugguuccucgaccucccgcucccguggacuuccggagcuaguaccagucaagaaacguggaacagacaagaucuauuaguuacguucaagacugcucaugccaagaaacaagaaguugucguuuugggcucgcaagagggugccaugcacacagcacuaacaggagcgacagaaauucaaacaucagggaccacuacaaucuucgcugggcaucuuaaaugucggcucaaaauggauaaacuaacguuaaaaggaaugucauacgugaugugcacagguucauuuaaauuagagaaggaaguugcugaaacucaacacggaacagugcucguccaaauaaaguaugaaggaacugaugcgccuugcaaaauaccauuuaguacacaggacgaaaagggagucacucagaaugguagacuaauaacugcaaacccuaucgugacugacaaagaaaagcccgugaauaucgaagcagaaccacccuucggggaaucauauauaguuauaggggcaggagagaaagcucugaaauuguccugguuuaaaaagggaaguaguaucggaaaaauguuugaagcgacggcaagaggugcaagaaggauggcaauucuuggagauacugcaugggacuucgggucuauagguggaguauuuacaucggucggcaaauugguccaccagauauucgggaccgcguauggaguauuguuuucuggugugagcuggaccaugaaaauagguauagggguacugcuaacguggcucggccuaaauucuaggucuaccaguuugucaaugacaugcaucgccguaggacucguuacucuauauuugggcguaaugguacaggcggacagcgguugcguuauaaauuggaaagguagagaauuaaaguguggcaguggaauauuuguaacaaaugaagugcacacuuggacggagcaguauaaauuccaagcagacucucccaaacgguuaagcgccgcaauagggaaagcaugggaggagggggucugcgguauacgaagugcgacuagauuagaaaauauuauguggaaacaaaucaguaaugaauugaaucauauuuuacuugaaaaugauaugaagcuaaccgucguaguaggagacgucgccgguauuuuagcucaagguaagaaaaugauuagaccacaaccgauggaauacaaauacaguuggaaaucguggggaaaagccaaaaucauaggggcugacguacaaaacacaaccuucauaauagauggaccuaacacacccgagugcccggacgaccaaagagcguggaauauuugggaaguugaggauuaugguuuuggcaucuuuaccacaaauauauggcuuaaguugcgugacucauauacacaaguaugugaucaucgccuuaugucagcagcaauaaaagacaguaaagcgguccacgcugauaugggguauuggauugaaagcgagaaaaaugaaaccuggaaacucgccagggcaucauucaucgaaguuaaaacuugcauuuggcccaaaucgcauacacuaugguccaacggaguucuugagucagaaaugauaauaccaaaaauauauggaggcccaauaagccagcacaacuauagacccggguacuucacccaaacggcaggaccguggcauuuggguaaacuagaauuggacuucgaucucugugagggaacuacgguaguuguggaugaacauugcggaaaccgaggaccuaguuuaagaacgacaacaguaacaggaaaaauaauacacgagugguguugcagaucaugcacccuuccgccacugcgauucaagggugaagacggauguugguacggaauggagauccgaccuguaaaagaaaaagaagaaaacuugguaaaaucuaugguauccgcaggaaguggagaaguagacaguuucagcuuagguuuacucuguauuucaaucaugauagaggaaguaaugagaaguagguggucucguaaaaugcuuaugaccggaacccuagcuguauucuuucuuuuaauaaugggucaauuaacauggaaugacuugaucagacuguguauaaugguuggagcaaaugcaagugauagaauggguaugggaacaacguaucuagcguuaauggcuacauucaaaaugagacccauguucgcaguuggucugcucuuuagacggcucacgagucgugaaguucugcugcuaacaauuggccugagccuagucgcgucgguugaacucccuaacucauuagaagaacugggugauggacuagcaaugggaauaaugauacugaaacugcuuacagauuuucaaccgcaccaauuaugggccacccuacuaagucucacuuucauacggacaacauucucacuacacuaugccuggaaaaccauggccaugguucuaucuauaguaucauuguucccgcuaugucucucgacgacaucacagaaaacaacuuggcuaccaguauuauuggguagccuuggguguaagccucuaacaauguuuuuaauagcugaaaauaaaauauggggucgaaaaagcuggccccuuaaugaaggcauaauggcaguggggauaguaaguaucuuauuaagcucacuauugaaaaacgaugucccgcuagcagguccgcugauagccgggggcaugcugauagcguguuauguaauuagcggcucaucugcagauuuaaguuuagaaaaggcagcagaaguaucaugggaagaggaggcggaacauagcggagccucucauaauauccuaguugaaguacaagaugaugggacuaugaagauaaaagacgaggagagagaugauacauuaacgauauuauuaaaagcuacccuucuugcggugucugguguuuauccacuaucuauaccugccacccuguucguuugguauuucuggcagaagaagaaacaacgaucaggaguuuugugggauacgccgaguccacccgaaguugaacgugcgguauuagacgacgggauauauagaauaaugcaaagaggccuguuagguagaagucaaguuggaguaggaguguuucaagaaaacguguuucacacaauguggcaugucacaagaggugccguacuaauguaucaagggaaaagauuagaaccgagcugggcuucgguaaagaaggacuugauaaguuacggagguggauggcgacugcagggcagcuggaauaccggcgaagaaguacaagugauagcagucgagccuggcaaaaaucccaaaaacguucagacagcuccaggaaccuucaagacaucagaaggagaaguuggagcaauagcacuugacuucaaaccuggcacauccggcagcccaauuguuaacagagagggaaaaauuguaggacuauaugguaaugguguaguaacuacuucagguacuuauguaucggcuauagcucaagcaaaggcaucacaggaaggacccuuaccagaaaucgaagaugaaguuuucagaaagcgcaauuuaacuauaauggauuuacaccccggaagcggaaagacgaggcguuauuuaccagcaaucguacgagaagcuaucaaaagaagacuuaggacguuaauauuagcuccuacaagaguaguagcaagugagauggcagaagcacugaaagguaugccgauaagauaccaaacaacagcaguaaagucggagcauacaggcaaagagauuguagacuuaaugugccacgccacauuuacuaugcgccuauuaagcccaguacggguuccuaauuacaauaugauuauaauggaugaggcucauuuuacugauccuaguucaauugcagcgagaggauacauaucaaccaggguagggaugggagaagcagcggcaauuuuuaugacggcaacuccaccugguuccgucgaggcauuuccgcaaaguaacgcagugauucaagacgaagaacgugauauuccagaacgcucguggaauagcggauacgaguggaucacagacuuuccgggaaagacaguaugguuugucccaucaauaaaaucaggaaaugauauagcuaacugucuucggaaaaacgggaagagaguaauucaguugagcagaaaaacauuugauacagaauaucagaaaacgaagaauaaugacugggauuauguugucacuacggacauauccgaaaugggagcaaauuuccgagcggaucgcguaauagauccaaggcgaugucuaaagcccguuauuuuaaaagauggaccagagaggguuaucuuggcgggaccuaugccagucacuguggccagugcugcacagcgcagggggcgcauugguagaaaucauaauaaagaaggcgaucaauacauauacaugggucaaccacugaauaaugaugaggaucaugcucacuggacugaagcaaaaaugcugcucgauaauaucaacacaccagaggguauaauucccgcguuauucgagccagagcgugaaaaauccgcagcuaucgauggagaguauagauuacggggugaagcgcggaaaacauuuguagagcuaaugcggcguggggacuuaccggugugguuaaguuauaaaguagcaucugaagguuuucaguacagcgauaggcggugguguuucgauggugaaagaaauaaccaaguauuagaagaaaauauggauguggagauuuggaccaaagaaggagaacgaaagaaauugcgaccacgauggcuagacgcacggacauauagcgauccacuagcuuuaagagaguucaaagaauuugcugccggccggagauccgugaguggagauuugauacuagagauugguaaacuaccacaacaccuaacacaaagagcacaaaacgcccuagauaaccuagugauguuacacaacagugaacagggugguagagcauacagacaugcgauggaagaacuacccgauacgauugaaacacucauguuauuagcuuuaauagcaguacuaaccggagggguaacccucuucuucuuaucgggccggggacuaggaaaaacuucaauaggcuuacugugcguuauggcgucgucaguauugcuauggauggcuaguguagagccucacuggaucgcagcuaguauaauacuagaguucuuuuuaaugguauuguuaauaccagaacccgacagacaaaggacuccacaggacaaucaauuagcauauguaguaauaggauuguuauuuaugauccugacuguagcugcuaaugaaaugggauuacuugaaacaacaaagaaagaccuugggauaggacacguagcaguggaaaaccaucaccacgcugcaauguuagauguugauuugcaccccgcaucagcuuggacgcuauacgcuguggccacuacgauuauaacaccaaugaugaggcauacaauugaaaacaccacagcuaauaucagcuuaaccgcaauugcuaaucaggccgcgauauuaaugggauuggacaaagguuggccgauuucaaaaauggauauuggugucccuuuguuagcauugggcuguuacagucaaguaaaucccuuaaccuuaacugccgcgguacuaaugcuuguagcacauuaugcgaucauaggaccgggguuacaagcuaaagcuacaagggaggcucagaaacgaacugcugccgggauaaugaaaaaccccacagucgacggaauuguggccauagaucucgauccgguaguauaugacgcgaaauuugaaaaacaauugggucaaaucaugcuucuaauacuauguacuucucaaauccuucuaaugagaacaacgugggcucugugugaaucgauaacacuugcaacaggaccgcuaacgacauugugggaagguagcccuggaaaauuuuggaauaccaccauugcaguuucaauggcaaacauauucagagguagcuauuuggcuggggcagguuuagcauuuucauuaaugaaaucguuaggaggcgggagacgugggacgggggcacaaggugaaacacuaggugaaaaauggaagagacaacuaaaccaguugucgaaaagugaauuuaauaccuacaaacguuccgggauaauggagguugaucgaucagaggccaaggagggauugaaaaggggagagacaacuaaacaugcugucaguagagggacugcaaagcuaagaugguuuguagagagaaaccuaguaaaaccugaagguaaagucauugacuuagguuguggucguggaggauggucauacuacugcgcuggccuaaagaaaguaacagaaguuaagggauacacgaaaggaggaccuggccaugaggaacccauaccuauggcaacauaugguuggaauuugguaaaacuucauuccgggaaagacguauucuuuauaccaccggagaaaugcgacacauuauugugugauauaggugagucauccccaaacccgacaauagaagaaggucguacguugagaguucuaaaaauggucgaaccauggcuuaggggcaaucaguuuugcauaaagauucuuaauccuuacaugcccaguguagucgagacacuagaacaaaugcaaagaaaacauggagguauguuagucagaaauccacuaucaagaaauuccacgcaugaaauguacuggguaucauguggaaccggaaacaucguaagugccgucaauaugacaucacgaaugcucuugaacagauuuacaauggcucacagaaaacccacauaugaaagggacguagaucuaggggcugggacgcgucauguagcuguugagcccgaaguggcaaacuuggacauaauagggcaaagaauugaaaauaucaaacacgagcauaaaagcacauggcauuaugaugaagacaauccauauaaaacgugggcguaucacgguaguuaugaaguaaaaccaaguggauccgccaguagcaugguaaauggugucgucaagcuauugacgaaaccaugggacguuauuccaaugguaacucaaauugcuaugaccgacacaaccccuuuuggacaacaaagaguauucaaagaaaaaguggauacacguaccccgaaagcuaaaagagggacagcucagaucauggaaguuacggcgaagugguuaugggguuuccucagcagaaacaagaaaccacgaaucugcaccagagaagaauuuacacgaaagguccgaaguaaugcggcgaucggugcugucuuuguagacgaaaaucaguggaacucagcuaaagaggcggucgaagacgaaagauuuugggauuuggugcaucgagaaagagaacuucacaagcaggguaaaugugcgacuugcgucuauaauaugaugggaaaacgagagaagaaacucggagaguucggaaaagcuaaagguucgagagccaucugguacaugugguuaggugccagauuucuagaguucgaagcccuaggauucaugaaugaagaccauugguuuucacgcgagaacucuuugaguggaguggaaggugaaggccuacacaaguuaggauauauauuaagagauaucucaaaaauuccuggagggaacauguacgcggacgacaccgccggaugggauacgagaauuacugaggaugauuuacaaaaugaagcuaaaauuacugacaucauggaaccugagcacgcauuacuugcuaagucuaucuucaagcugaccuaucagaacaagguaguacggguacaacggcccgccaaaaacggcacagugauggauguaauaucacgaagagaucagagagguucuggacaagugggaacauacggacuuaauacuuuuacaaauauggaggcacagcuaauuaggcaaauggagagcgaggggauauucucgccuucagaacuagaaaccccuaaccuugcaggucgagugcuagauuggcuagaaaagcauggcguggagagguuaaaaagaauggcgauuucuggagaugauugcguagucaaaccaauugaugaccguuucgccacggcacuaaccgcccuuaacgauaugggaaaaguacguaaagauauaccacaaugggaaccaucgaaagguuggaaugacuggcaacaggucccuuucuguagucaucacuuucaccaacuaauaaugaaagauggaagagagauaguuguaccguguaggaaccaagaugaauuaguagggcgagcuagaguuucacaaggggcaggauggucccuuagagaaacggcaugucuuggaaaauccuacgcacagauguggcaacuaauguauuuucaucgaagagauuuaagauuagcagcuaaugcuauauguagugcaguaccuguagauuggguaccgaccucaagaacgacguggucgauucaugcacaucaccaauggaugaccacagaagacauguugucgguauggaauaggguuuggauagaagaaaaccccuggauggaagauaagacacauguuucguccuggggugacgucccauaucugggaaaacgugaagaucaguggugcggaaguuugaucggacuaaccgcccgagccacuugggcaacaaacauucaaguugcgauuaaucagguucgacgauuauuggguaacgaaaacuaucuugauuacaugacaucaaugaaacguuuuaagaacgaaagugauccagaaggagcacuuugguga

SEQ ID NO: 21677 - RNA, 9879 nt, Artificial Sequence
  derived and/or modified CDS sequence (opt6) from DENV-1__GQ199800__SS-prME
ucuguuacuauguuauuaaugcugaugccaacugcauuagcuuuccaccuaacuacuagagggggagaaccccauaugauagugucgaaacaagaaagaggaaaaucacuacuguuuaaaaccagcgcuggaguaaacaugugcacauugaucgcaauggacuuaggagaauuuugugaagauacuaugacauauaaauguccuagaauaacagaagcggaacccgaugauguagauuguuggugcaacgcaaccgauacgugggucacauacgguacuuguucccaaacaggugaacauagacgagauaaaagaucuguagcucuagcgccgcauguagggcucggauuagaaacucgaacugaaacauggaugucaucagaaggugccuggaaacaaauucaacgaguggaaacaugggcuuuaagacacccaggauuuacgguaaucgcauuguuucuagcucaugcuaucggaacaagcauuacacaaaaaggaauaaucuuuaucuugcucaugcucgugacaccgagcauggccaugagaugugucgggauuggcucuagagacuucguagagggucuuucuggagcaacguggguagauguuguuuuagagcacgggagcugcguuaccacaauggcaaaagacaaaccgacuuuggauauagaacuauuaaaaaccgaagucacgaauccagcuguacuuaggaaacuguguauagaagcaaaaauuuccaacacgacaacggacagccgcugcccaacacaaggagaggcgacauugguagaggaacaagacgcgaacuuugucugucgucggacuuuuguagacagaggauggggcaacggauguggauuguucggcaaaggaagccuuauaacuugugcuaaauuuaaauguguaacaaaacuagaagggaaaauaguucaauaugaaaaucugaaauauuccguuauuguaacaguucacaccggagaccaacaucaaguggguaacgaaaguacugagcauggcacaaccgcaacaauaacuccucaagcaccaagcaccgagauacaauugacggauuacggagcacucacauuagacuguucaccccgaaccggacuggauuucaaugaaaugguccuauuaacuaugaaggagaaaagcugguuagugcacaaacaaugguuccucgaucugccacuaccauggaccucgggugcaagcacaagccaagaaacuuggaaucgccaagaucuuuuagucacauucaaaacggcucaugccaagaaacaggaaguuguaguccuaggaucacaagaaggugcuaugcacaccgcauugaccggcgccacagaaauucagacuagcggaacaacuacgauauuugcaggacacuuaaaaugucgacucaaaauggauaaauuaacauuaaaagguaugucuuauguuaugugcacuggcucauuuaagcuagagaaagaaguagcugaaacacagcaugggacaguguugguacaaauuaaauacgaggguacagacgccccuuguaaaauacccuuuuuaacacaagaugaaaaaggagucacacaaaacggaagacuuauaacggcuaauccaauaguuacugacaaggaaaaaccuguuaacauagaggcugaaccgccauuuggagagucauacauagucauaggcgcuggagaaaaagcauuaaaguuaucaugguucaagaaaggcaguuccaucgguaaaauguucgaagcaacagcgcggggagcaaggcggauggccauacugggcgauaccgcgugggacuucggauccauaggcggaguauucacaagcguaggaaagcuaguucaucagauuuuuggcaccgcguacgguguauuauuuaguggaguaucauggacaaugaaaauugggauagggguacuucuuaccuggcuaggauuaaauagucgcagcacuucccuguccaugacauguauagccguuggguuagucacauuguauuuaggaguaaugguucaagcagacuccggauguguuauaaauuggaaggguagggaguugaagugugguucaggcauuuucguuacgaacgaagugcauacauggacagagcaauauaaauuucaagcugauaguccgaagcgcuuaucagcugcaaucggaaaagcgugggaagaaggggucugcgguauacguagcgcuacucgccucgaaaacauaauguggaaacagauauccaaugaacucaaucauauuuuacuugagaaugauaugaaauucacgguuguagucggcgauguagccggcauucuugcccaaggcaagaaaaugauaagaccgcaaccaauggaguauaaauauucauggaaguccuggggcaaagcaaaaaucauuggagcagacguacaaaauaccaccuucaucauagacggacccaauaccccggaauguccugaugaucagcgagcauggaauauuugggagguagaagauuacggguucggaauauuuacaacaaauaucuggcuaaaacuuagagacagcuacacccagguaugcgaucaccgucucaugagugcggccauaaaagauucgaaagcgguucacgccgauaugggauauuggauagaaucagagaaaaacgagacuuggaaacuugcuagagcgagcuucauagaaguaaaaacgugcauauggccuaaaagucauacucuuuggagcaauggugugcucgaaagcgagaugauuaucccuaaaaucuaugguggcccaaucagucagcauaauuaucguccagguuauuuuacucagaccgcaggcccuuggcaccuaggcaaacucgaacucgauuucgauuugugcgaagggacaacugucgucguugacgaacauugcgguaauaggggucccucgcucagaaccacaacggugacagguaaaauuauccacgaaugguguugcagaucaugcacuuuaccuccauugagauuuaaaggagaagauggauguugguaugguauggaaauucgacccgugaaagaaaaggaggaaaaucucguuaaaagcaugguaagugcaggaucaggagagguagacucuuucucgcucggauugcugugcauuucuauaaugaucgaggaagugaugagaagccguuggucaagaaagauguugaugacaggcacccuagcaguuuucuuucuucuaaucaugggacaacuaacuuggaacgauuugauaagacuguguauuaugguaggugcuaacgccucggauagaauggguaugggaacuacuuauuuagcguuaauggcuaccuucaaaaugcggccgauguuugcaguugguuuacucuucagaagguuaacaagucgagaaguguuauuacuaacaauugggcuaucacuuguugcgagcguagaguugccuaacucacuagaagaacugggagaugguuuagcuaugggcauaaugauucuaaaauuauuaaccgauuuucaaagccaccaguugugggcaacauugcuuaguuuaacauuuauuaaaacaacauuuucucuccacuaugcauggaaaacuauggcaaugguuuugagcauaguuagccuuuucccucuauguuuaucuacaacgagucagaaaacaacauggcuaccgguccuccuugguagccuaggaugcaaaccauuaaccauguuccugauugccgagaacaaaaucugggguagaaagagcuggccguuaaaugaagguauaauggccguaggcaucgugaguauccuauugucaucccuccucaaaaacgacguaccucucgcagggccucuaauugcaggggguaugcuaauagcgugcuauguuaucucgggaucaucggcugacuuaucauuagaaaaggcugcagaagucucgugggaggaagaagcggaacacucuggagcgucacacaauauuuuaguggaaguacaggaugaugguacuaugaagauaaaagacgaagaacgugaugacacacuaacuauucuuuuaaaagcuacacuacuagcuguaucuggaguauacccacuaucgauaccggcuacuuuauuuguaugguauuuuuggcagaagaagaaacaacggagugguguauuaugggauaccccgucaccacccgaagucgagagggcaguccuagacgaugguauuuauagaauaaugcagagaggucuauuaggccguucucaaguuggagucgggguguuucaagagaacguauuucauacuauguggcauguaacacgaggagcuguccuaauguaucaaggaaagcgacuagaacccucaugggcuucagucaagaaagauuuaauuuccuauggaggcggauggcgauuacaagggucuuggaauacaggugaagagguacaaguuaucgccguggagcccgguaaaaauccgaaaaauguccagaccgcaccgggcacuuuuaaaaccagugaaggugaaguaggagcgauugcacuagacuucaaaccuggaacaaguggaucaccaauugugaacagagaaggcaagauuguaggucuuuacgggaauggagucguuacaaccagcggcaccuacguuucggccaucgcccaagcaaaggcaagucaagagggucccuugccagagaucgaggaugagguguuucggaagcguaacuuaacaauaauggaucuacacccaggcagcggaaaaaccagaagguauuuaccagcaaucguaagagaggcaauaaaacgaaaauuaaggaccuuaauuuuagcuccgacgagagucguagcuucagaaauggcugaggcacuaaaaggaaugccaauaagauaucagacaaccgccguaaaaagcgaacacacggguaaggagauuguugacuugaugugucacgcuacuuuuaccaugagacuauuaucuccaguuagagugccuaauuauaacaugauaauaauggacgaagcacacuuuaccgaccccaguuccauagcagcgcgcggauauauuucgacuagaguagguaugggcgaagcagcugcaauauucaugacggcuacacccccuggaagcguugaagcauuuccucaaucgaacgcaguaauacaggacgaagaacgagacaucccugaacgaucguggaacucgggcuacgaauggauaacagacuucccugguaagacuguuugguuuguaccgaguauaaaaucuggaaaugauaucgcgaauuguuuaagaaagaacgguaaacgaguaauccaauuauccagaaaaacauuugacacugaauaccagaaaacuaaaaacaacgauugggauuacguaguaacgacugauaucucugagaugggagcuaacuuucgagccgauagaguaauugauccgcgaagaugucuaaaaccaguuauauuaaaagacgggccagaaagagugauuuuagcagguccaaugccgguaaccguagcaucggcagcacaacgcagagggcguauagguaggaaccacaacaaagagggcgaucaauauauauacaugggacagccacuuaauaaugacgaagaucacgcacauuggacagaagcaaaaauguugcuugacaauauaaacacgccagaagguauuaucccugcacucuuugaacccgaaagggagaaaagcgcggcuauagacggagaguauagauuaaggggagaagcacgcaaaacuuuuguagaguuaaugagacggggcgauuugcccguguggcuaagcuauaaaguugcuucagagggauuccaauacucugaucggagaugguguuuugauggcgaacgaaauaaucagguuuuagaagagaauauggaugucgagauauggacuaaggaaggagagaggaaaaagcuaagaccgagguggcuagaugcaagaacauauagcgacccccucgcacuuagggaguuuaaggaauuugcugccggaagacgaucuguuucaggugauuuaauucuagaaaucgguaaacucccacagcacuuaacacagcgggcgcaaaaugcauuagacaaccuaguaauguuacacaacagcgaacaggguggcagggcauauaggcaugcaauggaagaacuuccugacacgauagagacacuaaugcuucuugcuuuaaucgcaguacuaacuggaggugucacuuuguuuuucuuaucagggcguggccuuggaaaaaccagcauagguuuacuaugcgucauggccucaagcguuuuguuguggauggcgagcguggaaccacacuggauagccgcuucuaucauuuuggaguucuuucuaaugguccuccuaauaccagaaccugaccgccaaaggaccccacaagauaaccaauuagccuauguaguaaucggguuacuguuuaugaucuuaacaguagcggcuaaugagaugggcuugcuugaaacgacgaagaaggaucuaggaauaggucauguagcgguugaaaaucaucaccacgccgcgaugcuagaugucgacuuacacccggcuucugccuggacuuuguaugcaguugcaaccacgauaauaacgccuaugaugcgacauacaauagaaaacacaacggcuaauauaucucuaacagcaauagccaaccaagcagcaauauuaaugggucucgacaaaggauggccaauaucuaaaauggacaucgguguuccucuacucgcucucggcugcuauucacaagugaauccgcuuacacuuacugccgcaguacuaaugcuugucgcccacuaugccauaaucggcccaggauugcaagccaaagcgacucgcgaagcgcaaaaacgaacugcagcaggaauaaugaaaaacccuaccguagauggcauaguagcuauagacuuagaccccgucguauacgacgcaaaauucgaaaaacaacuuggacaaauaaugcuucugauacuaugcacgagccaaauacuccugaugcguacuacuugggcgcuaugcgaauccauuacuuuagcuacugggcccuuaacaacgcuuugggagggaagcccagggaaauuuuggaauacaacaauugcaguaucgauggcuaacauauucagaggaaguuacuuggcaggcgcgggguuagcauuuucguugaugaaaucguuagggggcggcagacgaggaacuggugcucagggagagacuuuaggggaaaaguggaaaagacaauugaaccaacugagcaaaucugaguucaauacuuauaaaagaagugguauuauggaaguagaccgaucugaagcaaaagaaggauuaaaaagaggugagacaacaaaacaugcagucucuagaggaacagcgaaacugagaugguuugucgaaagaaaucucguaaaaccugagggaaagguaauagauuuggguuguggaagaggaggauggagcuauuauugcgcaggucuuaagaaaguaacagagguuaaaggauacacuaaggguggaccaggacaugaagaaccuauaccaauggcaacauauggcuggaaucuuguuaaauugcacuccggaaaagacgucuucuuuauaccaccggagaagugcgauacacuuuugugugacauuggagaaucaaguccaaaccccaccauagaagaaggaaggacauugagaguguuaaaaaugguggaaccaugguuacgcgggaaccaauuuuguauaaaaauauuaaauccuuauaugcccucuguuguugaaacccuagaacaaaugcaacguaaacauggaggaaugcuuguaagaaauccucuuaguaggaauaguacacacgaaauguacuggguaagcugcgguacuggaaauauagugucagccguaaacaugacaucacggauguuauuaaauagauuuacaauggcacaucgaaagccaacuuacgaaagggauguugaccucggugcugggacuaggcacgucgcaguugaaccugaagucgcaaauuuggauaucaucggucagcggauugaaaauauuaagcaugaacacaaguccacauggcauuacgacgaagauaacccuuauaaaacaugggcuuaucacggcucguaugaagugaaaccuucuggauccgcgaguaguaugguaaaugguguagugaaacuccucacuaaaccuugggacgucaucccgaugguaacacagauagcaaugacugauacgacccccuuuggacagcaacgaguauucaaagagaagguagauacacgaaccccaaaggcuaaaaggggaacugcacaaaucauggaaguaacugccaaaugguuguggggauucuuaucuaggaauaaaaagccacgcauuuguacgcgagaggaguucacacgaaaaguacgcagcaaugcugcuauaggugccguauuugucgaugaaaaucaauggaacagugcaaaagaagcgguugaagaugaaagauuuugggaccugguccaccgugaaagagaacugcauaaacaagguaagugugcaacaugcguauacaauaugauggguaaaagagagaagaaauuaggugaauuuggaaaagcuaaagguagucgggcaauuugguauaugugguuaggagcuagguucuuggaguuugaagcauugggauuuaugaacgaggaucacugguucaguagagagaacagucucucuggagucgaaggcgaagggcuacauaaacuugguuacauucuuagagacauaagcaaaauuccagguggcaauauguaugcugacgacacggccgggugggauacuagaauuacggaagaugauuugcaaaacgaagcuaagauaacugacauuauggaaccggaacaugcguuauuagcuaaaaguaucuuuaaacuuacguaucagaauaaagucguacgaguacaacguccugccaaaaaugggacuguaauggauguaauaagcagacgagaucaacgagguucaggucaaguaggaacauauggacugaacacauuuacaaauauggaagcacaacuaauucgacaaauggaauccgaaggaauauuuagucccucagaacuagaaacuccaaaucuagccgguagagucuuggauugguuagaaaaacauggagucgaacgucucaaaagaauggcuauaucaggcgacgauuguguuguuaaaccaauagaugaccgguuugcgaccgcguuaaccgccuuaaaugauauggguaaaguucgaaaagauauuccacaaugggagccuucaaaaggguggaacgacuggcaacaaguaccauucuguucucaucauuuccaucagcuaaucaugaaagauggucgagagauuguagucccuugcagaaaccaagaugaacuugugggaagggcgagggucagucaaggagcugguuggucccucagagaaacagcgugcuuggguaaauccuaugcacaaauguggcaacuaauguauuuccaucguagagaucuacgacuugcugcuaacgcaauuuguucagccguaccgguugauuggguuccuacauccagaacuacauggagcauacaugcacaucaucaauggaugacaacugaagauaugcuuagcguguggaacaggguauggaucgaagagaaucccuggauggaagauaaaacccacauaucaucuuggggagacgugccuuauuuaggcaagcgagaagaccaguggugcgguagccugauaggacuaacagcgcgugcuaccugggcuacaaauauucaaguggcuauaaaucaaguucgaagacugauugguaacgagaauuaucuagauuauaugaccaguaugaaacgcuuuaagaacgaaucagacccugaaggggccuuaugguaa

SEQ ID NO: 21678 - RNA, 9879 nt, Artificial Sequence
  derived and/or modified CDS sequence (opt6) from DENV-1__FJ882548__SS-prME
aguguaacuauguugcuaauguuaaugccuaccgcacuagcauuccaucuuacuacacggggaggagaaccacauaugauagugaguaaacaagaaagaggaaaaucauuauuauuuaaaacaucagccgguguaaacaugugcacauuaauugcaauggaucuaggugaacugugugaagauacgaugacauauaaauguccuagaaucacagaagcugaaccagaugacguugauugcugguguaacgcuacugacacuuggguaacauacggaacuugcucucaaacuggcgagcaucgacgagauaaacguucuguugcguuagccccacauguaggucuaggguuggaaacccggaccgagacguggauguccucagaaggcgcauggaaacaaauucaaaggguagaaacaugggcuuuaaggcauccaggauuuaccgugauagcauuauuccuugcccaugcgauaggcaccucaauuacgcaaaaagggauaauauuuauacuauugaugcuaguaacgccaagcauggccaugcgaugcgugggcauuggaucucgggauuuugucgaaggucuuaguggagcuaccuggguugacguagucuuagaacacggaagcugcgugacaacaauggcaaaagacaaacccacacuagauauugagcuauuaaaaacagaagugaccaauccugccguacuaaggaaguuauguauagaggcgaaaauuucaaauacuacaacagauaguagauguccaacacaaggagaagcgacucuuguagaagaacaagacgcuaauuuuguuuguaggcgaaccuuuguagauagaggauggggaaauggaugugggcuauucgguaaaggcucgcugauuacgugugccaaauuuaaaugcguuacaaagcuagaaggaaagauaguacaauaugaaaaccugaaauauagugucaucguaacaguacauacaggugaucaacaucaaguugggaaugaaaguacagaacacggaacaacggcgacaauaacaccacaagcgcccaccaccgaaauccaacuuacggacuauggcgcacuuaccuuagacugcucaccgcggacaggauuggauuuuaacgaaauggugcuccuaacaaugaaggaaaaaucguggcucguucacaaacaaugguuucuugaucuaccacuuccuuggacaucuggagcuuccacuucucaagaaacauggaaucgucaggaccuucuaguaacuuucaaaacugcgcaugccaagaaacaagaaguuguaguucuaggaucgcaagaaggagcuaugcacacagcacuaacgggagccacagaaauacagacaaguggcacaacuacuauauuugcuggucauuuaaaauguagacuuaaaauggauaaacucacacuuaaaggaaugaguuacguaauguguacaggcucuuucaaauuagagaaagagguagccgaaacacagcacgguacgguguuaguucagaucaaauaugaaggaaccgaugcaccauguaaaauacccuucucaacacaagacgaaaagggcguaacacaaaauggaaggcucauaacugcaaauccaauaguuaccgauaaagagaaaccagugaauauugaggcggaaccaccauucggagaaagcuauauagugauuggagcgggugagaaagcgcucaaacuaucuugguuuaagaaagggagcucaauaggaaaaauguuugaagcgacugcuagaggugcaaggagaauggccauauugggugauacugcgugggacuucggaaguauaggcgguguuuuuacaucaguagguaagcucauucaucaaauuuuugguaccgcuuauggcguacuuuuuagcggaguaagcuggacgaugaaaauaggcauaggcguacuauuaacaugguuaggacugaacuccagaucaacuuccuugagcaugacuugcauugccguaggacucgugacguuauaccucggaguaaugguacaagcugauuccggauguguuauaaacuggaaaggaagagaacuaaaauguggaucgggaaucuuuguaacuaacgaaguacacaccuggacagagcaauauaaauuucaagccgauucgccaaaacgccugucagcugcaauaggcaaggcuugggaggagggaguaugcgguaucagaucggcaacgaggcuggaaaauauaauguggaaacaaauaucaaaugaauuaaaccauaucuuacuagaaaacgacaugaagcuaacuguaguuguuggcgacgucgccgggauucuuggccagggcaagaaaaugauacguccacaacccauggaauauaaauacagcuggaaaucuuggggcaaggccaagauaauaggcgcggaugcacaaaacacuacuuuuauaauugacggaccuaauacccccgaguguccugacgaucagagggcauggaacauaugggaggucgaagauuacggcuucgguauauuuacaacaaacauauggcuaaaguuacgugacuccuacacccagguaugcgaucaucgacuaauguccgcagcaauaaaagauucuaaagcagugcaugcugauaugggauacuggaucgagucggagaagaaugaaacuuggaaauuagcacgugcuucguucaucgaaguaaaaacauguauauggccaaaaucucauacacuauggucaaaugguguccuagaauccgagaugauuauccccaaaauauauggaggacccauaucucaacauaauuacaggccaggauacuuuacacaaacagcuggaccuuggcaucuaggaaaacuagaauuggauuuugaccugugugaaggaacaaccgucguaguugacgaacauuguggcaauagaggaccuagccuaagaacuaccacugugacaggcaagauuauacacgagugguguugcagaagcuguacauugccucccuuaagauuucgaggcgaagacggaugcugguacggcauggagauaagaccaguaaaagaaaaagaagaaaauuuaguaaagagcauggugagcgcagguagcggcgaagucgacaguuuuaguuuagguuuguuguguauaagcauaaugauagaagaagugaugcgcucuaggugguccaggaaaaugcuaaugacugguaccuuagcaguguuuuuccuccugaucauggggcaguuaacauggaaugauuuaauccgccucuguauaaugguaggcgcuaacgcauucgaucgaaugggaaugggaacgaccuaucuugcgcuuauggcaaccuucaaaaugcggccgauguuugcaguagguuuacuauuucgccgauuaacuucccgcgaaguucuucugcucacuauuggccugaguuuagucgcuucaguggaauuaccuaacaguuuagaagaauuaggagauggcuuagcuauggguauaaugauuuuaaaauugcugacugacuuccaaucacaccaguuaugggcgacuuuacuuagucuaacauucauaaaaacaacuuucucgcuucauuaugcuuggaaaacgauggccaugguccuuaguauaguuucacuguuaccccuguguuugaguacgacaagucagaaaacaacgugguuaccaguuuuauuaggaaguuuggguugcaaaccuuuaacuauguuuuugauagcagaaaacaagauaugggggaggaaaagcuggccuuuaaacgaaggaauuauggccgucggaauagugucaauacuacuuucuucacuacucaaaaacgauguuccacuggcgggcccccuuauugcuggugguauguuaauagcauguuacgucauauccggcucgucagcagaucuuucguuagaaaaagccgcagaaguaucgugggaagaagaagcagaacacucaggggcuucacauaacauauuaguugaagugcaagaugacgguacuaugaagauuaaagacgaagaacgggaugauacauugaccauacuauuaaaagcuacuuuauuagcaguguccgguguauacccauuaaguauucccgccacacucuuuguuugguauuuuuggcagaaaaagaaacaaagaaguggaguauuaugggauacuccgaguccaccagagguggaacgggcugugcuggacgaugguauauaucguauaaugcaacgaggucugcuuggacgcagucaaguugguguuggagucuuccaagagaacguauuucauacuauguggcacguaacaagaggcgcuguccuaauguaucaagguaaaagacucgaaccaucuugggcaagcguuaagaaagaucuuauaucuuauggaggugguuggcgucuaagggggucuuggaauacaggugaggaaguacaaguaaucgccgucgaaccgggcaaaaacccuaaaaauguccaaacagcucccgggaccuucaaaaccccugaaggcgaaguaggagcuauugcccuagauuucaaaccagggacaucaggcaguccaauugugaauagagaaggaaaaauaguuggauuauauggcaauggcgucgucacaacuucagguacuuauguuucagcuauugcgcaggcaaaagcuagucaggagggaccauuaccugaaaucgaagacgaaguauuccgaaaaagaaaucucacuauuauggaccuucacccaggcucggguaaaacuagacgcuaccuaccagcaauagugcgagaagccaucaaacguaaacuuagaacccugauuuuagcaccaaccagaguagucgccucugaaauggcagaagcguuaaaaggaaugccgaucagguaucaaacaacggcagugaaaucagaacacacagguaaagaaaucguagaucucaugugucaugcaacuuuuacaaugagguuauugucaccaguuagaguaccaaauuauaacaugauuauaauggaugaagcccacuuuacagacccaaguaguaucgcagcccguggauauaucagcacucguguaggaaugggcgaagcagcagcaaucuuuaugacagcaacuccuccagguucgguagaagcauuuccccaaucuaaugcuguaauacaagaugaagagagggauauaccagagagaucauggaauaguggucacgaguggauaacagauuuuccuggaaaaaccguuugguucgugccaucuauuaagucugggaacgacaucgcaaacugccugcgcaaaaacgguaaacgagugauacaauugagccguaaaacauucgacaccgaauaccagaaaaccaaaaauaacgacugggacuauguuguuacgacggauaucucugaaaugggugcgaacuuuagggccgauagaguuauugauccuagaaggugccuaaaaccgguuauucuaaaagaugggccagagagaguaaucuuagccggccccaugccugucacaguagcaucugcugcucaaagaagggggcgaauugggagaaaucacaauaaggaaggagaucaauacaucuauauggggcaaccccuuaacaaugaugaggaucacgcgcacuggacggaagcuaaaauguuauuagauaauauaaauacaccugaagggauuauacccgcacuauuugaaccugagagggagaaaagugcggcaguugacggugaauaucgauuaaggggcgaagcaagaaaaaccuucgucgaacuaaugagaagaggggaccuacccguaugguugucauauaagguugcguccgaaggcuuccaauacucggacagaagauggugcuuugauggcgaacgaaacaaucaagugcuagaagaaaacauggacguugaaauauggacuaaagaaggugaaagaaagaaauugagaccuagauggcuggaugcacguacauauucggacccucuagcuuugagagaguuuaaagaauuugcagcaggacgaagaucugugucaggggaucuuaucuuagagauuggaaagcuaccucaacaucuuacucagcgagcucagaacgcauuagauaacuuaguaaugcuacacaauucugaacagggcggacgagcauaccggcaugcaauggaagaauuaccggauaccaucgaaacccucaugcuauuagcauuaauagcaguauuaacagggggaguaacacuauucuuucuaucagggagagguuuaggaaaaacaagcauaggguuacuaugcguuauggcauccagcguacuacucuggauggcauccguagaaccccauuggauugcugcgagcaucauacuugaauuuuucuugaugguucuacuuauuccggagccagaccgacaaagaacuccccaggauaaccaguuagcuuaugugguuaucggccuauuguucaugauacugacgguugccgccaaugaaaugggcuuacucgaaaccacaaagaaagaccuaggaauaggccauguugcgguagaaaaucaccaucaugcagcgaugcuagacguugaccugcauccugcuucggcuuggacucuauaugcaguagcaacuacaaucauaacuccuaugaugcgacacacuauugaaaauacaacagccaauaucagccuaacugcaauagcuaaccaagcggcuauacucaugggguuagacaagggcuggccuauaucaaaaauggacauaggcguaccuuuauuagcucucggaugcuauucucaaguaaauccauuaacgcuuacagccgcaguccugauguugguugcucauuacgcuauuauuggacccggacuucaagcaaaagcuacucgagaagcccagaaacggaccgccgccggaauaaugaaaaacccuacgguagacgguauaguagcaauugaucucgacccugugguauacgacgcuaaauucgaaaagcaguuaggucaaauaaugcuacucauacuauguacuucacaaauacuacuuaugaggacuacaugggcccugugugagagcauaacacuggcuacagguccgcucacuacgcucugggaaggcaguccggggaaauucuggaacacuacgauagcagucaguauggcuaacauuuuccgcggaucuuauuuagcuggagccgguuuagcuuuuucguuaaugaaaucacuaggagggggacgaagaggaaccggugcucaaggugaaacucuaggagaaaaauggaaacggcaauuaaaucagcuuucgaaauccgaguuuaauacuuauaagagaaguggaauuauggagguggacaggucagaggcuaaggagggauugaaaagaggugagacaaccaaacaugcaguaucccguggcacagcuaagcugagaugguuuguugagcgcaaucuugucaagccugaagguaaagugauagacuugggcuguggaagaggaggauggagcuauuauugugcagguuugaagaaaguuaccgaaguaaagggauacacuaaaggugguccggggcaugaagaaccaauucccauggcaacauacggcuggaaucugguaaagcuccauagugguaaagacguauucuuuaucccaccagagaaaugugauacguuacucugugauauuggagaaucgucaccgaauccuacaauugaagaggguagaaccuuacgggugcucaaaaugguugagccauggcuacgagggaaucaauucuguauaaaaauacuuaauccguauaugcccuccguaguggaaacacuagaacaaaugcagagaaaacauggcggcaugcugguaaggaacccucuaucuagaaauucgacucacgaaauguauuggguuagcugcgggaccggaaacauaguuucagcgguuaacaugacaucgaggaugcuacucaacagauucacaauggcacaccguaaaccuaccuaugaaagggacguggaucuaggaacugggacaagacacgucgcugucgaaccugaaguagcaaauuuagacauuauaggucagcgcauagaaaauauuaaacaugagcauaaaaguacuuggcauuacgacgaagacaauccguacaagacaugggccuaucauggaagcuaugaaguaaaaccaagcgguuccgcaucgaguauggucaacggaguaguuaaacuauuaacuaaacccugggacguuauaccuaugguuacgcaaaucgcgaugaccgacacuacaccguucggacaacaacgaguuuucaaggaaaaaguagacacaagaacaccuaaagcuaaacgagguacggcgcaaauaauggaaguuacugcaagaugguuguggggguuuuuaucucguaauaagaagccgagaaucugcacgcgagaggaguucacccgaaaaguccggucgaacgccgccauuggagccguauucgucgacgagaaccaauggaacuccgccaaagaggcgguggaagacgagcgguucugggacuuaguucaccgcgaacgugaacuacacaaacaagguaaaugugcaacauguguuuauaacaugauggggaagcgugaaaagaaacucggggaauuuggcaaagcaaagggaucuagagcaauaugguauauguggcugggagcaagauuucuagaauuugaggcgcuaggauuuaugaaugaggaucacugguuuaguagagaaaauucacuaagugguguagaaggcgaagguuuacauaaauuaggcuauauacugcgagacauuaguaaaauaccuggagguaauauguaugccgaugacacugcgggaugggacacacggauaacagaagaugaucuccaaaaugaagccaaaaucacugacaucauggaaccggagcaugcacuucuugccaaagcaauuuucaaguugacauaucaaaauaaggugguuagaguacaacggccugcuaaaaauggaacgguaauggauguuauaaguaggcgagaccaacguggaagcgggcaaguugguacguacggacucaacacguuuacaaauauggaagcacaacucauacgucagauggaaagcgaaggaauuuucucgccaagcgaauuagaaacaccuaaucuagcugaacgagcacuugauuggcuugaaaaguauggaguugagaggcuuaagaggauggcaauauccggagaugauugugugguaaaaccgauagaugauagauuugccacagcauuaaccgcacucaaugacaugggaaagguaagaaaagauauaccucaaugggagccuaguaaaggauggaacgauuggcaacaagugcccuuuuguucucaucauuuucaucaacucauaaugaaagacggacgugaaauagucguccccugccgaaaucaggaugaacucgucggcagagccagggugucucaaggcgcaggguggucacucagggaaacggcgugcuugggcaagucuuacgcucagauguggcaguuaauguauuuccaccguagagaccucagauuggcugcaaacgcaauauguucggccgucccaguugacuggguaccuacaucaagaacgacguggucaauacacgcacaucaccaguggaugacaacagaggacaugcuaagcguauggaauagaguauggauagaagaaaaccccuggauggaggacaaaacucauaucagcaguugggaagauguaccauaccuuggaaaacgagaggaucaguggugugggucgcuuauuggauuaaccgcaagggcuacuugggcaacaaacauacaaguagcgaucaaucaaguuaggagauuaauaggaaaugaaaauuaccuagacuacaugacuucaaugaagagauucaagaaugagagcgacccagaaggagcuuuaugguaa

SEQ ID NO: 21679 - RNA, 9879 nt, Artificial Sequence
  derived and/or modified CDS sequence (opt6) from DENV-1__GQ199801__SS-prME
ucggugacaauguuauuaauguuaaugccaacagccuuagccuuucaucuuacaacacgugggggagaaccucauaugauagucagcaaacaagaacgaggaaaaucauuacuauucaaaacuagcgccgguguaaacauguguacauuaauagcaauggauuuaggugaacuaugugaagacacaaugacauauaaauguccaagaaucacugaagcagaaccagacgacguggauugcugguguaacgcgacagauacauggguaacauacgguacauguucacaaacaggagaacacaggcgugauaaaagaucaguagcacuugcuccccauguaggacuaggauuagaaacacgaacugaaacguggaugaguucggaaggagccuggaaacagauacaaagaguugaaacuugggcacuacgccauccagguuuuacugucauugcucuuuucuuggcccaugcaauaggaacgucuaucacccaaaaaggaauuaucuuuauacuucuuaugcuuguaacacccuccauggcaaugagauguguugguaucggcuccagggauuuugucgaaggacuuucaggcgcuacaugggucgacguaguacuagaacauggaucauguguaacuacaauggcaaaagauaaaccaaccuuagauauagaacuacuaaaaacagaaguaacaaauccggcgguacugaggaaauuaugcaucgaagcaaaaaucucuaauacaacuacugacucuagaugcccaacacagggcgaagcaacgcuaguggaagaacaggacgcaaacuucguguguaggagaacguuuguggaccgaggcugggguaaugggugcggucuuuucggaaagggauccuuaauaacuugugcaaaauuuaaauguguaacccgauuagaagguaaaauaguacaauacgaaaaucuaaaguauucugucaucgucacaguacauaccggugaucaacaucaaguggggaacgaaucaacggaacaugggacaacugcaaccaucacaccacaggcuccaucuacagaaauucagcuaaccgauuacggagcccuuacacuagacuguucaccacgaacugggcucgauuuuaaugagauggugcuauuaacuaugaaagaaaagagcuggcugguacacaaacagugguuucuggaucuaccucuuccguggaccucaggcgcuuccacaagccaggaaacuuggaauaggcaagaucuacugguaacauuuaaaaccgcucaugcuaagaaacaagaagucguaguccucggcucucaagaaggcgcaaugcacaccgcguuaacaggugcuacugagauacaaacaagugggacgacaacuauuuucgcaggacauuuaaaaugccgucuaaaaauggauaagcuaacacuaaagggcaugaguuacgucaugugcacugggaguuuuaaauuagaaaaggaaguagcggaaacacagcacggaacugugcuaguucaaauaaaguaugaaggcacggaugcuccaugcaaaauuccauuuaguacucaggacgaaaaaggggugacccaaaauggcaggcucauaacagcuaaucccauuguuacugauaaggagaagccugugaacauagaagcugaaccaccuuuuggagagaguuacauagugaucggugccggagaaaaagcauuaaaacucucuugguuuaagaaggguucaucaauuggcaaaauguucgaagcaacagcucguggcgcacguagaauggccauauuaggagacacagcuugggauuucgguaguaucgguggaguauuuacuucaguagggaagcuagugcaccaaauauuuggaacugccuacgggguauuguuuuccggugugucauggaccaugaaaauaggcauaggagugcugcugaccuggcuaggacugaacuccagaucaaccaguuuaagcaugacauguauugcggugggacugguaacgcucuaucuagguguuaugguccaagcugauucagggugcguuauuaauuggaaaggccgagaacuaaagugcggcucaggaauauucgucacuaaugaaguacauacuuggacagaacaguauaaauuucaggcagauagccccaagcgacuaucugcugccauagguaaagcaugggaggagggcguauguggaauuagaucggcaacaaggcuagaaaacauaauguggaaacaaaucaguaaugaauuaaaucauauacuacuugaaaacgauaugaaauucacggucguuguuggagaugucgcugggaucuuagcacaagguaagaaaaugauaagaccgcaacccauggaguauaaguauucauggaagucuugggggaaagcaaagauaauaggugcggacguacaaaauacaaccuucauuauugauggaccuaauacaccagagugucccgaugaucaacgggcauggaacauuugggaaguugaagauuauggauucggcauauuuacaacaaacauauggcuuaaacucagagauucuuauacacaagugugcgaccauagauuaauguccgcggcaauaaaagacucuaaggccguucacgcugauaugggguacuggauagaaagugagaaaaaugaaacguggaaacuagcaagagccagcuuuauagaaguaaaaacaugcaucuggcccaaaucacauacgcuauggucaaacgguguacuagaguccgaaaugauaauaccaaaaaucuacgggggaccaaucucccaacauaauuaucgaccagguuacuuuacucagacggcaggaccguggcacuuagggaaguuggaacuugauuucaauuuaugugaaggaaccacugugguaguugaugagcauuguggcaaccggggucccucucugcgaacuaccacggugacaggcaaaauaauacacgaaugguguugcagauccuguacucucccaccauuacgguucaaaggugaagacggguguugguaugggauggaaauaaggccggugaaggagaaagaagaaaacuuggucaagagcaugguaagcgcuggcucuggagaaguggauucauuuagccucggauuauugugcauaaguauaaugauugaagaagugaugcguucgagauggagcaagaaaaugcuaaugaccggcacauuagcaguauucuuucuacuaauaaugggacaacucacauggaacgauuuaauacgacuuugcauaauggugggugcuaacgcuucagaccgaauggguauggggacaacuuauuuggcgcucauggcaacuuuuaagaugagaccuaugcuagcagugggguugcuuuuucguagacuaacaagucgagaggugcuauuacuaacaauaggauuaaguuuaguagcaaguguagaacuaccaaauagccuagaagaacuaggagauggacuagcaaugggaaucaugauucuaaagcuguuaacagauuuccaaucacaccaguuaugggcuacauugcugucacuaaccuuuauaaaaacaacauacucucugcacuacgcauggaagacuauggccaugguacuaaguauagucucgcuuuuuccacuaugccuauccacgacgucccagaaaacuacuuggcuaccgguguuacuuggaucacugggauguaaaccauuaacuauguuucugauagcugaaaacaaaauauggggaagaaagaguuggccucucaacgaagguauuauggcuguagggauaguuucaauauugcuaagcaguuuacucaaaaacgacgugccucuggcuggaccgcucaucgcuggagguaugcuuauagcauguuacgugauuucuggauccucagcggaucuaucuuuagaaaaagcagcggaaguaaguugggaagaggaagccgaacauaguggagccucacacaauauucuugucgaaguccaggaugacggcaccaugaagaucaaggaugaagaacgagacgauacacugacaauacuauugaaagcgacguuauuggcaguuucugguguauaucccuuaucgaucccagcaacauuauuugugugguauuucuggcagaagaagaaacaaagguccggcguauugugggacacacccaguccgccggaggucgaaagagcgguacuggacgacgggauauaucgaauuaugcaacgaggguuacuaggucgaucucaagugggggucggaguauuucaggaaaacgucuuucacaccauguggcacguuacgcgaggagcaguuuuaauguaucagggaaaaagauuggagccuucaugggcaagcguaaagaaagaccugauaagcuaugguggcggauggagauuacaagguaguuggaacacgggugaggaaguucaaguaauagcaguagaaccagguaaaaaccccaaaaacguacaaacagcuccaggcaccuucaagacaagugaaggagaaguuggagcuauugcacuugauuucaaacccggaaccagugguucacccauagugaacagggaaggaaaaauagucggccucuacgggaacggaguaguuacaacgucggguacauacguaagugcaauugcacaggcaaaagccucacaagaaggcccccugcccgaaauugaaaaugagguuuuuagaaagcgaaauuuaacaauaauggacuuacacccggguagcgggaagacaagaagauaccuaccggcuauuguucgagaagcaauuaagagaaaguuacgaacccucauacuagcuccuacaagaguugucgcgucagagauggcagaggcauuaaaagggauuccgauacguuaucaaacaacggccguuaaaagugagcauaccggcaaagaaaucguugaucuaaugugucaugccaccuuuaccaugagauuacuuucccccgugagaguuccaaacuacaacaugauaauuauggaugaagcucacuuuaccgaccccuccaguauugcagcaaggggauacaucuccacacgcguagggaugggugaagcugcggcaauuuuuaugacugcaacaccuccgggaucaguagaagcauuuccacaaucgaacgcugugauacaggaugaagaaagagauauuccagaacguuccuggaacucaggauaugaauggauuacggacuucccaggaaaaacugugugguucguaccgaguauaaagucaggaaaugacauagcuaauuguuuacguaagaaugguaaaagggucauucaacuaaguaggaaaacguuugacacagaauaucagaaaacuaagaacaacgauugggacuacgugguuacaacggauauaucagagaugggagcuaauuuuagagcugaucgagucauagacccaagaagaugcuuaaagccaguuauauuaaaagauggcccugaacgaguaauuuuagcaggcccaaugccaguaacgguagcaagugcagcccaaaggaggggaagaauaggacgaaaccauaauaaagaaggugaucaauauauuuauaugggucaaccguuaaacaacgaugaagaccaugcacauuggacugaagcaaagaugcugcuagacaacauuaauaccccagaagguauaauaccagcgcuuuucgaaccugaaagagagaaaucugcagcaauugacggggaauacagauuaagaggugaggcaagaaaaacguuuguggaacugaugagaagaggugaucuaccagucuggcuaaguuauaaaguggcuagugaaggauuucaauacucggacagaagauggugcuuugauggggagcguaacaaccagguauuagaagaaaauauggauguagaaauauggacaaaagaaggggaacgaaagaaauuacguccaagguggcuagaugcucguacguacucagauccucuugccuuaagagaauuuaaagaauuugcugcggggcgacgcuccgugagcggugaucuuauccuugaaauagggaaacucccacaacacuuaacccaacgugcucaaaaugcucuagauaauuugguaaugcuacauaacucagaacaagguggucgggcuuaccggcaugcuauggaggaacuacccgacacaauagaaaccuuaaugcugcuugcucugaucgcaguauuaaccggagguguaacguuauucuuucucuccggaagaggucuuggaaaaacaucuauaggauuguuauguguaauggccucaagcguuuuguuauggauggcuucuguugaaccucacuggauagccgcaucaauuauccuugaguucuuccuaaugguacuauuaauuccggagccagauagacaacggacgccucaagauaaucaacuggcauacgugguaauaggacuuuuauucaugauauuaacugucgccgccaacgaaaugggguuguuagaaacaaccaagaaagaucuuggaaucggacauguugcgguagaaaaccaucaucacgcagcuaugcuagauguagaccuacacccugccucagcuuggacucuauaugcaguagcaacuacaauuaucaccccuaugaugcggcauacgauugaaaauacuacagcgaauaucucuuuaaccgccaucgcaaaucaggcagcuauuuuaaugggauuggacaaaggauggccuauaucgaaaauggauauaggagucccacuacucgcacuuggaugcuacucccaaguuaauccacuuacuuugacugcugccguauuaauguugguagcccauuaugcaauuauaggaccaggucuacaagcuaaagcuacgagagaagcccagaaaaggaccgcggcaggaauuaugaaaaauccgacaguugaugggauaguagcuauagaucuugacccuguugucuaugacgcaaaauucgaaaagcaguugggccaaauaaugcuauuaauuuuauguacaucacaaauauuauuaaugcgaacuaccugggccuuaugcgaaucaaucacacucgccacaggaccacuaacaacacuaugggaagggucaccagguaaauuuuggaauacuacaaucgccguuuccauggcuaacauuuuccguggaaguuaucuagcuggugcaggguuagcauuuucucuaaugaaaaguuugggaggcggaagaagagggaccggagcucagggggagacauuaggggaaaaauggaaacgacaauuaaaucaacuaagcaagagcgaguucaauaccuacaaaaggagcggaaucauggaagucgaucguucagaggcgaaagaaggccuaaaacgaggagaaacuacuaaacaugcggucucucggggcacugcaaaacuuaggugguucgucgaaaggaacuugguaaaaccagaaggaaaagucauugaccuagguugcggacgaggugguuggaguuacuauugugcggggcucaaaaagguaacggagguaaaaggcuacaccaagggcgguccaggucaugaggagccaauccccauggcuacauacgguuggaacuuaguaaaauuacauagcggaaaagacguauucuuuauuccgccugagaaaugugacacauuguuaugugauauuggagagucaucgccgaacccaacaauagaagaaggacgaacccuaagaguauuaaagaugguggagccauggcucagagguaaccaauucuguauaaagauauuaaaccccuacaugccaucaguuguugaaacucucgaacaaaugcaaagaaaacaugggggaaugcucguacgcaacccguuaucacgcaauaguacacacgagauguacugggucucaugugguacaggaaauauagucagugccguaaacaugacgucuagaaugcuuuuaaaucgguuuacuauggcccaucguaaaccuacguaugagagggauguugauuuaggggccgguacacgucaugucgcaguggagccagaagucgcaaaucuugauauaauuggacaacggauagaaaauauaaaacacgaacauaaaucgacuuggcauuaugaugaagauaacccuuauaaaaccugggcauaccaugggucuuaugagguuaaaccaagcggaagugcaaguaguaugguuaacggagucgugaaacuauugaccaaacccugggacguaauuccaaugguuacacaaaucgcuaugacggauacuacuccuuuuggacaacaacguguuuucaaagaaaagguagauacacgcacacccaaagcuaaaaggggaacagcacaaaucauggaagucaccgcgaaauggcuauggggauuucuuagucgaaacaaaaagccacgaauaugcacccgagaagaauuuacacguaaaguaaggucuaacgcagcaauuggggcggucuucguagaugaaaaucaauggaacuccgcuaaagaagcggucgaagaugagagauucugggaccuuguccaucgagaacgcgaacuacauaaacaaggcaaaugugcuaccugcguuuacaauaugauggguaaaagagagaagaaauuaggugaguucggcaaagcaaagggaucuagagcuaucugguauauguggcuaggggccagauuuuuggaauuugaagcauugggauuuaugaacgaagaucacugguucucuagagagaacucauuaucagguguagaaggagaaggacugcauaaauugggcuacauccugagagauauauccaaaauccccggcggcaacauguaugcagacgauacagcuggaugggacaccagaauuacagaagaugauuuacagaaugaggcaaagauaacagauauaauggagccagaacaugcacuacucgcgaagucuaucuuuaaauugaccuaucaaaauaaaguaguacgagugcagcgaccggcgaaaaaugguaccguaauggacguaauaaguaggagagaucaacgagggucuggccaagugggaacuuauggccuuaacaccuucacuaacauggaagcucaauuaauacgucaaauggagucggagggaaucuucagcccuagcgaacucgagaccccgaauuuagccggacgaguuuuagauuggcuggaaaaacacgggguugagcgacuaaagcgaauggcuauuaguggcgaugauuguguaguuaagccaaucgaugacagauuugcaacagcucuuacagcauuaaaugacaugggaaaaguacgcaaagauauaccacagugggaaccaagcaagggcuggaaugacuggcaacagguaccuuucugcucgcaccauuuucaucaacuaauaaugaaggacggcagagaaaucguaguaccgugcagaaaccaagacgagcuaguugggagagcucgaguaagucagggugcgggguggucauugagagagacagcgugcuuaggaaaaagcuacgcgcaaauguggcaacuaauguacuuucacagacgugaucuacgguuagcagccaaugcaauauguagcgcaguacccguagacuggguucccacaucgagaaccacgugguccauccaugcacaccaccaauggaugacgacugaggauaugcuauccgucuggaauagaguauggaucgaagaaaauccauggauggaagacaaaacccacauuucaucuuggggagauguuccuuauuuaggaaaacgggaagaucaauggugugggagucuaauaggucuaaccgcgagagcaacuugggcaacgaacauacagguagcuauaaaucaaguacggcgcuuaaucggaaacgagaauuaccuggacuauaugacaaguaugaagagguucaaaaaugaauccgaccccgaaggggccuuaugguaa

SEQ ID NO: 21680 - RNA, 9879 nt, Artificial Sequence
  derived and/or modified CDS sequence (opt6) from DENV-1__GQ199802__SS-prME
ucggugacaaugcuauuaaugcucaugcccacggcauuagcuuuccaccuaacgacuagagguggugagccacauaugauaguuuccaaacaagaacguggaaaaagucuacuuuuuaaaacauccgcugggguuaauauguguacgcuuauagcaauggauuugggugaacuaugugaagacacaaugacauauaaaugcccaagaauuacagaaacagaacccgacgacguagauuguuggugcaacgccacggacacuuggguaacuuauggcacgugcucacaaacaggagaacauagaagagauaaaagaucugucgcauuagcaccgcacguaggucuaggauuagaaacccgcacagaaacauggauguccucggaaggugcauggaaacaaauacaaagaguagaaacaugggcgcugcggcauccggguuucaccguaauagcucuuuuccucgcgcacgcaauugguacaucaauaacucagaaagguauaauauuuauacuacuaauguuaguuacuccaaguauggcaaugagauguguaggaauugggucucgugauuucgucgaaggauuaucuggagcaacauggguggauguaguucucgaacacgggagcuguguaaccacaauggcuaaagacaaaccuacccuugauauagaguuauugaaaaccgagguuaccaacccagcaguuuugcguaaacuuuguauagaggcuaaaaucaguaauacaacaacugacaguaggugcccaacccaaggagaagcaacucuaguagaagaacaggaugcgaauuuuguaugccgaagaacauucguggauaggggauggggaaacggauguggguuauucggaaaaggaucccucaucacgugugccaaauucaaaugugugacuaaauuggaagggaaaauaguucaauaugaaaaucuuaaauauucaguaauagucacuguucacacuggagaucaacaucagguuggaaaugaaucuacugaacacgguacuacagccacaauuaccccgcaagcgccaaccacagaaauacaauuaacagacuacggagcccuaacucuggauugcucuccgagaaccggucuagacuuuaaugaaauggucuugcuuacaaugaaagaaaaaucuuggcugguucauaaacaaugguuucuggacuuaccacuucccuggacaagcggagccucuacuucacaggaaacauggaaucgacaagauuuauugguaacuuucaaaacugcacaugccaagaaacaagagguaguuguacucggaucucaagaaggagcuaugcauacagcauuaacuggagccacugaaauccagacaagugggacuacaacuauauucgcaggccaucugaaaugcagguugaaaauggauaaacuaacgcuuaaaggaaugucauaugucaugugcacaggaaguuuuaaguuagagaaagaagucgcagaaacacaacaugguaccguauugguucaaaucaaauacgaagguaccgaugcucccuguaagauaccauuuucuacgcaagaugagaaaggaguuacacaaaacggcagacugaucacagccaacccuauuguaacagauaaggaaaagccaguaaauauugaggcagagccacccuucggcgaaucuuauauaguaauuggugccggugaaaaggcgcuuaagcuauccugguuuaaaaagggcucaucaauagggaaaauguuugaagcuaccgccagaggagcacgaagaauggcgauacuaggagauacagcgugggauuuuggaucgauaggaggaguuuuuacuucagucggcaaauuaguacaucaaauauuuggaacugcauaugggguucucuucuccggaguuucauggacuaugaaaauagggaucggaguccuauuaacauggcuugggcuaaauagucgaucaacaucgcugucgaugacuugcaucgcaguagggcuugucacccuguacuuagguguaaugguacaggcugauuccggcuguguaauuaauuggaaagggagggaauuaaaaugcggcucugggauuuucguuacuaacgaaguccacacuuggacagaacaguauaaguuucaggcggacagccccaaaagacuuagugccgcaauaggaaaagcaugggaagagggagucuguggaauaagaagcgcuacucgacuugaaaauauaauguggaaacaaaucuccaaugaacuaaaucacauacuuuuagaaaaugauaugaaauucacuguagugguuggggacguugccgggauucuagcgcagggaaagaagaugaucagaccacagccaauggaguacaaguacaguuggaaaagcugggggaaagcaaaaauaauuggagccgacguacaaaacacaacauuuauuauagauggacccaacacaccggaauguccugacgaccagagggccuggaacauaugggagguagaggauuacggguucgguauauucacaaccaacaucuggcuaaaauuaagagacaguuauacacaaguaugugaccauaggcuaaugucggcagcaauuaaagacuccaaagcaguacacgcugauaugggauauuggauagaaucugagaaaaaugaaacuuggaaacuggcaagagcaucauuuauagaaguaaagacauguauauggcccaaaagccacacacuauggucuaauggaguucuugaguccgagaugauuauuccgaagauuuauggagguccaauuucacaacauaacuaucgcccaggguauuucacacaagccgcaggaccuuggcaccuaggcaaacuggaauuagauuuugauuugugugaaggaacaacuguaguagucgacgaacauugugguaaccgaggcccuucauuacguacuacaaccguaaccgguaaaauaauucaugaaugguguugucguucaugcacacuaccaccucuucgguucaaaggagaggauggauguugguauggaauggaaauacggccaguaaaagaaaaggaagaaaaccucgucaagucaauggugucagcuggaucuggggaaguugauuccuuuagucugggucuacuauguauuuccauaaugauagaggaagucaugcguucccgcuggaguagacgcauguuaaugacaggcacucuggcgguuuucuuuuugcuuauaaugggacaacuaacguggaacgauuuaauuagacuuugcauuauggucggugcgaaugcaucggaccgaauggguauggguacaacguaucuugcuuugauggcuaccuuuaaaaugagaccuauguucgcuguuggccuauuguuucgccgccuuaccucaagagaaguucuauuacuaacgaucgguuugucauuaguagcauccgucgaacuuccuaauaguuuggaagaacucggagacggccucgccauggguauaaugauacuaaagcuauugacagauuuucagucucaucaacuaugggcuacacuuuugagucuaacuuuuauaaaaaccacguuuucccugcauuaugccuggaaaaccauggcuaugguccuaucaauaguaagccuauucccacucugucugaguacaacuucccagaaaacuaccugguugccgguucuauugggauccuuaggauguaaaccucuaacaauguuucugaucgcggagaauaaaauuuggggaagaaggaguuggccauuaaaugaaggcauaauggcgguuggaauagugaguauuuuguuaaguagccuacuaaagaaugauguaccauuagccggaccuuuaauugcaggagggauguuaauagcaugcuauguaaucucaggauccucagcagaucucagcuuggagaaagcagcugaagugagcugggaggaagaagcggaacacucaggcgcuucacacaauauccuaguagaaguucaggacgaugguacuaugaaaauaaaggacgaggaacgagaugauacauuaacgauacuccuaaaggcaacauugcuagcgguaagcgggguuuauccacucaguauuccagcuacacuguucguaugguacuuuuggcagaagaagaaacaaagaagcggaguccuuugggauacuccuucaccgccagagguugagcgcgcuguucuggacgacggaaucuaucguauaaugcaacgagguuuguuaggacggagucaaguagguguaggaguguuccaggaaaacguauuucacacaauguggcaugucaccagaggcgccguccuaauguaucaggguaagagacuggaaccuaguugggcuucggucaagaaagauuuaauuuccuaugguggggguuggagguugcaggggaguuggaacacaggugaagaaguacaaguuauugccguugagccaggcaaaaauccuaagaacgugcaaacagcgccaggaacguuuaaaacuccugaaggagaaguaggagcuauugcacuugacuucaaaccagguacgagugguucuccuaucgugaacagggaagggaaaauagucggauuauauggaaauggaguugucacgaccucagguacuuauguaucugccauagcacaagcaaaagcaucucaagaggggccgcuaccagaaaucgaagaugaaguauuccggaaacgaaaucugacuauaauggauuugcauccugggagugguaaaacgaggcgcuauuuacccgcgauaguacgagaagcuauaaaaagaaaacuaaggacccuaauauuagcuccaacuagagugguagccucagaaauggcugaggccuuaaaagguaugccaauaagauaucaaacaacggccgucaaaucugaacacacaggaaaagaaauuguggaucuaaugugucacgcaaccuucacaaugagacuacugaguccaguccggguaccuaauuacaacaugauuauaauggaugaggcacauuuuacugacccaaguucuauagcugcgcggggauacauuaguacgagaguaggaaugggagaagcugcagcaauauuuaugacugcgacuccaccaggaucuguugaagccuuuccgcagucaaaugcaguaauccaggaugaggaaagagacaucccugagcgaucauggaacucaggauaugaguggauaacugauuuuccaggaaaaacaguuugguuuguuccaucaauaaagucaggcaaugacauagcgaauugucugaggaaaaauggcaagcgagucauacaacugucaagaaaaaccuuugauacagaauaccaaaagacuaaaaauaacgauugggacuacguaguaacgacagauauauccgagaugggagcaaauuuucgcgcugaucggguaauagauccccgaagaugucuuaagccaguaauucuaaaagauggaccugaacguguaauuuuagcgggaccaaugccggucacaguugcgucagcagcacagagacgcggacgcauagggaggaaucauaauaaagaaggagaucaguacauuuauaugggacaaccucuuaacaaugaugaagaccacgcacacuggacagaagcaaaaauguuguuagauaacauaaauacaccugaagguauaauuccagcuuuauuugaacccgaacgcgaaaagagcgcagccauagacggagaauacagacuaagaggagaggcaagaaaaacuuuugucgaacugaugagacgcggagacuuaccaguuuggcuuaguuacaaaguugcuucagaaggauuucaauauucugacagaaggugguguuucgauggugagagaaauaaccaagucuuagaagagaauauggauguagaaauuuggaccaaggaaggugaaaggaagaaauuaagaccaagauggcuagacgcgcgcacauacagcgacccacuggccuuacgugaauuuaaagaauuugcugcaggcagaaggucaguuucaggcgauuugauccucgagauuggcaagcuaccccaacaccuaacacaacgggcucaaaaugcacuugauaaccuaguaauguuacauaacagcgaacaggguggacgugcauaccgacacgcgauggaagaacuuccagacacaauugaaacacuaauguuacuggcacucauugcgguucuuacuggagggguaacacuuuucuuuuuaagcggucgaggacuuggaaaaacuucuauaggacucuugugcguaauggccucuucgguauuguuauggauggcuagcguugaaccucauuggauugcagcaaguauaaucuuagaauuuuuccuuaugguacuucucauucccgagccagacagacaaagaacgccacaggauaaccagcuggcguaugucguuauuggccuccuauuuaugauucuaacaguagcggccaaugaaauggguuuauuagaaacaaccaagaaagacuuagguauaggacauguagccguagaaaaucaucaucacgcugcaaugcuggauguagaucuucauccggcuagugcauggacguuauaugcagucgcaaccacaauuauaacuccaaugaugagacauacgauugagaacacaacugcuaauaucucauuaacugcaaucgcuaaccaagccgcuauacuaaugggacuggauaagggauggccaauuucuaagauggauauuggugugcccuuauuagcucuggguuguuacucacaggucaacccccugacacuaacagcagcgguacuaaugcuaguagcucacuaugcaauuauugguccuggcuugcaagcaaaagcgacgagggaggcucagaaaagaacagcugcagguauaaugaaaaauccaacgguugacgguauaguugccauugaucuggacccggucguuuaugacgcuaaguuugagaagcaacugggucaaauaaugcuucugauuuuaugcacaagucaaauucuauugaugcggacaacuugggcacuaugugagucgauuacacucgcuaccggaccuuuaacaacguuaugggaaggcucgccuggaaaauuuuggaauacuacaauugcaguuaguauggcuaacauuuuccgaggaucuuauuuggccggagcaggacuugcguucucauugaugaaaagccuggguggagggcgacgugggacaggggcucaaggagaaacccugggagaaaaguggaaaagacaacuaaaucaacuaucaaagagcgaauuuaacacuuauaaaagaucaggaaucauggaaguagauagaucagaggcaaaggaaggccucaaaaggggugaaacaacuaaacaugcugucucaagagggacagcgaaacuucgcugguuuguggaacggaauuuggucaaaccagaaggaaaaguaauugaucuaggcuguggacgagguggauggucauauuacugugccgggcugaagaaaguuacugagguaaaaggauauacaaagggugguccugggcacgaagaaccuauacccauggcaacuuaugguuggaaucuaguaaaacuucacucaggaaaagauguauucuuuauaccgccugagaaaugugauacucuacuaugugauaucggcgagucuucaccuaacccaaccauugaagagggacgaacguuaagggucuuaaaaaugguagagccgugguugagaggaaaccaauucuguaucaaaauccucaacccguacaugccaagugucguagagacucuugaacaaaugcagcgaaaacacggcggcaugcuaguucgcaauccccuuucuagaaacucuacccaugagauguacuggguauccugcggcacugggaauauaguuucggcaguuaauaugacuucaagaauguugcuaaaccgauucacuauggcucaccgcaaaccaaccuacgagcgagacguagaccuuggagccggaacuaggcauguagcuguagagcccgagguagccaauuuggauauaaucggacaaaggaucgaaaauauuaaacacgaacacaaaucaacauggcauuacgaugaagacaaccccuacaaaacgugggccuaucaugguagcuaugaaguuaaacccucgggauccgcguccagcaugguaaauggcguuguaaaguuauugacaaaaccaugggauguuauuccgaugguuacgcaaauagcuaugacggacacuaccccuuuugggcagcagaggguguucaaggagaagguggauacaagaacgccaaaagcaaaacguggaacagcacagauaauggaaguaacagcaaaauggcugugggucuuucuaucucgcaauaagaaaccaagaauauguacaagggaagaauuuacacggaaaguacgaucaaaugcugcaauuggagccguuuucguagaugaaaaucaauggaacagcgcgaaagaagcaguagaagaugaacgauucugggaucuaguacaucgggaacgggaauugcacaaacaaggaaagugcgccacauguguguacaauaugaugggcaagcgugagaaaaagcucggggaauuuggaaaggcaaaaggaagucgugcaaucugguacauguggcuaggagcacgauuccucgaauuugaggcccuaggguucaugaacgaggaucacugguuuucacgugaaaacaguuuaagcgguguagaaggugagggauuacauaagcuaggguauauccuuagagacauaucgaaaauaccuggagguaauauguacgcagacgacacagcagggugggauacgcguaucacagaagaugaccuccagaaugaggcaaggauaacggauauaauggaaccugaacaugcguuacuagcuaaaucuauauucaaguugaccuaccaaaauaaaguagugagaguacagcgaccagcaaagaauggcacuguaauggauguaaucuccaggcgcgaucaacgaggcucagggcagguaggaacuuacggucucaacacguucacuaauauggaagcccaguuaauuagacaaauggaaagcgagggaauauucagcccaucagaacuugagacacccaauuuggcugaacgagugcuugacuggcucgaaaaauaugguguagaaagauuaaaacgaauggccauuucuggggaugauuguguuguuaagccaauagacgacagguuugcaaccgcgcuaacggcguuaaaugauauggggaaaguacgaaaggacauaccacaaugggagcccucuaaaggcuggaaugauuggcaacaaguaccguuuuguucucaccauuuucaucaacucauuaugaaggacgggcgagagauaguaguaccuugccgaaaucaagaugaguugguggguagagcaagaguuucgcaaggagcggguuggucgcucagggaaacugcgugccuagguaaaaguuaugcacaaauguggcaauuaauguauuuucaucgucgagaccuaaggcucgcugcaaaugcuauuuguucugccguaccuguagacuggaucccuaccucuagaaccacaugguccauucaugcucaucaccaauggaugacaacggaggauaugcuuucgguauggaacaggguauggauugaagaaaacccguggauggaagauaaaacacauauaucuaguuggggagauguaccauacuuaggaaaaagagaagaccaauggugcggaucucucauugggcucacagcccgugccacgugggccaccaauauucagguagccauaaaccaaguucgacgauuaauugguaacgaaaauuaccuggauuacaugacgucaaugaaaagauucaagaaugagagcgauccagaaggagcgcuaugguga

SEQ ID NO: 21681 - RNA, 9879 nt, Artificial Sequence
  derived and/or modified CDS sequence (opt6) from DENV-1__JF937597__SS-prME
agcguaacuaugcuguuaaugcuaaugcccacggcucuagcauuccauuugacuacuagagggggugaaccccauaugauaguaucaaaacaggaaaggggcaaaucguuauuauucaaaacaagcgcaggcguaaauaugugcacuuuaauagcuauggaucuaggcgaacuuugugaagauacuaugacuuacaaauguccuagaauuacugaagcagagccagaugacgucgauuguugguguaacgccacugacacauggguaacauauggcacauguucccaaaccggagagcaccggcgugauaaaagaagcguagcucucgcaccacacgucggcuuagggcucgaaacuagaaccgagacauggaugaguucggaaggggcuuggaaacaaauacaaagaguagaaacuugggcacuacgacaucccggauuuacugugauagcuuuguuccuugcccacgcgauuggaacaucaauaacacaaaaaggaauaauauuuauacuacucaugcucguaaccccaucgauggccaugaggugugucggaauagguucuagggacuuuguugaaggccuaucaggagcuaccuggguagauguaguauuggaacauggaagcugcgugacaacuauggcgaaagauaaaccuacacuggauauagaacuucugaaaaccgaaguuacaaacccugcgguauuaagaaaacucugcauagaggcaaaaauaucaaauacaacuacagauucaagaugucccacgcaaggugaagcaacucuagucgaagaacaagaugcaaacuuuguuugccguaggacuuucguagaucgcgguuggggcaauggaugugguuuguuuggaaaaggaagccuaauaacaugugccaaauuuaaauguguuacuaaacuugagggcaaaaucguucaauacgaaaaucuaaaguauucggucauagucacugugcauacuggagaucaacaccaggucgguaacgaaagcacugaacaugguaccacggcaaccauaaccccgcaagcaccaaccacugaaauacaauuaacggauuauggagcauuaaccuuggauuguucaccacguacaggucuagacuuuaacgaaaugguuuuguuaacaaugaaagagaaaagcugguuaguacauaaacaaugguucuuagaccuuccuuuaccauggacuuccggagcgaguacuucucaagaaaccuggaauagacaagacuugcucguuaccuuuaaaacagcacaugcaaagaaacaagaggucguggucuuaggaagccaagaaggagcaaugcauacugcguugacaggagcgacagagauucaaaccaguggcacuaccaccauauuugcuggccaccuaaaguguagacuaaaaauggacaaauugacauuaaaaggcaugucauacguuaugugcacaggaucguucaaauuagaaaaagagguagcagagacucaacaugggacagucuuaguucaaaucaaauaugagggcaccgaugcgccauguaaaaucccauuuaguacucaggaugaaaaaggaguuacccaaaauggaagacuaauaacagcaaacccaauagucacagauaaagaaaaaccugugaacauagaagccgaaccuccuuuuggagaaucauauaucgugauuggagcaggggaaaaggcacuuaaacuuaguugguuuaagaagggaucuagcauagguaagauguuugaagcuaccgccagaggagccagaagaauggcaauucuuggugacacugcaugggauuucgguaguauugguggaguauuuacaagcguagguaaguuaguccaucaaauuuuuggcacugcuuauggaguucuauuuagugggguaagcuggacgaugaaaauugguauagguguucuguuaacuuggcuagguuugaacucaagaagcacaagucuaaguaugacauguaucgcggucgguuuagugacacucuaucuuggagcuaugguucaagccgauagcgggugugucauaaauuggaaaggccgagaacucaagugugggucuggaauauuuguuacuaacgaagugcacaccuggacggaacaauacaaauuccaagcugauucacccaaacgcuugagcgcagcaaucggaaaggcuugggaagaaggagucuguggaauacgaucagcaacgcgauuagaaaauauaauguggaaacaaauaucuaacgaauuaaaucacauuuuacuggaaaaugacaugaaacuuacaguuguagugggagauguugcgggaauacugggacaggguaagaaaaugauaagaccacaacccauggaauauaaguauaguuggaaaaguugggguaaagcgaagauuauuggagcugaugcacaaaauacuacuuuuaucauagacggaccuaacacgccagaauguccagacgaccaaagagccuggaauauaugggagguagaagauuacggguuuggaauauuuacuacaaacaucugguuaaaauugagggauaguuacacccagguuugugaucaccgauuaaugucugcugcuauaaaagauagcaaagcaguacacgcggacauggguuacuggauugagucggaaaagaacgaaaccuggaaacuagcgagagcuaguuuuauagaaguuaaaacaugcauauggccgaaaagucauacauuauggagcaaugguguccucgaaucagaaaugauaaucccaaaaauauaugggggucccaucucgcaacauaauuaucgaccgggauacuuuacucaaaccgcuggaccauggcaucuuggaaaacuggaacuugacuuugaccugugugaaggaaccacggucguuguagaugaacacuguggaaauagagguccuucauugaggacaacaacgguaacaggaaagauaauucaugaaugguguuguagaucauguacgcuaccaccucugagauucagaggcgaggacggauguugguaugguauggagauacgaccaguuaaagaaaaagaagagaaccuaguaaaaagcaugguaucagcuggauccggggaagucgauuccuucucacuuggauugcuauguauaucaaucaugauugaggaaguaaugcggaguagguggagucguaaaauguuaaugacaggaacucuugcaguauucuuucuucuuauuaugggacaacuaacuuggaacgaccugauucgucuauguauuaugguuggagcaaaugcuagcgacagaauggguauggguacgacauauuuagcguuaauggcaacuuuuaaaaugagaccaauguucgcaguaggauugcucuuucgaagacuaacgagccgcgaaguguugcuucuuaccauagguuuaagccuaguagcaaguguugaacuuccuaacuccuuagaggaacugggggaugguuuagccaugggcaucaugauucuaaaacuucucacagauuuucaaucgcaucaauuaugggccacacuauugucacucacauuuauaaaaacgaccuucuccuugcacuacgcauggaagacaauggcaaugguccuuucuauaguuagcuuauuuccucuaugucuguccacgacuucacaaaagacaacgugguuacccgugcuguuagguucgcuaggguguaaaccccuuacaauguuccucauagcagaaaauaagaucugggggcguaaaaguuggcccuuaaaugaaggaauaauggcagucgggauuguaagcauacucuuaucuucguugcucaaaaaugacguaccuuuagccggcccguuaauagcgggagguauguuaaucgcauguuacgucauuucagggucgucugcagaucugucacuggaaaaagcagcugaaguuuccugggaagaagaagcggaacauucuggggcaucacauaauauccuaguagaagugcaagacgaugguaccaugaaaauaaaagaugaagaacgcgaugauacucuaacgauauuguuaaaagcgacucuauuggccguuucuggcgucuauccucugagcauuccagccacuuuauuugugugguauuucuggcagaagaagaaacaacguagugggguauugugggauacaccgagcccaccagaaguugaaagagcgguuuuagacgacggaaucuacagaauaaugcaaaggggacuccuggguaggucucaaguaggaguuggaguguuucaggaaaauguuuuccacacuauguggcacgucacuagaggagccguauuaauguaccaaggcaagagauuagaaccuucaugggcuagugugaagaaagaucuaauaaguuacggggguggauggagacuuaggggaucauggaauacaggagaagagguacaaguaaucgcaguggaaccugguaaaaaccccaaaaauguucaaacagccccuggaacuuuuaagacaccagaaggugaagugggcgcaauagccuuagauuuuaaacccggcacuucaggaucuccgauugucaaucgagaaggaaaaauagucggacuguacgggaauggagucguuacgaccucgggaacguacguuagugcuauagcgcaggcaaaagcaucacaagagggaccucucccggaaaucgaagaugaaguauuuagaaaaagaaaucucacuauaauggauuuacacccugggagugguaaaacacgucgauaccuuccggcgauugugcgcgaggccauuaaacgcaaauuaagaacccucauacuagcaccgacuagaguuguagcgucugaaauggcagaagcacuaaaggggaugcccauuagauaccaaaccacugcaguaaaaucugaacauacgggaaaagagaucguggaccuaaugugccacgcaaccuuuacgaugcgacugcuaagcccagugagaguaccaaacuauaauaugauaauaauggaugaagcacacuucaccgaccccucaaguauagcagcccguggauauauuucaacacgcguugguaugggugaagcagcagcgauuuuuaugaccgcgacaccaccagggucaguggaggcauuuccccaaagcaaugccguuauccaagaugaagagagagacaucccugaacguaguuggaacuccgguuacgaguggauaacagacuuuccuggaaaaacaguuugguucgucccgucuauaaaauccgggaaugauauugcaaauugucuaagaaagaacgguaagagaguuauacaauugucaaggaaaacauuugacacagaauaccagaaaaccaaaaacaacgauugggacuacgugguaacaacugacauaucggaaaugggcgcaaauuuccgagcggacagaguuauagauccacgaaggugccucaaaccggugauacuuaaggauggccccgaaagaguaauacucgcuggaccaaugccagucacaguugcguccgccgcgcaacgacgaggacguauaggucgcaaucauaauaaagaaggugaucaauacauuuauaugggacagccacuaaacaaugacgaggaucaugcucacuggaccgaagccaaaaugcugcuggauaauaucaauacuccggaggggaucauuccggcauuauuugaaccggaacgagaaaaaucugcggcaguagauggugaauacagguuacguggugaagcacgaaaaacuuuuguagaacuaaugcgcagaggcgaccuucccguuuggcuuagcuauaaaguagcaucggaaggauuucaauauuccgaccguaggugguguuucgauggugagcguaacaaucagguacuagaagagaauauggauguagagauauggacuaaagagggggagaggaagaaauuaagaccuagaugguuagacgcaaggacauacagcgaccccuuggcacuuagggaguucaaagaauuugccgcugggagacgcucuguaaguggugaucuaauccuggagauagguaaacuuccccaacaccuaacacagcgugcacaaaacgcacuggacaauuuagucauguuacacaauagugagcaaggagguagagcuuauaggcacgcaauggaggagcuucccgacacgauugaaacccuaaugcuauuggcccugauugccguacuuacaggugguguuacgcuauucuuucuaagcggccgaggacuaggaaaaacaucuauagggcuucuuugcguaauggcaucgucuguuuuacucuggauggcgucugucgagccucauuggauugccgcgaguauuauacuagaguucuuucuuaugguucuacuuauaccggagccugacaggcagagaacuccacaagauaaucaauuagccuauguuguuauaggcuuguuguuuaugauucugacgguggcagcuaaugaaauggguuuacucgagacaaccaagaaagaucuugguaucggacacguggcaguggaaaaccaucaucaugcagcgauguuagacguagaccuccauccagcaucagcuuggacauuguacgccguggcuacaacaauaauaacuccaaugaugaggcauacaauugaaaauacaaccgcgaauauuucccugacggcgauagccaaccaggcagcgauacuaauggggcuagauaaaggcuggccuaucaguaaaauggauauaggcgucccacuacuugcauuaggauguuacucacaggugaauccacuuacucuuacggcugcgguucugauguuagucgcacauuacgcaaucauaggucccgggcuucaagcaaaagcgacaagggaagcgcagaaaagaaccgccgccgguauaaugaagaacccaaccguagaugguauaguagcaauagaccucgaccccguggucuacgaugcaaaauuugaaaaacaacuuggacagauaaugcuucugauacuuugcacaagucagauacuacuaaugcgaacuacaugggcacuaugugagucaauaacucuggcuacagguccccuuacuacuuuaugggaagguucgccaggaaaauucuggaacacgacgauagcuguauccauggcgaacaucuuuagagguagcuaccuagcgggagcugggcuugcuuuuucacucaugaaaucacuaggagggggacgaagaggaacaggugcacaaggggagacucuaggagaaaaauggaaacgacaacucaaucaguuaagcaaaucggaguuuaacacauacaaacgcucuggaauaauggaaguagacagauccgaagccaaggaaggguuaaaaaggggagaaacaacaaaacaugcuguaucuagagggacagcaaaauuacggugguucgucgaacgaaaucuaguaaaaccugaaggaaaagucauagauuuagggugcggacgaggaggguggucguauuauugugcaggccucaagaaaguaacugaaguaaaggguuacacaaagggaggacccggccaugaagaaccgauaccgauggcuacuuacggauggaaucuaguuaaacuucacagcgggaaagauguuuucuuuauaccaccagaaaaaugcgacacgcuauuaugugacauaggagaaaguucuccaaauccaacaauagaggaggggcgaaccuuacguguucuuaaaaugguagaaccauggcuacgcggaaaucaauuuugcauaaaaauauuaaacccuuacaugccuucgguaguagagacccuagagcaaaugcagcgaaaacacggaggcauguuaguaagaaacccuuuaucaagaaauaguacucaugaaauguauugggucaguugugguacaggcaauauugugucugcagucaauaugacaaguagaaugcucuugaaucguuuuaccauggcacacagaaaaccuacauaugaacgggacgucgaucuaggcacugguacaagacacgucgcaguagaaccagagguagcgaacuuagacauaauaggacaaagaaucgagaauauaaaacaugaacauaaaaguacauggcauuacgacgaggauaauccuuauaagacuugggcguaccauggaaguuaugaaguuaaacccucugggucugcaaguuccaugguuaaugggguagucaaacuccuaaccaaaccaugggacguuauaccaaugguaacacaaauugcuaugacugauacaacacccuuuggacaacaacgugucuucaaggagaaggucgauacuagaacucccaaagcgaagcguggaacagcacaaauuauggaagugaccgccagaugguuauggggauuuuuaucaagaaauaagaaacccaggauuuguacucgggaagaauuuacccgaaaagugagaucgaaugcugcaaucggugcagucuuuguugaugaaaaccaauggaacucugcaaaagaggcaguagaagacgaaagauuuugggauuuaguccaccgggaaagagaauuacacaagcaagguaaaugcgcaaccuguguguacaauaugaugggaaaacgugagaagaaacuuggugaguuuggaaaagcgaaaggaucaagagcgauaugguauaugugguuaggcgcccgguuucuagaauuugaggcguuaggauucaugaaugaagaucauugguuuagccgggaaaauucccuaagcggcguggaaggagaaggguugcauaaauuagguuauauccuuagggauauaaguaaaauaccaggaggaaauauguacgcagacgauacagccgguugggauaccagaauuacagaagaugaccuacagaacgaagcuaaaauuacugauauuauggagccggaacacgcucuccucgcuaaggcaaucuucaaacuuacuuaucaaaacaaggugguacgaguacagagaccugccaagaaugggaccgucauggaugugauuucucgucgugaucaacgcggcaguggacaaguaggaacauauggauuaaauacguucacaaauauggaggcgcagcuaauacggcaaauggaaucugaaggcauauuuaguccuucggaacuagagaccccuaaccuagcagaaagggcauuaaauuggcuggaaaaguauggaguggaaagacuaaaaaggauggcaaucucaggagaugacuguguaguaaagccuauugaugauagauuugcgacugcuuuaacagcucuuaaugauaugggaaaaguuagaaaagauauaccgcaaugggaacccagcaaaggauggaacgauuggcagcaagugccauuuugcagccaccauuuccaccaacuaauuaugaaggauggaagggaaaucgugguaccaugcagaaaccaggaugagcuagugggcagggcucgagucagccaaggagcaggauggucuuugagagagacagcgugccuagggaaaucauaugcccaaauguggcaauugauguacuuucauaggagggauuuaagauuggcagcuaaugcaaucuguagugcgguuccgguugauugggugccuacaagucggaccacuuggagcauccaugcccaucaccaauggaugacaacagaagauauguuaucuguuuggaacagaguauggauugaagaaaacccauggauggaagauaaaacccauauuaguuccugggaagacgucccuuauuuaggcaaacgagaagaucaaugguguggauccuuaauaggacuuacagccagagcgaccugggcgacgaacauucaaguggcaauuaaucaaguacguagacuaauaggcaacgaaaauuauuuagauuauaugaccaguaugaaacgauucaaaaacgagucagauccagagggagccuugugguag

SEQ ID NO: 21682 - RNA, 9879 nt, Artificial Sequence
  derived and/or modified CDS sequence (opt6) from DENV-1__GQ868609__SS-prME
agugucacuauguuguuaaugcuuaugccgacugcccuagcguuccauuuaacgacuagagguggggaaccacauaugauaguaacuaaacaagaaagggggaaaucauugcuauuuaaaacuucggcaggggucaauauguguacgcuaauugcaauggauuuaggugaauuaugcgaagauacgaugacguauaaauguccucgaauaacagaagcugaaccagacgauguggacugcugguguaaugcaacugacacauggguaacuuaugggacgugcucacaaacaggcgaacauagaagagacaaacgaucaguugcauuagcaccccauguaggacuaggacuugagacaagaacugaaacauggaugagcucggaaggagcauggaaacaaauacaaaggguagaaaccugggcacugcgacaucccggcuuuacuguuauagcacuauucuuagcacacgcaaucgguaccucaauuacgcagaaaggcauaauauuuauacuacugaugcuaguuaccccaucuauggcuaugcgcugcgucgggauaggaucacgggacuuuguggaaggauuaucaggcgcgacguggguugauguaguacuggaacauggaucaugcgucacgacuauggcuaaagauaaacccacccucgacaucgaauugcuaaaaacagaaguaacuaauccagcaguacuucggaaacugugcaucgaggcgaaaauaucaaauacaacuaccgacucacguugccccacacaaggcgaagcgacuuugauggaagaacaagaugcaaacuucguguguagaagaacuuuuguugauagagguuggggaaacgggugcgggcuuuuuggaaaaggcucucuuauuacgugcgccaaauuuaaaugcgucaccaaauuagaggguaaaaucguacaauaugaaaaucucaaauauagcguaauaguaacuguacauacgggugaccaacaucaagucggcaacgaaucaacggagcacgguacgaccgcuacgauuacaccacaagcacccaccucagaaauccaacuuacagauuauggagccuuaacgcuagacugcuccccaaggacagggcuagauuucaaugagaugguuuuacuaacaaugaaagaaaaaucauggcuaguacauaaacaaugguuucuagaucuaccuuugccguggacaaguggagcuucgaccagucaagaaacauggaauagacaagaucucuugguaacauucaaaaccgcucaugcgaagaaacaagaagucgucguauugggaucacaggagggcgcaaugcacacagcauuaacuggugcgacggagauacaaacaucugggacuacaaccaucuuugcgggacauuuaaaaugucgacucaaaauggacaaauuaacgcuuaaaggaaugaguuaugugaugugcacugguucauuuaaauuggagaaagaaguagcggaaacccaacauggaacuguauuagugcagauaaaauaugagggaacagaugcaccuuguaaaauaccauucucaacacaagaugagaaaggggugacucaaaaugggagguugauaacggccaauccaaucguuacugacaaagaaaaaccugucaauauugaagccgaaccuccguuuggagaauccuauauagucauaggggcuggugaaaaagcauuaaaauugucuugguucaagaaaggauccucaauaggcaaaauguucgaagcuacagcucggggugcccguaggauggcaauacuaggcgacacagccugggacuucggcagcgugggagggguuuuuacgucaguuggaaaacucguccaccaaauauuuggcacagcuuaugguguauuauuuucaggagucucauggacaaugaaaauuggaauagguguauuguuaacauggcuuggacuaaauucuagaagcacgagucuuucuaugacauguaucgcugucgggcuggucacuuuauaucucggcguaaugguacaagccgauagcggauguguaauuaauuggaaaggacgagaauuaaaaugcgguucaggcauauuuguuaccaacgaaguucauacauggacugaacaauauaaguuccaagcggauuccccuaaacgacuaucggcagcuauaggaaaggcuugggaggaaggcguuugugguauaagaucagcuacaaggcuagaaaacauuauguggaaacaaauuagcaaugaacuaaaucacauccuacuagagaaugauaugaaauucacuguaguuguuggagauguaguugguauucuggcacaggguaagaaaaugauuagaccacaacccauggagcauaaauacaguuggaaaucauggggaaaagcaaaaauaauaggcgcagauguacagaauacaacauucaucauugacggaccgaauacuccagaaugccccgacgaccagagagccuggaacauuugggagguagaagacuacgguuuuggcaucuuuacaaccaacauaugguuaagacuuagagauucguauacucaagucugugaccaccgauuaaugucagcagcuaucaaagauucaaaagcaguccaugcggacaugggauauuggauagagagcgagaaaaaugaaacuuggaaauuggcaagagcuagcuucauagaaguaaaaacuuguaucuggccgaaaucacauacgcucuggagcaaugguguguuggaaagcgaaaugauaauuccuaaaauuuacggcggcccgauaucacaacauaacuauagaccuggauauuuuacgcaaacagcaggcccauggcaucuaggaaaacuugaacuugauuucgaucuaugcgaaggaaccacuguagugguagacgagcacugcggcaauagaggacccucucuacguacaacaacugucacagggaaaaucauccacgagugguguuguagaucauguacucucccgcccuuaagauuuaaaggcgaggacggcugcugguacggaauggaaauacguccgguaaaagaaaaagaagagaauuuaguuaagaguauggugucugcagguucuggugaagucgauucguuuucguugggccugcucuguauuucuaucaugauagaagagguuaugcguaguagauggucccgaaagauguuaaugacaggaacguuggcuguauuucuuuuauugaucaugggucagcucacauggaacgacuuaauuagauuaugcaucaugguaggggccaaugcgucagaccgcaugggcauggguaccacauaucuugcacugauggcgaccuuuaaaaugcgaccaauguuugcaguaggacuauuguuucguagacugacgaguagagaaguucuacugcugacuauuggacugucauugguagccucuguugaacucccaaacagucuagaggaacugggagacgguuuggcuauggguauuaugauccucaaguuacuaacggacuuccaaagccaucaacucugggcaacccuacuuucucuuacuuucauuaagacaacccuaucacuacacuaugcauggaaaacgauggcgauggucuugucaauuguaaguuuguuuccauugugcuugucuacuacaucucagaaaacuacauggcuaccuguacuguugggaucacuaggauguaagccauuaacuauguuuuuaauaacagaaaauaaaauaugggguagaaaaucauggccucuaaacgaaggcauaauggcagugggcguugucucaauacuuuuaaguaguuuacucaaaaaugauguaccauuagcgggccccuuaauagccggaggaauguuaauagcauguuaugugaucucaggaagcagugcagaucuaagucuugagaaagcugcagaaguaucaugggaagaagaagccgagcauucgggcgcuucucacaacauccugguugaaguucaagacgauggaacaaugaaaauaaaagacgaggaacgggaugauacccugaccauauuguuaaaagccacacuacuagcugugucaggugucuauccguuaucuauacccgcaaccuuguucguaugguauuucuggcagaagaagaaacagagguccggaguacuaugggauacaccgucuccaccagaagucgaaagggcagugcuggaugauggcauuuacagaauuaugcaacgggguuugcugggaaggagucagguuggagugggaguuuuucaagaaaacguguuucauacuauguggcacguaacaaggggcgcgguucuuauguaucagggaaaacguuuagagcccuccugggcuucagugaagaaagaucuaauaaguuacggaggcgguuggcggcuacaagguagcuggaauacgggagaggaaguucagguuauugcaguagaacccgggaaaaaccccaaaaaugugcaaacggcuccuggaacuuuuaagacaccggaaggagaaguuggggcuauugcccuggauuuuaagccagguacaaguggaucaccaaucguuaacagagaagguaaaauaguagguuuauauggaaauggaguugugacgacaaguggcacauauguuucagcgauugcucaagcaaaagcgagucaagagggaccgcuaccugaaauagaagacgaaguuuuuagaaaacgaaaucuaacaauuauggauuuacauccuggaucagguaaaacaagacgauauuuacccgcgauuguuagagaagcuauaaaaagaaaacuccggacccugauacuugcaccuacaagaguuguggcuuccgagauggcggaggcacugaaggggaugcccauaagauaucaaacgacggcaguuaaaagugaacauacuggaaaggaaaucguagaccucaugugccaugccacguucacaaugcgacugcuuucucccguaagaguuccuaauuacaauaugauaaucauggacgaagcucacuucacugaccccagcucaauugcugcacgagguuacauaucaacacguguagguaugggggaggcugcagcaauuuuuaugacagcaacgccucccggaucuguugaagcauuuccacagagcaacgcaguaauccaggaugaagaacgugacauuccugagcgcucguggaacagcggauacgaauggaucacagacuuuccggggaaaacuguaugguuuguaccaucaauuaaaagcggcaaugauauugcaaauuguuuaaggaaaaaugguaagagaguuauacagcucaguagaaaaacauuugacacugaauaccagaaaaccaaaaacaaugacugggauuauguggugacaacggauauuucugaaaugggugcaaacuuuagggcggauagaguaauagauccacgcagauguuugaagcccgucauccucaaggauggaccggagagggucauucuugccggcccgaugccaguuacaguugcauccgcugcacaaagaagagguagaauuggacgaaaccauaauaaagaaggugaccaguacauauacaugggucaaccauuaaauaaugacgaagaucaugcucauuggaccgaagcaaaaauguugcuugacaauauuaauaccccggaaggaauaauuccagcauuauuugagccugaaagagaaaaauccgcggcaauugacggagaauaccgauuaagaggugaagcccgaaaaaccuuuguagaauuaaugcguagaggagaccuuccaguaugguuaagcuauaaagucgcuucagaaggcuuucaauauucggaccgaaggugguguuuugauggagaaaggaacaaucaaguguuggaggaaaauauggauguugaaaucuggacuaaagaaggcgaaaggaagaaauuacguccgcguugguuggacgcacgaacauacagugacccacuagccuugagagaauuuaaggaauuugccgcgggacgaagaucuguaucgggagaucucauauuagaaaucgguaaacuuccgcaacacuuaacacagcgugcccaaaacgcuuuagacaaucuuguuaugcuacauaauagugaacaagggggucgcgcuuauaggcaugcgauggaggaauuaccggauacuauagaaacgcuaauguuacuagcgcuaaucgcgguauuaacuggggguguuacauuauucuuucugagcggacgcggguuagguaagacuucuauaggauuauuguguguaauggcaucaagugugcuucuauggauggcaucuguagaaccacauuggauugcugcuucaauaauacuagaguucuuccugaugguacucuuaauaccagaaccugaccgacaacgaaccccucaagauaaucaguuagcguaugugguaauaggucucuuauucaugauacuaacaguggcagccaacgagauggggcuuuuagaaaccacuaagaaagaucucgguauaggacacguggcaguagaaaaccaccaccacgcaacuauguuagauguugaccuacaucccgcaagugcauggacucuuuaugcugucgcaacaacuauuauuacuccaaugaugaggcauacaauagaaaacacgacagcaaauauauccuugaccgcaauagcuaaucaagcagcaauccugaugggacuugacaagggcuggccuaucagcaaaauggauauagguguaccauuguuagcguuaggaugcuauagucaaguaaaucccuugacacucacugcggcaguauugaugcugguagcccauuaugcaauaauagggcccggucuucaagcaaaagcaacaagggaggcacagaaaagaacagcugcaggaauaaugaaaaacccaacuguugauggaauagucgcaauagauuuagaccccgucguguacgaugccaaauuugagaaacaguuggggcaaaucauguuacugauccucuguacaucgcaaauauuguugaugaggacaacuugggcacucugugaaucaauaacucuggcgacaggaccucuaacuaccuuaugggaagggucaccgggaaaauuuuggaacacaacuaucgcgguuucgauggcaaacauauucagaggcaguuaccuagcgggggcaggacuugcauucagccuuaugaagucauuagguggaggacguagagggacaggugcacaaggugagacacuuggagaaaaguggaaaaggcaauuaaaucaauuaagcaaaagcgaguucaauauauauaagagaucaggaauaauggaaguagacagaagcgaagccaaagaagggcuaaaacgaggugagaccacaagacacgcaguuucuaggggcaccgcgaaacuaagaugguuuguagaacgcaauuugguaaaaccugaagguaaagugaucgauuuaggauguggacgggguggauggucuuacuauugcgcaggacugaagaaagugacugaaguuaaaggauacacaaaaggaggaccuggccaugaagaaccgauuccaauggcaacauacgguuggaacuuagucaaacuucauaguggcaaagacguauucuuuacuccaccugaaaaaugcgacacucuucuaugugacauaggugaaagcaguccuaauccaacaaucgaagaaggaagaacccuacgaguacuaaaaaugguagagccuuggcuaagagguaaucaauuuugcaucaaaauuuuaaacccauacaugccgagcguagucgagacucucgagcaaaugcaacggaagcauggagggauguuggugagaaacccauuaucuagaaauucaacgcacgaaauguauuggguaucaugcgguaccgggaauaucguaucagccguaaacaugacaaguagaauguuguuaaacagauuuacuauggcacacaggaaaccuaccuaugaaaaagauguagauuuaggagccggaacgagacacguugcgguagaaccagaaguggcgaaccuggauauaauaggacaaaggauugaaaacauaaaacaugagcauaaaucaacguggcacuaugaugaagauaacccauacaaaacuugggccuaucacggcucguaugaagugaagccauccgguagugcuucaucuauggucaauggaguuguaaaacuuuuaacgaaaccaugggauguuauccccauggugacgcaaaucgccaugacugauacaacaccguuuggacaacaacggguauucaaagaaaagguagacacgcgaacccccaaagccaaaagggggacagcacagauaauggaaguuacggcgcguuggcuauggggguuucucagcagaaauaagaaaccaagaauuuguacaagagaagaauuuacuagaaaggugcgcaguaaugcagcaaucggagcuguguuuguggacgaaaaccaauggaacucagccaaagaagcgguagaagaugaaagauuuugggauuuaguccaaaaagaaagagagcuccacaagcaaggaaaaugcgcaacaugcguguacaauaugauggguaaacgugagaaaaaguugggugaauuugguaaagcaaagggcaguagggcaauaugguauaugugguuaggagcucgauuccuugaauuugaagcgcuuggguucaugaaugaagaucauugguuuaguagagaaaauucauuaagcggcgucgagggagaggguuuacauaaacucggguacauuuuacgagauauuagcaaaauuccaggagggaauauguaugcggaugauacugcggggugggauacucggauaacugaagaugaucuccaaaaugaagcuaagauaacagauauaauggagccagaacaugcucuccuagcuacuuccauuuucaaacuaacuuaucaaaacaagguuguccgcguacaaaggcccgcuaagaauggaacugucauggacgugauuucgaggagagaucaacgagguucgggacaagucggaacauauggauuaaauacuuuuacgaauauggaagcccaacucauacgccagauggagagugaaggaauuuucuugccaagugaauuggagacuccgaacuuggccgaacgagucuuagauuggcuggaaaaauauggcguagaaaggcugaaacgaauggcuauuuccggagaugauugcguuguaaaaccaauagaugaucgcuuugcaaccgcccugacagccuuaaaugauaugggaaaaguaagaaaagacauuccgcaaugggaaccuagcaaaggguggaaugacuggcaacaaguaccauuuuguucacaucauuuucaccaguuaauaaugaaagacggucgagaaauuguuguaccaugccgaaaucaagaugaacucguuggucgagcgagaguaagccaaggugcuggcuggucguuaagagagacagcaugccuaggaaaaagcuaugcgcaaauguggcaacuaauguacuuucaucgcagggauuuaagacucgcugcuaacgcgauuuguagcgcaguaccgguagauugggugccaacaagucguaccacuuggucuauacacgcucaucaccaguggaugacuacugaagauauguugaguguauggaaccggguauggauagaagaaaauccauggauggaagauaaaacccauguuucuaguuggggagauguuccauaucuaggaaaaagagaagaucaauggugugggucauuaauaggcuugacugcgcgagcuaccugggcaagcaauauucaaguugcaauuaaccaaguuaggagacuaauuggcaacgaaaauuauuuagauuauaugacaucaaugaaaagauuuaagaaugaaggagauccugagggagcacuaugguag

SEQ ID NO: 21683 - RNA, 9879 nt, Artificial Sequence
  derived and/or modified CDS sequence (opt6) from DENV-1__GQ199803__SS-prME
agugucacuauguuacuaauguuaaugccuaccgcgcuagcuuuucaccuaacuaucagagguggggaaccucauaugauagugucaaaacaagaaaggggaaaaagccuauuguuuaaaacaucagcaggagucaauaugugcacauugaucgccauggaucucggcgaacuuugcgaagacacaaugaccuacaaauguccgcggauaacugaagcugaaccagacgauguagauugcugguguaaugcuacagauacauggguaacauacggaacgugcagccaaacgggagaacaccgacgugauaaacguagugucgcacuagcgccucauguaggacuaggccuggaaacacggacagaaacauggaugagcagugaaggggcauggaaacaaauucagaggguggaaacaugggcccuacgccaucccggauuuaccgucaucgcacuauuucuagcacaugcaauaggaacuucaauuacucaaaaagggauaauuuucauuuuacucaugcuagugacaccgucgauggccaugagauguguaggcauagguucgcgggauuuuguggaaggacucagcggagcuacuuggguggauguaguauuagaacacggaucgugugugacaaccauggcuaaagacaaaccaacacuagacaucgaacuccuuaaaaccgaagugacaaacccagcuguacuaagaaaacuauguauagaagcuaaaauuuccaacacaacaaccgauagccgcuguccuacacaaggagaagcaacucugguggaggagcaggacgcuaauuucguaugcagaagaacauuugucgaucgggguuggggaaaugguugugggcuauuugguaaagggucauuaauaacaugugcaaaauucaaaugugucacaaaauuagaaggaaaaauaguacaauaugagaaucuaaaauacucaguuauaguaacuguucauacuggugaucaacaccaaguuggaaaugaaucuacagaacacggaacuacagccacgauuacuccacaagcccccacuaccgaaauccagcuaacagacuauggagcccuaacucuagauuguucuccgagaaccgguuuagacuuuaacgagaugguccuacuaacaaugaaagagaaaucaugguugguacauaagcaaugguuucuugaucuaccucugccauggacgucuggagcuaguaccagccaagaaacuuggaaccgacaagaucuauuagugaccuuuaagacagcgcaugccaagaaacaagaaguagucguguugggcucacaggaaggcgcuaugcacacagcgcuuacuggugccacggagauccaaaccagcggaacaacgaccaucuuugcaggacaccuuaaauguagacucaaaauggauaaauuaacucugaagggaaugagcuaugugaugugcacugguaguuuuaaauuagaaaaagagguugcugaaacucaacaugggacgguuuuggugcagauuaaauacgaaggaacagacgcuccuugcaaaauaccauuuucgacacaagacgagaagggaguaacucaaaaugggagacugauaacagcaaauccgauuguuacagacaaagagaaacccguuaacaucgaggcagaacccccguuuggugagucauauauuguuauaggagcaggagaaaaggcacuuaaguuaucaugguucaagaaagguucaagcauuggaaagauguucgaagcaacagcgagaggggcucgaaggauggccauacuaggagacacagcuugggauuuuggaagcaucggcgguguguuuaccagugugggaaaauuagugcaucaaauauucggcacagcauauggcguacuauuuuccgguguauccuggacuaugaagauaggaauaggcgugcuacucacuuggcucggucuaaauucuagaaguacaucacuaucaaugacaugcaucgcgguagggcugguaaccuuauaucugggaguaaugguucaggcagauagugguuguguuaucaauuggaaaggaagagaguuaaagugcggaagcgguauauucguuacaaaugaaguacacacauggacugaacaauauaaauuucaagcagauucaccgaaaaggcuaagcgccgcgauaggaaaggcgugggaagaagguguaugcggaauuaggagcgcgacaagacuggaaaacauaauguggaagcaaauauccaacgaauuaaaucauauucuuuuagagaaugauaugaaguuaacaguuguaguaggcgacguagcagguauacucggacaagguaagaaaaugauacggccccaaccaauggaauauaaauauagcuggaaaagcuggggaaaagcaaagaucauuggagcugacgcacaaaauacuaccuucauuauagaugguccaaacacaccugagugcccagacgaucagcgagcauggaauauuugggaaguagaagacuacggcuuugggauauuuacaacaaauaucuggcuaaaacuuagagauucuuacacgcaagugugugaccauagauugauguccgccgcaauaaaggauaguaaagcggugcacgcggacauggguuauuggaucgaauccgagaaaaaugaaacuuggaaguuggcuagagcaucuuucauagaaguuaaaacaugcauuuggccgaaaagucacacgcuaugguccaacggaguauuggaaagugagaugauaaucccaaaaauauacgggggcccuauuucucaacauaacuacagaccgggguacuucacccagaccgcuggaccauggcaucuuggaaaauuagaauuagacuucgauuuaugcgaaggaacgacagucgugguugaugaacacuguggcaaccgagggcccucacuucggaccaccacuguaacuggaaagauaauacaugaauggugcuguagaucauguaccuuaccacccuuaagauucagaggugaagaugguuguugguacgguauggagauaaggcccguaaaagaaaaagaagaaaaucuuguaaagucuauggugucugcaggaagcggggagguagauaguuucucauuaggguuauuguguauuagcauaaugauugaagaaguaaugcguucucgguggagcaggaaaauguuaaugaccgguacccuugcuguuuucuuuuugcuaauaaugggacaacugacauggaaugaccuaauaagguuauguaucaugguaggagcuaaugcuagugauaggaugggaauggguacaacguaucucgcgcuaauggcaacguucaaaaugcgacccauguuugcaguuggguuauuauuccgaagguugacaucucgggaaguucuacuauuaacgauaggucuauccuugguagcauccguagaguuaccaucaagucuugaggaacuaggugauggccuagccaugggaaucaugaucuuaaaauuauuaacagacuuccaaagucaucagcugugggccacuuuguuaucuuuaacuuuuauaaagaccgcauucuccuugcacuaugccuggaaaacaauggcgaugguacuaucaauagucucacuuuuucccuugugucuuagcacaacuucgcagaagacuacgugguuaccaguuuuacugggcucacuuggauguaaaccgcucacuauguuucuaaucgcugaaaauaagauaugggguagaaaaagcuggccacucaaugaagggauaauggcuguagguauugucagcauacuauuaucuucauugcuaaagaacgacguacccuuagcaggaccacucauugccgguggaaugcuaaucgcaugcuauguaauaagugggagcagugcagauuuaucucuagaaaaagcggcagaagugucgugggaggaagaagcugaacauuccggagcaucacacaauauauuaguagaaguccaggacgauggaaccaugaaaauaaaagacgaagaaagagacgauaccuugacuauauuacuuaaagccacuuuacuggcugugucugggguauacccuuuaaguauaccagcaacucuuuucgucugguauuucuggcagaaaaagaaacaaagaaguggcguacuaugggacacuccaagucccccagaaguugaacgagcgguccuagacgauggaaucuaccguaucaugcaaagagguuuacucgguagaucucaaguuggugugggcguauuccaggaaaacguauuucauacaauguggcacgucaccagaggagcaguacucauguaccaaggaaagagacuagaaccgucuugggccucuguaaagaaagaucuaauaaguuauggaggaggguggcguuuaagagguucauggaauacaggagaggagguucaaguuauagcuguggagcccggcaaaaaucccaaaaauguucagaccgcaccaggcacauuuaaaacucccgaaggagaggugggagcaauugcgcuugacuucaagcccggaacaucagggagcccaauagugaauagagaagguaaaauuguuggacuuuacgguaauggaguuguaacaacaagcggcacauacgugucagcaauagcccaagcgaaagccucacaagaagguccacucccagagauugaagaugaagucuuuagaaagagaaaucuuacaauaauggacuuacacccaggaaguggcaaaacccgcagauaccuucccgcaauuguccgagaagcgauaaagcgaaaauugcgaacuuuaauauuagcccccaccagaguuguagcgagcgagauggcugaagccuugaagggcaugccuauccgauaucagacgacugcuguaaaaucagagcacacggggaaagagauaguugauuuaaugugucaugcuacauuuacaaugagauuacuaagcccaguuaggguaccgaauuauaauaugauaauaauggacgaggcacauuuuacugauccaucgucaaucgcagcaaggggcuacauuaguacaaggguaggaaugggagaggcagcagcgauauucaugacggccacaccucccggguccguagaagcauuuccucaaagcaacgcugucauacaagaugaagaacgggacauacccgaaaggucauggaacucggguuaugaauggauaacagacuuuccgggcaaaaccguaugguuugugccaucaauaaagagcggaaaugacauagcuaacuguuuacguaaaaacgguaagagagucauacaacugagcagaaagaccuucgauacggaguaccagaaaacaaagaauaacgacugggacuauguggucacaacagauauaucggaaaugggugcgaauuucagagcugaucguguuauugacccaaggagauguuugaaaccgguaauauugaaagacggaccugaaagaguuauacuugcaggcccaaugccuguaacaguagcuucggccgcacaaaggagaggacgcaucggaaggaaucauaauaaagaaggugaucaguacauauauaugggucagccguuaaauaacgacgaagaccaugcccauuggacugaagcgaaaauguuguuagauaacauuaacacuccagagggaauuaucccagcacuauucgaaccagaaagagaaaagucagcggcgguagacggugaauacagguuaaggggcgaagcaagaaagacauucguagaacuaaugcgacgaggagaccuaccugucugguuaucuuauaaaguagcgagugaagguuuucaauauucagauagaagaugguguuucgacggcgaaagaaauaaucaggucuuagaagaaaauauggacguggaaauauggaccaaggaaggagacaggaagaaauuacgcccacgauggcuugaugccagaacauacuccgauccucuggcccuaagagaguucaaagaauuugcagcaggaagaagaucuguaucuggcgaucugauuuuagagauaggaaaauuaccucaacacuuaacacagcgagcgcaaaaugcauuagauaauuuaguaaugcuccauaauucggagcaaggaggaagggcauaccgucacgcuauggaagaauugcccgacacuauugaaacguugaugcuauuagcacugauagccguacuaacaggaggagugacauuauuuuuccuaucgggacgcggacuaggcaagacgaguauagggcuuuuaugugucauggcguccucaguacuuuuauggauggcgucgguagaaccacacuggauugcugcuuccauaauucuggaguucuuuuuaaugguguuauuaauuccagaaccagaucgacaacggacaccgcaggacaaccagcuagcauacgucguaauagguuuacuuuucaugauacuuaccgucgcagcuaacgaaauggguuuauuggaaacuacuaagaaagacuuaggcauuggacauguagccguggaaaaccaucaucaugcugcgauguuggauguugaucuccauccugcuagugcuuggacacuuuaugcuguugcaaccacuauaaucacaccaaugaugcgccacacgauagaaaacacgacugcaaacaucucauugacugcaauagccaaucaagcagcgauauuaaugggacuugauaaagguuggccuaucagcaagauggauauaggaguuccauugcuagcauuaggcugcuacagccaaguaaacccucuuacauugacggcagcaguauuaauguuggucgcucauuaugcuaucaucggccccggacuacaagcaaaagcuacuagggaagcccaaaagagaacagcagcugguauuaugaaaaaccccaccguagaugggauaguugcgauagaccuugaucccgugguguacgaugccaaguucgaaaaacaauuaggccaaauaaugcuauuaauucuauguacgucccagaucuuacuuaugcgcacgacaugggcacuaugcgaaucaauaacauuagcaacggggccacuaaccacccuaugggaaggaucaccaggaaaauuuuggaauacaacuaucgcggucucaauggcuaauauauuucgaggaaguuacuuggccggagcagggcuugccuucagucuaaugaaaucguugggaggaggacggcgcgguacaggugcgcagggagaaacguuaggcgaaaaauggaaacgacaauuaaaccaacuaaguaagagugaauuuaacaccuauaaaagaagcggaauuauggaaguggaucguucugaagcaaaagaagggcugaaacgaggggaaacaacaaaacacgccguaucgcggggaaccgcaaaguuaagaugguuuguugagaggaacuuagugaaaccugaggguaagguaauugaccuuggauguggaagaggaggguggucuuauuauugugcaggucucaagaaaguaaccgaaguaaaaggauacacaaaaggaggacccggacaugaagaaccaauaccaauggcaacguacggcuggaacuugguuaagcuccacucuggcaaggacguauucuuuauaccuccagaaaaaugugacacauugcuuugugacauaggagaaucaucuccaaacccgacuauagaagagggaaggacacucagaguguuaaaaauggucgaaccguggcuaagagguaaucaauucuguauuaaaauauuaaauccauacaugccgaguguuguagagacacuggaacagaugcagcgaaagcauggaggcaugcucguaagaaauccucuuucaagaaauucuacacaugaaauguauugggucaguugugguacuggcaauaucgugucagcgguaaauaugaccucucguaugcuauuaaaucguuucaccauggcccaucguaaaccuacauaugagcgggacguagaucuggggacagggacaagacacgucgcaguagaaccggaagucgcaaacuuagauauaauaggucaaaggaucgaaaauaucaagcacgaacauaaaagcacguggcauuacgacgaagauaacccauacaaaaccugggcguaccauggcagcuaugaagucaagccuucaggcuccgccagcucuaugguaaaugguguagucaaacuuuuaaccaaacccugggauguaauaccaauggucacacaaauugcaaugacagacacaacgccauucggucagcaacggguauucaaagaaaaaguugauacuagaacaccuaaagcuaaaaggggaacagcucaaaucauggaaguuacagcacgguggcuaugggguuuucucuccaggaauaaaaagccucgaauuuguacgagagaggaauuuacuaggaaaguacgauccaacgcagcaauuggugcaguguucgucgaugaaaaucaauggaacucugccaaagaagccguggaagaugaaagguucugggacuuaguacacagggaaagagaacuacauaagcaaggcaaaugcgcaacauguguguauaauaugauggguaagagagagaaaaaguuaggcgaguuuggcaaagccaagggaaguagagccauuugguauaugugguuaggagcacgauuuuuagaguucgaggcccugggcuucaugaacgaggaccacugguucagcagagagaacagucugucagggguggaaggggaagggcuccacaaauuaggguauauucuaagagauauaucuaaaauaccugguggaaauauguacgcugaugauacagcaggcugggacacacggauuacggaagacgauuuacaaaacgaagcuaagauaacagauaucauggagccugaacaugcccugcuggcaaaagcaauauuuaaauuaaccuaucaaaacaaaguuguuaggguucaaagaccggccaaaaacggaacagucauggauguuaucucucgaagagaccaacgaggauccggucaaguuggcacuuacggauuaaacacauuuacuaauauggaggcccaauugaucaggcaaauggaaagugaagguaucuuuucuccaagugagcuagaaacuccuaaccuagcagaacgugcacuugacugguuggagaaauauggaguagaacgacucaaaagaauggcaauaucgggggaugacuguguuguuaaaccaauagaugaucgcuucgccacugcacucaccgcacucaaugauaugggaaaaguccgaaaagauauaccacaaugggaaccauccaagggcuggaaugacuggcaacaaguaccauuuugcucucaucauuuccaccaguuaauaaugaaagacggucgggaaaucguggucccuugccguaaccaggacgaguuggucggacgcgcuagagucagccaaggugcagguuggucucugcgagaaacugccugccuuggaaaaaguuaugcacagauguggcaacugauguauuuucauagacgggacuuaagauuggcugcuaacgcuauauguucagcagucccgguugauuggguaccaacuucgagaacaacgugguccauucaugcacaucaccaauggaugacaaccgaagauaugcuuaguguauggaaccgaguauggauagaagaaaauccguggauggaagacaaaacucacauaaguucgugggaagauguuccauacuuaggaaaacgagaagaccaaugguguggaagucucauaggacucacugcaagggcgaccugggcuaccaauauacaaguagcgaucaaccaagugcggcgucuaauaggaaacgaaaauuauuuggacuauaugacguccaugaaacgguuuaaaaaugaaucugauccagaaggagcauuaugguaa

SEQ ID NO: 21684 - RNA, 9879 nt, Artificial Sequence
  derived and/or modified CDS sequence (opt6) from DENV-1__GQ199804__SS-prME
agcguuacaaugcuacuaauguuaaugccaacagcuuuagcuuuccacuuaacaacaagaggaggagaaccacauaugauuguuucuaaacaagaaagaggaaaaucauuacuuuucaaaacaagcgcgggagugaauauguguacauuaauugcaauggaccuaggagaauuaugcgaagauacaaugacuuacaaguguccaagaauaacagaaacagaaccugaugauguagauuguuggugcaaugcaacggauacauggguaaccuaugggacaugcucccaaacaggugagcauagacgggacaaaagaucaguagcacucgcuccacacguaggauugggccuagagacaagaaccgagacauggaugucaucugagggugcuuggaaacagauacaaagaguagagaccugggcucuaaggcauccugguuucacagugauagcauuauuucucgcacauguaauugguacgucuauaacacaaaaaggaauaauuuuuauacuacucauguugguaacgccauccauggcuaugcguuguguugguauagguagucgagacuucguagagggcuuaucaggugcaacguggguagaugucguucuggagcauggaucuugcguaacuacuauggcuaaagauaaaccaacauuagacauagaacuacuaaagacagagguuacuaauccugcgguacugcggaaacuauguaucgaagcuaaaaucaguaacacuacgacugauaguagaugcccaacacaaggugaugcaacguuaguugaagaacaagaugcaaacuuugucugcaggcgcacauuuguggaccgaggcuggggcaauggauguggauuguuuggaaaaggguccuugauaacuugugcaaaauuuaaauguguaacuaaauuagagggaaaaauuguacaauacgaaaauuuaaaauacucuguuauagugacaguacauaccggagaucaacaucaagucgggaacgaaaguacagaacaugguaccacggcaacaauaaccccucaagcaccgacaacugaaauacaauuaaccgacuacggagcuuugaccuuagauuguucuccgagaaccggacuugauuuuaaugaaaugguauuauuaacuaugaaggagaaaagcuggcuuguacauaaacagugguuccuagaccucccguuacccuggacaucaggagcaaguacgucucaagagacauggaauagacaggaccuauuaguaaccuuuaaaacugcacacgccaagaaacaagaaguagucguacuaggaagucaggagggcgcaaugcauacugcacugacuggagcuacagaaauacagacuagcgguacaacuacaauauucgcuggucaccucaaauguaggcuaaaaauggacaaguuaacucuuaaaggaauguccuacguuauguguacagguucuuuuaaacuugaaaaagagguagcggaaacucaacauggcacuguuuuaguucagauuaaguacgaaggaacggaugcuccauguaagauuccauuuucaacucaagacgaaaaggguguuacacaaaacgggcgucuaauaacagcuaacccuauuguaacggacaaagaaaaaccagucaacauagaagcagaaccaccauuuggggaaucuuauauuaucaucggagcuggcgaaaaggcguuaaaauuaaguugguuuaaaaaggguucaaguauagggaaaauguuugaggccacugcccgaggagcuagaagaauggcgaucuuaggagacacagccugggauuuuggaucuauaggcggaguauucacaaguguaggcaaauugguucaucaaaucuucggcacugcguacggaguccucuucuccgggguuagcuggacgaugaaaauuggaaucggaguucuacuuacuugguuaggauuaaauagccggucaacaaguuuaucaaugacuuguaucgcugucggccuaguaacccuauacuuaggcguaaugguucaggcggacaguggcugcguuaucaauuggaaaggaagagaauuaaagugugguucuggaauauuuguaacuaacgaaguacauacuuggacagagcaauacaaauuucaggcugauucccccaaacguuuauccgcugccaucggcaaagcaugggaggaaggcguuugugguauacgaucagccacacgccuagaaaacaucauguggaaacaaaucucaaaugaauugaaccacauccuccuagagaacgauaugaaauuuaccgucgugguaggagauguugcaggaauauuagcacaagguaaaaagaugauuagaccacagccgauggaauauaaguauucauggaaaaguuggggaaaagcaaaaauuaucggugcagacgugcagaacacuacauucauuauugauggacccaauacgccugaauguccggacgaucaaagagcuuggaacauuugggaagucgaagauuauggauuugggauauuuacgacaaacaucugguuaaaacuucgagauaguuacacacaaguaugcgaccacagacugaugagugcggcaaucaaagauucgaaagcuguucacgcggauaugggauacuggaucgaauccgaaaagaacgagacauggaaauuagcacgagccucauucauagaggugaaaaccuguauuuggccuaaaucucacacccuauggaguaacgggguccuagaaagugaaaugauuauacccaagaucuauggaggcccaauaucccaacauaacuacagaccaggauacuuuacccaaacagcagguccuuggcaucugggcaagcuagaauuggacuuugaucuaugugagggaacuacuguaguuguagacgagcauugcggcaaucgaggaccuucauuaagaaccacaaccguaacuggcaaaauaauccaugaauggugcuguagaucauguacguuacccccauugagauuucggggugaagacggaugcugguauggcauggaaauucggccggucaaagagaaagaagaaaacuuaguaaagucaaugguuagugcaggaucuggcgaaguggauucuuuuagucuaggacuccuuuguauaucgauaaugauagaagagguuaugaggucaagguggaguaggaaaauguuaaugacagggacccuagccgucuucuucuuacuaauaauggggcaacuaacauggaaugaucuaauuagacucuguauaauggugggggcgaaugcaucagaucggaugggcaugggaacuacguaccuugcauuaauggccacauuuaaaaugagaccuauguuugcuguuggccugcucuuuaggagauuaaccucacgcgaaguacuacuccuaacuaucggacuaagucuuguagcuaguguagaauugcccaacagccuagaagaguugggagacgggcuugcaaugggaauaaugauuuuaaaacuucucacggacuuucagagccaucaacuaugggcaacacucuuaucgcuaacguucauaaaaacuacuuucucucuacauuacgccuggaaaacaauggcaaugguucuaucuauugucucuuuauuuccguugugcuuaucuacgacaucucagaaaacuacuuggcuaccuguguuauuaggaucacuaggcugcaagccccugaccauguuccucauagcagagaauaaaauuuggggacgucgaucuuggccacuaaaugaggguauaauggcaguagggaucguguccauuuugcugaguucguuacucaagaacgaugucccguuggcggguccuuuaauagccgguggcaugcuaauagccugcuacgucauaagcgggagcagugcugaucuuucuuuagaaaaagcagcggaaguaucaugggaagaagaagcugaacauagcggugcuucacauaacauccuaguggaaguucaagaugaugggacaaugaagauuaaagacgaagaaagagaugacacccuaacaauccuuuuaaaagcuacucuacucgcaguguccgggguguauccuuuaucuaucccagcgacauuauuuguaugguacuucuggcagaaaaagaaacaaagaaguggaguacugugggacaccccgucuccaccagaaguggaacgagcuguuuuggaugauggaauauaucgaauuaugcaacgugguuugcuuggaaggucucaagucggaguuggaguuuuucaagaaaacguauuucauacaauguggcacguuacucgaggugcugucuuaauguaucaagguaaaagguuagagccaagcugggcgucgguuaagaaagauuuaauuuccuacggcggcggauggagacuucagggaucuuggaauaccggugaagaaguacagguuauugcggucgaaccugggaaaaacccgaaaaacgugcagaccgcuccuggaacauuuaaaacacccgaaggugagguaggugcaauugccuuggauuuuaaaccagguacgucuggaucaccuauuguaaaucgagaagguaaaauuguuggucuguacgggaacggagugguaacuacgucaggcaccuacguaucagcgaucgcgcaagcuaaggcaagucaagaaggaccauuaccagaaaucgaagaugagguguuuagaaaacguaaucuaacaauuauggauuugcauccaggcagugguaaaacuagaagguacuuacccgcgauaguucgagaagcaauaaagcgaaagcugagaacucuaauccuugcaccaacaagaguuguugcuucugaaauggcugaagcccuuaaaggcaugccaauaagauaucagacaacggcugucaaaagugagcauaccgguaaagagauuguagaccuaaugugccacgcaacuuucacaaugagacuccuuucuccaguaagaguacccaacuacaauaugaucauuauggacgaagcucauuuuaccgacccaucuucuauagcugcuaggggguacauauccacuagagucgguaugggagaagcagcugcuaucuuuaugacagccacuccaccggguucuguagaagcauuuccacagucaaaugcuguaauacaagacgaagaacgcgauauaccugaaagauccuggaacucggguuaugaguggauuacugacuuuccagguaagacggucugguuugucccgucaauaaagagugguaacgacauagccaacugccuaaggaaaaauggcaaaaggguuauacaguugagcagaaaaacauucgauacugaauaucagaaaaccaaaaauaaugacugggauuacguaguaacgaccgacauaucggaaaugggagcaaauuuccgugcugauagaguaaucgaccccaggagaugccuaaaaccagugauccuaaaggauggaccggagagagugauacuagccggcccaaugccuguaacaguggccucagcagcacaaagacgaggaaggauaggucgaaaucauaacaaagagggggaucaauacauuuacaugggacaaccguugaacaaugacgaggaucacgcucauuggacugaagcgaaaauguugcuggauaauauaaauacuccggaggguauaauuccagcauuguucgaaccggaaagagagaagucagcagcaauagauggagaguaucgguugaggggugaggcaagaaaaacauucguagaauuaaugaggcgcggugacuuacccguuuggcuaaguuauaaaguagcaucggaagguuuucaauacucagaccggaggugguguuuugacggagaacgcaacaaucaaguguuggaagaaaauauggacguagaaauauggacaaaagaaggcgagcguaagaaguuacguccucgcugguuagaugcccggacauauucagacccacuagcgcuaagagaguucaaagaauuugcugcuggcaggagaucaguaucgggagaucugauucuagaaaucggaaaacuuccacaacauuuaacccaacgggcacaaaaugcuuuagacaauuuaguuaugcuucauaacuccgaacaaggcggacgagcguauagacaugcaauggaagaauugccggauacaaucgagacgcugauguugcucgcauuaaucgcagugcucacuggaggaguaacguuauucuuucuaaguggaagaggacucgggaagaccucaauagggcuauuguguguaauggccucuagcgugcuucuauggauggcuuccguugaaccacacuggauugcagcgagcauaauacuagaguuuuucuuaauggugcuauuaauaccggaaccagacaggcaaaggacaccacaagacaaccaauuggcguacguuguuauuggucuccuauuuaugauucugacaguggcagcgaaugagaugggacuacuagagacuaccaagaaagaucugggcauaggacauguagcaguggaaaaccaucaccacgcggcgauguuagauguugauuugcacccagcaagcgcauggacguuauaugcaguugccacuacaauaauaacuccaaugaugcggcauaccauugaaaauaccacggccaacauuagucuaacugcaauagcuaaucaagcagcaauucuuaugggauuagacaaaggauggccaauuucaaaaauggacauuggcgucccccuccuugcacuuggcuguuauagucaagugaacccacugacauugaccgcagccguacuaauguuaguggcacauuacgcaauaauagggcccggacuucaagccaaagcgaccagagaagcucaaaagcggacugcagcaggcauaaugaaaaacccuaccguagaugguauuguagcuauagacuuagauccaguaguauaugacgccaaauuugaaaaacaacuuggccaaauaauguuacucauacugugcacaucacaaauuuuauuaaugaggacaacuugggccuuaugugaaucaauaacguuggcgacagggccucuaacuacucuaugggaaggaucgcccggaaaauuuuggaauacuacaauagcaguuuccauggcaaauauauuuagggguaguuaucuggcaggagcaggacuagcguucaguuuaaugaaaucucuggguggugggaggagaggcacgggugcgcaaggugaaaccuuaggagaaaaauggaagaggcaauuaaaccaauuaucuaaauccgaauuuaacacguauaagagaagcgggauaauggaagucgaucgaagcgaagcaaaggaagguuugaagagaggugaaaccacaaaacacgcaguaagucgaggcacggcuaaguugagaugguuuguugaaagaaauuuaguaaagcccgaaggaaaaguaauagaucuuggaugcggccguggaggcuggucguacuacugugcugguuugaagaaagugacagaggugaaaggauacacaaaaggaggcccggggcaugaggaaccaauaccaauggcaaccuauggauggaaucucguaaaauuacauagcggaaaagauguauucuuuaucccgccugaaaaaugugauaccuuacucugcgauauaggugagucaaguccaaaucccacaauagaagagggaagaacucuaagggugcuaaaaauggucgagccgugguuaagaggaaaccaauuuuguauaaagauauugaaucccuauaugcccucaguggucgaaacauuagagcagaugcagcguaaacaugggggcaugcuagucagaaauccauuaaguaggaacucaacacaugagauguauugggucucaugcgguacgggaaacauagucucagcagucaauaugacaucccgaaugcuacuaaaccgauucacuauggcccaucgaaaaccaacauacgaaagagauguagaucuaggugcugggacaagacauguagcuguagaaccggagguugcgaaccuugacaucaucggacaaaggauugagaauaucaaacacgagcauaaaaguacuuggcauuaugaugaagacaaccccuacaagacgugggcauaucacggaucauaugaaguuaaaccaucaggaucugcaucaucaaugguaaauggcguaguaaaacugcuuaccaaaccaugggaugugauacccauggucacacaaaucgcuaugaccgacacgacaccauuuggucaacaaagaguauuuaaagaaaagguagacacaaggacaccuaaggcgaaaagaggaacugcucaaauuauggaaguaacagcaaaauggcuguggggauuccuuagcagaaacaaaaagccaagaauuugcacaagagaggaguucacaagaaaaguacgcagcaaugcagcgauuggagcaguauuuguagacgaaaaucaauggaacucugccaaggaagccguggaggacgaaagguucugggauuuaguacauagagaacgcgaacuacauaagcaaggaaaaugcgcuaccugcguauacaauaugauggguaaaagggagaagaaauuaggggaauuuggaaaagcaaaaggaucgagggcaauaugguacauguggcuaggagcgcgauuucuugaauuugaagcgcuuggauuuaugaaugaggaccauugguuuaguagagaaaacuccuuaucuggaguagaaggugaaggauuacacaaauugggauauauacuacgagauauuucgaaaauaccaggagggaauauguacgcugacgauacagcaggaugggauacacgaaucacagaagaugaucugcagaacgaagcacgcauuacugacauaauggagccugaacaugcacuguuagcuaaaucaaucuucaaacugaccuaccaaaauaaagucguccgaguucaaagaccugccaaaaauggaaccgucauggacgugauaucgaggagagaucaaagagguaguggacaagucggcacauauggacucaacacauuuacaaacauggaagcucaguuaauuaggcaaauggagagcgaggguauauuuucccccagugaacuagagaccccaaacuuagccgaaagaguguuagauuggcuagaaaaguacggcguugagagauuaaaaagaauggcaaucagcggggacgauuguguuguaaaacccauugaugauagguucgcuacugcacucacggcauugaacgacaugggaaaagugcgaaaagauauuccacaaugggagccaucgaaaggcuggaacgacuggcaacaaguaccauucuguucucaucauuuucaucagcuuauuaugaaagaugggcgugaaauaguaguuccauguagaaaccaagacgagcuaguagguagagcaaggguuucacaaggugcaggguggagucuuagagaaaccgccuguuuagguaaaucuuacgcacaaauguggcaauuaauguacuuucaccgaagggaucuucgucuugccgccaaugcaauaugcucugccgugccaguggauuggauuccgaccucaagaacaacauggucaauacaugcccaccaucaauggaugacuaccgaagauaugcuuucaguuuggaaccguguauggaucgaagagaacccauggauggaagacaaaacccacauuagcaguuggggugaugucccauauuuagggaaaagagaggaucagugguguggaagucuuauaggcuuaacugccagagcuacuugggcuacgaacauucaaguggcuauuaaucaggucagaagguuaauaggaaacgaaaauuaccuugauuauaugacgucaaugaaaagauucaaaaacgagucagauccagaaggagccuuaugguaa

SEQ ID NO: 21685 - RNA, 9879 nt, Artificial Sequence
  derived and/or modified CDS sequence (opt6) from DENV-1__GQ199805__SS-prME
agcguuacaauguuacuaauguuaaugccuacagcacuagcauuccaccugacaacacgugguggagaaccucauaugauaguaacuaaacaagagagagggaaaucucuacuguucaaaaccagcgcagggguaaacaugugcacguuaauugcaauggaccuaggagaacuuugugaagauacuaugacuuauaaaugcccuagaauaacagaagccgaaccagaugauguggacugcugguguaacgcaacggacacuuggguaacguaugguacaugcagccagacgggagaacacagaagagacaaacgauccguugcccuugcgccacaugucggacuaggucuagaaacuaggacugaaacauggaugucgucagaaggagcguggaagcagauucaaagaguagaaacuugggcgcuaagacauccaggguuuacuguaauagcucuauuuuuggcacacguuauugggacaucaaucacccagaaagguauaaucuucauacuccucaugcuuguaacaccaucuauggccaugagaugcguuggaauaggcagcagagauuuuguugaagguuuauccggagcaacuuggguagaugugguguuggaacauggaaguugugugacgacaauggcuaaagacaaaccaacacuagauauugagcuauugaagacggaagucaccaacccagccguauuaagaaagcuaugcauagaagcgaaaaucagcaauacgacaaccgauagucgauguccaacucaaggggaagcgacucuaauggaagaacaagaugcuaauuucguauguagaagaaccuuuguugaucggggguggggcaacggcugugggcuguuuggaaaagggucccuaauuaccugcgcaaaauuuaaaugcguaaccaaauuagagggcaagaucguucaauaugaaaauuugaaguauucaguuauagugacaguacauacgggcgaccaacaucagguaggcaaugaaaguacugaacacgguacgacggccacaauaacuccucaggcgcccacgagcgaaauacaacuuacugacuacggagcacuuaccuuagauugcagccccaggacugggcuugauuucaacgaaaugguccugcugacaaugaaagagaagucauggcuggugcauaaacaaugguucuuggaccuacccuuaccauggacgagcggugcaucuacaagccaggaaacauggaaccgacaagauuugcucgugacauuuaagacggcucaugccaagaaacaggaggucguaguacuaggaagucaagaaggcgcaaugcacacagcauuaacaggagcaacggaaauucaaacaucagguacuaccacaaucuucgcuggacauuuaaaaugucguuugaaaauggauaaauuaacacuaaaagggaugaguuacguuauguguaccggcagcuuuaaguuagaaaaggaaguagcugagacacaacacggaacagugcuuguacaaauaaaauaugaagguacugacgcaccaugcaaaauaccauucaguacgcaagaugagaaaggaguuacacaaaaugguagauugauuacugcuaauccgauuguaacagauaaagaaaagccagugaauaucgaagcagagccaccauuuggggagagcuauauaguaauaggugccggugagaaagcauuaaaacuaucuugguuuaagaaagggucgagcauuggcaaaauguuugaagccacugcgagaggggcaagacgcauggccauauugggcgacacggcuugggauuucggauccauaggcggaguuuuuacuagcguaggaaaauugguccaccaaauauucgguacugcguaugguguucuauuuucagguguaucauggacuaugaaaauaggauuggguguccuucucacaugguuaggacuaaacucucguagcacaagccuuaguaugacauguauagcagucggauuaguaacacuuuaucuagguguaaugguacaagcugauucugguugcgugaucaauuggaagggucgcgaguuaaaaugcggcuccgggauauuugugacaaaugaaguucacacguggacugagcaauauaaauuucaggcagacagccccaaaagacugucugccgcuauugguaaggcgugggaagaagggguaugcggcauucguucggcaacuagacuagaaaauaucauguggaaacaaauuuccaaugaauugaaucauauacuuuuagaaaacgauaugaaauuuacgguuguagugggggacguuguagguauacuagcacagggcaaaaagaugauacguccucagccgauggagcacaaguacagcuggaaaucauggggcaaagcaaaaauaauaggcgccgacguacagaauaccaccuucauaauagauggaccuaauacaccugaguguccagaugaucaaagagcguggaacauaugggaaguggaggauuacggauuuggaauauucacaacaaacauaugguuaaaacuaagagacucacacacgcagguaugugaccacagauugaugagcgcagcgauaaaggacaguaaagcuguccacgcagauauggguuauuggauagagagcgagaaaaaugagaccuggaaguuagcuagagcgagcuucauagaaguaaaaacaugcauuuggccaaagagucauacucuauggagcaacgguguucuagagucugaaaugauuauuccaaaaauauauggaggaccuauuagccaacauaacuaccgcccgggcuauuuuacucaaacugcuggaccuuggcaucuuggcaagcucgaauuagauuucgaccuaugugaagggacaacaguaguaguagacgaacauugugggaacagaggacccagcuugcguacuacuacaguuacagggaagauuauucacgagugguguugcagaagcugcacucuuccaccccuccgguuuaaaggagaggacgguuguugguauggaauggaaauuagaccagucaaagaaaaagaagagaaccucguaaagucaaugguuucugcagguaguggggaaguagauaguuuuuccuuaggacuauuguguauauccaucaugauagaggaagugaugaggucgagauggagcagaaaaauguuaaugacaggaacauuagcuguuuucuuacuauuaaucaugggucaauuaacuuggaacgauuugacccguuugugcauuaugguuggagcaaaugcgagcgacagaaugggcauggguacaacauauuuagcccuaauggcaaccuuuaaaaugcggccaauguuugcagugggauuauuauuuagaagacugacaucaagagagguacucuuguugacaauuggauuauccuuaguagcaaguguagaauuaccaaacagcuuagaagaacugggugauggacuugcgauggguauaaugaucuugaaauuacuaacagauuuucagucgcaucaauuaugggcaacguuauuaaguuuaacuuuuaucaagacgacacuaagccuacauuaugcguggaagacaauggccaugguucuuuccauaguuucuuuauuuccauuaugcuuaaguacaacuucacagaaaacuacaugguuaccaguacuauuaggaagucuuggcuguaaaccauuagcuauguuucuaauagcagagaauaaaauuugggggcgaaaaucauggccacuuaaugaaggaauuauggcgguuggcguaguaaguauucuuuugucuucucuacugaaaaacgauguaccuuuagcuggaccauugauugccggugguaugcuaauugcguguuacguaaucucagguuccucggccgacuugucauuggagaaggcagcggaaguaucgugggaggaagaggcggaacacuccggggcaagucauaauauccuaguagaaguacaggaugauggcaccaugaaaauaaaagaugaagagagagacgacacauuaacgauucuucuaaaagcaacgcugcuagcgguuucagguguauauccuuuaucgauuccagcaaccuuguucguaugguacuucuggcagaagaagaaacaacgcagcggagucuuaugggauacucccucgccaccagaaguugagagagccguacuugaugacgggauauaucgaauuaugcaaaggggacuuuuagguaggagucaaguaggagugggaguauuccaagaaaacgucuuucauacaauguggcaugucacaagaggagcuguacuaauguaccagggaaaaagguuggagccaucuugggcuucggucaagaaagaccuaauaagcuauggagggggcuggcgacuacaaggaucguggaauacgggcgaggaaguucaaguaauagcgguagaaccagggaaaaaucccaaaaauguacaaacugcaccgggaacauuuaaaacgccggaaggagaaguuggagcaauagcucuugauuuuaaaccagguaccaguggguccccuaucguuaaccgggaaggaaaaauaguaggacuguacgguaaugguguaguaacaacaucgggaacauauguuucugcgauagcacaagcaaaagcaucacaagaaggaccacuucccgaaauagaggaugaaguauucaggaaacgaaacuugacaaucauggauuugcaccccggcagcggaaaaacaagaagguaccuuccagcaauaguacgagaagccaucaaaagaaaacuuagaacccucauccuagcgccgacaagaguuguggcaagcgagauggcagaagcacugaagggaaugccgauaagguaucaaacgacggcaguaaaaucggaacauacagguaaagaaauuguugauuuaaugugucacgcaacauuuacaaugcgguuacuaucucccguacguguuccaaacuauaauaugauaauuauggaugaagcgcauuuuacagacccuuccagcauagcagcacguggauacauaucgacaagaguaggaaugggugaagcugcggcgauauucaugacggcgacaccgcccggaucaguugaagcauuuccucagucaaaugccguaauccaagacgaggagcgugacauacccgaacguucauggaacucuggguacgaguggauuaccgauuuuccuggaaaaaccguuugguuuguuccaucaauaaagucuggcaaugacauugcaaacugccuccggaaaaaugggaaaagagugauucaauuaagcagaaaaacuuuugacacagaauaucagaagacaaagaauaaugacugggauuacguaguuacaacugauauuucugaaaugggagcuaacuuuagagcugaucgaguuauagacccaagacgaugccugaaaccuguuaucuuaaaggauggcccagagcgaguuauacuugccggaccaaugccgguuaccguugcaucagcagcucaacgaagaggccgaaucggcaggaaccauaacaaagaaggggaccaauauauauauaugggucagccauuaaacaacgacgaagaucacgcucacuggacugaagccaaaauguuauuagauaacauaaauacccccgaaggaauaauuccugcgcuauuugaaccggaaagagaaaaauccgcugcgauugacggagaguauagguugagaggagaagcacggaagacauuuguagagcuuaugcguagaggggaccuuccgguaugguuaucuuacaaagucgccagcgaagguuuccaauauagcgauagaaggugguguuucgauggagagcgaaauaaucaaguauuagaagaaaauauggaugucgagauuuggacaaaggaaggagaaaggaagaaacuucgaccuagaugguuagaugcccggacauacucagacccucuagcacuaagggaguuuaaggaauuugcagcggguagacgaucugugaguggagaccuuauauuggaaauaggaaaauuaccccaacaccuuacacaaagagcacaaaaugcucucgauaacuuaguaauguuacacaauucagaacaggguggaagggcauaucggcacgcuauggaagaauuaccugacaccauagaaacauugauguuauuagcucuaauagccguauuaacuggugggguuacauuauucuuucuaucaggccguggacuugguaaaacuuccauaggacuacuuugugugauggccagcucuguuuuacuauggauggcgaguguggaaccucauuggaucgcggcuucuauuauauuagaguucuuucucauggugcuacuaauucccgaacccgacagacagcgaacgccucaagauaaccaacuugccuauguaguaauuggacuccucuuuaugauacugacggucgcggcaaaugaaaugggguuauuagaaacuacaaagaaggaucucgguauagggcauguugcaguugaaaaccaccaucaugcgacgaugcuagauguagaucuccacccagcuagcgcauggacauuauacgcgguggccacaacaauaauaacuccaaugaugcgacacacaauagagaauaccacagcuaauauaaguuuaacugcaauugccaaccaagccgcaauauuaaugggguuggauaaaggauggccaauuucuaaaauggauauagguguaccccuuuuagcacuuggauguuacucacaaguuaauccucuaacucuaacagcagccguuuugauguuaguugcgcacuaugccauaauuggucccgguuugcaagccaaagccacacgagaggcucagaaacggacagcagcuggaauuaugaaaaauccgaccguagauggaauugucgcuauugauuuggacccaguaguuuacgaugcaaaauuugaaaagcaacuaggacaaauaauguuacucauccucugcacaucacagauacugcuuaugcgaacuacgugggcacuaugcgaaucaaucacuuuagcgacgggaccgcugacgacacucugggaggggagcccagguaaauuuuggaacacuacgauugcggucuccauggcgaauauauuccgagggagcuaucuggcgggugcaggcuuagcauucaguuuaaugaaaucucuggguggagguagaagaggcacaggugcucaaggugaaacacuaggugagaaauggaagcgucaacuuaaucaauugaguaaauccgaguucaacaucuauaaaagaucugggaucauggaagucgaccgaagugaagcgaaagaaggcuuaaaaaggggcgaaacuacacgccaugcaguauccagggguacagcuaaacucaggugguuuguugaacgaaauuuagucaaaccagaaggcaaaguaauugaucucgguugcgggcggggagguuggucauauuauugugcaggacucaagaaaguaacagaaguuaagggauauacaaaaggagguccuggacaugaagaaccuauaccgauggcgaccuauggguggaaucuaguaaaauugcauagcggcaaggauguauucuucacgccucccgaaaaaugugacacacuacuuugugauauuggagagucaucaccuaauccaaccauugaagaagggaggacacuuaggguauuaaagaugguagaaccgugguugcgagguaaucaguuuugcauaaaaauauuaaauccauacaugccgagcguuguagaaacacuagaacaaaugcaacgaaagcauggaggaaugcuaguuaggaauccuuuaagucguaauaguacacaugaaauguauuggguuuccugugguacuggaaacaucguaucugcggucaacaugaccucaagaauguuauugaaucgauuuaccauggcgcacagaaagcccaccuaugaacgugacguagauuuaggagcagggacaagacaugucgcgguagagcccgaaguagcaaaucuugauauuauaggucagaggaucgaaaauauaaaacacgaacauaaaaguacauggcauuaugaugaagacaauccauauaaaacaugggcauaucacggaagcuacgaaguaaagccaaguggaucagcaaguucuaugguaaauggaguagucaaauuauuaacaaaaccaugggacgucauccccaugguaacucaaauugcgaugacagacacaacuccuuucggacaacagagagucuucaaggaaaaaguagauacucgcacacccaaggcgaagcguggaaccgcacaaauuauggagguuaccgcgagaugguuauggggauuucuaagccgaaacaagaaaccuagaauaugcacgagagaagaauuuacuaggaaaguaagaucuaaugcagccauaggagccguuuucguggacgaaaaucaauggaacucagcgaaggaggcaguggaagaugaacgguuuugggacuugguccaaaaagagagagaacuucauaaacaaggcaaaugugccacaugcgucuauaauaugauggguaaacgcgagaagaaauuaggagaauuugguaaagcuaaaggguccagggcuauaugguacaugugguugggagcccgcuuucucgaauuugaagcauugggauucaugaaugaagaccauugguucucuagagaaaacucguugucagggguagaaggcgagggauugcacaaguuaggauacauucuuagagacauuucgaaaauaccagggggaaauauguacgcugacgacacugcgggcugggauacacgcauuacggaagacgaucuacaaaaugaagcacggauuacagacauuauggaaccggagcacgcauuacuagcuacguccauauuuaagcuaacauaccaaaacaagguggucaggguacagcgcccggccaaaaaugguacgguaauggauguaauaaguaggcgugaucaacgggggucuggacaaguuggcacuuacggccucaauaccuucacaaacauggaggcacaguuaauuagacaaauggaaucagaaggaaucuuucucccaucagaacuugaaacacagaaucuagcagagcgugugcuugauugguuagaaaaauauggaguugaaagacuaaaacgaauggccauaaguggagaugacugcguaguuaaaccaauagaugauagguucgcaacggcuuuaacugcacucaaugacaugggaaaaguucggaaagacauaccccaaugggagccuagcaaaggcuggaacgauuggcaacaaguacccuuuugcucacaccauuuccaccaacucauaaugaaagacgguagggaaauaguaguaccauguaggaaccaagaugaauuaguaggucgagcaagagugucacaaggugcagguuggagucuacgugagacagcuugcuugggaaaaagcuacgcacaaauguggcaauuaauguauuuucaucgcagagacuugcgauuagcagcaaacgcgaucuguucugccguaccggucgauugggugccaacgucgcguacuacauggucaauucacgcgcaucaucaauggaugacgacugaagauauguuaaguguauggaaucggguauggauagaagaaaaucccuggauggaagacaagacgcauguaucaaguuggggugauguaccuuaucucggaaagagagaagaucaaugguguggcagcuugauaggcuuaaccgcacgagcaaccugggcaucuaauauucagguggcuauuaaucaaguacguagacucauaggcaaugagaauuaucuggauuacaugacgucaaugaaaagauucaagaaugagggugacccugaaggagcauuaugguaa

SEQ ID NO: 21686 - RNA, 9879 nt, Artificial Sequence
  derived and/or modified CDS sequence (opt6) from DENV-1__GQ199806__SS-prME
agugugaccaugcuucucaugcuuaugccaacugcucuugcuuuucaucugacaaccagaggaggagagccucauaugauaguuaguaaacaagaaagaggaaaaaguuugcucuuuaaaaccagcgcuggaguaaacaugugcaccuugauagcuauggauuuaggugaguuuugugaagauacuaugaccuacaaaugcccccgcauaaccgaagcagaaccugaugauguagacuguuggugcaaugcuacggacacuugggugacauauggaacgugcucgcaaacaggagagcacaggagagauaaaaggagcgucgcucuggccccacauguaggauuggggcucgaaacuagaacggaaacauggauguccucugagggagcauggaaacaaauccaaagggucgaaacaugggcucuaagacacccagguuuuacuguuaucgcucucuuuuuagcucacgcgauuggcaccaguauaacgcaaaaaggcauaaucuuuauccuucuuauguugguuacuccuuccauggccaugcgguguguagguaucgguuccagagauuuugucgaggguuuaucuggagcaacguggguagacgugguccuugaacacggaaguuguguuacuacaauggcgaaagauaaaccaacgcuugacauagaacuucuuaaaaccgaaguaacaaacccagcaauuuuacgaaaacuuugcauagaagccaaaauuagcaacacgacaacugauagcagaugcccaacacaaggagaagccacauuaguugaggaacaagacgcuaacuuuguaugucguagaacuuuuguagaucgaggcuggggcaacggcugcggauuauuugggaaaggaagucugauaacaugcgcuaaauuuaaaugugucacuaaauuggaggguaaaauugugcaauaugagaacuuaaaauauucggugauuguaacggugcacacaggagaccaacaucaaguaggaaacgagaguacagaacacggaacaacagcuacaauaacaccacaagcaccuucuaccgaaauucaauugacagacuacggagcguuaacauuagacugcaguccaaggacaggguuggauuuuaaugaaaugguguuguuaacaaugaaagagaaaagcugguuagugcauaaacaaugguuucuggauuugccccuaccuuggacuucgggagcgagcacaucacaggaaacauggaacagaaaagaucuauuagucacauucaagacagcgcacgcaaagaaacaagaagccguaguacuaggaucgcaagaaggggcuaugcacacugcauuaacaggcgcgaccgaaauacaaaccucuggaacgaccacgauuuuugcuggacaucuaaaaugccgcuuaaaaauggauaaacucacacuaaagggcaugucguacgugauguguacagguagcuuuaaauuagagaaagaaguugcagaaacucaacauggaacaguccucguacaaauaaaauaugaagguacagaugcaccaugcaagauaccguucaguacucaagaugaaaaaggugucacacaaaacgggcggcuuauaacugcaaauccaauuguuaccgauaaagaaaagccaguuaauauagaagcggaaccaccguucggugaaagcuacauagugauuggggccggugaaaaagcacuaaaacugucgugguuuaagaaaggaagcucaauuggaaagauguuugaagcaaccgcacggggagcaagaagaauggcaauauuaggagacaccgcaugggacuuuggaaguauaggaggaguguuuacuucaguaggaaagcuaguccaucaaaucuuugggacggcuuacggagucuuauuuaguggcguaaguuggacaaugaagauaggaauuggaguacuguuaacaugguuaggucuuaacaguaggucaacuucucuuucaaugacauguaucguagucggacugguuacauuauauuuagguguaauggugcaggcagauucggguuguguaaucaacuggaaaggccgcgaguuaaagugcggauccggaauuuuuguaacgaaugaaguacacacguggacggaacaauauaaauuucaagcagauuccccaaaacgccuuagugcagccaucgguaaggcaugggaagaagggguuugcggcauucgcucagccacucgcuuagaaaacauaauguggaaacagauaaguaacgaacucaaucauauacuuuuagagaacgauaugaaguucacagugguaguaggagacgucgcugggauucuggcacaggguaagaaaaugauuagaccccaaccaauggaauacaaauauucauggaagaguuggggaaaagcgaaaauuauaggggcagauguacaaaacacaaccuucauuaucgauggaccaaacacuccagaauguccugacgaccaaagggccuggaauauaugggaaguagaagauuacggauuugguauauucacuaccaacauaugguugaaacuaagagauuccuacacacaggucugugaucaccgacucaugucagccgcgauaaaagauaguaaggccguacaugcagacaugggguacuggauagaaucagagaagaaugagacuuggaaacuagcccgugcaucuuuuauagaaguuaaaacuuguauuuggccaaaaucacauaccuuauggagcaacggaguccuagaaagugaaaugaucauuccaaaaauuuacggaggacccauaagucaacauaauuaccguccgggcuauuuuacacaaaccgcgggaccguggcaucuugguaaauuggaguuagauuuugacuugugugaagguaccaccguaguaguagaugaacauuguggaaauagggguccauccuuacguacuacaaccgucacugggaagauaauacaugaauggugcuguagaucuugcaccuuaccgccauugcgauucaaaggagaagaugguugcugguauggcauggaaaucaggccugugaaagaaaaggaagagaaccuaguaaaaucgaugguuucugccggaucuggugaaguagacagcuuuucacuaggguugcuauguauuagcauaaugauagaagaaguaaugcgauccagguggaguagaaagaugcuaaugaccgggacauuagcuguauucuuucuuuugauuaugggccaauuaaccuggaacgaccucauucguuuaugcauuauggugggugcaaaugcguccgaucgcaugggaaugggaacaacguaccucgcucuaauggcaacauuuaagaugagaccaauguuugcagucgggcuacuguuccgacgucucacuucacgagaaguauuacuucuuacaauuggucuaaguuuaguagccagcguagaauugccaaauucucuagaagaacuuggagacggguuagcaauggggauuaugauccuaaaauuacuuacagauuuccagucacaccaauuaugggcaacuuugcuaucauugaccuucauaaaaacgacauuuucuuuacauuacgcauggaagacgauggcgauggugcuuaguauaguuagccuauucccacucugucugucaaccacuucucagaaaacuacaugguuacccguacuuuuaggaagccuaggguguaaaccccugacaauguuuuuaaucgcggagaauaaaauauggggaagaaaauccuggccguuaaaugagggcauaauggccguagggauaguaagcauauuauuaucaucauuacuuaaaaaugacguaccacuagcuggaccacuaauugccggaggaauguuaauugcauguuacgucauaaguggaucuucugcagauuuaucucucgaaaaggcugcagagguaucuugggaagaagaagcggaacacaguggagcuagccauaacauuuuaguagagguucaggaugauggaacaaugaaaauuaaagaugaggaacgagacgauaccuuaacaauauuacuuaaagccacguuauuagccguaaguggaguauaccccuuaucuauaccagcgacacuguuuguaugguacuucuggcagaaaaagaaacaacguagcggaguacuuugggauacacccucuccuccagaaguugaacgggccguacuugaugaugggauuuaccguauuaugcaaagaggccuacucgggcgaucccaaguagguguuggaguguuccaagaaaauguguuucacacuauguggcauguuacacgaggcgcaguccuaauguaucaaggcaagcgccucgaaccauccugggcgucuguaaagaaagaccucauuagcuauggaggggguuggcgauuacagggauccuggaauacuggggaagaaguacaaguuauagcaguagaaccugguaaaaauccuaaaaauguacaaacugcgccuggcacuuuuaaaacgagugagggagaaguuggagcuauagcacuagacuucaaaccaggaacguccggcaguccaauaguaaauagagaaggaaaaauaguaggacuuuacggaaauggaguggucacaaccucggguacauacguaucggcaauugcucaagccaaagcaagucaagauggaccguuaccagaaauagaagaugagguuuuccguaaaagaaauuugacaauaauggaucuacacccaggaaguggaaaaacccguagauaucucccugcuauaguaagagaggcaauuaagaggaaacugaggacauugauccuggccccaacacgugugguagccucagaaauggcagaggcacuuaaaggaaugccuauaagauaucaaacaacugcugucaaaucugaacauaccgggaaagagauaguggauuuaaugugccacgccacauucacaaugcgauuacuauccccaguaagaguuccgaauuacaacaugauuaucauggaugaagcacacuuuacggacccgucuucaaucgcugcucgcggcuacaucuccacaagaguuggcaugggagaagcugccgcaauuuuuaugacggcaacuccgcccgguagugucgaagcauuuccccaaagcaacgccgucauacaggacgaggagcgggacauccccgaacgcaguuggaacucgggauaugaauggauaacagacuucccuggaaagacaguaugguucguucccagcauaaaaagugguaaugauauagccaauugccuaagaaagaaugggaaaagagugauacaacuuuccagaaaaacauucgauacugaauaccagaaaacuaaaaauaacgauugggacuacguggucaccacugauauaucagaaaugggugcgaauuuucgagcugaccgaguaauagaccccagaagaugucuuaaaccggucauacuaaaagacggaccagagcguguaauucuggcuggcccaaugccgguuacaguagcaucugcagcccaacggcgcggccguauaggcagaaaccacaauaaagaaggggaucaauacauauacaugggccaaccacucaauaacgaugaagaccaugcacauuggacggaagccaaaaugcucuuagacaacauaaauacuccggaaggcaucaucccagcucuguuugaaccagaacgugaaaaaucagcggcuauugauggagaauauagauugaggggcgaagcgagaaaaacauucguagagcucaugaggaggggcgaccuccccguaugguugucuuauaaagucgcauccgaagguuuucaguauagcgaucgaaggugguguuuugauggagagcggaacaaccaaguauuagaagagaauauggauguggagaucuggacgaaagaaggugaacgaaagaaauugagaccaagguggcuugaugcccgcacauauagcgauccuuuagcacuaagagaauuuaaagaauuugcggcggguagaagauccguauccggugauuuaauucuagagaucggaaaauuaccgcaacauuuaacccaacgagcacaaaaugcacucgacaaucuagugauguugcauaacucugaacaaggaggcagagccuacagacacgcgauggaggagcuccccgauacaauagaaacgcucaugcuguuggcuuugauugcaguauuaacaggaggaguaacacuauucuuucuauccggacgaggcuugggaaagacaaguauaggacuuuuaugcgugauggcuucauccguccuauuauggauggcaucaguagaaccacauuggauagcugccagcauuauacuagaguucuuucucaugguauuauugauuccagagccagauagacaaagaacgccacaggauaaccagcuggcguauguaguuauuggauugcuguucaugauacuaacaguggcagcaaacgaaaugggacuacuugaaacgacuaagaaagauuuagguauaggucacguagccguugaaaaccaucaucacgcagcaaugcuggauguugaucuacacccagcgagugcauggacauuauaugcgguugcuaccacaauuauaacuccgaugaugagacauacaauugaaaacacaacugcgaacauaucguugaccgcgauagcuaaccaggcagcgaucuuaaugggucuggauaaaggauggccuauuuccaaaauggacauaggcguaccgcuucuggcucuuggauguuauucacaggucaauccgcuuacauugacggcggcaguucucaugcuaguugcgcauuacgccauaauugguccugggcuacaagcuaaagcuacaagagaagcacagaaaaggacugcggccgguauuaugaaaaaucccacuguugacggcauaguagccauagaucucgauccaguaguuuacgaugcgaaauuugaaaaacaauuaggacagauaaugcucuugauauuauguacaucucagauucugcuaaugcgcacaacaugggcauuaugugagucaauaacauuagcgacugguccauuaaccacgcuaugggaggguucaccuggaaaauuuuggaacacuacaaucgcaguuucgauggcuaauaucuuuagaggaucauauuuggccggugcuggauuagcuuucagucuaaugaaaucacuaggaggaggaaggcgcgguacuggagcccagggagaaacauuaggagaaaaauggaagcggcaacucaaccaauuaaguaagucagaauuuaauacuuauaagcgaagugguauuauggaaguugaucgauccgaggcgaaggaagguuugaaacguggagaaaccacuaaacacgcaguaaguagaggcacggcgaaacuaaggugguucguugaacgaaaccuuguuaaaccugaagguaaaguaauagacuuggguugcggaagaggcggguggagcuauuacugugcuggacugaaaaaggucaccgaagucaaaggauauaccaaagggggcccagggcaugaagaaccaaucccaauggcaacuuauggcuggaaucuugugaagcuaaauucaggaaaagauguauucuuuauaccgccagaaaaaugcgauacacuucugugugauauaggugaaagcucuccaaauccuacaauugaggaaggccguacauugcgaguacuuaagauggucgaaccauggcuacgcggaaaccaauuuuguaucaaaauacuaaacccauacaugccuucugucguagaaacucuugaacaaaugcaaagaaaacauggugguaugcuaguccgaaauccacuaagccguaauucuacacaugaaauguauugggucucauguggaacgggaaacauaguaagcgccguaaacaugacgaguaggaugcuucucaacagauuuacaauggcccaccgcaagccgacuuaugaacgagauguagaccugggcgcuggaacucgucacgucgcuguagaaccugaaguugcuaacuuagauauuauaggucaacgcauagaaaacauaaaauaugaacauaaaagcaccuggcauuaugacgaggauaauccuuacaaaacuugggccuaucacggaucauacgaaguuaaaccaucaggaagugcuaguucuauggugaauggagugguuaaacuucugacaaaaccaugggacguuaucccaauggucacacaaauagcuaugaccgauaccacgccauucggccaacagagaguuuucaaagaaaaaguagacacaaggacacccaaggccaaacgaggaacggcacaaaucauggaaguuacugcaaaaugguuguggggguuccuuuccaggaacaagaaaccgcgaaucugcacaagagaagaauuuacccgaaaagucaggucaaacgcagcaauaggugcuguuuucguagacgaaaaucaauggaauagcgcuaaagaagcgguugaggacgaaagauucugggaucucguccaucgggaacgagaacuccauaaacaaggaaaaugugcaacauguguuuacaauaugauggguaagcgagagaagaaacuuggcgaauuuggaaaagcuaaaggaaguagagcgauaugguacaugugguuaggcgcaagauuuuuagaguucgaagcacugggauuuaugaacgaggaucauugguucucgagggaaaauucguuaaguggcguugagggggaaggucuccauaaauuggguuacauacuuagagauauuagcaaaauaccaggugggaauauguaugcagacgauacagcuggaugggacacuagaauaacagaagaugaucuccaaaaugaggcuaaaauuacugauauaauggaaccugaacaugcacuucuagcaaaaucuauuuuuaaauuaacuuaccagaauaaagugguuagaguacaacgcccugccaaaaauggaacagugauggaugugauaucucgaagagaccaacgggggucugggcaaguggguacauacggcuugaauacauucacaaauauggaagcacaauugauuagacaaauggaaucugaggguauauuuaguccaucagaauuggagacaccaaauuuggcgggacgaguccuagacugguuggaaaaacaugguguagagcggcuaaaaagaauggcaauuucgggggaugauugugucgucaaaccaauagacgaccgauucgccacagcauugacggcacugaaugacauggggaaaguacgaaaagauauaccacaaugggagccaaguaaaggguggaaugacuggcaacaggucccguucuguucccaucauuuccaucaacucauaaugaaggauggaagagagauaguaguaccuuguagaaaccaagaugaacugguuggacgagcucgaguuucucaaggagcuggauggucacucagggaaacagcaugccucgggaaaagcuaugcacagauguggcagcuaauguauuuccauaggcgcgauuuacgauuagcagcaaaugcuaucuguuccgcaguaccuguagauugggucccaacaucacgcacaacauggucgauacaugcgcaucaucaguggaugacuacugaggauaugcuaucgguauggaaccguguauggauagaagaaaacccguggauggaagauaaaacacauaucagcucaugggaggacguuccauaucuuggaaagcgagaggaucaauggugcgggagccugauagggcucacugcuagagcaaccugggcuacgaauauccaaguugccauaaaucaaguaagacgucucauagggaacgagaauuaucuggacuauaugacuuccaugaagagauucaaaaaugagucggauccugaaggagcauugugguag

SEQ ID NO: 21687 - RNA, 9879 nt, Artificial Sequence
  derived and/or modified CDS sequence (opt6) from DENV-1__GQ199809__SS-prME
ucaguuacuaugcucuuaaugcuaaugccaacugcccuugccuuccaucuaacuacccgcgggggcgaaccucauaugauaguuacuaaacaagaacgggggaaaucuuugcuauucaaaacuucagcgggugugaauauguguacccugaucgcaauggaucuaggcgaauugugcgaagacacuaugacuuauaaaugcccaagaauaacugaagcugaaccagaugauguugacuguuggugcaaugcuacagauacuuggguaacauaugguacuuguagucaaacaggagaacaucgcagagauaaacguucgguggcguuggcaccacacguuggccuagguuuagaaacucguacugaaacuuggauguccagugaaggagcauggaaacaaauacaacgcguggaaacuugggcauuaagacauccuggauucaccgugauugcacuauuccuagcacacgcaauaggcacaagcaucacccaaaaagguauuaucuuuauacugcuaaugcucgugacaccgucaauggcgaugcgaugcguagggauaggaucaagggauuuuguggagggacugucuggugccacauggguagacguaguguuggagcaugggucuuguguuacaacaauggcaaaagauaaaccaacccucgauauagaauuacuaaaaacagagguaacaaauccagcugucuuaaggaaguuaugcaucgaagccaaaauaucgaacacaacuaccgacucaagauguccaacgcaaggagaggcaacgcuaauggaggaacaagacgcuaauuucgucuguagaagaacuuuuguagaucggggcuggggcaacggaugcggucuauuuggaaaaggaagucugauaacgugugccaaauuuaaguguguuacgaaacuagaaggaaagauaguacaguaugaaaacuuaaaauauucuguaaucgucacagugcacacaggagaucaacaccaaguaggcaaugaaucaacagaacacgguacuaccgcaaccauuacaccgcaagcaccuacaagugaaauacagcucacagauuauggcgcucuuacauuggacuguucaccgagaacugguuuagacuucaaugaaaugguucuacugaccaugaaagaaaagucuuggcucguacauaaacaaugguuccucgaucucccauuaccuuggacaucgggggcaucuacaagucaagaaacauggaaucggcaagauuuacugguaacauucaagacagcccaugccaagaaacaagaagucguaguacuugggagccaagaaggugcuaugcauaccgcauuaacuggagccacagaaauucaaacuucaggcacaacgaccauauuugcuggacaucuaaaaugcagacuuaaaauggauaagcugacccuaaaaggaaugucuuacguaauguguacuggaaguuuuaaguuagaaaaagaaguagcugagacacagcaugguacaguacuuguacaaauuaaauacgaaggaacggaugcaccuugcaaaauuccauucucuacacaggacgaaaaaggaguuauacaaaaugguagacuuaucaccgcuaauccaauaguuacugacaaagaaaagccaguaaacauagaagcggagccaccguuuggcgaaucauauauaguaauaggcgugggagaaaaagcccuaaaauuaucuugguucaaaaagggcucguccauuggcaaaauguuugaagcuacagcucgaggugcucggcguauggcgauauuaggugauacggcgugggauuucgguucuauaggugggguauucacaagugugggaaaguuaguucaucaaauuuucgguacugcauacggugugcuuuucuccggugucucuuggacaaugaaaauugguauagguguacuacuaacauggcuugggcuaaauagucgaucaacuucguuaagcaugacguguauagcugugggucuugugacauuauaucugggaguaauggugcaagcagauucagggugcguaauaaauuggaaagggcgagaauuaaaguguggaucuggaaucuuuguuacaaaugaaguucacacuuggacagagcaauauaaauuucaagccgauucgcccaagcgacuuagcgcagcgauaggcaaagcaugggaagaggggguaugugggauuaggagugucacaagguuagaaaacauaauguggaaacaaauaagcaaugagcuaaaccauauccuacuugaaaaugauaugaaauuuacaguaguaguuggugauguugucgguauacuagcacaggguaagaaaaugauuagaccacaaccgauggagcacaaauauucauggaaaucaugggguaaggcaaaaaucaucggagccgacguacaaaacacaacuuuuauaauagauggcccgaacacuccagagugcccagacgaccaaagagccuggaauauaugggaaguugaagauuauggguucgguauauucacaacaaauauuugguuaaaacugcgagauucauacacgcaggcaugcgaccauagauuaauguccgcagcgauaaaagacagcaaagcaguucaugcagauaugggauacuggauagagucagagaaaaaugagacauggaagcuggcucgagcuaguuuuauagaaguaaagacaugcauuuggccaaagagucauacauuauggucgaacggagucuuggaaucggaaauggucauaccaaagauauaugguggacccauuagccaacauaauuauagaccaggcuauuucacacaaaccgcaggaccauggcaucuuggaaaauuagaacucgauuucgaucugugugaaggaacaacgguaguugucgacgaacauugcgggaaucgaggcccaaguuuaagaacaacaacugucacugggaaaauaauucacgaauggugcuguagaucaugcacguuaccuccccuaagguucaaaggugaagacggaugcugguaugguauggaaauuagaccaguaaaagagaaagaagaaaaucucguaaagaguaugguauccgcaggaaguggagaaguggauaguuuuagcuuaggauugcuuuguauuucgauaaugauugaggaaguaaugcgcucuagauggucacgaaaaaugcuuaugacuggaacgcuugcgguauuuuugcuacuuauuaugggacaauuaacguggaacgauuuaauaaggcuaugcauuaugguuggagcgaaugcaucugaucgcaugggcauggguacaacauaccuagcccuaauggcaacauucaagaugcguccuauguucgcgguaggacuacuuuuuaggcgacugacaaguagggaaguauuacuccucacgauuggucuaagccuaguagcuucuguugaacuaccgaacucgcuagaagaacuaggcgauggcuuggcuaugggaauaaugauuuuaaaauuauuaacagacuuccaaucucaccaacuuugggcaacuuuauugucccuuacauuuaucaaaaccacucuaagucugcauuacgccuggaaaacaauggccaugguacuuaguaucguuucacucuucccucugugccuaaguacgacaucccagaaaacuacaugguuaccaguguuguuaggcagccuaggcuguaaaccacuaacgauguuuuugauagcugaaaauaaaaucuggggaaggaagaguuggccacuaaaugaagggauuauggcaguuggagucgucucaauuuuacugagcagucuacugaagaaugauguaccucuagcagguccacuuauugcggguggcaugcugauugcgugcuacgucauuucugggagcuccgcagaucucucucucgagaaggcagccgaggugucgugggaagaggaagcugaacauucaggcgcaagucauaauauauuaguugagguccaagacgauggaacgaugaaaaucaaagaugaagaacgugaugauacccuaacaauucuacuuaaagcgaccuuacuugcgguuaguggaguuuauccucucucuaucccugccacauuguuuguuugguauuucuggcaaaagaagaaacaacguucagguguuuugugggauacuccaucaccaccggaagucgagagggcuguucuagaugauggaaucuauagaauuaugcaaagaggucuccuagggcggagccaagugggggugggaguuuuccaggagaauguuuuucauacaauguggcaugucacacgaggagcaguacuaauguaccaaggaaaacgacucgaaccuucaugggcauccguaaagaaggaucuuaucaguuacggagggggauggagacuacaaggcagcuggaauacaggagaggaaguacagguaauagcgguggaacccgguaaaaauccaaagaauguacaaacugcgcccgguacuuucaaaacuccggaaggcgaaguuggcgcuauugcauuagacuuuaagccggguacaucuggaagccccauugugaauagagaagguaaaauaguugggcuauaugguaauggaguggucaccacuucugguacuuacgugucagcaaucgcccaggcaaaggccagccaagaagguccccucccagaaauugaggaugaagucuucagaaaacguaaccugacgauuauggaucuucauccaggcagugguaagacaagaagauaccuaccugcuauaguacgcgaggcuaucaaacguaaacugcggacacuaauacuggcaccuacuagaguuguugcgucagagauggccgaggcauugaagggaaugccaauaagauaucagacuacagcaguaaaaucagagcacacaggaaaagagauuguagacuugaugugccacgccaccuuuacuaugcguuuauuauccccaguucgaguaccuaacuauaacaugaucauuauggacgaggcucauuuuacggacccgucaagcauagcugcaagaggcuauaucucaacuagagugggaaugggcgaagcugcggccaucuuuaugacugcuacaccaccgggaucaguugaggcuuucccgcagucaaaugcuguaauccaagaugaagagagagacauaccugagcgauccuggaacucaggguaugaauggauaacagacuucccugggaaaacaguuugguuugugccuucuauuaaauccggcaaugacauagccaacuguuugaggaaaaaugggaaaagaguaauucaacuauccagaaaaacguuugauaccgaauaucagaaaacuaaaaacaacgauugggacuacguuguuacuaccgauauuucagaaaugggugcaaauuuuagagcagauagaguuauagacccgaggagaugcuugaaaccagucauccuuaaggaugggccagaaagaguuauacuugcaggaccgaugccaguaacugucgccucggccgcacaacgucgcggucgaauagggaggaaucauaauaaagagggcgaccaauacauuuauaugggacaaccacugaauaaugacgaagaccacgcucauuggacagaagcaaagauguuacucgauaauauaaacacaccagaaggaauuauacccgcucuauuugaaccagaacgugaaaaaucagccgcaauagacggcgaauauagauugcguggugaggcacgaaaaacauucguagaauugaugcggaggggugauuugccuguuugguuguccuauaaaguugcuagcgaaggcuuccaauauucugaccgcagaugguguuuugacggugaaagaaauaaucagguucuagaagaaaauauggauguagaaauauggacuaaggaaggagaacggaagaaauugcgaccgcgcuggcuugacgcccgaacauacagugacccguuggcuuugcgggaguucaaagaauuugcugcaggucgacgauccguaucaggagacuuaaucuuggaaauaggaaaauugccccagcacuuaacacaacgagcucagaaugcacuagauaaccugguuaugcuucauaacucagaacagggcggacgugcauacagacacgcaauggaagaauugccagacacaauagaaacacuaauguuacuugcgcuaauagcaguauuaacuggcggaguaacauuguucuuuuuaucaggaaggggucuggguaaaacgaguauagguuuacucuguguaauggcaagcuccguauuguuauggauggcaaguguagaaccacauuggauagcagcgaguauuauauuagaguucuucuuaaugguauuacucaucccagaaccugacagacaaagaacaccacaagauaaccaauuagcauacguuguaauaggauuacuauuuaugauauuaacgguagccgccaaugaaauggguuuauuagagacaaccaagaaagacuuaggaaucggucaugucgccgucgaaaaccaccaucaugcgacgauguuagauguugacuugcauccagcauccgcauggacacucuaugcaguagcaacuacuauuaucacuccuaugaugcggcauacaauugagaauacaacggcuaauaucucucuaacugcaaucgcaaaucaagcagcuaucuuaaugggacuagacaaagguuggccuaucucuaaaauggauauaggagucccacugcucgcauuaggguguuauucgcaaguaaauccccucacgcucacagcugcaguucucaugcucguggcacauuacgcaauaauagggcccggccuucaagcuaaggccacacgagaggcucaaaaacgaacugcagcuggcauaaugaagaauccaacaguggauggaauaguagccauagaucuagauccagucguguaugaugcaaaauucgaaaaacagcuaggucaaauuauguugcuaauccuauguacgucacaaauauuguugaugcgcacaacaugggcgcuuugugaaagcauaacuuuagcuacaggaccauuaacaacguuaugggaaggaucacccgguaaauuuuggaacacuacaauugcagucucgauggcuaauauauuuagaggaucguauuuagcgggugcaggacuugcauuuucucuaaugaaaucacuaggcgggggacgacgcggaacaggggcccaaggggaaacccucggagagaaauggaaaagacaacuaaaucaacuaucaaaaagugaauuuaauaucuacaaaaggucagggauaauggaaguagauagaucugaagcuaaagaagguuuaaaacgaggggagacuacuagacaugcaguuucaaggggcacagccaaauugagaugguucgucgagagaaauuuagucaaaccagaaggcaaggugaucgaccucggcugcggucgggguggauggagcuacuacugugcuggucuaaagaaaguaacugagguuaaagguuauacuaaaggaggaccaggccaugaagaaccgauaccuauggcaacauacggguggaaucuaguaaaacuacacucagguaaagaugucuucuucacaccgccagagaaaugcgauacacuacuuugugacauaggagaaucaagcccuaacccgacaaucgaggaaggaaggacuuuaaggguucugaagauggucgagccuuggcuacguggaaaccaauuuuguauuaaaaucuuaaauccuuacaugccuagcguggucgaaacguuggaacaaaugcaaagaaagcaugggggaaugcuuguaagaaauccauuaagcagaaauagcacacaugaaauguauugggugagcuguggcacagguaauaucguuucggcgguaaauaugacaaguagaaugcuacucaaccgauuuacaauggcccaucggaagccaacuuaugaacgggauguugauuuaggcgcagggaccagacauguugcggucgaaccggaaguagccaaucuagauauaauuggucaacggaucgaaaauaucaaacaugagcauaaaagcacauggcacuaugaugaagacaauccauacaaaaccugggcauaccacgggagcuaugaaguuaaaccuagugggucugcauccaguauggugaaugggguugugaaacuucuuaccaaaccuugggacguuauaccuaugguuacgcagaucgcaaugacagacaccacgccguucggucaacaaaggguauucaaagaaaaaguagauacgcgcacgccaaaggccaagcgaggcacugcacaaauaauggagguaacggccagguggcugugggguuuucucagcagaaacaagaagccaagaauuugcacacgagaggaauuuacuagaaaggucaggaguaacgcagcaauaggcgcuguguucguggaugaaaaccaauggaacucugcaaaagaagcagucgaagaugaaagguuuugggaccugguccagaaagaacgugaguugcauaaacaaggaaaaugcgcaacuugcgucuauaauaugauggguaaaagggagaagaaacuuggcgaauuugguaaggcaaaaggaaguagagcaauaugguacaugugguuaggagcaagauuucucgaauuugaagcacuuggcuucaugaacgaagaucauugguucagucgggaaaauucacuaucuggcguggagggagaagguuugcauaaacuuggauauauauuaagagauauaucuaaaauaccuggggguaauauguacgcagaugauacugcaggaugggauacacgcauuacagaagaugaccuacaaaacgaagccaaaaucacagacaucauggaaccagagcacgcauuauuagcaacgucgauauucaaacuuacauaucaaaacaaaguugucagaguucagagaccugcaaagaacgguacagugauggauguuauaucacggcgugaucaacgaggaucgggacaaguaggaacguaugggcucaauacguuuacaaauauggaggcacaacuuauucgacaaauggaaucugaaggaauauucuuaccaucagaacuagaaacaccuaauuuggcugaaagaguacuagacugguuagagaagcaugguguagaaagguugaagagaauggccauaucuggagaugacugcguuguaaaaccuauugaugauagguuugcaacagcccucacagcgcucaacgacaugggaaagguaagaaaggacaucccucaaugggagccaaguaaaggcuggaacgacuggcaacaaguaccguucuguagccaccacuuccaucagcucauaaugaaagauggcagggaaaucguuguaccuuguagaaaucaagaugaacugguugggagagcuagaguaucacaaggagcgggauggucguuacgagagacggcaugccuuggaaaaucuuaugcucaaauguggcaacugauguauuuucaucguagagaccugcgcuuagcagcaaacgcuaauuguuccgccguuccagucgauuggguuccaacuucaagaacgacuuggucaauucaugcacaucaccaauggaugacuacagaagauaugcuuucgguguggaacagaguauggauugaggaaaacccuuggauggaagacaaaacgcauguuaguucauggggugacgugccauaccuagggaaaagagaggaucaauggugugggagcuugaucgguuugacagcgagggcuacuugggcaucgaacauacagguagcgauuaaccagguuagaaggcuaauagggaaugaaaauuaucuagacuacaugaccaguaugaaaagauuuaaaaaugaaggagacccagagggugcauugugguaa

SEQ ID NO: 21688 - RNA, 9879 nt, Artificial Sequence
  derived and/or modified CDS sequence (opt6) from DENV-1__GQ199810__SS-prME
uccguaacaaugcugcuaauguuaaugccuacagcgcuugcuuuucauuuaacgacgcgggguggcgaaccccauaugauaguuagcaaacaagaaagaggaaaaagucuacuauuuaaaacaagcgcugguguuaauaugugcacauuaauugcaauggaccuaggagaacuaugcgaagauacgaugacauauaaauguccacgcauuacagaaacagaaccagacgauguagacugcugguguaacgcaacggauacuuggguaaccuauggaacguguucacagacuggagaacacagacgggauaaaagauccgucgcacuugcaccucauguuggauugggacuggaaacacgaacggaaaccuggaugagcagcgaaggagcuuggaaacaaauacaaagaguggaaaccugggcacugcgacaccccgguuucacggucauugcauuauuuuuagcacacgcaauuggaacguccauaacacaaaaaggaauuaucuuuauauuauuaaugcuugucacaccaucaauggcaaugagauguguugguauugggucaagagauuuuguugaaggacuaaguggugcaaccugggucgauguaguacuagaacauggcuccuguguaacuacgauggcaaaagacaaaccaacauuagacauagaacuacuuaaaacagagguuaccaauccugcaguccuccguaaacucuguauugaagcaaaaaucucaaauacaacuaccgauucaagaugucccacucaaggagaggcuaccuugguugaggaacaagaugccaauuuuguuugucguagaacauucguagacagaggguggggaaacggauguggucuuuuuggaaaaggcagcuuaauaaccugugccaaauuuaaaugcgucacuaaauuagaagggaagauaguccaauacgagaaccuaaaguacucaguuaucguaacuguucacacgggugaccaacaccaaguuggaaaugaaucaacugaacacggaacuacagcaacaauaacuccucaagccccaacuacggaaauacaguugacagauuauggugcgcuuacgcucgacuguaguccuagaaccggucuggacuucaaugaaaugguauuacuuacaaugaaagagaagucgugguuaguccacaaacagugguuuuuagaccuaccauuaccauggacaaguggcgccucaacuucucaagagacuuggaacaggcaagauuugcucguuacuuuuaaaacagcgcaugcaaagaagcaagaaguaguuguauuggggucacaagaaggggccaugcacacagcuuugacaggagcaacagagauacagacgucaggaacaacaacaauuuucgcaggccaccuaaaaugucguuugaaaauggacaaacuaacauugaaaggaaugaguuacguaauguguaccggcucuuuuaaauuagaaaaagaaguagcggagacacaacacggaaccguuuugguacaaaucaaauaugaggguacugacgcccccugcaaaauaccauuucuuacucaagaugaaaagggaguaacucagaauggaaggcuuauaacagcuaauccgauaguaaccgacaaggagaaaccgguuaauauagaagcggaaccuccauucggagaaucauauauaauaauaggugcuggcgaaaaagcauuaaaacuuaguugguuuaagaaagguagcucaaucggaaaaauguucgaagcuacugcucgaggagcgagacgaauggcaauucuuggagacacugcgugggacuucgguuccauaggaggaguuuuuaccagugucggaaaauugguacaccaaauauuugggacagcuuaugggguuuuauuuaguggggucucauggacaaugaaaauaggcauuggcguucuauuaacaugguuagguuuaaauucaagaucaacaucacucucgaugacaugcauagcaguuggacuuguaacauuauauuuaggaguuaugguacaagcagacagcggaugugucauuaauuggaagggacgugaacuuaaaugugguagugguaucuuuguaacaaacgaaguacauacauggacagaacaauauaaguuucaagcagauucaccuaaacgucugucugcagcuauuggcaaggcuugggaagagggaguauguggaauacguagugcaacgcguuuagaaaacaucauguggaagcaaauaucaaacgaguugaaccauauucuacuugagaacgauaugaaauuuacuguaguugucggagauguagcgggaaucuuagcucaaggcaagaaaaugauaagaccacagccaauggaauauaaauauucauggaaaucauggggaaaagcuaaaauuauuggugcagauguccagaauacaaccuucauuauagauggacccaauacaccagaauguccugacgaccaacgcgcguggaacaucugggaaguagaagacuauggauuuggaauauucaccacuaauauuuggcuaaaacucagagauagucauacucaaguuugcgaucaccgccuuaugucugcagcaauaaaagauuccaaagcaguccacgcggauaugggcuacuggauugaaucagagaaaaaugaaacuuggaaauuggcuagagcaucauuuauugaggugaaaacgugcauauggccgaaaagccauacauuauggucgaaugggguguuagaaucagagaugauaaucccuaagauauaugguggcccaauaagucagcacaauuaccguccggguuacuuuacgcaaacugcuggaccauggcaucuggguaaacucgaacuugacuuugaucuaugcgagggaaccacugucguaguagaugaacauugcgguaaccgaggaccaucacuaagaacaacaacuguuaccgguaaaauaauacaugaaugguguugucgauccugcacccuaccaccauuacguuucaggggagaagacggguguugguacgguauggaaauaaggccaguaaaggaaaaagaagagaaucucgucaaaucaauggucagcgccgguucuggggaaguagacucuuucucauuaggacuucuauguauaagcauaaugauagaggaaguaaugcgaaguagauggucacggaagaugcuuaugacagggacguuagcggucuuuuucuuauuaauaaugggccaauuaacuuggaaugaccugauaagacuuugcaucaugguuggugcaaacgcaucagauagaaugggcauggguacaaccuacuuggcauugauggcaacauuuaaaaugcguccaauguuugcugugggccuguuauuccgacgauuaacaucaagggagguacuauugcuaacaauaggcuuaagccuggucgccuccgucgaacuaccaaacucauuagaagaguugggcgauggucuagcaaugggaauaaugauauugaaacuucuuacagauuuucaaucucaccaguuaugggcaacucugcuaucccuaacauuuauaaagacgacauucucuuuacacuacgccuggaagaccauggccaugguccuaaguauuguaucauuauucccccucugucugaguaccacaucacagaagaccacgugguugccgguauugcucggaucgcuagguuguaagccguuaacaauguuucuuauugcggaaaacaagaucugggguagacguucauggccacuuaaugaaggcauaauggcgguaggaauuguaucgauacucuuauccucacuccucaaaaaugauguuccauuagcagggccuuuaauagcaggaggcaugcuuauugcaugcuauguaauaaguggaaguucugcagaccucucucuugaaaaagccgccgagguauccugggaagaagaggucgaacauucuggagcaagucacaacauacuuguugagguacaagaugauggaacaaugaagauaaaagaugaggagcgagacgacacacuaacaauccuacuaaaagcuacacuccuagccgugaguggaguguauccucuaaguauaccagccacccuauuuguuugguauuuuuggcaaaagaagaaacagcgcucagguguuuuaugggacacaccaaguccaccagaagucgaacgagcaguccuagaugacgguaucuauaggauaaugcagagagggcuccuaggucgcucacaaguagggguagggguauuccaggaaaaugucuuucacacgauguggcauguuacacgcggugcgguauuaauguaucaagguaagaggcuagagccgucaugggcgaguguaaagaaagaccucauaucauaugguggcggauggagauuacagggaaguuggaauacuggagaagaagugcaggucauagccguagaaccugguaaaaaucccaaaaauguccaaacagcaccagggaccuuuaaaacaccagaaggagaaguaggugcgaucgccuuggacuucaaaccuggaacaucgggaucgccaauaguaaaccgugaaggcaaaaucguuggacuauacggaaauggaguugugacaacuucaggcacguacguuagcgcaauagcgcaagcuaaagcaucccaagaaggaccacugccagagauagaggaugaaguauuuagaaaacguaacuuaacaauaauggauuuacauccagguaguggaaagacaagacguuaucuuccugcaaucguucgagaagcaauaaaaagaaaacuaaggacucuaauacuagccccuacccguguaguugcaagcgaaauggcagaagcauuaaagggaaugcccauucguuaucagacgacagccgucaaaucagaacacacuggaaaagaaauaguugaccuuaugugccacgcuacuuucacaaugcgacuucugucgccaguuagaguaccuaacuauaacaugauaaucauggacgaagcgcauuuuacugacccgucuucuauugcagcaagagguuacauaucuacacgaguaggaaugggugaagccgcggccaucuucaugacggcuacaccaccaggcuccguggaagcauuuccacagucaaaugcuguuauacaagaugaggaacgagauauccccgaaaggucguggaauaguggcuaugaauggauaacagauuuuccagggaaaacggucugguuuguaccaagcauaaaaucuggaaacgauauugcaaauugccuaaggaaaaaugguaaaaggguuauccaguuaaguagaaaaaccuuugauacggaauaucagaaaacuaaaaacaaugauugggauuacgugguaaccacagacaucagugagaugggggcaaauuuccgcgcggacagaguuauugauccacgacguuguuuaaagccugucauuuuaaaagacgguccagaacgagugauccuagcuggaccuaugccagugacugucgcaucagcugcucaaaggagggguaggaucggucgcaaucauaacaaggagggcgaccaauacauauacaugggacaaccucugaacaaugaugaagaccacgcacauuggacagaagcgaaaauguuauuagacaauauuaauacuccggaaggcaucauaccugcacuguucgaaccggagagagaaaaaucugccgcaauagacggagaauauagguugagaggagaagcacguaaaacauucguugaacugaugcguagaggggaucuaccaguaugguugucauacaaggucgcguccgagggguuccaauauagcgauagacgguggugcuuugauggugaacguaacaaccaggugcuggaagagaacauggacguggagauauggaccaaagagggugaacguaagaaauuaagaccacgauggcucgaugcaagaacuuauagugauccgcucgcccucagagaguucaaagaguucgcagcuggacggaggucuguaucaggcgauuuaauucuggaaauagggaaacuuccacaacaccugacucaaagagcacaaaaugcacuagacaaucuuguuauguugcauaauuccgaacaagguggaagggcuuaccgacaugcuauggaagaacuucccgauacaaucgagacgcuaauguuauuagcuuugauagcaguacuuacaggaggagugacauuauuuuuccugaguggacguggauuggggaaaacuucaauaggacuauuaugcgucauggcuucgaguguucuacucuggauggcuagcguagagccacauuggaucgcagcgucgaucauacucgaguucuuuuuaauggucuuacuaauaccggagccagauagacagaggacaccccaagauaaccaauuagcguacguagugaucggcuuacuguuuaugauccugacugucgcggcuaaugaaaugggacuauuggaaacuaccaagaaagaucugggaaucggacacguagcuguagagaaccaccaucacgcagcaauguuggacguagaccuucauccugcaagcgcguggacacuauaugcuguggcuacaacaauaauaacaccgaugaugcggcauaccauagaaaacacaacugccaacauaucacucacugcaaucgcaaaccaggcggcuauccuuaugggacuagauaagggauggccuauauccaaaauggauauagguguaccauuauuagcuuugggauguuauucacaaguaaacccucuuacccuaacagcagcaguacuaaugcugguugcacauuaugcuauaauuggaccuggucugcaggcuaaagcaacacgcgaagcucaaaaacgcacagcggcaggaauaaugaaaaauccaacuguagacggcauaguggcaauugaucuagauccgguugucuaugaugcaaaauucgagaaacaauugggccaaauaaugcuguuaauuuuauguaccucccaaauuuuguugaugagaacgaccugggccuuaugcgaaucuauuacacucgcuacugguccacuaacaaccuuaugggagggaucaccaggaaaauucuggaauacaacaauagcagugaguauggcaaacauauuucgcggaucuuauuuagccggugcgggccuugcguucucuuuaaugaaaucguugggcggagguaggcgcgguacgggggcgcagggugaaacguuaggagagaaguggaaaagacaacuaaaccaauuaaguaaaucagaguucaacaccuacaaaagaaguggaauaauggaaguagaccgaagugaagcaaaagaaggcuugaaaagaggggaaacgacaaaacaugcugugucgagggguacagccaagcuacggugguuuguggaacgcaacuuaguuaaaccagaaggaaaaguaaucgauuuggguuguggacgaggaggcuggucauauuacugcgcgggucucaagaaaguuaccgaagugaaaggauauacaaaaggaggccccggacaugaagaaccuauuccaauggcuacguaugguuggaaccuaguuaaacuucauagugggaaggauguauuuuucauaccaccugagaagugcgacacauuacuuugugacaucggugagucaagcccgaauccuacaauugaagaaggccgcacauugagaguacugaagaugguggaaccaugguugcgcgguaaccaauucugcauaaagauauugaacccauacaugccaucaguuguugagacucuagaacaaaugcaaagaaaacauggagggaugcuagucagaaauccguuaaguagaaacuccacacaugaaauguauuggguaagcuguggcaccgguaacauugugucagcuguaaacaugacgaguagaaugcuauugaacagguuuacuauggcgcauagaaagcccaccuaugaaagggacguagacuuaggugcugggacuagacacguagcuguagagccggagaucgcuaauuuggauauaauugggcaaagaauagaaaacauuaagcacgaacacaaaagcacauggcauuaugacgaagauaaucccuacaaaacuugggcauaccaugggucuuacgagguaaagccuucuggaucggcuucgucuaugguaaaugggguaguaaaauuacugacuaagcccugggaugugauuccaaugguaacacaaauagcuaugacggacacaaccccauuuggacaacaacgagucuuuaaggagaaaguugacacacggacgccaaaagcaaagcgugguacagcacaaauuauggaaguuaccgcuaagugguuauggggauuccucagcagaaauaagaaaccuagaaucuguaccagagaggaauuuacacgaaagguaagaaguaaugccgcuauaggagcaguuuuuguagacgaaaaccaauggaacagugcaaaggaagcaguagaagaugaacgauuuugggaccuuguucaccgugaaagggaauuacauaagcaagguaagugcgcuacguguguauacaauaugauggguaaaagagagaagaaauuaggagaguucggaaaagcaaaaggcucaagagccauaugguacauguggcuaggcgcuagauuuuuggaguucgaggcacucgguuuuaugaaugaggaccauugguucuccagagaaaauucacuuaguggaguagagggggaaggucuacauaaacuuggguacauacuuagagauaucucaaaaauacccggugggaauauguaugcagaugauacugcggguugggacacaaggauaacagaggaugaucuccaaaaugaagcuagaauuacagacauuauggaaccggaacaugcgcuguuagcgaaauccauauuuaagcugacguaucaaaacaaagucguacgaguucagagaccugccaaaaacggcacaguaauggauguuauuagucgaagggaucaaaggggaagcgggcaaguagguacauacggauuaaauaccuucacgaauauggaagcacagcucauaaggcagauggaaagcgaagggauauuuucacccucggagcuugaaaccccgaaucuagccgaaagaguacuggacugguuggagaaguacggaguggaacgacuuaagcguauggccauauccggcgaugauuguguagugaagccaaucgaugaucgguucgcaacugcccucacggcccugaaugauaugggaaaaguucgaaaggacauaccucagugggagccauccaaaggcuggaacgacuggcaacaaguccccuuuuguucacaccauuuccaucaacuaauaaugaaagauggcagggaaaucguagucccuugcagaaaucaggacgaauugguaggucgagcuagaguaucgcaaggcgcagguuggucucucagagagacggcaugccugggcaaaucuuaugcacaaauguggcaguuaauguacuuucauaggcgcgacuugagauuggcggcaaacgcuauuuguucagcggucccaguugauuggauuccaacaucccguacgacauggucaauacacgcacaucaucaauggaugacuacagaagauaugcuuucagucuggaaccgaguauggauugaagagaauccuuggauggaagacaagacacauauuaguucauggggugacguuccuuauuuggguaaacgagaagaccaaugguguggaucauugauuggacugacagcgagagcuaccugggcaaccaauauacagguggcaauuaaucagguucgaagacuaaucggaaaugagaauuaucuagauuauaugaccagcaugaaaagauuuaaaaaugagggagacccagaaggugcgcuaugguga

SEQ ID NO: 21689 - RNA, 9879 nt, Artificial Sequence
  derived and/or modified CDS sequence (opt6) from DENV-1__GQ199811__SS-prME
ucuguaacuauguuguugaugcuuaugccuacggcauuagcauuucaccugacuacaaggggaggggaaccucacaugaucguaucaaaacaagaacguggaaaaucccugcuauuuaaaacaucugcuggcguaaauaugugcacacugaucgcuauggaccuuggggaauuuugugaagauacgaugacuuacaaauguccucgaaucacugaagcggaaccagaugacguagacuguugguguaaugcaacagauacguggguaacguacggcacauguucucaaacgggcgaacauagacgcgacaaacguagcguagcacuugcaccacaugugggauuaggcuuagaaacuagaacugaaacauggaugucaagcgagggagccuggaaacaaauacaacguguagagacaugggcacuuagacauccaggauuuacaguaauugcccuauuucucgcacacgcaauugggacgucaauaacucagaaaggaauaauuuuuauauuauuaaugcuagugacgcccagcauggcgaugcggugcgucgggauagguuccagggacuuuguugaggggcuuucuggagcaacaugggucgacguaguacuggaacauggaucguguguaacaacaauggcuaaagauaaaccaacacuugacauagaacuauugaaaaccgagguaacgaauccugcaguucuacgaaaauugugcauugaagcaaaaaucucaaauacaaccacagacaguagaugcccaacacaaggcgaagcaacucucguagaggaacaggaugcgaauuuuguuugccgcagaacauuuguagacagagggugggggaauggauguggucuuuuuggaaaagggucucuuauaacuugcgcgaaauuuaaaugcguuacgaaacucgaaggaaaaauaguacaauaugaaaaucucaaauauagugucaucgugacagugcacacuggagaucaacaucaaguagggaaugagucuacagagcaugguaccacugccacuaucacuccgcaagccccaucaacagaaauucaacugacagacuauggagcuuuaacacuagauuguucaccgagaacuggacucgacuuuaaugaaauggucuuacuuacuaugaaagaaaagucauggcuagugcacaaacaaugguuuuuagauuuaccacuuccauggacgucgggagcuucaacuucccaagaaaccuggaaucgacaggauuuguuaguaaccuucaaaacagcacacgcuaagaagcaagagguuguaguacuagggucgcaagaaggagcaaugcauacugcguuaacaggagcaacagaaauacagacaucaggaacaaccacgauauuugccggacaucuaaaaugucgccuaaaaauggacaaacuaacacuaaagggaaugucauaugugauguguacagguucauuuaaacucgaaaaagaaguggcagaaacucagcaugguacuguguuaguucaaaucaaguaugaagguacugaugccccaugcaaaauaccauucaguacgcaagacgaaaagggugugacgcagaacggccggcuaauaacggcuaaccccauuguuacugauaaagaaaaacccguaaauauugaagcugaaccaccuuucggagagucauacaucguuauuggagcuggcgaaaaagcauuaaaacugucuugguucaaaaaggguucauccaucggcaagauguucgaagccacggcaaggggcgcuaggaggauggcuauucugggcgacaccgcuugggauuucggcaguauaggcggcguuuuuacuuccgugggaaaguuaguccaucaaaucuucggaacagcauauggaguccuauuuucagggguaagcuggacaaugaaaaucgguaucgguguauuacugacuugguuaggguugaauagucggucuacgucguuaaguaugacuugcaucgcaguuggcuugguaacucuauauuugggcguaaugguacaggcugauagcggcugcguaauuaauuggaaaggccgagaauuaaaauguggaucggggauauuuguaacuaacgaaguccauacuuggacugaacaauacaaguuucaagcugauucuccuaaacgacuuucugcggccauaggcaaggcuugggaagaaggugucuguggaauaagaagugcaaccagacuggagaacauaauguggaaacaaaucucuaacgagcuuaauuacauacuguuagagaaugauaugaagcuaacaguuguuguuggugacguagcgggaauccuugcgcagggcaagaaaaugauccgaccacaaccuauggaguacaaauauucuuggaagucuuggggcaaggcuaagauaauaggggcagaugugcaaaauacuacuuuuauaauagacggaccuaauacuccagaauguccugacgaucaaagagcuuggaauaucugggaaguggaagacuacggguucgguauauuuacgacaaauauauggcugaaauugagagauucauauacacaaguuugugaccaccgauuaaugagcgcagcaauaaaagacuccaaagcagugcacgcagauaugggcuauuggauugaaucagagaaaaaugagaccuggaaacucgcgagagcgucuuuuauagaagugaaaacauguauauggccuaagagccacacauuguggucgaauggagucuuagaaagcgaaaugaucauaccuaaaauauacggaggaccaaucucacaacacaacuacagaccuggguacuuuacucaaacagccggaccuuggcaucuugguaaauuagaacuugauuucgacuugugugaaggaacaaccguaguugucgaugagcauugcgggaacagagguccuaguuuaagaacgaccacgguaacuggaaaaauaauacaugaauggugcuguaggaguugcaccuugccgccauuacgauucaagggggaggaugguuguugguauggcauggaaauacggcccguaaaggaaaaagaagaaaaccugguaaaaaguauggucagugcuggaagcggagaaguagauagcuucucucuuggauuauugugcauaagcauaaugauagaggaagucaugagaagucguuggucaaggaaaaugcuaaugacaggaaccuuagccguauucuuucugcugauaaugggacaguuaacauggaacgauuugauacgacuaugcauaaugguaggugcuaaugcuucagacagaaugggaaugggcacuacuuaucuugcacuaauggcgacauucaaaaugcgacccauguucgcagugggccucuuauuuagaagguuaacaaguagagagguucuacuguuaacuauaggacucagucuaguugcaucagucgaacuaccaaauucauuagaagaacugggagacggcuuagcaauggguauaaugauuuuaaaacuauugacagauuuccagucucaccaauuaugggcaacucuuuugucauuaacguucguuaggacaacauucagucugcauuaugcuuggaaaacaauggcuaugguuuugucuauagucagucuauuuccucuauguuugucaacuacaagucagaaaacuaccugguuacccguacucuugggcucacuuggauguaaaccguuaacgauguuccucaucgcggagaauaaaauaugggggagaaaaucuuggccuuuaaacgaaggaaucauggcuguugguaucguaucaauauuacucuccagcuuacucaaaaaugacguaccacuugcagggccuuuaauagcaggcggaaugcugauugcaugcuacguaauaucagggucaucugcugauuuaucauuagagaaagccgcgguugucuccugggaggaagaagcagagcacaguggagccagucacaacaucuuaguagaagugcaagacgacgggacgaugaaaaucaaagaugaagaaagagaugacacucuuacaaucuuacuaaaggcaacguuacuugcagucucaggcguauacccauuaaguauuccugcgacccuauuuguaugguauuuuuggcagaagaagaaacagagaucgggaguauuaugggauaccccaaguccaccugaggucgaaagagcaguucuagaugauggaauauauagaaucaugcaaaggggacuacuagguagaucucaaguggggguuggcguguuccaagaaaauguauuccauacuauguggcauguaacacguggagcuguccuaauguaucaaggaaaaagguuggagccaucgugggcaucggucaagaaagaucuuauaucauacggugggggauggcggcuacaaggaagcuggaacacaggagaagaagugcaaguuauagcggucgaaccuggcaaaaauccgaaaaauguacaaacagccccagggacuuuuaaaacgucagagggugaagucggagcgauugcauuggacuuuaaacccgguacuucuggcucaccaauagugaauagagaaggcaaaaucgugggacucuacgggaauggaguaguaacaacgucgggcacauaugucucagcgauugcucaagccaaagccagucaagaagguccauuaccugagauagaagacgagguguuucgaaagcggaaucuaacaauaauggacuuacauccagggucuggaaaaacccgcagauauuuacccgcaauuguuagggaagccauuaaaagaaaacuuaggacgcugauccuugcuccuaccagaguaguagcaucagaaauggcagaagcucuuaaaggaaugccuauaagguaccaaaccacugcaguuaaaucagagcauacagguaaagaaaucguugauuugaugugccaugccacauucacgaugcggcuacucagcccaguaagaguaccuaacuauaacaugauaauuauggacgaagcacauuucacagacccuaguaguauagccgcucguggauacaucucaacaagagucgguaugggugaagcugcagcgauauuuaugacagcuacgccuccuggaaguguugaagcauucccucaaucaaacgcuguuauccaagacgaagaaagggacauuccugaaagaaguuggaacuccggguacgaauggauaacagacuucccagguaaaaccguaugguuuguuccaucuaucaaaucuggaaaugauauagccaacugucuacgcaaaaacggcaaaagggucauccaacuaucaagaaaaaccuucgauacggaauaccagaaaacgaaaaauaaugacugggauuacgucguaaccacagauauaucugaaaugggagcaaauuucagagcugacagggugauagacccacgacguuguuuaaaaccagucauacuaaaggaugggccagaaagaguuauauuagcugggccgaugccuguaacuguagcgucugcugcacaaagaaggggcaggauaggacgaaaucauaauaaagagggagaccaguauauauacaugggucagccguuaaauaacgacgaagaucaugcacacuggacggaagcaaaaauguuauuagauaauauaaauacgccugaagggauuauacccgcacuauucgaaccggaacgcgaaaagagugcagccauagacggagaauauagguugagaggggaagcucgaaagacuuucguagaauuaaugcggaggggagaucuucccguauggcugucauauaagguagccagugaagguuuccaauacuccgauaggcguugguguuucgacggagaaagaaauaaucaaguucuggaagaaaauauggacgucgagauuuggacgaaagaaggagaacgaaagaaauuacgaccucgaugguuggacgcaagaacauauucggacccacuagcgcuaagagaguuuaaagaauuugcugcgggcagaagaucaguaucuggcgaucuaauucuugaaauaggaaaacuaccacaacauuugacucaaagagcgcaaaaugccuuagauaauuuggucaugcuucauaacagcgaacagggagggagagcauacagacacgcaauggaggaauugccagauacgauugaaacccuaaugcuauuagcccugauagcuguauuaacaggagggguaacauuguucuuuuuaaguggaagaggcuuggggaagacauccauaggcuuauuauguguuauggccaguucaguucuacuguggauggcgagcguagaaccacacuggauagccgccuccaucaucuuagaguucuuuuuaaugguccuccuaauuccagaaccugaucgacagagaacaccacaagacaaccaacuggcuuauguuguaauuggacuucuuuucaugauauuaacaguagcugcaaaugaaaugggucucuuagaaacaaccaagaaagauuuagguauagggcacguugcaguagagaaccaucaucaugcagccaugcuagauguggauuuacauccugcaagugcauggacgcuauacgccguagccacaacgauuauaacacccaugaugagacauacaauugagaauacaacagcaaacauaucuuuaacagccauugcaaaucaggcagccauauugaugggacuugauaaagguuggccuauuuccaaaauggacauugguguaccucuacuugcucuagggugcuacucccaaguaaauccacuuacucuaacagccgcaguucuuauguugguagcacauuaugcuauuauagguccagggcuacaggcaaaagcaacacgagaagcccagaaaaggacagcugcuggaauaaugaagaacccuaccguagaugggauagucgccauugaccucgaccccgugguauacgaugccaaauuugaaaaacagcugggacaaauuauguuauuaauauuauguacuucucagauauuauuaaugcgcacgacaugggcucuaugcgaaucaauuacacuagcuacugguccuuuaacuacacuuugggaagguucuccaggaaaauuuuggaauacaacaauugcuguaaguauggcaaauauauuucgaggcaguuaucuugcaggggcaggguuggcauucucuuugaugaaaucauuaggugguggaagaagaggaacaggugcucaaggagaaacucugggcgagaaguggaagagacaguuaaaccaauuaaguaaaagugaguuuaacacguauaagcguagugguauaauggaaguugauaggucugaggcaaaagaaggacuaaaaagaggcgaaacgacaaaacaugcagugagucgcgggacggccaaauuacgaugguuuguagaacgaaacuuggugaagccagaaggcaaaguuauagauuuaggcuguggcagaggcggaugguccuacuauugcgccggucuuaagaaaguaaccgaaguaaaaggcuacacaaaaggcgguccagggcacgaggaaccgauaccaauggccacuuaugguuggaacuuaguaaaauugcacucuggaaaggacgucuucuuuaucccuccagagaaaugugauacgcuuuugugugauauuggcgaguccucaccaaacccaacuauugaagaaggaaggacucuacgcguauuaaagaugguagaaccauggcuaagagguaaucaauuuuguauaaaaauacuaaauccauacaugccaucuguugucgagacucuagaacaaaugcaaagaaaacauggaggaaugcuagugaggaauccauugucacgcaauucaacccaugaaauguauuggguaagcugcgguacaggaaauaucgugucggcggugaacaugacaaguagaaugcuacuuaauagguuuaccauggcccaccguaaaccaacauaugaaagagacgucgauuuaggagcuggcacccgacauguggcuguagagccagaaguggcgaaccucgacauaauaggccagagaaucgaaaacauaaaacaugaacacaaaaguacguggcacuacgacgaggauaacccuuacaaaaccugggccuaucacggaaguuacgagguaaaaccaucgggguccgcaucaagcaugguuaacggugucguaaagcuacuaacaaaacccugggacguaauuccuauggucacgcagauagcaaugacugauacaacaccauuuggacaacagagagucuucaaagaaaaaguggacacuagaacuccgaaggcaaaaagaggcacagcacaaauuauggaaguaacugcgaaaugguuaugggguuucuugagucgaaacaagaaacccaggaucuguacacgagaagaauuuacaaggaaggugagaaguaaugcagcaaucggugcuguuuuuguagaugagaaucaguggaacucugcaaaggaagcgguugaggaugaaagauuuugggaucucguccacagagaacgugaacugcacaaacaagguaaaugcgcgacuugcguguauaacaugaugggcaagagggagaagaaacuuggagaguuuggaaaagcaaagggaagucgagcaauuugguacaugugguuaggggcaagguuuuuggaguucgaggcucucgguuucaugaacgaagaucacugguucagcagggaaaauucacuuucugggguagaaggcgaaggacuacauaaauuagguuauauucuccgggauauuucaaaaauacccggaggcaauauguaugcagaugauacagcuggaugggauacucgcauaaccgaggaugauuuacaaaaugaggcuaagauaacagacaucauggaaccugaacaugcgcuuuuagcgaagucuauauucaaacuuaccuaucagaauaaggucguacgagugcaacgaccagcuaaaaaugguaccguaauggaugucaucuccagaagggaccagagagguaguggacaagugggaacuuauggcuuaaauacauuuacgaauauggaggcacaacuaauacgccaaauggaaucagagggaauauuuaguccuucugagcucgaaacaccaaauuuagcgggucguguucucgauugguuagagaaacacggaguggaaagacuaaagagaauggcuauaucuggagaugauugcguaguuaaaccaauagacgaccgcuuugcgacagcgcugacugcauuaaaugacaugggaaagguacgaaaagauauaccucaaugggagccuagcaagggguggaacgacuggcagcaagugccuuucuguucacaucacuuucaucaguugauaaugaaagauggccgagaaauugucguuccuugccguaaucaagacgaauuaguugggagagcgagaguaucacaaggagcagguuggucccuaagggagacagcgugucuggggaaaucuuacgcacaaauguggcaguuaauguauuuucacagacgagaucuuagauuagcagcaaaugcaauaugcagcgcuguaccuguggauuggguuccuacaagucgaacuaccuggucgauacacgcacaucaucaauggaugacuacagaggacauguugucggucuggaaucgcguguggauagaggaaaauccauggauggaagauaagacacauauaaguuccuggggugacgugcccuaucuagguaaaagagaagaucaauggugcggaagucuaaucgggcuaacugcccgggcuacaugggcuacaaauauacagguggcaaucaaucaagugagaagacucuuggggaacgaaaauuacuuagacuauaugacuagcaugaagagauucaaaaaugaaagcgaucccgaaggcgcccuuugguga

SEQ ID NO: 21690 - RNA, 9879 nt, Artificial Sequence
  derived and/or modified CDS sequence (opt6) from DENV-1__FJ882549__SS-prME
aguguaacaaugcuuuuaaugcuuaugccgacggcuuuagcauuucaccuaacaacacguggaggugaaccacacaugauaguuucgaaacaagaaagaggcaaaucuuuacuauuuaaaacaucagcaggcguuaauaugugcacauuaaucgcuauggauuugggcgaacuuugugaagacacaaugacauauaaaugcccaagaaucacagaaguagaaccagaugacgucgauuguuggugcaacacaacggauacauggguuacuuacggaacauguucacaaacaggggaacacagaagggauaaaagauccgucgccuuagcuccgcauguaggauuaggacuugaaacacgggcugaaacuuggaugaguagcgaaggagcguggaaacaaauccaaaaaguugaaacgugggcacuaagacauccaggauucacuguaauagcucuuuuucuugcucacgcuauuggaacuucuauaacgcaaaaagggauaauuuucauacuguuaaugcuaguaacuccaucgauggccaugcguugugucgggaucggaucaagggauuucguggaaggacuuucaggcgcaacguggguagacguaguuuuagaacauggcucauguguaacgacuauggcaaaagauaaacccacacuagacauagaauuauugaaaacagaaguaacaaaucccgccguacuccguaaacuguguauagaagcaaaaauuaguaauacaacgacagauucaagauguccaacgcaaggcgaagcaacucuuguagaagaacaagaugccaauuuuguauguagaagaaccuucguugauagaggaugggggaauggaugcggcuuguuuggaaaaggaucacuaauaacuugcgcaaaguucaaaugcguuacaaaacuggaaggcaaaauaguacaauaugaaaaucuaaaauauucagucauagugacuguacacacaggugaucaacaccaaguggggaacgaaucuaccgaacaugguacaaccgcuacgauuacaccucaagcaccgacgucagaaauacaacuaaccgauuauggugcacuaacccuagacuguucaccuagaacaggccuagauuucaaugaaaugguucugcuuacaaugaaagaaaaaucuuggcuaguucacaagcaaugguuuuuagauuuaccacuaccauggaccuccggagccagcaccucacaagaaaccuggaauaggcaagaccugcucguaacauuuaagaccgcacaugccaagaaacaagaaguugucgugcuugguucucaagaaggugccaugcauacagcgcugacuggagcaacugaaauacaaacaucagguacaacuacuauauuugcugggcauuuaaagugcaggcuuaagauggauaaauugacccuuaagggcaugucauacguuauguguacaggaucuuuuaaauuagagaaagaaguagcugagacacaacaugggacaguauuagugcaaauaaaauacgaaggcacggacgcaccauguaaaauacccuuuuccacccaggacgaaaaaggaguaacacaaaacggaagguuaauaacagcuaauccuauaguuaccgauaaagaaaaaccuguuaacauagaagcugaaccgccguuuggugaaagcuacauugucauaggagcgggcgaaaaagcacuuaaacucucaugguuuaaaaagggaucgucaauugguaagauguucgaagcgacugcgcggggugcucgaagaauggccauucuuggugacacagcaugggauuuuggaucaauuggugguguuuuuacgucggugggaaaacuuguacaccaaauuuucggaacugcauaugguguucuguucagcggcgugagcuggaccaugaaaaucggaauuggcguucuacuuacaugguuaggauuaaacagcagaagcacaucguuauccaugacaugcauugcuguuggauuaguaacacucuacuuaggugucauggugcaagcugacuccgguuguguuauuaacuggaaagggagggaacuaaaaugugggucaggaauauuugugacuaaugagguacauacauggacugaacaauacaaauuucaagcagacucgccaaaaagauuaucagcugcaauugguaaagccugggaagagggaguaugcggaauccguagugcaacccgccuagaaaacauuauguggcgucaaauaaguaacgaguuaaaccauauucucuuagagaacgacaugaaauucacagugguuguuggggauguaguaggaauauuagcucaagggaagaaaaugauaagaccccagccgauggaacacaaauacagcuggaaaucauggggaaaagcuaagauaauaggagccgacguccaaaauacuacauucauaauugacggaccuaauacaccugaguguccugacgaucagcgcgcuuggaauaucugggaaguggaagauuacgguuucggaauauuuacuacaaauauaugguuaaagcuacgugacaguuacacacaagugugugaucaccgcuugaugucggcggccauaaaagacucaaaagcuguacacgccgauauggguuauuggaucgaaagugaaaagaacgaaacauggaaacuagcuagagcuagcuucauugaaguaaaaacuugcauauggccaaaaucacauacacuauggucaaacgggguuuuggaaucagagaugaucauuccaaaaaucuacgguggucccauaucacagcauaacuaucgacccgguuacuucacccaaacggcuggacccuggcaccuagggaaacuagaauuagacuuugaccuuugcgaagggacaacaguuguaguagaugaacauugugggaacaggggaccuucauuaaggacuacuacaguaacuggaaaaauaauacacgaaugguguugccgaucgugcacccuuccgccccuacgcuuuaaaggggaagauggauguugguacggaauggaaauuagaccagucaaagaaaaagaggaaaaucucguaaaaucaauggugucugcaggaaguggagaaguugacucuuuuaguuuggguuugcuguguaucagcaucaugauagaggaaguaaugcgaucgcguuggucucgaaaaaugcucaugacggguaccuuggcaguauuuuuccuauuaauaauggggcaacuuacauggaacgaucucauucguaguugcauuaugguuggagcaaaugcaucagaccgcauggggaugggcacaacuuauuuagcacuaauggccaccuucaaaaugaggccaauguucgcgguaggauugcuguuuaggcgauuaacuucccgagaaguauuacuauugacaaucggucucagucucguagcuagcguagaacuaccuaacaguuuagaagaauuaggcgauggucuggccauggguauaaugauuuuaaagcuccuuacugauuuucaaucauaucaauuaugggccacgcuauuaucccuaacguucauaaaaacaacguuuucacuucauuaugcuuggaaaacgauggcuaugguucuauccauugucucccuucuaccccugugucuaagcacaacuucucaaaagacuacuuggcucccgguacuacuaggcucacuagguuguaagcccuuaacuauguuucuuauugcagaaaauaaaauaugggguagaaaaaguuggccauugaaugaagggauaauggcuguggguauagugucaauucuauuaucaagccugcucaaaaaugauguaccacuagcaggaccauuaauugcaggcggcaugcuuauugcgugcuauguuauuuccggaucaagugcagaucuaagccuugaaaaggccgcggaaguaaguugggaagaggaagccgagcauagcggagcaucucauaauauauuaguagaaguucaagacgaugguaccaugaaaauaaaagaugaagaaagggaugacacguuaaccauauugcucaaagcgacauuauuagcuguuuccgguguauacccguuaaguauccccgcaacacuuuucgugugguauuuuuggcagaaaaagaaacaaagaucuggugucuugugggauacuccaucaccuccugaaguagagagagcaguacuagacgauggaauauauagaauaaugcaaagaggacugcuagguagaucacaaguaggugucggcguuuuccaggagaauguuuuucauacaauguggcacgugacacguggugcagugcuuauguaccaaggcaaacgccuagaaccuucuugggcgucagucaagaaagauuugaucucauauggaggagguuggaggcuacaagggaguuggaauacgggagaggaaguucagguaauagccgucgagccagguaaaaauccuaaaaauguucaaacugcccccgguacguuuaaaacuccugaaggcgaaguuggggcgauugcuuuagauuuuaagccgggaacaucgggcagcccaauaguaaaccgggagggcaaaauugucggcuuauauggaaaugggguuguaacaacaucaggcaccuacguuucagcgaucgcgcaagccaaagcaucucaagaaggaccguugccagaaaucgaagacgaaguauucaggaaaagaaaucuuaccauaauggacuuacauccagguagugguaaaacuaggcgauauuugccagcaauaguacgcgaggcaaucaagagaaaacuccggacacuuauauuggcuccuacgagagugguugccucggaaauggcagaagcccuuaaaggcaugcccauuagauaucaaaccacugcaguaaaaagcgagcauacaggacgugaaauaguagaucuuaugugucacgcaacguuuacaaugcggcuuuuaaguccuguucgagucccaaacuacaauaugauaauaauggacgaagcacauuuuacagauccuagcucuauagcugccaggggcuauauuaguacgagaguaggaaugggugaagcagcagcaauuuucaugacagcuacaccaccugguucgguagaagcguuuccccaaaguaaugcgguuauucaagaugaggaaagagauauuccggaacgaaguuggaauaguggauaugaauggauaaccgauuucccugguaaaaccguaugguucgugccuucgauuaagaguggcaaugacauugcaaauuguuuaaggaaaaauggaaaacguguaauccaacuaagcaggaaaacauuugacacugaauaucagaaaacaaagaauaaugacugggauuacgugguaacaacggauauuucagagaugggugcgaauuuuagagcagaucgcgucauugauccucgaaggugcuuaaagccaguuauacuuaaagauggaccggagcgagugauuuuagcaggaccaaugccgguaaccguagcuucagccgcacaacgaagagggagaauugguagaaaucacaacaaggagggcgaucaauauauuuacaugggucaaccacuuaauaaugacgaggaucaugcgcauuggacagaagcaaaaauguuacuugauaauauaaauaccccugagggaauaaucccagcacuguucgaaccugaacgagaaaagucggccgcgauugauggugaauaucgucuacgaggcgaagcuagaaaaacauuuguagagcucaugcgaaggggcgauuugccaguauggcuaagcuauaaaguugcaucugaaggauuccaauacagugauagacgauggugcuucgacggggaaaggaauaaccaagugcucgaagaaaauauggauguagagauauggacgaaggaaggagagagaaagaaacuacguccgcgauggcuagacgcaagaacauacucugauccccuagcacuccgagaauuuaaggaauuugcugcugggcgucguucgguuucaggugaucuaauccuagaaauuggcaagcuaccucaacaccucacgcagagagcccaaaaugccuuggauaaucuagucaugcuucauaauucagaacaaggagguagagcauauaggcaugcaauggaagaacuaccagauacgauugagacacuaaugcuccucgcucuaauagccguucuuacaggugggguaaccuuauucuuccugaguggaaaaggguuaggaaagacaagcauuggguuacuaugugugauggcaucauccgcacugcucuggauggccucuguggaaccgcacuggauagcggcgucaaucauauuagaguucuuccuaaugguacuucuaaucccagaacccgaccgacaaagaaccccgcaagauaaucaacuagccuacguuguaaucggauugcuuuucaugauccuuacgguagccgcaaaugagauggguuuacuggaaacaaccaagaaagacuugggaauaggucauguggcaguagaaaaucaucaucacgcaacaaugcuugacguugaccugcacccagccucagcuuggacgcuuuaugcuguagcgacuacaauuaucaccccuaugaugcgccacacgauugaaaauaccacagcuaauauaaguuuaacagcaauagccaaccaagcagccauacucaugggacuugauaaaggauggccgauuuccaagauggauauaggagugccccuguuagcccuuggauguuacucucaaguaaacccacuaacauuaacagcugcaguacuaauguugguggcucacuaugcgauaauaggccccggucuacaagcaaaagcaacuagagaggcacagaaaagaacugcugccgguauaaugaaaaauccaaccguugauggaauaguugccauugaucuugauccuguuguuuaugaugcuaaguuugaaaaacaacuagggcaaauaaugcucuuaauccuuugcacgucucaaauucuuuuaaugagaacgacgugggcuuuaugugagucaauaacguuagcgaccgguccacuaacaacuuugugggaaggaucaccuggaaaauucuggaacacuaccauugcaguaagcauggcaaauauuuuuagagggucguauuuagcaggcgcggguuuagccuuuucucuuaugaagucauugggaggaggacguagaggaacaggcgcgcaaggugaaacacuuggagagaaauggaaaagacaguuaaaccaacucagcaagucagaauuuaacacauauaaaagaagcggcauaauggaaguagaucguagugaagcgaaagaagggcuucgucgcggcgaaacaaccaaacaugcggucucuaggggaacagcuaaguuacgaugguucguagagaggaauuuaguaaaaccugagggcaaaguaauagacuuaggaugcggaagaggcggauggaguuacuacugcgcaggacuaaagaaaguuacagaagugaaagguuacacuaaaggcggcccugggcaugaagaaccaauaccaauggccacauacggcuggaaccuaguaaaauuacauagcggcaaagacgucuuuuucauaccacccgaaaaaugugacacauuacucugugauauuggagaauccucgccaaauccaacaauugaagaagggcgaacuuuacguguacugaaaaugguagaacccuggcuaagaggaaaucaauucugcauuaaaauccuuaacccguauaugccgucuguaguugaaacauuggaacaaaugcaacggaaacacggugggaugcucguuagaaauccccugaguagaaauagcacgcaugaaauguauugggugaguuguggaacagggaacaucguaagugcuguuaacaugacuagcaggaugcuucucaacagauuuacaauggcacauaggaaaccgacguacgaacgcgacguugaucuuggugcuggcacacgacacguugcggucgagcccgaaguggcuaaucuagacauuauaggacaaagaauagaaaauauaaaacacgaacauaaaucgacauggcauuacgaugaagacaacccuuauaaaacaugggcauaccauggcucauacgagguaaaaccuucuggaagcgccucuagcauggucaacggaguggugaaauuacuaacuaagccgugggaugugauaccuaugguuacucagauagccaugacugacacuacucccuucggacaacaacguguucuaaaagaaaaagucgauacgagaacuccaaaggcaaaacgagguaccgcacaaauuauggagguaacugcuaaauggcucugggguuucuuaaguagaaacaagaaaccuagaauauguacccgugaagaguucaccaggaagguccgaaguaaugccgcaauaggcgcaguuuuuguugaugaaaaccaauggaacagcgcaaaggaagcagucgaagaugaaagguuuugggacuugguucacagagagagagaacuacauaaacaaggaaaaugugcgacguguguguauaauaugaugggaaaacgcgaaaagaaacuuggagaguucggcaaagcuaaggguucacgagcaauaugguauauguggcuuggagcuagauucuuggaauuugaagcccuaggguucaugaacgaagaucauugguucucaagagaaaacucuuuaagugguguagaaggcgaaggucuucauaaauugggguacauucuucgcgacauaagcaaaauaccgggaggcaacauguacgcugaugauacugcaggaugggauacucgaauaaccgaagacgaucuucagaacgaggcgaaaauuacagacauuauggaaccugaacaugcacuucuugcaaccucgauauucaaauuaacauaccaaaacaaaguugugcgaguacagagaccggcgagaaauggaacgguaauggauguaauaucucgcagagaccaaagggguaguggucaagugggcaccuauggucuuaacacauuuaccaacauggaagcgcaauuaauaagacaaauggagagcgaagggauauucucaccguccgaacuagaaacgcccaauuuagcagagcgugucuuagacuggcuugaaaagcaugguguugaaagacugaagagaauggcgauuucuggugaugauuguguagucaaaccgaucgaugaccguuucgcgacggccuugagcgcuuuaaaugacaugggaaaaguucgaaaagauauuccucaaugggagcccaguaagggauggaaugauuggcaacagguaccauuuugcucacaccauuuucaucaauugauaaugaaagacggucgggaaaucguagucccuuguaggaaccaagaugaacuuguagggcgugcacgaguuagccaaggugcaggauggagccucagagaaacagccugcuuggggaaaucguacgcacaaauguggcaacuaauguacuuucaccgaagagaccuuagacuagcggcaaaugcaauuugcucggcaguaccaguagauuggguaccuacuucgcgaacuacuugguccauacaugcacaucaccaauggaugacaacugaagauaugcucuccguuuggaauagaguguggauagaagaaaaccccuggauggaagauaaaacgcauauuaguagcuggggagacguaccauaccucggcaaacgggaggaucaauggugcggaucguuaaucggcuugacggcaagagcaaccugggcuacuaauauacaaguugcaauaaaccaaguccgaagacuuaucgggaacgaaaauuauuuggacuacaugacgucaaugaaacgcuuuaagaaugaaagugaccccgagggcgcuuugugguaa

SEQ ID NO: 21691 - RNA, 9879 nt, Artificial Sequence
  derived and/or modified CDS sequence (opt6) from DENV-1__GQ199814__SS-prME
ucugucacuaugcuauuaaugcuaaugccgacugcacuagcauuucaucuuacgacucggggaggugaaccacacaugauaguuucaaaacaagagcgagggaaaucucugcuauucaaaacaagugcggggguaaacauguguacguugaucgcaauggaccuaggagaauuuugcgaagauacaaugacauauaaaugcccgagaauuacagaggcugaaccagaugauguugacuguugguguaacgcaacagauacaugggugacauauggaaccugcucgcaaacaggagaacauagacgagacaaacgcagcguagcccuugccccgcaugugggacuaggucuugaaacgagaacggagacauggaugaguagugaaggcgcguggaaacaaauccaaagaguugaaacgugggcgcuuaggcacccaggguuuaccguaauugcucuauuucuagcacacgcuauuggaacuucaauaacacagaaaggaaucauuuucauauuacucaugcuugucacuccaucaauggcuaugcguuguguaggcauagggucgcgagacuuuguagaaggucuaagcggagcuacguggguagauguaguacuggaacauggaagcugcguaaccacaauggcuaaagacaaaccaacacuugacauagaauuacuaaaaacagagguaacuaauccggcgguccuccggaaauuaugcauugaagcaaaaauuucuaauacaacuacagacucuagauguccaacacaaggagaagcaacccugguugaagaacaagacgcaaacuucgugugcaggagaacauucguugaucgcgguuggggaaaugguugcgggcuguuugggaaaggaucucuuauuaccugugcuaaauuuaaauguguuacaaaacuggaaggaaaaauaguacaauaugaaaacuuaaaguauagcguuauagugacaguucauacaggcgaccaacaucaagucgguaacgaaucaaccgaacacgguaccacugcuaccauuacgccacaagcaccuucaacagaaauacaacucacugauuauggugcgcuuacccuggacuguaguccccggacaggccucgauuuuaacgaaaugguccugcuaacaaugaaagaaaagagcuggcuuguccauaagcaaugguuucuugauuugccucuaccauggaccucuggagcuucaaccucccaagaaacuuggaauaggcaagaucuccugguuacguucaagacugcgcacgcaaagaaacaagaaguaguaguauuagguucacaagagggagcuaugcacacagcuuuaacuggagcaacugaaauucagaccagugguacgacuacaauauucgcaggccauuugaaauguagguugaaaauggacaaauuaaccuuaaagggaaugucguacguaauguguacaggaaguuuuaaacuagaaaaagaggucgcggaaacacaacacggaacgguccuggugcaaauaaaauacgaaggcacugacgcuccguguaaaauaccauucucgacgcaagaugaaaagggugucacacagaacggacgguuaaucacggcuaacccaauagugacugacaaagauaaaccaguuaauauugaagcugaaccuccauuuggcgaaucauacauaguaauaggcgcaggagaaaaggcccuaaaacugucuugguuuaagaaagguucguccauaggaaagauguuugaggccacugcccgaggugcucgucgaauggcuauccuaggagacacagcaugggauuucgguuccauaggagggguauuuacaucuguuggaaaauuggugcaucaaauauuuggcacggcuuauggcguauuauucagcgguguaucauggacgaugaagauugggauuggggucuugcucacguggcuggggcuaaauagucguaguacgucauugaguaugaccuguauagcagugggccugguaacccuuuacuugggggucaugguacaagcugacuccgguuguguuauuaauuggaaagguagagaacuaaaauguggaucaggaauuuuugugacuaaugaaguucacacauggacagaacaauauaaauuucaagcugauaguccuaaacgacugucagcagcaauagggaaggcaugggaagaaggaguaugugggaucagaagugcuacucgucuagaaaacaucauguggaagcaaaucucaaaugaauuaaaucauauauuacuggaaaaugacaugaaguucacaguagugguaggugauguugcagggauacucgcccagggcaagaaaaugauuagaccacaaccuauggaauacaaguauaguuggaaaucguggggaaaggcuaaaaucauuggagcagauguucagaauacaacauuuauaauagaugggccuaacacaccagaauguccagacgaucaacgagcguggaauauaugggaggucgaagauuauggcuuugguauauuuacaaccaacauuuggcucaaauuaagagauucuuacacacagguaugcgaccaccgacuuaugucugcggcaauuaaagacaguaaagccguccaugcugauaugggauacuggauagaaagcgaaaagaacgaaacauggaaauuagcaagagccagcuucauagaaguaaagacaugcauauggccaaaaagccacacauuguggucaaauggaguacucgagucugaaaugaucauucccaagauauauggaggacccauuucucaacacaacuauagaccuggcuauuuuacacaaacagcaggacccuggcacuuagggaaacuugagcuugauuuugaccugugugaaggaacgacaguugugguugaugagcacuguggaaaccgaggacccucuuuacgaacaacaacagucacggguaagaucauacaugagugguguugucguucauguacccugccuccacuuagauucaagggcgaagaugguuguugguacggaauggaaauuagaccaguuaaagaaaaagaagaaaaccuuguaaaguccaugguaucagcagggucaggugagguagauucauucucgcuagguuuacuauguauuucaauuaugacugaggagguaaugcgaucgcgcuggucuagaaaaauguuaaugacuggcacccuugcaguauucuuuuuacucauuauggggcaauugaccuggaaugauuuaauuagauuaugcauaaugguaggugcaaaugcaagugauagaaugggcauggggacaacauaucuggcucuuauggcuacauuuaagaugcgaccuauguucgcaguagguuuauuauuuagaagauuaaccucccgagaaguuuuauuauuaacgauugguuuaucucuaguugcgucuguggaacuucccaauucauuagaagaacucggcgacggcuuggcuaugggaauaaugauccucaaacuguugacagauuuucagucccaucaauuaugggcuacccuacuuagccuuacguuuauuaaaacaaccuuuucucuacauuaugccuggaagacaauggcaauggugcuauccauaguuucgcuguuuccccuaugcuugagcaccacuucgcagaagacaacaugguuaccuguacuacuggggucacuaggcuguaaaccuuuaacaauguucuuaauagcagaaaauaaaaucugggguagaaagagcuggccauuaaacgaaggaaucauggcaguggguauagucaguauauuacuaucaucucuccuaaagaaugaugucccauuagcaggcccccucauugcaggaggcaugcuuauagcuuguuauguuaucagcgguaguucagcugacuuaagccuugagaaggcagcggaaguaaguugggaggaagaagcagaacauagcggagcuucacacaauauucuaguugagguacaagaugaugggacuaugaaaaucaaagacgaagaaagagacgacacucuaacaauacugcuuaaagcgacacuccuagcugucucagguguauauccccuaucaaucccagcgacccuauuuguaugguauuuuuggcagaagaagaaacaaagaucaggaguuuuaugggacacaccaucgccaccagaaguagaaagagcaguauuagaugauggaauuuauagaauuaugcagaggggucuauuaggaaggagucaaguugggguagggguauuucaagaaaaugucuuucauacaauguggcauguuaccagaggcgcuguauuaauguaucaaggaaaacgacuagagcccaguugggcuagcguuaagaaagacuugauaucuuauggaggagguuggcgacuacagggaucguggaacaccggagaagagguacaagugauagcugucgaaccggggaaaaauccaaagaacguccagacagcaccagguaccuucaaaaccucugaaggggaaguaggagcaauagcucuggauuucaaacccggaacgucaggaagcccaauuguaaauagggaaggaaaaauagucggacuuuacgguaacggaguuguaaccacuucggguaccuacgucucggcgaucgcacaggcaaaagcgagccaagaaggaccucuacccgaaauagaggaugaaguauucagaaaaaggaaccucacaaucauggaccuucauccgggaagugguaagacgagaagauaucuccccgcaauuguacgcgaagcuauuaaaagaaaauugcgaacguugauucucgcacccacaagagucguagcaucagaaauggcugaggcacuaaaagguaugccgauccgcuaccaaacaacggccguuaagagcgaacacacuggcaaagagaucguagaccucaugugccaugcuacuuucacaaugcgacuacuuucuccaguaagagucccuaauuauaacaugauuauuauggaugaagcacacuucaccgauccaaguucaauugcggcaagaggauacauuuccacaaggguugguaugggagaagcggcagcaauauucaugacagcaacaccucccgguuccgucgaagccuucccacagaguaacgcagugauucaagaugaagaaagagauauaccagaaaggucuuggaacucuggguacgaauggaucaccgauuuucccggcaaaacagugugguuuguuccuucgaucaagagcgguaaugauauagcaaauugcuuaagaaagaaugggaaaagagugauccaauuaucaagaaaaacguuugauacugaauaccagaaaacgaaaaacaaugauugggauuacguaguuaccacagauauaucagaaaugggagcaaauuuccgagcagaucgagucauagauccgcggagguguuuaaaacccguaauauuaaaagacgguccugaacgggugauauuagcagguccuaugccggugacuguagcuucggcagcgcaaagacgagggaggauaggucggaaucauaauaaggaaggagaccaauauguauacaugggccaaccuuuaaauaaugaugaagaucacgcgcauuggacagaagcuaaaauguuauuagacaacauuaacacaccagaaggcauuauaccagcauuauucgagccugagcgggagaaaagugcugcaaucgauggagaguacaggcugagaggagaagcgcgaaaaaccuucguagaacuuaugcgcagaggagaucuaccgguguggcuaagcuauaaaguggcgagcgaaggauuccaauauucugaucguagaugguguuucgauggagagaggaauaaccagguuuuagaagaaaauauggaugucgagauuuggacuaaggaaggagaaaggaagaaauugagaccucgauggcuagaugccagaacuuauucggauccccuagcacuucgagaauuuaaggaauuugccgcaggacgucgcuccgugagcggagauuugauauuagagaucggaaagcugccucagcauuuaacacaaagggcacaaaacgcucucgauaaccuagugaugcuucauaauucagaacaaggcgguagagcuuauaggcaugcaauggaagaauuaccagauacuauagagacucuuauguugcuagcauugauagcgguauugaccggaggcguaacgcuauucuuuuugucaggccguggauugggaaaaacuucaauuggacuauuguguguuauggcaucaagcgucuuauuauggauggcauccgucgaaccacauuggauagcugcuaguauuauacuugaguucuuuuugaugguuuuauuaauaccagaaccugaccgacaaagaacuccucaggauaaucaguuagcuuacgucgucaucggacuuuuauuuaugauacuaacaguugccgcgaacgaaaugggucuacuagaaacaacaaagaaagauuuaggaaucggucauguugcaguagagaaccaucaccaugcugcaaugcuagauguggaccuacauccggcuagugcauggacucuuuaugcuguagcaacuacaauaauaacaccaaugaugcgacacacaauagaaaauacaacagccaauauuucauugaccgcaauugcaaaucaggcugcuauucucaugggauuggauaaaggauggccuaucagcaagauggauaucggagugccacuacuugcgcuagguuguuacagucaaguaaauccgcuaacuuuaacagcugccguccuaaugcuaguugcucauuacgccauuaucgggccagggcugcaagcuaaagcuacuagagaggcucaaaagagaacagcugccggaauuaugaagaacccaacaguagaugggauaguugcaauagacuuagaucccguuguauacgacgcaaaauuugaaaagcaauugggccaaauaaugcuauuaauauuauguaccucgcaaauccuguugaugagaacaacuugggcgcuaugcgagagcauaacacuugccaccggcccgcuuacaacgcuaugggaagguucaccagguaaauuuuggaauacaacuauugcaguaucaauggcgaacauuuucagagggaguuauuuagcuggugcaggucuggccuuuagccugaugaaaucucuggguggagguagaagagggacgggagcacaaggugagacuuuaggugaaaaauggaaacgucaguuaaaccaauuaaguaaaucagaauuuaacacauacaaaagaucaggaauuauggaggucgacagaagcgaagcuaaagagggauugaaaagaggugaaacaacaaaacaugcaguaagucguggcacagccaagcuaaggugguuugucgaaagaaaucuugugaaaccggaggguaaaguaauagaucuaggcugcggacgaggcggauggucuuauuauugugcuggccucaagaaaguuacagaaguaaaagguuauacaaagggugguccaggacacgaagaaccaauuccgauggcgacauacgguuggaaccuagucaaauuacauagcggaaaagaugucuucuuuauaccaccagaaaagugcgauacucuacuaugcgacauaggcgagucuucaccaaaucccacaauugaagaagguagaaccuuaaggguacuaaaaaugguagagcccuggcuacggggaaaucaauuuuguauuaaaauauuaaacccuuauaugccuucggugguagaaacccuggaacaaaugcaaagaaagcauggagguauguugguaagaaauccacuuucuagaaacaguacacaugagauguacugggucagcugugggacagguaacaucgugucagcagucaauaugacuucucguaugcuucuuaaucgauuuaccauggcgcaccgcaaaccaacauacgaacgagacgucgaucucggugcagguacgagacacgucgcgguugagccugaaguagcgaacuuggauauuauaggacagagaaucgaaaauaucaaacaugagcacaaaagcacuuggcauuacgaugaggauaaccccuauaaaacuugggcauaccacggaagcuaugaaguaaaaccguccgguucugcaucuaguauggucaauggugugguaaaauuguuaaccaaaccaugggauguuauaccgaugguuacacaaauagcuaugacagauacgacuccuuuuggacaacaaagagucuucaaggagaaagucgacacucggacacccaaagcaaaacgugggacagcacaaauuauggaaguaacggcaaaauggcuguggggcuucuuaucacgaaacaagaaaccucgaauaugcaccagagaggaauuuacaagaaaaguaagaagcaacgcugcgauaggggcaguuuuuguagacgaaaaucaauggaacuccgcuaaagaagcuguggaggaugagcgauuuugggaucuaguacaccgagaacgugaacuacauaagcaggggaaaugugcuacauguguguauaauaugauggguaaaagagagaagaaacuaggagaauuuggcaaagccaagggcagcagagccauuugguauauguggcucggcgcuagauuucuagaauuugaagcguuaggauuuaugaaugaagaucauugguuuagucgagaaaacucucucucuggggucgaaggagaaggcuuacacaaauugggcuauauauuacgagauauuucaaaaaucccgggcggcaauauguaugcugaugacaccgccgguugggauacaaggauuacugaagaugacuuacaaaacgaagcaaaaauaacugauauuauggagcccgaacacgcccuguuagcaaagagcaucuuuaaauuaacguaccaaaauaaagucguaagaguacagagaccggcgaaaaauggaacggucauggauguaaucucaagaagagaucaaagaggcagcggacaaguuggcacguauggauuaaauacauuuacaaacauggaagcucaacugauacggcaaauggaauccgaagggauauuuagucccucugaauuagaaacaccaaaccuagcaggucgcguguuagauuggcuagaaaaacauggcguggaacgucuaaaacgaauggccauaaguggagacgauuguguugugaagccaauugacgauagguuugcaacugcacuaacagcccuaaacgacaugggcaagguacgaaaagauauuccacagugggagccaaguaagggcuggaaugauuggcaacagguuccauuuugcucacaccacuuccaccaauuaaucaugaaggauggaagagaaauugucguaccauguagaaaccaagacgaguuaguagggagagcuagagugucacaaggggcaggauggaguuuacgagagacagcgugcuugggcaaaaguuacgcgcaaauguggcaguuaauguauuuccaccgcagggaucugcgucuagcagcuaaugcaauaugcucagcuguaccaguagauuggguuccuacgaguagaacuacuugguccauacacgcccaucaucaauggaugacgaccgaagauauguuaucagucuggaacagaguauggaucgaagaaaauccauggauggaagauaaaacacauauuucuucuuggggagauguuccguacuuagggaagagagaagaucaguggugugguagucugauugguuuaacagccagggcaacaugggcaacaaauauucagguagcgaucaaucaaguccgaaggcucauuggaaacgaaaauuaccuagacuauaugacuucuaugaagagauuuaagaacgaaagugauccugaaggagcauuaugguaa

SEQ ID NO: 21692 - RNA, 9879 nt, Artificial Sequence
  derived and/or modified CDS sequence (opt6) from DENV-1__GQ199816__SS-prME
ucaguaacuauguuauuaauguuaaugcccacagcgcuggcauuccauuuaacaacuagaggcggugaaccacauaugauaguuaguaaacaagaaaggggaaaaagucugcuuuuuaaaacaagugcaggggugaacauguguacuuuaauagcaauggauuuaggugaauuuugugaagacacgaugaccuauaaaugcccccgaauaacggaagcagaaccagaugauguugauuguuggugcaaugcaacagauacuuggguaacuuaugguaccuguucucagacuggagaacacagaagggacaaacguaguguagcacuggcaccccaugugggccuugggcuugaaacgagaaccgaaaccuggaugucaagugaaggggcuuggaaacaaauacaaaaaguagaaacgugggcacuacgccauccuggguuuacaguaaucgcauuauuccuagcccaugcgaucggaacgucaaucacucaaaaaggaauaauauuuauucugcugaugcuaguaacuccaucgauggcgaugaggugcguaggaaucggaaguagagauuuuguugaaggucuaagcggugcuacuuggguggauguugucuuagaacaugguucgugcguuacuacgauggcuaaagauaaaccuacauuggacauagaauuacuuaaaaccgaggugacaaacccugcuguacugcggaaacuaugcauagaagcaaaaauaaguaacaccacaacagauagcagauguccgacacagggagaggcgacucuaguagaagaacaggacgcgaauuuuguaugccggagaacauucguugauagaggcuggggaaacggguguggauuauuuggaaaaggaagccuaauaacaugugcaaaauucaaaugcguuacaaaacuggaaggaaaaaccguacaauaugaaaaucuaaaauacagcguuauagugacaguucacacaggugaucaacaucaagugggaaaugagucuacagaacauggaacaaccgcuacuauaaccccucaagcacccucaacugaaauccaguuaaccgacuacggggcuuuaacacuggauugcucuccgagaaccggacuagauuucaacgaaaugguauuguugacuaugaaagaaaaggcauggcucgugcauaaacaaugguuucuagaucuaccguuaccauggaccaguggugccucaacuagccaagaaacuuggaaccguaaagauuuauuaguaacauuuaagacagcccaugcgaagaaacaagaagucguaguucuagggucacaagagggugcuaugcacaccgcauuaacuggagcgacagaaauacaaacgucaggaacgacgacaauauuugcgggccaucuuaaaugucguuuaaagauggauaaacuaaccuugaaagguaugucauacguaaugugcacugggagcuuuaaacuugaaaaagaagucgcagaaacucaacauggcacgguacugguccaaauaaaauacgagggaacagaugcacccuguaaaauucccuucaguacccaagaugagaagggaguaacucaaaaugguagacucauuacagccaauccaauaguaacugauaaagaaaaaccuguuaauauugaagcugaaccuccuuuuggggagagcuauauuguuaucggggcgggugaaaaagcacugaaauuaaguugguuuaagaaagggucaucaauagggaaaauguuugaagccacggcaaggggagcgagaaggauggccauacuaggcgacacugccugggauuuuggaucuauuggagguguauucaccaguguuggaaaguuagugcaccaaauauuugguacugcuuauggcgucuuguucaguggaguaagcuggaccaugaagauaggcauugggguauuauuaacuuggcuaggauuaaacagcaggucaaccaguuuaucgaugacaugcauagcggugggucuaguaacauuauacuuaggagucaugguucaagcggauucagguuguguaaucaauuggaaaggaagagaauuaaaaugcgguagcgguauauuuguaaccaaugaaguacauacauggacagaacaauauaaguuccaggccgauucgccuaaacgcuugagugcggcaauaggaaaagcaugggaagaagguguuugcgggauucguucggcaacgcgucuugaaaacauaauguggaaacaaauuucgaaugaacuaaaccauauccuauuagaaaacgacaugaaauuuacugugguugugggagauguugcagguauucuggcccaaggcaagaaaaugauccgaccgcaaccuauggaauacaaguauucuuggaaaagcugggguaaggcgaagauaaucggcgccgacguacaaaacgcgaccuuuauaauugauggcccuaauacuccagaauguccagacgaucagagggccuggaauauaugggaaguagaagacuauggauucgggauuuucacuacgaauauauggcuuaaauuaagagacucuuacacacaaguuugcgaucauaggcuaauguccgcagcaaucaaagauuccaaagcaguacaugccgacaugggcuauuggauagaaagcgagaaaaaugaaacuuggaaguuggcgagagcuucuuuuaucgagguaaaaacaugcauauggccuaaaagccacacauuauggagcaaugguguucuagaaagugagaugaucaucccuaaaauauaugguggaccaauaucucaacauaacuaccguccgggauauuuuacacaaacggcgggaccguggcaucuaggaaaacuagaacuggauuuugaucuaugcgaagguacaacaguugucguugaugagcacugugggaaccgaggcccuucauugagaacuacuacagucacaggaaagauaauccacgaaugguguuguagauccuguacucuacccccacuacgcuucaagggugaagauggauguugguaugguauggaaauaaggccggugaaagagaaagaagaaaauuuagucaaaaguauggucucagcugggaguggagagguagauucauucuccuuggguuugcuguguauuucgauaaugauagaggaaguaaugagaucaagguggagucgaaagaugcuuaugacagguauucuugcgguauuuuucuuacucaucaugggacagcugacguggaaugaccuaauuaggcuaugcauuauggugggagcaaacgccagcgaccgcaugggaauggguacuacuuaucuggcacuuauggccacuuuuaagaugaggccaauguucgcgguuggucuucuguuucgcagauugacuucuagagaaguucuauuauugacuauaggacuuucccuaguagcuucaguggaauugccgaauaguuuagaagaacuaggcgauggacuagcuauggguauuaugauauuaaaguuacucaccgauuuucaaucccaccaacuaugggcaacauuauugagucuaacauucauaaaaacaacguuuucgcuacauuaugcauggaagacgauggcuaugguuuugucuaucguaucacuguucccucuauguuugucaaccacuagccaaaagacuacuugguugccugugcuuuuggguuccuugggcugcaaaccccuaaccauguucuuaauagcagaaaauaaaauaugggggcgaaaaucguggccucuaaaugaaggaauaauggccguugguaucgucucuauucuucuaagcagcuuacucaaaaacgacgucccauuagcggggccacuaauagccgguggaaugcuaauagccuguuauguuauaucgggauccucagcugacuuaucgcuagaaaaggccgccgaaguaucaugggaagaggaagcugagcauucgggggcuagucauaauaucuuaguggagguacaggacgauggaacgaugaaaaucaaggaugaagaacgggaugauacccuuacaauauuguuaaaggcuacccucuuggccguuucagguguuuacccguuguccauaccggcuacucuuuuuguuugguauuuuuggcaaaagaagaaacaacguagcgguguuuuaugggauacuccaucgccgcccgaaguagaacgcgcuguacucgacgacggaauauauaggaucaugcaacgaggacuuuuggggagaagucaaguuggaguaggaguuuuucaggagaacguauuucauaccauguggcacguaacuagaggcgcuguucuaauguaucaagguaaaagacuagaaccaucaugggcaucggucaagaaagaccucauuucauacgggggcggguggagacugcaagggucauggaauacuggugaagaaguacaagugauagcaguagaaccggggaaaaacccuaaaaauguacaaacugcaccuggaacauucaaaacgagcgaaggugaagugggagcaauugcacuugacuuuaagccgggcaccucaggaagcccuaucguaaauagagagggaaaaauaguaggguuguaugggaacgguguggugacgaccucuggaacauaugucucugcuauugcgcaggcuaaagccagccaggaaggcccacugccagagauagaagaugagguuuuucgaaaacgaaacuugacuauaauggaccuucacccuggcucugggaaaacucgccguuauuuaccugcgauuguacgagaagccauuaaaaggaaacuacggacucugauccuugccccaacuaggguaguagcgagcgagauggcugaagcccuaaaagggaugccgauaagauaucaaacaacagcugugaagagugaacacacuggaaaggaaaucgucgacuugaugugucaugcgacauuuaccaugcgccuauuaagucccgugagagucccaaauuacaacaugauuauuauggacgaggcacacuuuacagaccccucuaguauagcggcuagagguuauauaucaaccagaguuggcaugggagaagccgcagcaauauucaugacugcgacgccaccaggaaguguggaggcauuuccacagaguaaugcuguaauucaggaugaagagagagacaucccggaaaggucguggaacucaggguaugaauggaucacagauuucccagguaaaacuguuugguuuguaccgaguauuaaaagcgguaaugauauugcaaauuguuuacggaaaaauggaaagaggguaauacaauugucuaggaaaacguuugacacggaguaccagaagacuaaaaacaacgacugggauuauguaguuaccacagauauaagugaaaugggcgcgaacuuccgagccgauagaguaauagauccaaggaggugucugaaaccgguaauacucaaagauggcccggagagaguuauccuagccggaccaaugccaguaaccguagcgucagcagcacaacgccgaggacggauuggucgaaaccauaauaaagaaggagaucaauacauauauaugggucaaccacuaaauaaugaugaagaucaugcacacuggacagaagcuaaaaugcuauuggacaacauaaacacaccggagggaauaauaccagcguuauucgagccugaaagagagaagagugcggcaauagauggugaauacagacuaaggggugaggcuaggaaaaccuuuguagaauugaugaggagaggagaucuaccaguauggcuaagcuauaaggucgcaagugaggguuuucaauauagcgauaggcgguggugcuuugacggagaacguaauaaucaagugcucgaagaaaauauggacguugaaauauggacaaaagagggagaacgaaagaaacugcgaccaagguggcuagacgcgcguacauacucagauccacuagcucuacgcgaauuuaaagaauuugcagcgggacgucguagcgugaguggagauuugauacuagaaauuggaaaacucccgcaacacuuaacucagcgagcgcaaaaugcacuugauaaucucguaaugcuacauaauuccgaacaagggggcagggcuuauaggcaugcaauggaagaauugccagacacaauugaaacauuaauguugcuagcuuuaauagccguauuaacaggaggaguaacuuuauuuuucuuaucgggaagaggacugggaaaaacaaguauaggucuucuaugugugauggcaucaucaguacuacuauggauggcaaguguagagccacauuggauagcugcuucuauaauacuugaguucuuccuuaugguguuacucauaccugaaccugaccggcaaaggacuccacaggacaaucaauuagcguauguagucauaggcuuacuauuuaugauacuuacuguagcugccaaugagaugggacuuuuagaaaccacuaaaaaggaccuagggaucgggcauguagcaguagaaaaucaucaucacgcggcaaugcuagacguagaccuucacccagccucagcauggacauuauacgccguggcaacaacgaucauaacgccgaugaugagacacacuauagaaaauacaacggcgaauaucagcuuaacggcgauugcaaaucaagcagcuauuuugaugggccuggacaaggguuggcccauaucaaagauggacauaggugugccauuacuggcgcuaggauguuauucucaaguaaacccucuaacguuaacugcagcaguucuuaugcugguagcucauuacgccauuauagggcccgguuugcaggcaaaggccacaagggaggcccaaaagaggacagcugcggggauuaugaaaaacccuacaguagacgggauuguagcaauagaucuagauccaguuguauacgacacgaaauucgaaaaacaacuuggacaaaucauguuacucauucuauguaccagucaaauuuuauuaaugcgaacuacaugggcuuuaugcgaaucuauuacauuagcuacagguccacuaacaacacuuugggaaggcucuccagggaaguuuuggaauaccacuauagcaguaucaauggcaaauauauuuagggguucauaucuggcgggagcaggauuagcguucucguuaaugaaaagucugggcggaggcagaagggggacgggugcucagggagaaacacuuggagagaaauggaaacgacaacuaaaucaacucucgaaaucagaguucaauacauacaaacgaucaggaaucauggaaguugaccguagcgaagcaaaagagggcuugaaaagaggugaaacaacaaaacaugcugucucccguggaacagcuaaacuaagaugguuugucgagagaaaucuuguuaaaccagaaggcaaagucaucgaucuugguugugggagaggugguuggaguuacuauugcgcaggacuaaagaaaguuacggaggucaaaggauauacgaaaggcggaccaggacaugaagaaccaaucccaauggcaacuuauggauggaauuuaguaaaacugcauagugguaaggacguauuuuucauaccacccgaaaaaugcgacacauuauugugcgauauaggugaaucgaguccuaaucccacaauagaggaaggaagaacauuacggguguuaaagaugguugagccauggcuacgaggaaaucaauuuugcauaaagauauuaaaucccuacaugccgaguguaguagaaacgcucgaacaaaugcaaagaaaacacggcggaaugcuaguacgcaacccacugucccgaaauucaacgcaugaaauguauugggugagcuguggcacuggaaauauaguaagcgcgguaaauaugaccagucggaugcuacuuaaucgguuuacaauggcacaccgaaaaccaaccuaugagagagauguagacuugggugcaggaacgagacacguagcagucgaaccggagguugcgaacuuagauauuauaggacagagaauugaaaauauaaaacaugagcauaaaaguacauggcacuacgaugaggauaauccuuacaaaacaugggccuaucacggaucauaugaaguaaaaccgucaggaucugccaguaguaugguuaacggugucguaaaacuauuaacaaaaccaugggacguaauaccuaugguuacacaaaucgcuaugaccgacacgaccccuuuuggucaacaaagaguauuuaaagagaaaguggacacuagaacuccaaaagcgaaacgaggaacagcacaaauaauggaaguuacagcaaaaugguuauggggauuuuuaaguaggaacaagaaaccacguauaugcacacgugaagaguucacuagaaagguucggucaaaugcggcuauuggggcaguguuuguagaugagaaucaguggaauagugcaaaagaggcugucgaagaugagcgauuuugggaucuuguccacagggaaagggaguuacauaaacaagggaaaugugccacuugcguauauaacaugaugggcaaaagagagaagaaauuaggcgaguuuggcaaagcaaaaggcucaagggcaauaugguauaugugguuaggugcacgauuuuuggaguuugaagcguuaggcuuuaugaaugaagaucacugguucucgagggaaaauucucuuaguggugucgaaggggaaggcuugcacaaauugggauacauacuuagagacaucucuaaaauuccaggggguaauauguaugcagacgacacagcggggugggauaccagaauaacagaagaugaucuacaaaaugaagcaaagauaacggauaucauggaaccugagcaugcccuucucgcuaaaucaauauucaaacugaccuaucaaaacaaaguuguacguguacaaaggccagccaaaaacggaacaguuauggaugucaucaguaggagagaucaacggggcaguggucagguggggacguauggauugaauacguuuacaaauauggaagcacagcucauaaggcaaauggagagcgaaggaaucuuuucacccucggaauuagaaaccccuaacuuggcaggacggguuuuagauuggcuagaaaaacauggagucgagagacuaaaaagaauggcuaucaguggugacgauugcguaguaaaaccuauagaugacagauuugcgacagcucuaacggcccuaaaugauaugggaaaaguaagaaaagauauaccacaaugggaaccaaguaagggauggaacgauuggcagcagguucccuucugcagucaucauuuccaccaauuaauaaugaaggauggacgagagauugucguuccauguagaaaucaagaugagcuagugggucgagcuaggguuucgcaaggggcaggguggucucuaagggaaacagcaugucucggaaaaaguuaugcucaaauguggcaacuuauguacuuucacagacgagauuugcgccuagcagcuaaugcaauauguucugcuguaccaguugacuggguaccgacuuccagaacaacguggucgauacacgcacaccaccaauggaugacuacagaagacaugcuaucaguuuggaauaggguuuggauagaagagaacccauggauggaagauaaaacccauauauccucuuggggagaugugccauaucuuggaaaaagggaggaucaguggugcggaucguuaauuggguugacagccagagcuacaugggccacaaacauucaaguggccauuaaucaagucaggcgauuaauaggaaaugagaacuaccucgauuauaugaccucuaugaaacgguucaagaaugaaauugauccagaaggcgcauuaugguaa

SEQ ID NO: 21693 - RNA, 9879 nt, Artificial Sequence
  derived and/or modified CDS sequence (opt6) from DENV-1__GQ199817__SS-prME
uccguuacuauguuacuuauguuaaugccuacagcuuuagcuuuucaucuuacgacuagagggggugaaccacacaugauuguuagcaaacaagaaagggguaaaucauuacucuuuaaaacuucugcaggagugaauauguguacuuuaauagcuauggauuuaggggaauuuugcgaagauacaaugacuuacaaaugcccuagaauaacagaagcugaaccugacgacguagauuguugguguaaugccacugacaccugggucaccuacgguaccuguucucaaaccggggaacaccgacgcgacaaaagauccguagcgcucgcaccucacgucggauugggacuggaaacacgcacugaaacuuggaugaguagugaaggagcuuggaaacaaauucaacgagucgaaacaugggcacugcgacaucccggguuuacaguuauagcgcuauuucuugcucaugcuauuggaaccagcauaacucaaaaagggauaauauuuauauugcuaaugcuagugacacccucuauggcaaugagaugugucggaauaggcucaagagacuucguagaaggcuuaucgggagcaacuuggguugauguuguauuagaacauggcucauguguaacaacaauggcaaaagauaaaccgacucuggauauagaauuacuaaaaacugaaguaacaaauccagcgguacuuagaaaauuauguauugaagcaaaaaucucaaauacuacaacagacagcagaugcccaacucaaggagaagccacucucguagaagaacaagacgcaaauuuuguaugcagacguacauuugucgaucgaggaugggggaaugguugcggacuuuucggcaaagguuccuugauaacaugugcaaaauucaaaugcguuaccaaauuagaggguaagauaguacaauaugaaaaucuaaaauauucaguaaucgucacaguacauacaggggaccaacaucaaguagggaaugaauccacagaacauggaacaacugcaacuauaacuccucaagcaccuaguacugaaauacagcuaacugacuacggagcuuuaacacuugacuguucuccaaggacugguuuagacuucaaugaaaugguuuuauuaacgaugaaggagaaaaguuggcuuguacacaaacagugguuccuugacuuaccauuaccguggacaaguggagcaucgacuagccaggaaacuuggaaucgacaagaucuacugguaacguucaaaacugcucacgcuaagaaacaagaaguaguaguguugggcagucaagaaggcgcaaugcauacggcucuuacuggcgcaacugaaauacaaacaagugguacgacaacaauauuugcggggcacuuaaaauguagacuuaaaauggacaaauugacucuaaaagguaugucauacgugaugugcacaggaucauucaaacuagaaaaagaaguggcagagacacagcacgguacaguguuaguacaaauuaaauaugaagguacagacgcuccauguaaaauaccuuuuagcacacaagaugaaaaaggagugacacaaaacggacguuuaauuacagcaaauccuaucguuacugauaaagaaaaaccuguaaauauagaagccgaaccuccguucggagaguccuauaucguaauaggugcaggagagaaggcguuaaagcuaucaugguucaagaaaggaagcucgaucggcaagauguuugaagcaacugcaagaggugcgcgcaggauggcuauucuuggcgauacagcgugggacuucgguaguauaggagggguuuuuaccaguguuggaaaacugguucaucagauauuuggaacagcuuacgguguucuauucagcggaguaagcuggacaaugaaaauagggaucggcguguugcugacuuggcuaggauugaacucuagauccacuucgcuuuccaugacaugcauugcuguuggcuuggucacucuauauuuaggaguuauggugcaagcggacucaggauguguuauaaacuggaaagggagagaauuaaaaugcggaagcggaauauucguuaccaacgagguucauacauggaccgaacaauacaaauuucaagcugacaguccuaaaagguugucggcagcuaucggaaaggcuugggaggaagggguaugugguaucagaucagcgacuaggcuagaaaacauaauguggaagcaaauuuccaaugaacugaaucauauauuacuagaaaaugacaugaaacuaaccguugucgugggcgauguugcaggaauacuugcucaagggaagaagaugauuagaccucaaccaauggaauacaaguauagcuggaaauccugggguaaagcaaaaaucauaggggcugacguacagaacacuacauucauaauagauggcccuaauacgccggaaugcccggacgaccagagggcuuggaauauaugggaaguugaagauuacggguuuggaaucuucacaaccaauauuuggcuuaaauugagagauuccuauacgcaaguuugugaucauagauuaaugucggcugcgauaaaagauucgaaagccguccacgcagacaugggauacuggauagaaucugagaaaaaugaaacauggaaauuagcacgcgcuucauuuauagaaguuaaaacaugcauauggccgaagagucauacacuuuggucaaauggaguucuagaaucugaaaugauaaucccaaaaauauauggcgggccaauaagccaacacaauuacagacccggauacuuuacacaaaccgcgggaccguggcauuuaggcaaauuagaauuagauuuugacuuaugcgaaggaaccacuguaguugucgaugaacauugugguaacagaggcccuucauugagaaccacaacaguaacuggaaaaauuauacacgaaugguguugcagaucauguacacuuccuccccuacgcuuuaaaggagaagacggaugcugguauggcauggaaaucagaccagugaaggaaaaagaagaaaaucuuguaaagaguaugguaagcgccgguucaggagaaguagacuccuuuucacuggguuuauuaugcaucucgauuaugauugaggaaguuaugaggucacgauggucacguaaaaugcuuaugacuggaaccuuagcggucuucuuucuguuaaucaugggucagcuaacguggaaugauuuaauaaggcuuuguauaauggugggugcuaaugcuucugauagaauggggaugggcacgacauaucuugcucuaauggcaacuuuuaagaugaggcccauguucgcgguaggauuacucuuuaggagacuaacaaguagagaaguccuuuuauuaaccauugguuuguccuuaguagcaaguguugaacuuccaaacucacuugaggagcucggagauggcuuagccaugggcauuaugauucugaaauuauugacugacuuucaaagucaccaacugugggcaacacucuuaucacugacauucauaagaacaacauucagcuuacauuaugcauggaaaacaauggcaauggugcucucaauuguuucuuuaaucccauuaugccugaguacuacaagccagaaaaccacguggcuaccaguacuuuugggaagucuagguugcaagccguuaacaauguuucuaauugcggaaaacaaaauuugggguagaaaaaguuggcccuuaaaugagggaauaauggcaguugggauaguuaguaucuuacuaucuagccuacucaaaaaugaugugccacuagcagguccucugauagccggugggauguuaaucgcauguuaugucauuucgggaagcucagccgauuuaucacuagagaaggcagcugaaguuucaugggaagaggaagcugaacauucaggugcuucgcacaauaucuuaguagaaguacaagaugauggaacaaugaaaauaaaagacgaagaacgagaugacacauuaaccauacucuuaaaagccacccuucuagcgguuucaggaguauauccauuaaguauaccagcaaccuuguuugugugguguuucuggcaaaagaagaaacagcgaucggggguuuuaugggacacacccuccccaccagaagucgaacgugcgguguuggaugacggaauauauagaauuaugcagcgcggauugcuugggagaucucagguaggaguaggggucuuccaggagaauguauuccacacuauguggcacgucacccguggagccguacuaauguaccagggcaagagacuugaaccgagcugggccucagucaagaaagaucuuauaucauauggaggcgguuggcgccuacaaggaaguuggaauacgggugaggaaguacaagucauagcggucgaaccuggcaaaaauccuaagaaugugcaaacugccccaggcacauuuaaaacaagcgaaggugaggugggugccauagcgcuggauuuuaaaccagguacaaguggaucgccuauaguaaacagagaaggaaaaauuguaggauuauaugguaauggcgugguuacuacaagcggaacauaugucagugcaauagcccaagcaaaagcaucgcaagaaggaccuuuaccggagauagaagaugagguauuucgcaaacguaauuugacgauaauggauuuacauccuggaagcggcaaaacucguagauaucuaccugccaucgugagagaagcaauuaaaagaagauuaagaacacuaauacuagcaccaacucgcgugguggcaucugaaauggcggaagcacucaaaggaaugccaauuagauaccaaacuacagcaguuaaaagcgaacauacugguaaagaaauuguggaccuuaugugccacgcgacauuuacgaugcgcuugcuuaguccaguacgcguaccaaauuacaacaugauuaucauggaugaagcucauuuuacagaccccucuaguauugccgcgagagguuauauuuccacuagaguuggaaugggagaagcagcugcgauuuucaugacagccaccccuccuggaagcguugaggccuuuccucaaagcaaugcgguaauccaagaugaagaaagggacauccccgagagaaguuggaacucgggauaugaguggaucacagacuucccaggaaaaacugugugguuuguuccaagcaucaaaaguggaaaugauauagcaaacugucuuagaaagaaugguaaacguguuauacaacuaucaagaaaaacguucgauacggaauaccagaaaaccaaaaauaacgauugggauuauguaguuaccacagacauaagcgagaugggggcuaacuuucgggcugaccgagucauagacccccgacgaugcuugaaaccaguaauucugaaagauggaccagaaagagucauacuggcagguccgaugccggugacagucgcuagugcggcgcagcgaagaggacgaauugggcguaaucauaacaaagaaggggaccaauauauuuacaugggacaaccacuuaauaaugacgaagaucaugcccacuggacagaggcaaaaaugcuacucgauaacauaaauacaccggaagggauaauaccugccuuguuugaaccagaacgugaaaagucagcggcaauagacggugaauacagacuaagaggggaagcgcgcaaaacuuuuguagaauuaaugcgucgaggcgaucucccuguaugguugagcuauaaaguugcgagcgagggauuucaauauucugauagaagguggugcuucgauggugagaggaauaaucagguauuggaagaaaauauggauguagaaaucuggacaaaagaaggagaaaggaagaaacuacgacccaggugguuagaugcgcguacuuacucagauccucuagcucuacgugaauuuaaagaauuugcagcgggaagaagguccgucagcggagaccucauacucgaaaucggcaaauuaccacaacauuuaacacagagggcucaaaaugccuuagacaauuuagugaugcuacauaacucagaacaggguggucgcgcuuacaggcacgcaauggaggaauuacccgauacgauugaaacauugauguuguuagcgcuaauagcaguacuaacagggggaguuacuuuauuccuacuuagugggcgaggauuaggcaaaacgagcauaggauugcugugcguuauggcuucuucaguucuacuuuggauggcuaguguugaaccucacuggauugcagcgucgauuauauuagaguucuuucugaugguguuauugauaccagaaccagacagacaaagaacaccucaagauaaccaauuagcguaugucguaaucggacuucucuuuaugauucuuacagucgcugcgaacgaaauggggcuucuagaaacaacuaagaaagaucuaggaauaggucauguagcaguugagaaucaccaucaugccgcgaugcuagauguagauuuacacccagcuagugcuuggacccuguacgcgguagcgaccaccauaaucaccccgaugaugcggcacacaaucgaaaacacaacagcaaauaucucauugacagcuaucgcuaaccaagcugccauuuuaaugggauuagauaaaggguggccuauaucgaagauggacauaggaguaccauuguuagcauugggcuguuauagccaagucaacccgcuuacacucacugcagccguacugaugcugguggcacauuaugcaauaauagggccgggacuccaggcaaaggcuacaagggaggcucagaaaaggacagcggcagggauaaugaaaaauccaacugucgacggaaucguagcaauagaccucgauccaguaguauacgacgcuaaguuugagaagcaauuaggucagauuauguugcuaauccuuuguacuucacagauacuauuaaugagaacgacaugggcacuaugugaaaguauaacucuugcuacaggaccacugaccacguugugggagggaaguccagguaaguuuuggaauacgacuauagcuguuuccauggcaaacauuuucaggggaucauaccuggcuggagcuggccuagcauucagucugaugaagagucugggugguggaagaagagguacaggagcccaaggugaaacguuaggagaaaaguggaaaaggcagcuuaaucaguuaaguaaaucagaguucaauacguauaaacggagugguauuauggaaguagaucgauccgaagcaaaagaagggcuaaaacggggcgagacuacaaagcaugcugugagcagaggaaccgcgaaacuaaggugguucguggaaaggaauuugguuaaaccagaagggaaaguuauugaccuugggugcggucgagguggauggagcuacuauugugcaggccucaagaagguaacagaagugaaaggauauacuaaaggagggccgggccacgaagaaccaauaccgauggcuacauacggauggaauuuaguaaaacugcacucagggaaggauguauucuuuauaccaccugaaaaaugcgacaccuuacuuugugacauaggggagaguaguccuaacccgaccauagaagaaggccgcacacuacguguguuaaaaaugguugaacccuggcuacgcgguaaucaauuuuguauaaaaauccucaauccauacaugccaagcguuguggaaacauuagagcaaaugcaacgaaaacauggcgguaugcuugucagaaauccacugucuagaaauucuacucaugaaauguacugggugucgugugguaccggaaauaucguuucagcgguuaauaugacaucuagaauguuguuaaacagauucacaauggcucaucgaaaaccuacguaugaaagggacgucgacuuaggcgcaggcacaagacacguugcggucgaaccagaagucgcaaauuuagauauaauuggucaacgaaucgagaauauuaagcaugaacauaaaagcaccuggcauuaugaugaggauaauccauacaaaacuugggcguaucauggaaguuacgaggucaagcccucaggaucagcuucaucaaugguuaaugguguaguuaaacuuuuaaccaaacccugggauguaauaccuauggugacacaaauagccaugacugacacaacaccuuuuggacagcaaaggguauuuaaagaaaaggucgacacuaggacacccaaggcaaaacgaggaacagcucaaauaauggagguaaccgcaaaauggcuauggggguuccuaucacguaauaagaaaccacggauauguacucgagaggaguucacgagaaaagucaggagcaaugcagccauaggcgcuguuuucguagaugagaaccaauggaacucggcaaaagaagcuguggaagacgaacgcuuuugggaucucguacaucgagaaagagaacuacacaagcaaggaaagugugcgacauguguauauaacaugaugggaaaaagagagaagaaacuuggggaauuuggaaaggcgaaagguagucgugccauuugguauaugugguuaggcgcuagguuccuagaauuugaggcacucggauuuaugaacgaagaccauugguuuucgcgagaaaacagucugaguggggucgaaggcgaggguuugcauaaacucggauacauuuuaagggacauuucgaaaauuccaggcgggaauauguaugccgaugauaccgcuggcugggauacccgaaucacagaagaugaccuacagaacgaagcaaagauuacggacauaauggaacccgagcacgcccuauuggcuaaaaguaucuucaaauugaccuaucaaaauaaaguuguaagaguccagcggccagcuaagaauggaacagugauggauguaauauccagacgagaucaaagagggucgggccagguaggaacauacggucucaacacauuuacuaacauggaagcucaauuaauucgucaaauggaaagcgaaggaauauucagcccaucagaacuagaaacaccaaacuuagcgggccgaguacuugacuggcuugagaaacauggcguagaacgguugaaaagaauggcaauaucgggcgaugacugcgugguuaagccaauagacgaccguuucgcgacagcucugacagcauuaaaugauaugggaaaagucaggaaggacaucccacaaugggaaccuucuaaaggcuggaaugauuggcagcaaguuccauucugcucucaccacuuccaccaguugaucaugaaggauggucgagaaauagucgugccguguagaaaucaagaugaguuaguaggaagggcacggguuagccaaggagcaggguggagucuaagagaaaccgccugccuaggaaagucuuaugcacaaauguggcaauuaauguauuuucaucgucgggauuugcgccuggcugcgaacgcgaucuguucagcaguaccaguagacuggguuccgacuucucgaacaaccuggucgauacaugcccaucaccaguggaugacaacagaagacauguuaucaguguggaauagagucuggaucgaggagaacccauggauggaagauaaaacacacgucucuucauggggugacgugcccuaccuaggaaaaagagaagaucaauggugugggucguuaauuggacugaccgccagagcaacuugggcaacgaauauacagguugccauaaaccaaguuagaagauuauuaggaaaugaaaacuaucucgacuacaugacaucgaugaaaagguuuaaaaaugagagcgacccagaaggugcgcugugguaa

SEQ ID NO: 21694 - RNA, 9879 nt, Artificial Sequence
  derived and/or modified CDS sequence (opt6) from DENV-1__FJ882550__SS-prME
uccgugacaaugcuguuaaugcuaaugccuacagcguuagcauuucaccuaacaacgagggguggggaaccucauaugauagugacgaaacaagaaagaggaaaaucucuacuauucaagacuucagcugguguuaauaugugcacucuuauagcaauggaucuuggugaacuaugugaagauacaaugacuuauaaguguccucgaauuacagaagcagaaccggacgauguugauuguugguguaaugcaacugacaccuggguuaccuacgguacgugcucgcaaacgggagaacaccgccgugauaaaagaaguguagcauuagcaccucauguaggucuuggcuuagaaacgcgaacugaaacauggaugucaucggaaggugccuggaagcaaauucaaagggucgaaacaugggcucuuaggcacccagguuuuacuguuauugcuuuauuccuggcccacgcuauaggaaccagcaucacacaaaaaggaauaauauucauucuguuaaugcucguuacuccaucgauggcaaugagaugugucggcauuggaagucgagauuuugucgaaggacuauccggugcuacauggguugacguaguauuggaacacggaaguugcgugacgacaauggccaaagauaaaccaacauuagacauagaauuauuaaaaacugaaguuacaaauccugcgguucugaggaaacuuuguauagaagcaaaaauauccaauacaacaaccgacagucguuguccaacacaaggagaagcaaccuugauggaggaacaagacgcgaauuuuguuuguagacgaacuuucgucgauagaggaugggguaacggauguggccuauuuggcaaaggaucacuaauuacaugugcgaaauuuaaaugcguaacuaaguuggaaggaaaaauuguucaguacgaaaaucuaaaguacaguguuauugugacaguucauacuggagaucaacaucaaguagggaaugaaucgacagaacacgguaccacugccacgauaacaccucaagcuccuacuucugagauacaguuaacagauuacggagccuuaaccuuagauugcucaccaagaacagguuuggacuuuaaugaaaugguuuuguugacuaugaaagaaaagucaugguugguacauaagcaaugguuucuugaucuaccacugccuuggacaaguggagcgucaacaucccaagaaaccuggaaccgccaggauuuauuagugacauuuaaaacugcacacgccaagaaacaagagguagugguucuagggagucaagagggagccaugcacaccgcacuaacuggugcuacagaaauacaaacaagugguaugacaacaaucuuugcgggacaccuuaaaugccgccuuaagauggacaaacugaccuuaaaaggcaugagcuaugucauguguacaggcucauucaaacuggaaaaagagguugccgaaacgcagcaugggacagucuuaguacaaaucaaauaugaagguacggaugcuccuuguaaaaucccguucucaacucaagaugagaaaggcguaacucaaaauggaagacuuaucacagcaaauccaauagugacagacaaagagaaaccuguaaacauagaagcggagccuccuuuuggggagucuuauaucguaauaggagcaggcgaaaaggcccuaaaacucuccugguuuaagaaaggaucgaguauaggaaagauguucgaagcaacagcacguggagcacgacgaauggccauacuaggggacacagcgugggauuuuggaucaguuggagguguguuuacaaguguagggaaauuaguacaucaaaucuuuggaacugcuuauggaguacucuucucaggaguauccuggaccaugaaaauuggaauagggguccuguugacaugguuaggucuaaauagccgaucaacaagucugucuaugacgugcauagccguaggacuggugacauuauauuuaggagucauggugcaagcugauucgggaugugugauuaacuggaaagguagagaauugaaaugcgggucaggcauuuuugugacaaaugaaguacauaccuggacugaacaauacaaauuccaggcagauucgccaaaaagacuauccgcugcaaucgggaaagcgugggaggaagguguaugugguauuaggucugcaacuagauuggaaaauauaauguggaaacaaauuucaaaugaacuaaaccauauacuguuagaaaaugacaugaaauucacuguaguagucggcgauguuguagguauccucgcacaagggaagaaaaugauccgaccacagccgauggaacauaaauauucuuggaagaguuggggcaaagccaaaaucauuggcgcggauguacagaacacaaccuuuauaauugauggaccaaacacacccgagugccccgaugaccaaagggcauggaauauaugggagguugaagauuacggcuuuggaauauuuacuacgaacauuuggcuaaaauugagggauucauauacacaggugugcgaccauagacucauguccgcugcaauuaaagauaguaaagcuguucacgcagacauggguuauuggaucgaguccgagaaaaaugaaacguggaaauuagcacgagcuaguuuuaucgagguaaagacauguauauggccaaagagucacacauuauggaguaauggcguacuggaguccgaaaugauaaucccgaaaauauacggugggccgaucagccaacauaauuacaggccgggguauuuuacacaaaccgcugggcccuggcacuuagguaaacuagagcuugacuuugauuugugcgaagguacuacuguggucguugacgaacacuguggaaaucgaggaccaucacuccguacaacgacgguuacggguaaaauaauacaugaaugguguugcaggucauguacacugccgccccuaagguucaagggagaggacggauguugguaugggauggagauaagacccguuaaagaaaaagaagaaaaucuaguaaagagcaugguaucugcagguaguggagaaguagauucguucagccuagggcuacucugcauuucaauuaugaucgaagaggucaugcguucuagguggagcagaaaaauguuaaugacagguacguuagcuguauuucugcuuuugauuaugggacaauuaacauggaacgaccugauaagacuuuguauuaugguuggagcuaaugccagugaucgaaugggaaugggaaccaccuaucuagcucuaauggccacuuuuaagaugcgaccuauguuugcgguaggucugcuauuuagaagacuuacaucaagagaaguccugcuauuaacuauaggauuaucccuuguugcaagugucgagcugccaaauucuuuggaagaguuaggagacggguuggcgaugggcaucaugauuuugaaacuacugaccgauuuucaaagucaccaguuaugggcuacgcuacuaucccuuacuuucauuaaaacuacauuaaguuuacacuacgcauggaaaaccauggccaugguguuauccauuguuagcuuauucccucugugcuuaaguacuacgucgcaaaagacaacaugguugccuguuuuauuagggucuuuagguuguaaaccgcuuacuauguuucugaucacugagaacaaaauaugggggcguaaaucauggccacugaaugaagguauuauggcaguuggcgugguuagcauccuucuaucaagucuacugaagaaugauguacccuuggccggcccucuaauugcuggaggaaugcuaauugcguguuauguuauaaguggcagcagcgccgacuuaaguuuagagaaagcagcugaagucucaugggaggaagaagccgaacauucaggugcaucccacaauauuuuaguggagguucaagacgacggaacaaugaaaauuaaggacgaagagagagaugauacccuaacaauauuacuaaaggccacauuacuagcagucagcggcguuuauccacugucaauacccgccacucuauuuguuugguacuuuuggcagaaaaagaaacaacgaucuggaguguugugggacacaccuaguccuccggaaguagagagggcaguccucgaugauggaauuuaccgaauaaugcagcgaggauuguuaggccgaucacaaguaggaguuggagucuuucaagaaaauguguuccacacaauguggcauguuacaagaggggcaguucugauguaucaaggcaaacgcuuggaaccgucaugggcaucaguaaagaaagaucucauaucuuauggaggaggauggagacuccaagguaguuggaauaccggcgaagagguccagguuauagcgguagagcccggcaagaauccaaagaacguucaaacagcuccagggaccuucaaaacaccggagggcgaaguaggagcuaucgcuuuagacuuuaaaccuggaacaagcgguagcccuaucguaaacagagaagguaagauaguugggcuauaugggaauggaguagucacaacaucaggaacauacguguccgcuaucgcgcaagccaaagccagucaggagggaccacuucccgaaauagaagaugaaguuuuuagaaagaggaaccuuacaaucauggauuuacacccuggaagugguaaaacgagaagguauuuaccugcaauaguacgugaagcaauaaaacgaaagcuacguacguuaauacuggcaccaacgcgagugguugcgucagagauggcagaagcauuaaagggcaugccgauaagauaucagacuacagcaguuaagucagaacauacaggcaaagaaauuguagacuugaugugucaugcaacguuuacaaugcgauuguugucaccaguaagaguaccuaacuacaacaugaucauuauggacgaggcacacuuuacagauccgaguaguauagccgcacggggcuauauuucuacucgaguaggaaugggagaggccgcggcuauauuuaugaccgcuacgccaccaggaucagucgaagcauucccccagagcaacgcuguaauacaggaugaagaaagggauauuccagaaaggaguuggaacucuggauaugaauggaucacagacuuuccuggaaaaacaguaugguuugugccauccauuaaaucggguaacgauaucgccaauugucugaggaagaaugggaaaagagucauccagcuaucucguaaaacauuugacaccgaauaucagaaaaccaaaaauaaugacugggauuaugugguuaccacugacauaucagagaugggagcuaacuucagggccgacagggucauagauccacgacgaugucugaaaccaguaauccucaaagaugguccagaaaggguuauauuggcaggaccuaugccgguuacgguggcauccgcagcccagaggagagggcguauagguagaaaucauaacaaggaaggagaccaguauauuuacaugggacaaccccuuaauaacgacgaagaucaugcacauuggacagaagcuaaaaugcuacuagauaacauuaauacuccagaaggcauuauuccagcucuauuugaaccggaaagagagaaaagcgcagcuauagacggagaauaucggcuacggggugaagcacguaagacauucguagaauuaaugaggagaggugaucuucccguauggcuaucauauaaaguagcaucugaaggauuucaauacagugauagaagauggugcuuugauggugagcgaaauaaucagguacuugaggaaaauauggaugucgaaauauggaccaaggaaggcgaaaggaagaaacuuaggccaagaugguuagacgcacgcaccuauucagauccuuuagcguuaagggaauuuaaagaguucgcagccgguaggcgaagugucucaggcgacuuaauuuuagaaauaggaaaauuaccucaacaucuuacacaacgagcgcaaaaugcauuagauaaucuaguaaugcuacacaauagcgaacaaggaggaagggcguaccgccacgcgauggaagaacuaccagauaccauugagacacuuauguugcuagcacucaucgcaguacucacagguggggucacacuauucuuccuaagcgguagaggacugggaaaaacaucgauuggcuuauuaugugucauggcaagcaguguauuacuuuggauggcaucgguugaaccucauuggaucgccgcuucuauuauacuagaguucuuucugaugguuuuauuaauaccagaaccugaucgccagcgcacgccucaagacaaucaauuagcguauguuguaauaggacuauuauucaugaucuuaaccguugcagccaacgaaaugggguuguuagaaacaacaaagaaagaucucggcaucgggcaugucgcuguagagaaccaccaccacgccacuaugcucgacguggaucuccacccagccuccgcauggaccuuauaugcaguagcaacaacaauaauuacgcccaugaugcgccauacaauagaaaacacaacagccaauaucucauuaacagcgauugccaaucaagcggcaauacuaauggguuuagauaaaggcuggccaauauccaaaauggauaucggagucccccuacucgcacuagggugcuauagucaagucaauccccugacucugacagcagcuguauuaaugcucguagcccauuacgcuaucauaggaccuggauugcaagcgaaagcaacacgggaggcccagaaacgaacagcugcgggaauaaugaaaaacccgacagucgauggcaucgucgcaauagaccuagacccaguaguauacgaugcgaaauucgaaaaacaauugggccaaauaauguuguuaauacuaugcacgucccaaauucuccuuaugagaacaacgugggcguuaugcgaaaguaucacauuagcuacaggaccuuugacuaccuuaugggaaggaucuccuggaaaguucuggaacacaacaauagcuguaucuauggccaacauauuucggggaucguaucuagccggugcuggucucgccuuuucgcuuaugaaaucacugggcggcggaagaagagguacuggagcgcagggcgaaacauuaggagagaaauggaagcgucagcugaaccaauuaaguaaaucagaguuuaauauuuacaaaaggucggggauaauggagguggauagaucagaagcaaaagaaggacuaaaaaggggcgagacuaccagacacgcaguaucaagaggaacagcaaaauuaaggugguuuguggaaagaaaccuuguuaaacccgaaggaaaaguuaucgaccuugguugugguagaggcgguuggaguuacuacugugcuggucucaagaaaguuacugagguuaaaggguauacuaaaggagguccaggucaugaagaacccauaccuauggcuacguauggcuggaaucuaguaaaacuacacucaggaaaagacguauucuuuacaccgccggaaaagugcgacaccuuauugugugauauuggagagaguagcccaaacccgacuauagaggaaggacgaacacugcgaguuuuaaaaaugguagaaccaugguuacguggaaaucaauuuugcauaaagauucugaauccguacaugccaucaguaguggaaacauuagaacagaugcagagaaaacacggcggaaugcuuguaagaaacccacuaagcagaaauucaacccaugaaauguauugggucucuuguggaacagguaacaucgugagcgcaguaaacaugacuucaagaaugcuacugaauagauuuaccauggcacauagaaaacccacuuaugaaagagacguagaucucggagcggggacaagacacguugccguggaacccgaaguugcaaacuuagauauaauaggccagagaaucgagaauaucaaacaugaacauaaaucaaccuggcauuaugacgaagacaauccauacaaaacgugggcauaccauggcucauaugaaguaaaaccaucgggaucggcaaguagcaugguaaacggaguuguuaaacuacuaacaaagcccugggauguaauuccuaugguaacucagauagcgaugacggauacaacaccguuuggacagcaaaggguauuuaaggaaaaaguugauacccgaacgcccaaagccaaaagaggaaccgcgcaaauaauggagguaacagcgcgguggcucuggggguuccuuucucguaauaagaaaccacgaauuuguacacgagaagaguucacgagaaaaguucgaucaaaugcggccauaggggcugucuucguagaugagaaccaauggaacucagcaaaagaagcaguagaggacgaaagguuuugggauuugguacaaaaagaacgugagcuacauaaacaaggcaaaugcgcaacuugcguauacaauaugauggguaaaagagagaagaaacucggagaauuuggaaaagcgaaaggcucuagagcaaucugguauaugugguuaggagcaagauuucuggaguuugaggcacugggauucaugaaugaggaccacugguuuagucgcgaaaacagcuuauccggaguagaaggugaaggacuacauaaacucgguuauauacucagagacauaaguaagauuccuggagguaauauguaugccgacgauacugccgguugggauacgagaaucacagaagacgaucuucaaaaugaagcuaaaauaacugacauaauggaacccgaacaugcauuauuagccacuucgauauucaagcucacauaucaaaacaaggugguuagaguccagcgaccagcaaagaacggaaccguaauggacguaaucucacggagagaccagagaggcucagggcaaguuggaacuuauggucuaaacacauuuaccaauauggaagcucaauugauccgacaaauggaaagcgagggaaucuuucuaccaucugaauuagaaacacccaauuuagcggaacguguguuagauugguuggaaaaauaugggguugagcgauugaaacgaauggcaaucucaggugaugauuguguuguaaagccuauagaugacagauucgcuacagcacuuacagcuuuaaacgauaugggcaaaguacgaaaggauauuccacaaugggaaccuucaaagggcuggaacgauuggcaacaaguaccauucuguucacaucauuuccaucaacuaauaaugaaagauggacgagaaauagucgugcccugcagaaaucaagacgaacugguaggacgagcaagaguaucucaaggagccgguuggagcuuaagggaaacugccugccugggaaagagcuacgcacaaauguggcaacucauguacuuccaccgucgagaccugcgacuugcagccaaugcuauuuguucugccguacccguagacugggugccaacuucacgaaccacauggucuauucacgcacaucaucaauggaugacuacagaagauauguugaguguauggaaucgaguauggauagaggaaaacccuuggauggaagacaagacacaugucagcucauggggagauguaccuuaucucgggaagagagaggaccaauggugugguucacuuauaggucuuaccgcacgagccacaugggcaucuaauauucagguggcaauuaaccaaguaaggcgcuuaauagggaaugaaaacuauuuagacuauaugacuucuaugaagagauuuaaaaaugaaggagauccagaaggugcgcuaugguaa

SEQ ID NO: 21695 - RNA, 9879 nt, Artificial Sequence
  derived and/or modified CDS sequence (opt6) from DENV-1__FJ882551__SS-prME
agcguuacaaugcuguugaugcucaugccuacugcguuggcuuuccacuugacaacgagaggaggagaaccacacaugauaguuucaaaacaagaacgcggaaaaucauugcuuuucaaaacaagugcaggaguaaauauguguacauuaauagcaauggauuuaggcgaauuuugugaagacaccaugacauauaaaugcccacgaauaacugaagcagaaccugaugacguugacuguuggugcaacgcgacugauacaugggugacauacggcacguguagucaaacuggugaacaucguagagauaaacggucaguagcacuggcuccucacguaggacuggggcuagaaacccguacugaaacauggaugucaucggaaggagcauggaaacaaauacaaagaguggaaaccugggcauuaagacaucccgguuuuacaguaauagcauuauuuuuggcacaugcgauaggaaccucaauuacgcaaaaaggaauaauauucauacugcuuaugcuagugacccccucaauggcaaugaggugcgucggaaucggaucccgugacuucguugaaggauuaucaggcgcaacuugggucgauguaguauuagaacauggcagcugcgucacaacuauggccaaggauaaaccaacucuugacauagaacugcuaaaaacagaaguaaccaauccagcaguguuacgcaaauuaugcaucgaagcaaagauuagcaauacuacuacagacuccagguguccgacacagggagaagcaacccuaguagaagaacaagaugcaaacuuuguuuguaggcgaacuuuuguagauagagggugggguaacggaugcggauuauuuggcaaaggaucccuaauaacgugugcaaaauucaaaugcguuacaaaauuagaaggaaagauuguucaauacgagaaccuuaaguauucaguaaucgugacaguacauacuggugaccaacaucagguaggaaaugagagcacugaacaugggacgacugcaacaauuacuccacaagcacccaguacagaaauucaauuaaccgauuacggcgcacuaacacuggacuguucuccaaggacagguuuagauuuuaaugaaauggugcuguugacuaugaaagagaaaagcuggcuuguacauaaacagugguuuuuggaccuaccucuaccauggacaucuggcgcaucaacaagccaagaaacguggaaccgacaagauuuauuaguaaccuucaaaacagcucaugccaaaaagcaagaaguaguuguucucggcucucaggagggagcaaugcacacagcucucacuggugcgacagaaauucaaacgagugguacaacaacgauauuugcgggccaucuuaaaugucgacuuaagauggacaaacuuacuuuaaaggguaugucuuacguaaugugcacaggaucguucaaauuggagaaggaaguugcagaaacccagcacggaacaguguugguccaaauaaaauacgaaggcacugaugcgccauguaaaauacccuucaguacucaggacgaaaaggguguaacucaaaaugggcgccuaauaacggcaaaucccauuguuacagacaaagaaaaacccguuaauauagaggcagagccuccauuuggagaaagcuacauuguaaucggugcaggagaaaaagcauuaaaauuauccugguucaagaaagguuccucgauagguaaaauguuugaagcgacagcaagaggagcccgacgaauggcaauuuugggagauaccgccugggacuucggcagcauaggggguguuuuuacuucaguuggaaaauugguacaucagauauuugguacugccuacggcgucuuguuuucgggcgugucguggacgaugaaaauaggaauaggcgugcuucuaacguggcuuggucuaaauucaagaagcacaagucugucaaugacauguaucgcagucggauuaguuacacuuuacuugggaguuaugguacaagcugacagugguugugucauaaauuggaaagggagagaacuaaaauguggcucagguauuuuuguuacgaacgaaguacauacuuggacugaacaauauaaauuccaagcugacucuccaaaaaggcuaagugcagccauugguaaagccugggaagaaggugugugugggauccgcagugcgaccagacuggagaauauaauguggaaacagauauccaaugaguuaaaucacauacucuuggagaaugauaugaaguuaacaguuguugugggggauguagcaggaauacuagcccaagguaagaaaaugauuagaccacaaccgauggaauacaaauauucauggaaaagcuggggaaaggccaaaauuauaggggcagauguucagaauacuacuuucauuauugauggaccaaauacaccagaauguccagaugaccaaagagcuuggaacauuugggaaguagaagauuaugguuuuggcauauuuacuacaaacaucuggcugaaacuuagagauagcuacacccaaguaugugaucauagacuaauguccgcugcaauuaaagauagcaaggcaguacacgcugacaugggcuauuggaucgaaucugagaaaaaugagacauggaagcuagcuagggccagcuuuaucgaggugaagacaugcauauggccaaaaagucacacacuguggucaaauggcgucuuagagagugaaaugauuauacccaaaauauauggcggaccaacuucacagcauaacuauagacccggguacuucacucagacagcaggaccauggcaccuagguaaauuggaacuugacuucgacuugugugaaggcacaacaguuguaguagacgaacauugugguaaccguggacccucacuaagaacuacaacagugaccgguaaaauaauacaugaaugguguuguaggucuuguacauugccgccucuuagauucaaaggugaggauggcuguugguacgguauggaaauuagaccagugaaagagaaagaagaaaaucuggucaagaguaugguaagugcagguucaggagaagucgacucguuuagccugggacuauuaugcauaagcauaaugauugaagaaguuaugagaucaagguggagccgaaagauguugaugacuggaacuuuagcuguauucuuucugcuaauaauaggccaacuaacauggaacgaccuuauccgccuauguauaaugguuggugcuaacgcgucggauagaauggggauggguacaacguauuuggcuuuaauggcuaccuuuaaaaugcguccgauguuugcagugggucuguuauuucgacguuuaacuucaagagaaguucuccuucucacgauaggucucagcuugguagcaucagucgaguugccaaauaguuuagaagaauuaggggauggacuagccaugggaaucaugauacuaaaauuguuaaccgacuuucaaagucaccaauuaugggcuacauuacugucucuaacauucaucaggaccacuuucucacuacacuaugcuuggaaaacaauggcaaugguacuaagcauagucagcuuguucccuuuauguuuaucaaccacaagccagaaaacuacuugguuaccgguacucuuagguucgcucgguugcaagccgcugacaauguucuuaauagcugaaaauaaaauauggggucguaagaguuggccauuaaaugaggggauaauggccgucgguauaguguccauauuauuaucaucacuucuaaagaacgacguaccguuagcagguccacuaauagcuggugggauguuaauagcauguuacguaauuucaggaucaagugcugacuugucucuagaaaaagcugcaguugucucaugggaagaggaagccgagcauucaggagcaagucacaacaucuuaguggaggugcaagaugacgguacgaugaaaaucaaagacgaagaacgcgacgacacucuuaccauacuucuaaaagcuacucuucucgcagugagugguguguauccauuaucaauacccgcuacauuauucgucugguacuucuggcagaaaaagaaacaaagaucagguguauuaugggacacuccaagcccuccugaaguugaaagagcgguauuagacgacgguauauauagaauuaugcaaagaggcuuacuaggcagaucacaagugggaguuggugucuuucaggaaaauguauuucacacgauguggcauguaacucgcggagcuguacucauguaucaggggaagaggcuugaaccuaguugggcuucgguuaagaaggaucuaauaagcuacggaggcggguggagauuacaaggaucauggaacacaggcgaggaaguacaaguuauugcaguggaaccaggcaaaaaccccaagaauguucaaaccgcaccaggcaccuuuaaaaccagcgaaggagaagugggcgcuauugcauuagacuucaaaccaggaaccucagguuccccaauuguaaauagagaaggaaagauugugggccuauacggaaauggugucgucacgacaaguggcacuuacguaucugcaauagcacaggcaaaagcaucucaggagggcccgcuaccagaaauagaggaugaaguuuuuagaaaaaggaauuugacuauaauggaucugcacccugggucaggcaaaaccagacguuauuuaccugcaaucgugcgugaggccaucaaaagaaaacuaaggacgcuuauuuuggcaccgaccaggguaguugcguccgaaauggcagaagcauuaaaaggaaugccuauacgcuaucagaccacagcggucaaaucagagcacacuggaaaagagauaguagaucuuaugugccacgccacauucacuaugagauuacugucuccaguucgaguuccaaacuacaauaugauaauuauggacgaagcccacuuuaccgauccaaguucgaucgcugcacgaggauauaucagcacuagagucggcaugggagaagccgccgcaauauucaugacagcgacaccaccugguaguguagaagcguuuccccaaaguaacgcagugauacaggaugaagaaagagacauuccugaaagaagcuggaacucaggauacgaauggauuacagauuuuccaggcaaaacuguaugguucguuccaucuauuaagucaggaaaugacauagcaaacuguuuaagaaagaaugguaaaagaguaauacaauuaucuaggaagacauucgauacagaguaucaaaagaccaaaaacaacgauugggauuaugugguaacaacagauauaucugaaaugggagcgaacuuuagagcugauagaguaauagauccccgaagguguuuaaaacccguaauucuuaaagacgggccggaaagaguaaucuuagcagguccaaugccuguaacggucgcgagugccgcucaacggagaggaagaauaggcagaaaucauaacaaggaaggagaucaauacauauauaugggacaaccuuuaaacaaugacgaagaucacgcacacuggacagaagcaaaaauguuacuagauaacaucaauacgccagagggcauuauaccugcucucuuugaaccagaaagggaaaaaucugcagcuaucgauggcgaauauaggcuacgcggagaggcaagaaagacuuucguugaacugaugcggagaggagaucuaccaguauggcuaucccacaaagucgcaucggaaggauuucaauauagugaccgacgcugguguuuugacggugagaggaauaaucaaguguuggaagaaaauauggauguggaaauuuggacuaaagaaggagaacgaaagaaacuuagaccaagguggcuggaugcacgcacguauuccgauccgcuagcuuuaagggaauuuaaagaauuugccgcagguaggagaucugugucaggcgaucuaauacuugaaauaggaaaacuaccucaacaccugacucagagagcacaaaaugcacuggauaaucuugugaugcugcauaauagugaacaagguggccgcgcguaccgucacgccauggaagaacucccugauacuauagagacauugauguuauuagcucugaucgcaguucugacaggaggaguaaccuuauucuucuuaucuggccgaggauuaggcaaaaccucaauuggcuuacuaugugucauggcaagcucagugcuacuauggauggcgucaguugaaccacacuggauugccgcgagcauuauucuggaguucuucuuaaugguacuauuaauaccagaaccagauagacaacguacuccacaagacaaucaacucgcuuacguuguaaucggguuacuauucaugauucucacaguagcagcaaacgaaaugggacuucuagaaaccacaaagaaagauuuagguauaggccauguugcaguugagaaucaccaucaugcagcuauguuagacguagauuuacauccugcuucugcuuggacgcuauaugcagucgcuaccacaauaauaacgccaaugaugagacauacaauagaaaauacaacagcaaauaucagcuuaaccgcaauugcgaaccaagcugcaauuuuaaugggauuagacaagggauggccuauaagcaagauggauauaggaguuccgcuucuugcgcucgguuguuacagucagguaaauccauuaacucuaacugccgcaguacuaaugcucguugcucauuaugcuauuaucgguccaggucugcaggcaaaggcuacgcgugaggcgcagaaaaggacagcggcagguauaaugaaaaauccgacaguugauggaauaguggccauagaucuagaccccgucgucuacgacgccaaauuugaaaaacaguuagggcaaaucauguuauuaauauuauguaccagucaaauccuccuaaugcgcaccacaugggcacucugcgaaucaauuacucuagcuacaggaccgcugacaacacuaugggaagguagucccgggaaguuuuggaacacaacuauagcuguuucaauggcuaacauauuuagggguucauaucuugcgggugcuggcuuagcauucucauuaaugaaaucacuaggaggagggcgucguggcaccggagcccagggugagacucuuggugaaaaauggaaacgacaacuaaaccaauuaaguaaaagcgaguuuaacacuuauaagaggucgggaauuauggagguagauagaagcgaggcuaaagaagggcuaaaacgcggagaaacuaccaaacacgcaguuucucgagggacugccaaacuccgcugguuuguugagcggaaucucgucaaaccagaagggaagguaauagaucuaggauguggucgaggaggcuggucauacuacugugcagggcuuaagaaaguaacggaagugaaagguuacacaaaaggcggacccgggcaugaagaaccaauuccaauggcuacauauggauggaaccugguaaaauugcacaguggcaaagaugucuucuuuauaccuccagaaaaaugcgacacauuacugugugauauaggagaaagcaguccgaauccuacuauagaggaaggacgcacauuaaggguacuuaaaaugguugagccaugguuacgaggaaaucaauuuugcaucaaaauuuuaaauccauauaugccaagugucguagagacguuagaacaaaugcaacguaaacacgggggaaugcuaguucgaaauccuuuaaguagaaauucaacucacgaaauguauuggguuucaugcgguacaggaaacauagucucugccguuaauaugacgagucguauguugcuuaaccgguucacaauggcacauagaaaaccgacuuacgaacgugaugucgaccuaggagcuggaacaagacauguagcgguagaaccagagguugcaaaccuagauaucauaggucagcgaauugaaaacauaaaacaagaacauaagagcaccuggcauuacgaugaagauaacccauacaaaacaugggcuuaucaugggucuuaugaaguaaaaccguccggauccgcuucaucaaugguaaauggaguaguuaaauuacuuaccaaaccuugggaugucauuccuaugguuacacagauugcuaugacugacacuacaccguucggccaacaaagaguuuucaaggaaaaagucgacacucgcacacccaaagcaaagagggguacggcacaaauaauggagguuacagcgaaaugguuauggggcuuccuuagucggaacaaaaagccucgaauuuguacucgagaggaauuuacccguaaagugagaucuaaugcagcgauaggugcaguuuucgucgacgaaaaucaauggaacagugcaaaggaagcgguugaggaugaacgcuucugggacuugguacauagagaacgcgaguuacacaaacaagggaagugugcgacauguguguacaacaugaugggcaaaagagagaagaaacuaggggaguucgguaaagcuaaagguucaagggcgauuugguauauguggcugggggcgagguuucucgaguucgaagcgcuaggguucaugaacgaggaccacugguuuagccgagaaaauucgcuaucuggaguagaaggugaaggcuuacacaaacuaggauauauucuucgagacauaucaaaaauaccgggcggaaauauguacgcugacgauacagcagggugggauacccguauaaccgaagaugaucuacaaaacgaggcaaaaauaacugauauaauggaaccggagcaugcauuguuagccaaaucgauauucaaauuaaccuaucaaaauaaagucguuagagugcaaagaccugccaaaaacggcaccgugauggacgugauuucaagaagagaucaaagaggaucaggucaaguaggcacauacggauuaaacacauucaccaacauggaagcucaauuaauacgacaaauggaaagcgaagguaucuuuucgccuagugaauuagagacgcccaaucucgcagguagaguauuagauuggcucaagaaacaugguguugagagauugaaaaggauggcgauuucaggggacgauugcguaguaaaaccaauagaugacagauucgcaacggcauuaaccgcuuugaaugauauggguaaaguuagaaaggauauaccacaaugggaaccuagcaaagguuggaaugauuggcagcaagugccauucuguagccaccauuuucaccaauuaauaaugaaagacggccgugaauugguagucccauguaggaaucaagaugaacucgucgggagagcaaggguaucucaaggagcaggauggagccuccgagagacagcaugucucgguaaaucguacgcacagauguggcaacucauguauuuucaucgacgagauuuacgucuggcggcgaaugcgauuugcagugcaguucccguagauuggguaccgacaagucguacgacauggucaauccaugcccaucaucaauggaugacaaccgaagacaugcuguccguauggaacagaguuuggaucgaagagaacccauggauggaagacaagacccauaucaguuccuggggugauguaccauaucuagguaagagagaggaucaaugguguggaaguuuaauuggauuaacggcacgagcuacuugggccacaaauauacagguggcgauuaaucaaguacguagacuuuuagguaaugaaaacuauuuagauuauaugacaucuaugaaacgauucaaaaaugaauccgauccugaaggagcuuugugguaa

SEQ ID NO: 21696 - RNA, 9879 nt, Artificial Sequence
  derived and/or modified CDS sequence (opt6) from DENV-1__FJ882552__SS-prME
ucagucacaaugcuacucaugcucaugccaacggcacuugcauuucacuugacaacgcgagggggagaaccacauaugauuguaucuaaacaggaacgaggaaaaucuuuauuauucaaaacgucagcuggagugaauaugugcacacuaauagccauggaucuaggggaauuuugugaagauaccaugacauacaaaugcccaaggauaaccgaggcugaaccugaugacgucgacuguuggugcaaugcgacggacacaugggugacauauggaaccuguucucaaacaggugaacacagaagggacaaaagaaguguagcacuggcaccccauguaggucugggacuagaaacaagaaccgaaaccuggaugagcucagaaggugcauggaaacaaauccagagaguagaaacaugggccuugcgucauccagguuuuacagugaucgcccuuuucuuagcgcacgcuauuggaacaucgauaacucagaaagggaucauuuucauucuucuuaugcuugucacaccaagcauggcgaugagaugcgucggaauuggaucucgagacuuugucgaaggcuuaagcggugcgacauggguagaugugguucuugaacauggaucuugugucacgacuauggcuaaagacaaaccuacacuagauauugaacuacucaaaacagaaguuacaaauccugcaguauugaggaaacucuguauagaggcaaaaauuucaaauacaacaacugacucaagauguccaacccaaggugaggcuacucucguugaagaacaagacgcuaauuucgugugcagacguaccuuuguggauagggggugggggaauggauguggauuauucggcaaaggaucuuuaauuacaugugccaaauucaaaugugugacgaaacuugaaggaaaaacaguccaauacgaaaaucuuaaauauagcguaauagugacaguacauacaggcgaucaacaucagguaggaaaugagucaacagaacaugguacaacugcuacuauaaccccacaagcaccuaguacggagauacaauuaaccgacuauggcgcacuaacauuagauugcucccccagaaccggauuagauuuuaacgagaugguguuacuaacaaugaaagagaaaaguuggcucguucauaaacaaugguuucuggaccuaccgcuuccauggacgucuggugcgucuaccagucaagaaacauggaauaggaaagaucucuuaguaacguuuaagacagcacacgccaagaaacaggaggucgugguucuaggaagucaagagggggcuaugcauacagcauugacuggugcaacggaaauacagacaagugguacgacuaccauuuuugcuggucacuuaaaauguagacuaaaaauggacaaacugacgcuuaagggaaugagcuauguuaugugcacaggaucauuuaaauuagagaaagaaguagcagaaacacaacacgggaccgugcuuguacaaauuaaguaugaagggaccgaugcgccaugcaaaaucccuuuuaguacucaagacgaaaagggggucacgcaaaauggaagauuaauaacagcgaacccuauaguaaccgacaaagaaaaaccaguaaacauugaagccgaaccaccauucggagagagcuacauuguuauaggagcaggagaaaaagcucugaaauugucuugguucaagaaaggaucuaguauaggaaaaauguuugaagcuacggcucgaggcgccaggcgcauggcuauccuaggagauaccgcaugggauuuugguucuauugggggagucuucacuucaguaggaaaguuagugcaucaaauauuugguacagcguauggaguuuuguuuaguggggugagcuggaccaugaagauuggcauuggaguucuacucaccuggcucggguuaaauagucgcucuacaucacuauccaugacauguauagcaguuggccuagugacgcuauauuuaggaguuaugguacaagcagauucaggaugugucaucaacuggaaaggacgagaacucaaaugugggucugggauauucguuacaaacgaaguacauacguggacugaacaauacaaguuucaagccgauagcccaaagcgguuaucugcagcaauugggaaggcgugggaggaaggcguuugcggaauaaggucugcgacacgccuagaaaauauuauguggaaacaaaucagcaaugaacuaaaucauauauuacuagaaaaugauaugaaguuuaccguagugguaggggacguagcuggaauacucgcgcaaggcaagaaaaugauccgaccgcaaccgauggaguauaaauauucauggaaaagcugggggaaagcaaaaauaauuggugcggaugugcaaaacacaacguuuauaaucgacggaccuaauacaccagaaugucccgacgaccaaagagcauggaauauaugggaaguugaagauuaugguuuuggaaucuuuacaacaaauauaugguugaaacuucgagauuccuauacccagguaugugaccaucgccuaaugucugcagcuaucaaagauaguaaggcaguccacgcggacaugggauacuggauugaguccgagaaaaaugagacauggaaauuggcccgugcuagcuuuauugaaguaaagacauguauauggccuaagagucacacauuguggaguaacgggguauuagaaagcgaaaugauuauaccgaagauauauggcgguccaaucagucaacauaauuauagaccaggcuauuuuacacagacugcaggaccguggcacuuggguaaacuugaacuggacuucgaucuaugcgaaggaacuaccguggucgucgacgaacacugugggaacagagggcccucauugcgcacaacaaccgucacgggaaagaucauucaugaaugguguugccguucuuguacuuuaccaccuuuaagguuuaaaggugaagauggauguugguaugguauggagauuagacccguaaaagagaaagaagaaaaucuuguaaagucaaugguuucagccggcucuggugaaguggacagcuuuuccuuagggcuucuaugcauaagcauaaugauugaagaaguaaugcguagucgauggagcaggaaaaugcuuaugacuggaacucuagccguguucuuucuacuuauaaugggucaauuaacuuggaaugaucucauuagacuguguauaauggugggcgcaaaugcaagcgaucgaaugggaaugggcaccaccuaucuagcccugauggccacauucaaaaugcguccuauguuugcaguaggucuuuuauuuagaagguuaaccucgagagaaguacuucuucuaaccauaggguuaagucuaguugcgucgguagaauuaccaaacucauuagaagaguuaggugacggauuagcuaugggaauaaugauacuuaaacuacucacggacuuccagucacaccaacucugggcgacacugcucagcuuaacauucauuaagacuacaucaucccuacauuaugcguggaaaacaauggcgaugguucuaaguauagucucacucuucccgcuaugcuuauccacaacaucacaaaagacaaccuggcugcccguccuccuaggaagccucggaugcaaaccauuaacaauguuucuaauagcugaaaacaaaauauggggcaggaaauccuggccauugaaugaaggaauuauggcaguaggaaucguaaguauauuacuguccucacugcucaagaaugacguaccauuagcaggcccuuuaaucgcgggcggaaugcuaauagcgugcuaugugauaagcgguaguagcgcugaucuuucacucgagaaagcugcagaaguaucuugggaggaagaagccgaacauucaggagcaagucauaauauuuuaguagagguccaagacgacggaaccaugaagaucaaagacgaagaacgagaugauacacuaacuauacuauugaaagcgacguuacucgcuguaucaggcgucuauccuuugucaauucccgcgacucucuucguaugguauuuuuggcagaagaagaaacaacguagugguguacucugggauacgccguccccacccgaaguagaaagggcgguccuagacgauggaauauaucggauuaugcaaagaggccuacuaggaaggucucaaguagggguaggaguguuccaagaaaauguuuuucacacgauguggcaugugacgagaggagcuguauuaauguaccaagggaaaagauuagaaccaaguugggcuagcgucaagaaggacuuaaucaguuauggggguggguggagacuccaggguaguuggaacacaggggaagagguacaaguaauugcggucgaacccgguaagaauccgaaaaacgugcagacagcgcccgguacauuuaaaacgucagaaggcgaggugggagccaucgcgcucgacuucaaaccgggcacaagcggcucgccaauagugaauagagaaggaaaaaucguuggauuauaugguaauggcguaguaaccacaucaggaacguacguuucagcgauagcucaggcaaaagcaucacaggaagguccuuuaccugaaaucgaagacgaaguguuuagaaaacgaaaccuaacuauaauggauuuacauccagggucaggaaaaacaagacgauaccugcccgcaaucguccgagaagccauaaaaaggaagcucagaacauuaauucucgccccuacuagggugguugcauccgaaauggcagaagcucuaaaggguaugccaaucagauaccaaaccacagcuguaaaauccgaacauacagguaaagaaauaguugauuuaaugugucaugcaaccuucacaaugcgcuuacuaucaccagucagaguacccaacuauaauaugauuauaauggacgaagcacauuuuacagacccuucaaguauugcagcacgaggauacauuaguacucgaguuggcaugggagaagcugcagcgauauucaugacagcuacaccuccaggaucuguugaggcauuuccccaaagcaacgcagucauacaagaugaggaaagggauauaccggaaagaaguuggaacucaggguaugaauggauaacagacuuucccgggaagacugucugguuuguccccaguauaaaauccggaaaugacauagccaacuguuuaaggaaaaaugguaaaagagucauccaacuaucucggaaaacauuugauaccgaauaucagaaaaccaagaauaaugauugggacuauguuguaacaacugauauaagcgagaugggagcuaauuuccgggcugaucggguaauagacccuagacgaugucucaaaccuguaauauugaaagaugguccugaaaggguuauacuagcuggaccaaugcccguaaccgucgcaucagcugcucaaagaagggggcgaaucgggagaaaucauaauaaagaaggugaccaguacauauauaugggacaaccuuuaaauaacgaugaagaucaugcacauuggacagaagcaaagauguuguuagacaauauaaacaccccagaggguauuauuccagcacuuuuugaaccugaacgggagaaaagugcagcaauugacggcgaauaccgauuacgaggugaggcacgaaaaaccuucguagaauuaaugagaagaggcgacuugccagucugguugaguuacaaaguugcuucugaaggauuucaauacucagacaggcgauggugcuucgacggggaaagaaauaaccaaguauuagaagaaaauauggacguugaaauuuggacaaaagaaggagaacgaaagaaacucagaccacgcugguuagaugcaagaacguacagcgacccauuagcgcuaagagaauuuaaagaguucgcggcaggcagaagaucaguaaguggagaccugauauuagaaaucggaaagcugccccaacaucuuacccaaagagcacaaaaugcuuuagauaaccuaguaaugcugcauaacagugaacagggugguagagccuaucgacaugccauggaagaacuuccggacacaauugaaacucugauguuacuggcauuaauagcaguguuaacagggggaguaacccuauucuuuuuaucgggaagagggcucggcaagacuucaauuggucuuuuaugcgucauggcgucaucaguuuuacucuggauggcauccguggaaccucacuggauagcagcaagcauaauacuugaguucuuucuaauggugcuacuuauaccagagccugacagacaaagaacuccacaggauaaucagcucgccuauguagucaucggcuuauuauucaugauauuaacagucgcagcuaacgaaaugggcuuacuagaaacaaccaagaaagaucuaggaauaggacaugucgcaguagaaaaccaucaccaugcggcaauguuagacguagauuuacaccccgcaucagcauggacuuuguacgcuguagccacaaccauaauaacaccgaugaugagacauacuauagaaaauacuacagcgaacaucucuuuaacagcaauugcaaaucaggcugcuauauuaaugggacucgauaagggauggccaauaaguaaaauggauaucggugugccacuuuuagcccuuggauguuauagccaaguaaauccacuaaccuuaacugcagcuguucuaaugcugguagcacauuaugcuauaauugggcccggauugcaagcaaaggcaacccgugaagcccaaaaacgaacagcagccgguauaaugaagaauccuacaguagauggaaucguugcaauagaccucgauccuguggucuacgacgccaaauuugaaaaacaacucggucagauaauguuacugauauuauguacgagucaaauuuugcuaaugagaacaacgugggcacuaugcgaaucaauaacauuggcaacgggaccuuugaccacacuuugggaaggaaguccuggaaaauucuggaacacgacgauagcugugaguauggcuaacauuuucagaggaucguacuuagccggugcuggauuggcauucucccuaaugaaaaguuugggcgguggacggagaggaacuggcgcacaaggugagacgcuaggagagaaauggaaaagacaauuaaaucaauugaguaaauccgaguucaacacauacaaacgaucugguauaauggaaguagauagaagcgaagccaaggagggccuuaaaaggggagagacuacgaaccacgccgucucuagagggacagcaaaacucagaugguucguggaaagaaacuugguaaaaccugaggguaagguaauugaucuuggaugugggagggguggauggucuuauuauugugcaggucucaaaaaggucacagaagugaaagguuacaccaaaggcggacccggucaugaagaaccaauaccaauggcgacauauggauggaauuuaguaaaguuacacuccggcaaggauguguuuuucaucccuccagaaaaaugugauacucuauuaugugauaucggugagaguucaccaaauccuacuauagaagaaggaagaacauuaagaguuuuaaaaaugguugaaccauggcugcgcggaaaucaguuuuguauaaaaauacucaauccguauaugcccucuguaguggaaacauuagagcaaaugcaaagaaagcaugguggcauguuagugcgcaacccucucucccguaacucgacacacgaaauguauuggguuagcugugggacuggaaacauuguuagcgcaguuaauaugacgucgcgaauguuauuaaauagguuuacaauggcgcauagaaaacccacauaugaacgagauguugaucuuggugccgggacgaggcacguggcgguagaaccagaaguugcaaauuuagauauaauaggacaacgcauugaaaacauuaaacaugaacacaagaguacauggcauuacgaugaagauaauccguacaaaacaugggcuuaucaugguucauacgaagucaagccuucaggaucagcgucaucgauggugaauggaguagugaagcugcuaacaaagcccugggacguaauaccuaugguaacucagaucgcgaugaccgacacaacaccuuuuggacaacagaggguuuuuaaagaaaagguagauacgagaacgcccaaagcaaaaagaggcacagcccaaauaauggaagugaccgccaaaugguuauggggauuuuuaucuagaaacaagaaaccgagaauauguacucgagaggaguucacccggaaaguaagaaguaacgcagcaauaggagcuguauuuguggacgaaaaccaguggaacucugcuaaagaggcuguugaagaugaaagauucugggacuuaguucaccgagaacgcgaacugcauaagcagggaaaaugugcuacuugcguuuacaauaugaugggaaaaagggagaagaaacuaggugaauuuggaaaagccaaggguucuagagcaauaugguauauguggcugggugcucgcuuccucgaauuugaagcgcuaggguucaugaacgaagaccauugguuuaguagagagaacucacucagcgguguugagggggaaggccuacacaaacuugguuacauacuacgagauauaucgaaaauuccaggugguaacauguaugcagacgauaccgcgggcugggauacccguauaacugaagacgaccuccagaaugaagccaagauaacugauaucauggagcccgagcacgcgcuauuagcuaaaucaaucuuuaaacuaaccuaucaaaacaagguugugagaguacaacgaccggccaaaaauggaacaguaauggacguuauaaguagacgagaucaacguggaucaggucaaguagguacguaugggcuuaauacuuuuacaaauauggaagcccaacuaauucgccaaauggaaucagaaggaauauuuucaccuucagaguuagaaacuccgaauuuagcuaggagaguauuagauugguuggaaaaacauggugucgaaagacuuaaaaggauggcaaucucuggggaugauugcguggucaaaccuaucgacgaucgguuugcgacagcuuuaacggcacucaaugauauggguaaaguacguaaagacauaccgcaaugggaacccucaaagggauggaacgauuggcagcaaguaccuuucugcucacaccauuuucaucaauuaauuaugaaagauggccgugagauagucguaccauguaggaaucaagaugagcuagucggaagggcacgcguuucacaaggugcaggauggucucuacgcgaaacagcaugccuggguaaauccuaugcacaaauguggcaacuuauguacuuccacagacgugacuuacggcuugccgcaaaugcaauuuguucugccgucccuguagauuggguaccgacuucgagaacaacguggagcauacacgcacaucaucaguggaugaccacagaagacauguuaaguguuuggaauagaguauggauagaggaaaaucccuggauggaagauaagacacacauuaguucuuggggagacguaccauaucuuggcaagagagaggaucaauggugcggaucuuugauagggcuaacugcacgcgcgacaugggcuaccaacauacagguggcuauaaaucaggugagacgguuaauagggaaugagaauuauuuagauuacaugaccucuaugaaaagauuuaagaacgaaucggauccggagggagcacugugguaa

SEQ ID NO: 21697 - RNA, 9879 nt, Artificial Sequence
  derived and/or modified CDS sequence (opt6) from DENV-1__FJ882553__SS-prME
ucuguaacgauguuauuaauguugaugccaacugcacucgcuuuucaccuaacaaccaggggcggagaaccacacaugauuguaucuaaacaagaacgugggaaauccuuguuauuuaaaaccagcgccggaguaaauauguguacacuaaucgcaauggacuugggcgaauuaugcgaagauacaaugaccuacaaauguccgagaauuacagaaacagaacccgaugauguugauugcuggugcaaugcaaccgauacguggguaacguacggaaccuguagucaaacuggcgagcaccgucgagacaaaagaagcguugccuuagcaccacauguuggacuaggacuagaaacuagaacugaaacauggaugucaagugaaggugcuuggaaacaaauucaaagaguggaaaccugggcuuuacgacacccagguuuuacaguuauagcacuuuucuuggcacaugccauagguacuucuauaacgcagaaagguauaaucuuuauauuacuuauguuaguaacuccuucgauggcaaugcguuguguagguauugguucacgagauuucguagagggacugucaggcgcaacuuggguugacguaguacuagaacaugggucuugcgugacaaccauggccaaagauaaacccacacuugauauugaguuauugaaaacggaaguuaccaacccggcuguucuuagaaaacuauguauugaagcgaaaauaagcaauacaacaaccgacagcagauguccaacacaaggagaagcaacgcuaguugaagaacaagacgcaaauuuuguuugucgaagaacguuuguagaucgagguuggggcaauggguguggguuauucggcaaaggaucacuaauuacaugcgcgaaauuuaaguguguuaccaaauuagagggaaagaucguacaauacgaaaaccugaaauacucaguuaucguaacgguacauacaggagaucaacaccaagucggaaaugaauccacagagcauggaacuaccgcuacuauaacaccucaagccccuacgacugaaauucaguugacggacuacggcgcucucacuuuagauuguucgccuagaacgggacucgacuucaaugaaauggucuuguuaacaaugaaggagaaauccugguuaguacauaaacagugguuuuuagaccucccgcuaccauggacaucgggugcaucaacaucgcaggagacauggaaucgucaagauuuacugguuacguuuaaaacugcacaugcuaagaaacaagaagucguaguuuuagguucacaagagggagcuaugcauacagcccuuacaggcgccacagaaauccaaacaucgggaaccacaacgauauuugcaggacaccucaaaugucgcuuaaaaauggacaaauugacuuuaaaagguaugucuuauguuauguguacuggcagcuuuaaauuggaaaaagaagucgcagaaacucaacaugguacggugcuuguucaaauaaaguaugaagggaccgaugccccaugcaaaauacccuuuucuacacaggacgagaagggagucacucaaaacggcagauuaauuacagccaacccgauaguuacagauaaggagaaaccugugaacauugaggcagagccuccguuuggugaaagcuauauagucaucggagcaggagagaaagcacuuaaauuaaguugguucagaaaagggucgagcaucgguaaaauguuugaagccacagcgcggggugcacgcaggauggcuauacucggugauacagccugggauuucggaaguauaggaggaguauuuacauccguagguaagcuaguccaucagauuuucggaacggccuacggugucuuauuuuccgguguaagcuggacaaugaaaaucgguaucggaguuuugcuuacguggcuuggccuaaauaguagaagcacuucgcuuucuaugacuuguauugcuguuggccuugugacacuauauuuagguguaaugguacaggcugacucagguugcgugauaaauuggaaagggcgagaacucaaaugcgguaguggaauauuuguaacuaacgaaguucacacuuggacugagcaauacaaauuucaagcagacagucccaaacgauugucggccgccauagguaaagcaugggaagagggagucugcggcauccguucugcuacacggcuagaaaauauaauguggaaacaaauaucuaacgagcuaaaucacauauuacuggagaaugauaugaaguucacaguuguaguaggugauguugcagguauccuagcucaagguaagaaaaugauacgaccacaacccauggaauauaaauauaguuggaaaucuuggggcaaagcuaaaauaauaggagccgacgugcaaaauaccacauuuaucauugauggaccuaacacgccagaauguccggacgaccaacgagcauggaauauuugggaaguagaggacuauggguucggcauuuucacuaccaauauauggcuaaaacuuagggauucauacacccaaguuugcgaccauagacuuaugucagcagccauuaaagacucaaaagcaguccacgccgauaugggcuauuggauugagucagaaaagaaugaaacguggaaacuugcaagggccucguuuaucgaagucaaaacgugcaucuggcccaaaucacacacacucuggucaaauggcgucuuggaaagugagaugauaauccccaagauauacggagggccuauaucccaacauaauuauagacccgguuacuucacucaaacggcaggcccauggcacuuggguaagcuagaauuagauuucgaccuaugcgaaggaacaaccguugucguagacgaacacugugguaaucguggaccaagccuccgaacuacgacugucacgggaaaaauaauccacgaauggugcuguagaaguugcacacucccuccuuuaagauuuagaggugaggaugggugcugguaugguauggagauucgaccaguaaaagaaaaagaagaaaaccucgugaaaaguaugguaucggcagguaguggagaagucgacuccuuuucuuuagggcuacuuugcauuucaauaaugauagaagaaguaaugagaucgcguuggucuagaaagaugcuaaugacagguacguuagcuguauucuuucuauuaauuaugggacaguuaacauggaaugaccuaauccguuuaugcaucaugguuggggcaaacgcaucagaucguaugggcauggguacuacauauuuagcccugauggccacuuuuaaaaugagaccuauguuugcgguaggauuguuguuuagaagguugacuucacgugaagugcuuuuacuaacaauuggacuuucucuaguugcaaguguagaacucccuaauucccuggaagaacuaggggacggauuagccaugggaauuaugauccuaaaauuacuuaccgauuuucaaucgcaucagcuaugggcaacauuacucucccugacuuucauuaaaacgacguuuagccuucauuacgcauggaaaacuauggcaaugguuuugagcauaguuucccuauuuccucucuguuuaucaaccacgucacagaaaacgacauggcuacccguacuccuaggcagucucggguguaaaccgcuuacuauguuuuuaauugcagaaaacaagauuugggggagacguuccuggccauuaaaugaagggauuauggcaguaggcaucguuucuauacuuuuaucaucucuccuuaaaaacgaugucccauuagcagguccucuuauugcggguggaauguugauugcguguuacguaauaucaggaaguuccgcagaucugaguuuggaaaaagcggcagaagugaguugggaagaagaagcagaacauaguggagcaucacacaauauuuugguagaaguucaagacgacgguacaaugaaaauuaaggaugaggaacgggaugacacgcuaacuauccuacuaaaggcaacacuccuggcugucagcggcguauacccccucaguauaccggccacacuguuuguaugguauuucuggcagaagaagaaacaacgaagcgguguauuaugggacacaccaagcccaccagaaguugagcgagcaguccuggaugauggaauauaucggauaaugcaaagaggauuauuggguaggagucaaguagguguuggaguuuuucaagaaaauguuuuucacacuauguggcauguuacucgaggagcuguguuaauguaucagggaaaacgacucgaaccaaguugggcauccguuaaaaaggacuugaucucuuaugguggaggauggagacuacaagguuccuggaauacaggcgaagaagugcaagugauagcuguugagccgggcaaaaaccccaaaaacguccaaacagcgccaggaacguucaaaacgcccgagggugaaguaggugcuauugcucucgacuucaagccgggaacauccggguccccgauaguaaaucgugaagggaaaauagucggacuuuaugguaacgggguuguaacaacaucagguacauacguaagcgccauagcacaggcaaaagcaagucaggaaggaccgcucccugaaauagaagaugaagucuuuaggaaacguaacuugacaauaauggauuuacacccuggaucugggaaaacgaggagauaccuaccugcaauuguaagagaagcaauuaaaagaaagcuacguacacugaucuuagccccgacccgcguaguagcaucagaaauggcagaggcucuaaaaggaaugcccauuagauaccaaacaacugccgucaaauccgaacacacaggcaaagaaauuguggaccugaugugucaugcaacuuuuacaaugcgacuacucucaccggugcgagugccuaacuacaacaugauaauaauggacgaggcacauuucaccgauccauccaguauugcagccagagguuauauauccacgagaguugguaugggggaggcagccgcaaucuucaugacagcaacaccaccaggaucagucgaggcuuuuccacagucuaacgcuguaauucaggacgaagaaagagauauuccagagaggaguuggaauagcggauacgaauggaucacggauuuuccugguaaaaccguaugguuuguaccuaguauaaagucuggaaaugauauagcaaacuguuuaagaaagaauggaaaaagggugauucagcuuucuaggaaaacuuuugauacggaauaucagaaaaccaaaaauaaugauugggauuaugucgucacaacggacauaagcgaaaugggagccaacuuucgugccgauagaguuauagacccgcgaagguguuugaaacccguaauacuuaaagacgggccugaaagggugauauuagcaggaccuaugccugucacaguugcgucagccgcacaaagaagaggucgcauaggccgaaaccacaacaaagagggugaucaguauauauacauggggcaaccacugaauaacgacgaagaucaugcacauuggacugaagcaaaaaugcuguuagauaacaucaacacgccggaagguauuauuccugcacuauuugagccugaaagagagaaaagugcugcuauagacggagaauacagauuacggggagaagcuagaaaaacauucguagaacuuaugagacgcggagaccugcccguauggcuaaguuauaagguugcuagugaaggauuucaauauucugauagaagguggugcuucgauggcgaacgcaauaaucaaguuuuggaggaaaauauggacguagagaucuggacgaaagaaggcgaacgaaagaaacuuagaccucgauggcucgaugccaggaccuacagugauccgcuugccuuaagggaguuuaaagaauuugcagcaggacgacguucagucucaggagacuuaauccuugagaucggcaaauugccacaacaccuuacacaaagagcccaaaaugcacuugauaaucuugucaugcugcacaauucagaacaaggaggacgugcauaucgacacgcuauggaagaacuaccagacacuauugagacguuaaugcugcuagcccucauugcaguacugacuggagggguaacccuauucuuucuaucgggacgaggccuagguaagacaaguauagggcuccuaugcguuauggcaagcagcguccuacuuuggauggcuaguguugaaccgcauuggauugcagcgucaauaauuuuagaguucuuucugaugguauuacuaauucccgaaccugauaggcaacgcacaccccaagauaaucaauuggcauacguaguaauaggacuccuuuucaugauacuaacaguagcagcuaaugaaauggguuuauuagaaacaacaaagaaagaccuaggaauaggucacguagcaguugaaaaucaucaucaugcugcuaugcuagacguagauuugcaccccgcaucagcauggacauuauaugcagucgcaacgacaauuauaacuccaaugaugagacacacaauagaaaauacuaccgccaauaucucacucacagccauugcuaaucaagccgcaaucuuaaugggauuagauaaaggauggccuauaagcaaaauggacaucgggguaccgcuauuggcucuugguugcuacucacaaguaaacccacucacauuaacugcagccguacuaauguuggucgcacacuaugcaaucaucggaccaggacuccaagccaaagcuacuagagaagcccaaaaacgaacggccgcagggauuaugaagaauccuacuguagauggcauaguugcuauagacuuagacccagugguauaugacgcaaaguuugaaaaacagcuuggacagauaauguuacuaauacuauguacuucacaaauucuguuaaugagaaccacaugggcccuaugcgaaucuauuacacuggcaacaggaccacucacgacacuaugggagggcagcccaggaaaguuuuggaauacaacuauagcaguuucaauggcaaacauuuucaggggaucauaccuugcuggagcggguuuggcauuuucauuaaugaaaucuuuagguggaggcaggcgcgguacgggagcucagggcgaaacucuaggugaaaaguggaaacgccaacuuaaucaauugagcaaaagugaauuuaauacguacaagaggucuggaauuauggaaguagaucgaagcgaagcaaaagaaggguugaaacguggcgaaacuacuaaacaugcugucagucguggaacagcgaaauuacgaugguucguggagcgcaaucucgugaaaccugaaggcaaaguuauugaucuggggugugggagaggggguuggaguuacuauugcgcaggauugaaaaaggugacggaaguaaaaggauacacaaaaggaggaccaggucacgaagaaccaaucccgauggcaacauauggauggaaucuuguaaaguuacacuccggcaaggacguguucuuuauuccaccagaaaaaugugauacccuucucugcgauauaggagaaucuaguccaaacccuacaauugaagaaggucguacgcucaggguauuaaaaaugguagaaccaugguuaagaggaaaucaauucuguauuaaaauauugaaucccuacaugccauccguuguagaaacucuggaacaaaugcaacgcaagcacgggggcaugcuaguaaggaauccccugucucguaauucaacgcacgagauguacuggguuucuugcggaacugggaacauugucucugcagucaauaugacaucucgaaugcuacuuaacagauucacaauggcacaccgcaaaccaacauaugaacgugauguggaucuaggagcagggacgaggcaugucgcugucgagccagagguggcuaaucuugacaucauuggccaacggauagaaaacauaaaacaugaacauaaaucaaccuggcauuaugacgaagauaauccuuauaagaccugggccuaucauggaaguuacgaggugaaaccaucgggauccgcaagcucuaugguuaacgguguugucaaauuguuaacaaagccaugggacguuauaccaauggucacgcagaucgcaaugacggacacaacacccuuuggucaacaaagaguauuuaaagaaaaaguagacaccagaacaccaaaagcuaaaagagguacugcucaaauaauggaaguuacagcaaaguggcuuuggggguucuuaaguaggaauaagaaaccuaggauuuguacacgagaggaauuuacucggaaagugcgaucaaaugccgcuaucggagcaguuuuuguggaugaaaaucaauggaacucagcaaaagaggcuguagaagacgaaagauucugggauuugguacaccgagaaagagaauuacacaaacaagggaaaugugcgacaugcguauacaauaugauggguaaaagagagaaaaaguuaggcgaauuuggaaaggcgaaaggaagccgcgcaauuugguauauguggcuuggggcucgauuucucgaguucgaagcauuagguuuuaugaaugaagaucauugguuuuccagagaaaacaguuugaguggaguagagggagaagguuuacauaaacuaggcuauauauugcgagacauuucaaaaauaccaggaggaaauauguaugccgacgacacagccggaugggauacaagaaucacggaggacgacuuacagaaugaagccagaauuacugauauaauggaaccagaacaugcgcucuuagcaaaaagcauauuuaaauuaacuuaucaaaacaaaguaguaagaguacagagaccggccaaaaaugggacugucauggauguaauuucccgccgggaucaacgggguagcggucaaguaggaacauacggauuaaauacauuuacuaacauggaagcccaauugauaaggcaaauggagagugaaggcauauucucaccaucagaacuugagacaccuaacuuggcggaaaggguauuggauugguuagaaaaauauggcguagaaagacuuaaacgaauggcaauaucuggugaugacugugugguaaagcccauagaugacagauuugcaacagcacucacagcucuaaaugauauggguaagguccguaaggauauuccccaaugggaaccgaguaagggauggaaugauuggcaacaagugcccuuuuguagccaccauuuucaucagcuuauaaugaaagacggcagagagauaguaguuccgugucgaaaccaagaugaacucgucgggagagcacguguaucucagggugcuggguggagucuaagagaaacggccugccuugggaaaucauaugcacagauguggcaguugauguacuuucacagaagagaucuaagauuagcagccaacgcaauaugcagugcugugccaguagauuggauuccgacgagucguacaacaugguccauucaugcacaucaucaauggaugacgaccgaagacaugcuuucuguauggaaucggguauggauugaggagaacccauggauggaagauaaaacacauaucucgucauggggagacgugccuuauuugggcaaacgcgaagaucaaugguguggcaguuuaauagguuugacagcuagagcaacgugggcaacuaauauacaaguagcaauaaaucaaguccggagguuaauuggcaaugaaaauuacuuagacuauaugacaucaaugaaacgguuuaaaaaugaaucagaaccagaaggugcacuaugguaa

SEQ ID NO: 21698 - RNA, 9879 nt, Artificial Sequence
  derived and/or modified CDS sequence (opt6) from DENV-1__FJ882554__SS-prME
ucaguuacaauguugcuaauguuaaugccgacugcacuggcuuuucaucuaacuacgagagggggcgaaccccacaugauuguaagcaaacaggaaagagggaaaagccuacuguuuaaaacaagugccggugucaauaugugcacauugauagcaauggacuuaggagaauuaugugaggacacaaugacauacaaauguccacguauuacugagacugaaccagacgacguagauugcuggugcaacgcaacggauaccuggguuacauacgguacgugcagccagacaggugagcaucggagagacaaaagaaguguugcacuugcaccacauguagguuuaggacuagaaacacgaacagaaacauggaugaguagugaaggugcauggaaacaaauacagcgaguugaaacaugggcacuuagacacccugguuuuacaguaauugccuuauucuuagcucacgcuauugggacaagcauaacgcaaaaagggauaauauuuauccuacuaaugcuagugacaccaucgauggcuaugaggugugucggcaucggcucgagagauuucguugagggauuauccggagcuacuugggucgacguugucuuagagcaugggucaugcgugaccaccauggcaaaagauaaaccaacacucgauaucgaacuuuuaaaaaccgaagucaccaaccccgcuguucuacgcaaauuauguauagaagcaaaaauuucuaauaccacaaccgauucucgaugcccaacucagggugaagccacgcuuguugaagaacaagacgcuaacuuuguuuguagacgcacauucguagaucgaggguggggaaacgggugcggacuauuugguaaaggcucacuaauaacaugugcaaaauucaaaugugucacaaaauuagaagguaaaauaguucaauaugaaaaccugaaauacaguguaauugugacgguacauaccggagaucaacaccagguggggaacgaaaguacagaacauggaacaacggccacaaucacuccacaagcaccaaccaccgaaauccaacucacagauuacggcgcacuaacauuagauuguuccccaaggacgggacuagauuucaacgagaugguuuugcuuacaaugaaggaaaaaucauggcuaguacauaagcaaugguuuuuagacuuaccccucccauggacaucuggagcaaguacaucucaagagacauggaaucgucaagaucucuuaguaacuuucaaaacugcacaugcuaagaaacaagaaguuguuguauuaggaucacaggaaggagcaaugcauacugcacugaccggcgcaacugaaauacagaccagcggaaccacaaccauauucgcugggcaucuuaaauguagguuaaaaauggauaaacucacauuaaaggggaugucauauguaaugugcacaggcagcuucaaauuagaaaaagagguugcagaaacccaacaugggacaguacugguacaaauaaaauaugaaggaacugaugcaccauguaaaauaccauucuugacgcaagaugagaaaggagugacacaaaacggucgucuaauaacugcaaacccuauaguaaccgacaaagaaaaaccagugaauaucgaggccgagccaccauuuggugaaaguuauaucguaauuggggccggcgaaaaagcacuuaaacuaagcugguucaagaaagguagcagcauaggcaagauguuugaggcaacagcacgaggugccagaaggauggcgauauuaggugauacagcuugggauuuuggaucuauaggugggguuuuuacuagcguaggaaaacucguacaccaaauuuuugguacagcuuauggagugcucuuuucuggaguaucauggacaaugaagauuggaauuggaguauuacuuaccuggcuaggucuaaauucaagaagcacuucccugucuaugacauguaucgcggucggccuuguaacucuuuacuugggagucaugguccaagcggacucaggauguguaauaaauuggaaagguagggaacuaaaaugugguucuggcauauuuguaaccaacgagguccauacauggacagagcaguacaaauuucaggcggauuccccaaaacgcuuguccgcugcuaucggaaaagcaugggaagaaggaguguguggaauaaggagugcaacgagauuggagaacauaauguggaaacagauuucaaacgaacucaaccauauucuauuagaaaacgacaugaaauucaccguaguaguuggugauguggccgguauccuagcacaagguaagaaaaugauuaggccacaaccuauggaauacaaguacucauggaagucgugggguaaggcgaaaaucauuggcgcagauguccaaaauacuacguuuauaauagauggcccgaacaccccggaaugcccugacgaucagcgcgcguggaacauuugggaagucgaagauuauggauuuggcaucuuuacaacgaauauuuggcuuaaacuacgagacaguuauacacaaguaugugaccaccgucuuaugucugcagcuauaaaagauucuaaagcgguucacgcagauaugggauacuggauagaaagcgagaaaaaugaaacguggaaacuggcgcgggcauccuuuaucgaggugaaaacuuguauauggccaaaaagccauacuuuauggaguaauggaguucuggaaagugaaaugaucauaccuaaaauauacggaggaccuauuucccaacauaauuaccgaccgggauacuucacacaggcagcuggcccauggcacuugggaaaguuagaauuggauuucgacuuaugugaaggaacuacagucgucguagacgagcauugcgggaacagaggaccaagccuucgaacuacaacgguuaccgguaaaauaauacacgaaugguguuguagaucaugcacuuuaccaccuuuacgauuccguggugaagacgggugcugguauggaauggaaauucgaccgguaaaagaaaaagaagagaauuuagucaaaagcaugguaagugcuggcucuggagaagucgacucauucucguuggggcuacuuugcauuucuauuaugauagaagaaguuaugcgauccagauggucgaggagaaugcugaugacagggacgcuagcaguauucuuucuucuuauuaugggacaauugacuuggaacgaucucauaagauuguguauaauggugggggcuaaugcuuccgaccgaaugggaaugggaacuacauauuuggcacuuauggccaccuucaaaaugcgaccuauguucgcgguaggacugcuauuuagaagauuaacaucgagggaggucuuacucuuaacaauugggcuuucacuuguagccucaguagaauuaccaaauucccuagaggaauuaggcgacgggcucgcuaugggcauaaugauuuuaaaacuacucacagauuuccagucacaccaacuuugggcuacacuccuaucuuugacauuuauaaaaacuacauuuagucuucauuaugcauggaaaacgauggccauggugcucagcaucgucucauuguuuccccuuugucucagcacuacuucccaaaagacaacauggcugcccguccugcuuggcucauuaggcuguaaaccgcuaacaauguuucuuauagcagaaaauaagauuugggggagaagaucauggccccucaacgaaggaauaauggcugugggaauaguaucaauacuauugucaagucuccucaaaaaugaugugccguuagcagggccacuaauagccggaggaaugcuaauagcuuguuacgugauaaguggaucuagugcggauuuaucacuugaaaaggcugcggaagugucaugggaagaggaagcagaacacucgggcgcaucucauaacauccuggucgaaguucaagacgacggcacaaugaaaauaaaggaugaggagagggacgauacguugacuaucuuacuaaaagcgacauuacuagcaguaucaggaguauauccguuaucaauaccugcaacacucuucgucugguauuuuuggcagaaaaagaaacagcguaguggcguuuuaugggauacaccuucuccacccgagguugaacgugcaguauuagaugauggaauauaucgaauuaugcaacggggauuacugggucgaucacaaguuggaguggggguguuccaagaaaacguauuucacacaauguggcacgucacucgaggagcaguacugauguaucaggguaaacguuuagaaccaaguugggcaucaguuaagaaagaucuaauaagcuacggaggaggguggagauuacaaggcucauggaauacaggggaagaggugcagguaauugcgguugaaccggggaaaaauccuaaaaauguccagacggcgccuggaacauuuaaaacuccugagggugaaguuggagcaauagcccuagacuucaaaccaggaacuagcgguaguccuauuguuaauagggaagguaaaaucguagggcuuuacggcaauggugugguuacgacgagcggaacauaugugucagcgaucgcucaagcaaaagccagccaagaggguccguuaccagagaucgaagaugaaguauuccgaaaaagaaauuuaacuauaauggacuugcauccagguagcgguaaaaccaggcgauauuuaccugcuauagucagagaggcgauuaaaagaaaauugagaacccugauauuagcaccaacuagggugguagcaagcgaaauggcagaggcuuuaaaagggaugccuauaagauaucaaacaacagcaguaaaguccgagcauacaggaaaagaaauuguagacuuaaugugccaugcgacguucaccaugagauuacuuagcccugugaggguaccaaacuacaacaugauaauaauggaugaagcccauuuuaccgauccuuauagcauugcugcacgcggguacauaaguacuagggucgggaugggcgaagcggcagcaauauucaugacugcaaccccucccggaagcguggaggcuuucccccaaucaaaugcaguaauaaaggaugaagaaagagauauacccgaaagguccuggaauagugguuaugaguggauaaccgauuuuccuggcaaaacaguuugguucguuccauccaucaaaaguggaaaugauauagcuaacugcuuaaggaaaaauggcaaaagaguaauucaguuaaguagaaagacuuuugacacugaauaucagaaaaccaaaaauaaugacugggauuauguuguaacgacugauauaagcgaaaugggcgccaauuuuagagcggauagaguuauagacccacgcagaugucuaaagccagucauccuaaaagauggaccugaaagaguaauacuagcaggaccuaugccgguuacugucgcgucagcggcacaaagaagaggcaggaucggcagaaaucacaacaaagaaggugaccaauauaucuacaugggacaacccuuaaauaacgacgaagaucaugcgcacuggacagaagcuaagauguuacuagauaauauuaauacgccagaaggcauaauaccagcguuguuugaaccugaaagggaaaagucugcagcuauugacggcgaauacagacuuagaggagaggcacggaagacuuucguugaacuaaugcgacguggagauuuaccuguauggcuaaguuauaagguagcuucagaagguuuucaauacucagaucggcgcugguguuucgacggugaaagaaauaaucagguacuggaggaaaauauggauguugaaaucuggacgaaagagggcgaaaggaagaaauuaagaccgaggugguuggaugcaaggacauauagugauccuuuagcccuaagagaauuuaaagaauuugcugcaggaaggagaaguguaucaggggaucucauucuugagauuggcaaguuaccgcagcacuuaacacaaagggcacagaaugcucuugacaaucugguaauguugcacaauucugaacaaggagggagagcauaccgacaugcgauggaggaauuaccggacacaauugaaacuuugaugcuacuagccuugauugcaguacugacuggagggguaacacuauucuuucuauccgggagaggauuaggcaaaacaucgauaggauuauuaugugucauggcauccaguguacugcuuuggauggcaucaguagaaccccauuggauagcugcaucuauaauucuagaauuuuuccuuaugguuuuauugauaccugagccagacagacaacguaccccacaggacaaucaacuugcuuacguuguaauaggacuacuauuuaugauuuuaacaguagcugccaaugaaaugggacuguuggaaacgaccaagaaagaucuaggcauaggacauguagcugucgagaaucaccaucacgcggccauguuggauguggaucuacauccugcaagcgcuuggacuuuauacgcaguagcaacuacuauaaucacgcccaugaugaggcauacgauagagaauaccaccgcgaauaucucauugaccgcgauugcuaaccaggcagcaaucuuaaugggucucgauaaaggauggccuauuaguaaaauggacaucggcguuccauuguuggcgcuaggcuguuacagucagguaaacccuuuaacucugacagcagcaguucuaauguuaguagcucauuacgcgauaaucgguccgggacuacaagcaaaagcgacaagagaggcacaaaagcgaaccgcagcaggaauaaugaaaaaucccacaguagacgguauuguugcaaucgaucuagauccaguuguguacgacgccaaguuugagaaacaauuggggcagauaaugcuguuaauacuaugcacgagccagauucuccuaaugaggacuacgugggcauuaugugaaagcauaacucuagccacaggcccccuaacaacuuuaugggagggaagcccuggaaaauucuggaauacaaccauugcuguauccauggcaaacauauucaggggaagcuaccuagcaggggcuggacucgcguucagucuuaugaaaagucuaggagguggccgacggggaacaggggcacaaggggaaacucucggcgaaaaguggaaaagacaacuaaaccagcuauccaaaagcgaguuuaacacauauaaaagaucggguauaauggaaguggauaggagugaggccaaagagggucugaaaagaggugagaccacuaagcacgcggugagcagaggcacagccaaguuaagaugguucguagagagaaaucuagucaaaccagaagggaagguaaucgaucuaggcugcggaagaggaggauggucuuacuacugcgcaggucuaaagaaaguaacagagguaaaaggauauacgaaaggagguccagggcacgaagaaccaauuccuauggcaacuuaugguuggaaucuaguaaaauugcauucaggcaaagauguguucuuuauaccgcccgagaaaugugauacacuucuaugugauaucggggaaucuucuccuaauccaacaauugaagaagggagaaccuugagaguguuaaagauggucgaacccugguuaagagggaaucaauuuuguauaaagauucuaaauccguauaugccuucugugguugagacauuagaacagaugcagagaaaacauggcggaauguuagugaggaauccucuaagcagaaauaguacacaugagauguauugggucaguugcgguacuggaaacauagucagugcuguaaauaugacaaguaggauguuacuuaacagauucaccauggcgcacaggaaaccuacguacgaaagggauguugaccuaggugcagguacaagacauguagcaguggagccagaaguagcuaaccucgauaucauaggacagcggauagagaacaucaagcacgagcacaagucuacauggcacuacgaugaagauaauccauauaaaacaugggcguaccauggaaguuaugaaguuaaaccaucaggcagcgcuagcucgauggucaacggcguggucaaauuauuaacgaaaccaugggacguaauaccuaugguaacacagauagcgaugacugauaccacgccauuuggucagcaaaggguauuuaaagaaaaaguagacacaagaacaccaaaagccaaacgagguacagcucaaauaauggaaguaacggcaaaauggcuguggggauuuuuaucaagaaauaagaaaccaaggaucuguacacgugaggaguuuacaagaaaaguaaggucgaacgcagcaauuggggcuguuuuuguugacgagaaccaauggaacucagcuaaagaggcuguggaagaugagagauuuugggaccuaguacaucgcgaaagagaauugcauaaacaagggaagugugcgacguguguguauaauaugauggggaaacgcgaaaagaaacucggagaauuugggaaagcgaaaggaucgagggcuauaugguacaugugguuaggagccagauucuuagaguucgaagcacucggauuuaugaaugaagaccauugguuuagccgugaaaauucacucucuggagucgagggcgaaggacuucauaaauugggauacauacuucgugauauauccaagauuccgggaggcaauauguacgcagaugauacagcggguugggauacaaggauaacagaggacgauuuacaaaaugaggcccgaauaacagauauuauggaacccgagcacgcguuacuagcaaagucaauuuuuaagcugacauaccaaaauaaaguaguaagaguccagcguccagccaaaaacggaacagucauggacguuauuucacgaagagaucaacgggguaguggacaaguagguacauaugguuuaaauacauuuacuaacauggaagcccaguuaauccgccaaauggaauccgaggggauuuuuagucccagcgaauuggaaacgcccaacuuagcggaacgaguacuagauugguuagagaaauaugguguagagagauugaaaagaauggcgauaagcggagacgacuguguugugaaaccuaucgacgauagauucgcuaccgcacugaccgcauuaaacgauaugggaaaaguuagaaaggacauuccucaaugggagccgucgaaagguuggaacgacuggcaacaagucccauucuguucccaccauuuucaccaacuaauaaugaaggacggaagggaaauagugguuccuuguagaaaccaagacgaauuagucgguagagcacgcgucucucaaggagccggguggagcuuacgagaaacagcgugcuugggaaaaucuuaugcgcagauguggcaguugauguauuuucauaggagggaucuacgacuagcagcgaacgcaauauguuccgcuguaccuguagacuggauaccuacauccaggaccacuuggucuauccacgcacaccaccaauggaugacaacugaagacaugcucaguguauggaaucgaguuuggauagaggaaaaucccuggauggaagauaagacacacauauccucuuggggagacgugcccuacuugggaaagcgagaagaccaauggugugguucacugaucggacuaacggcucgugcaaccugggccaccaauauccaaguagcaaucaaucaaguaagacgccuuauagggaacgagaauuauuuagauuacaugacaaguaugaaacgauucaaaaacgaaagcgacccugagggggcauuaugguaa

SEQ ID NO: 21699 - RNA, 9879 nt, Artificial Sequence
  derived and/or modified CDS sequence (opt6) from DENV-1__GQ868610__SS-prME
aguguaacgaugcuuuugaugcuaaugccaacggcauuagcauuccaucuaacuacuagaggaggggaaccacauaugauuguaacuaaacaagaaagagguaaaucuuuauuauucaaaacaagugcuggagucaauauguguacccucauagcaauggauuuaggugaauugugugaagauacaaugacuuacaaaugcccuagaauuacugaagcagaacccgacgauguagauugcugguguaacgcaacggacacauggguuacguacggaacuuguagucaaacgggagaacacagaagagacaaaagaaguguagccuuagccccacauguggggcucggauuagaaacuagaacagaaacauggaugucaagugaaggugcauggaaacaaauacaaaggguugaaaccugggcacuuagacauccaggauuuacagugauagcccuauuccuggcucaugcuaucgggacgaguauuacccaaaaaggaaucauuuuuauauugcuuaugcuaguuacuccuaguauggcaaugcgcugcguaggaauaggcucuagagacuucguugaaggcuuauccggggcuacauggguagauguaguucuagaacacggaucguguguuacuaccauggcaaaagauaaaccgacuuuagauauugaacuacuuaaaacugaaguuacgaacccagcaguauuaagaaaauuaugcauugaagcaaaaauuucuaacacaacaacagauaguagauguccaacgcaaggcgaagcuacgcuaauggaagaacaagaugccaacuuuguuugccguaggacuuuuguugaccgaggauggggaaauggcuguggcuuauucgguaaagguucuuuaauuacaugugcaaaauucaaauguguaaccaaauuagaaggaaaaauaguccaauaugaaaacuuaaaguacagugugauuguaacuguacacacaggugaccaacaccaggucggaaaugaaagcacggaacacgguacgacugcuacaauuacuccucaagccccaacuucggaaauacaauugacugauuacggagcacugacccuggacugcaguccgcgaacaggacucgacuuuaaugaaaugguucugcuaacaaugaaggagaaaaguuggcuaguccauaagcaaugguuuuuagaucuaccacuaccuuggacaucuggggcgucaacaucacaagaaacauggaacaggcaagauuuacuugucacauuuaaaaccgcucacgcaaagaaacaagaaguugucguccuuggaagccaagaaggcgccaugcauacagcguugaccggugcaacugaaauucagacgucagguacaacgacuaucuucgcuggacaucucaaauguagacugaagauggacaaauugacacugaaaggaaugucguauguuaugugcacuggaucauuuaaauuagagaaagaaguagccgaaacacagcauggaacaguacugguccaaaucaaguacgagggaacugaugcaccaugcaaaaucccauucucaacacaagacgagaaagguguaacacagaacgguagacugauuacugcgaauccgauagugacugauaaagaaaaaccggucaauauagaggcagagccaccauucggagaaucuuauauuguuauaggugcgggggaaaaggcauuaaaauugucaugguuuaagaaagguucaucuaucggcaaaauguuugaagccacagcuagaggcgcuaggaggauggcaauucuuggcgacacagcuugggauuuuggguccauaggcggcguauuuacaucgguagguaaacuuguucaccagauuuuuggaacagcauacgggguguuguucucaggcgucucauggacuaugaaaaucggcauaggcguacuuuugacauggcuuggcuuaaacucacgaaguaccagucuaagcaugacauguauagcagucgggcugauuacacuuuaccugggagucaugguacaagcagacucugguuguguaauaaauuggaagggaagagaacuuaagugcgggaguggcauauuuguaacgaacgagguucauacuuggacugaacaauauaaauuccaagcugacaguccgaaaagacuaucugcggcuauuggaaaagcaugggaagaaggugucugcggaauacguagugcgacuaggcuagaaaauauaauguggaaacaaauaucgaacgaguuaaaucauauauuacuugagaaugacaugaaauucacggucguggucggggauguuguagggauauuagcucaagggaagaagaugauucguccccaaccaauggaacacaaguauagcuggaaauccuggggaaaagcgaaaauuaucggagcagacgugcaaaauacuacuuucauaauugauggucccaauacaccagagugucccgacgaucagagagccuggaauauuugggaaguggaagacuauggcuuugguauauucacaacgaauauaugguugaaacugagagauaguuauacccaaguaugugaucacaggcuuaugucagccgcaauuaaagauucaaaagcagugcaugcagacaugggauacuggauagaaagcgagaaaaaugagacguggaagcuggcgagagcaucguuuauagaagugaaaacaugcauauggccaaaaagucacaccuuguggucaaauggaguucucgaaucagaaaugaucauaccaaaaauauauggcggaccuauuucgcaacacaauuauagaccaggguauuuuacgcaaacugcaggcccguggcauuuaggaaaacuugaauuggauuuugauuugugcgaaggaacaaccgucguagucgacgaacauugugguaacagagggccaucgcugcguacaacaaccguuaccggaaaaauuauacaugaaugguguugcagaaguuguacccuuccaccauuacgguuuaaaggagaagauggauguugguacggaauggaaaucagaccaguuaaggaaaaggaggaaaacuuagugaaaagcaugguaucagcuggauccggugagguagacucauucucccuaggauuacuauguauaaguauaaugauugaagaaguuaugcgaucaagguggucacgaaaaaugcugaugacuggaacucuggcaguuuucuuauuguuaauuaugggccaauuaacuuggaaugaucuaauuagacuuuguauaaugguaggggcaaaugccagugaucgaaugggaaugggcacuacauaucucgcacuaauagcaacuuuuaaaaugagaccaauguuugcugugggcuuguuauucagaaggcuaacuucaagggaaguacuacugcuaacaaucggucuaagccuaguagcaucaguugaacuuccuaauucucuagaagaacuaggagauggauuggcuaugggcauuaugauuuuaaaacuccucacugacuuccaaucacaccaauuaugggcuacauuguuaucauucacauucauuaagacuacauuaagucuacacuaugcuuggaaaacuauggcgauggugcuuucaauagucaguuuauuuccccuaugucugaguacaaccucucagaaaaccacauggcuaccaguacuauugggaagucuaggaugcaaaccguugacuauguuuuugaucgccgaaaauaagauauggggccgaaaaagcuggccucuuaaugaaggaauaauggcaguuggugugguuucaauuuuacuaucaucucuacucaagaaugauguaccgcuagcgggaccauuaaucgcuggcggaaugcuuauagccuguuaugucaucucagguaguagugcagacuuaucauuagaaaaagcggcggagguauccugggaggaagaagcagaacauaguggugcaucacacaauauacuuguugaagugcaggacgauggaacgaugaaaauaaaagaugaagaacgugacgauacacugacuauucucuuaaaagcaacacuccuagcaguuagcggcguauauccguuaagcauuccagcaacauuauuuguuugguauuucuggcagaagaagaaacaaagaaguggcguauuaugggacacgccgucuccaccugaaguagaacgagcaguauuagaugauggaaucuaucgaauaaugcagcgaggauuauuaggaagaagccaaguggguguaggcguauuucaagagaacguuuuucauacgauguggcaugucacacgcggagcuguucugauguaucaaggaaaacgacuugagccuucaugggccucaguaaagaaagauuuaauaaguuauggcggggguuggaggcuucaagguucguggaauacuggcgaagagguucaagucauagcuguagaaccggguaaaaaucccaaaaauguccagacagcaccaggaacauucaaaacgcccgaaggugagguaggagcgaucgcgcucgacuucaagccaggaacaaguggcucaccaauuguaaaccgugaaggcaaaauuguuggucuuuauggcaacggcguuguaaccacaagcggcacauauguaagugcuaucgcacaagccaaggcuucucaagaaggcccucuuccagagaucgaagaugaaguguuccguaaaagaaacuugacuauaauggacuuacauccaggcagcgggaaaacgcgacgcuaucuuccagcuauaguccgagaagcaauaaagagaaaauuacguacacucauacuagcucccaccagaguaguagccucagaaauggcggaagcauuaaaagggaugccaauacgauaucaaacuacugcggucaagagugagcauacaggcaaagaaaucguugauuugaugugucacgccacuuucaccaugcgguuauuaucaccaguuaggguaccaaacuacaauaugauuauaauggacgaagcacauuuuacagaucccucaagcauugcagcccgaggguacauaaguacuagagugggaaugggggaggcugcagcaauuuucaugacagccacucccccaggaaguguugaggcuuucccacaaucuaaugcaguuauacaagaugaggaacgagacauaccagaacggucuuggaacucuggauaugaauggauaacggauuuuccaggaaaaacagugugguucgucccaucuauaaaauccgguaaugacauagccaauugccugagaaagaauggcaaacgcguaauacaguuaucgcgaaaaaccuuugacacagaguaucagaaaaccaaaaacaaugauugggauuacguuguuacgacagacauaucagagaugggggcgaacuuuagagcggauagaguuauagacccacgccgaugucuaaagccaguaauuuugaaagauggaccggagagaguaauuuuagcggggccuaugccuguaacugucgcaucggcagcccaaagacggggccguauagguagaaaccauaauaaagaaggagaucaauauauauacaugggacagccauuaaauaacgacgaggaccacgcucauuggacagaggcaaaaaugcuucuagacaauauuaauacaccagaaggaaucaucccggcuuuauuugaaccagaaagggagaaaagcgcagcaauugacggugaguauagacuaagaggcgaggcaagaaaaacuuucguggaauuaaugcguaggggagauuuaccaguuugguuaaguuacaaagucgcaucugaaggauuucaguacagcgaccggcguuggugcuuugauggggaacgcaauaaccaaguuuuggaagaaaacauggaugucgagaucuggacuaaagaaggagaaaggaagaaacucagaccaagauggcuugaugcuagaaccuacagcgauccuuuggccuugagggaauuuaaagaauuugccgcaggaagaagguccguuuccggagaucuaauuuuggaaauuggcaagcucccccaacaccuuacccaaagggcacagaacgcacuagauaauuuggugauguuacauaauucagaacaaggugguagagcauauaggcaugcaauggaggaacuuccagacacuauagaaacauuaaugcuauuagcuuuaauagcgguauuaacuggaggaguuacacuauucuuucugucagggagagggcucggcaaaacaucaauaggcuuauuguguguaauggcguccucgguucuauuauggauggcguccgucgaaccacauuggauagccgcaaguaucauauuagaguuuuuccugaugguauuacuuaucccggagccugauagacaaaggacaccacaagauaaucagcucgcuuacguaguuauugggcuacuuuuuaugauccuuacaguggcagcuaaugagaugggauuauuagaaacuacgaaaaaggaccuugguauugggcacguagcaguugagaaccaccaucacgcaacuaugcuggauguagaucuccacccggccagugcauggacgcuauacgcgguagcgacaacgauuauuacaccaaugaugagacauacgauagaaaauacaacugcuaacaucuccuuaacagcgaucgcgaaucaggcagcgauuuuaaugggacuugacaaaggauggcccaucuccaaaauggauauuggaguaccacuauuagcacuagggugcuauagccaagucaacccgcuuaccuuaacugcagcgguacuaaugcuaguugcgcauuacgccauaauuggucccggauuacaagcuaaggcuacuagggaagcacagaaacguaccgcagcagguaucaugaagaauccgacuguagauggaauaguagccauugauuuagauccuguaguuuacgaugccaaauuugaaaaacagcucggacaaauaauguugcuaauucucuguacaucccagauucuucuuaugaggacuacaugggcccuuugcgaaucuauaacucuugccacgggaccuuugaccacauuaugggagggaucgccugguaaguucuggaauaccacgaucgcaguuuccauggcuaacauuuuuagagguaguuaucuagcgggcgcugguuuagcuuucucauuaaugaaaucauuagguggggguagacgggggacuggcgcccagggggaaacucuuggugaaaaauggaagagacaacuuaaccaauuauccaaaucugaguucaacacuuauaaacggaguggaauaauggagguugauagaagugaggcaaaagaaggucuaaagcguggggaaacgacucgacacgccguuagcaggggaacagccaaacuuagaugguucguagaaagaaaucucgucaaaccagaaggaaaaguuaucgauuuaggauguggucgaggcggauggagcuauuacugugcaggacuuaagaaagucacugaaguuaaaggauauacuaaaggcgguccuggccacgaagaaccgauuccaauggcuacauacggauggaaccuaguaaagcuacauucaggaaaagacguuuucuuuaccccaccggagaagugugauacgcuuuuaugugacauaggcgaauccucacccaaucccacgauagaggaagguaggacauuaagaguacuaaagaugguagaaccaugguuaagggggaaucaguuuugcauuaaaauucuaaaccccuacaugcccucaguagucgaaacucuagaacaaaugcaaaggaagcauggugggauguuggugcggaauccccugagccguaauucaacgcacgagauguauuggguaucuuguggaaccgguaauauaguaagugcaguaaauaugaccagucguaugcucuugaaucgcuuuacgauggcucauaggaaacccacauacgagagagacguagaccugggcgcaggaaccagacauguagcuguugaacccgaaguagccaauuuagauauuauaggacaaagaauugaaaauaucaaacacgaacacaagucgacguggcacuacgaugaagauaacccauacaaaacuugggccuaucaugguucguacgaagugaaaccgaguggaucugcuaguagcaugguuaauggaguuguuaaauuauuaacaaagccaugggauguuauuccgauggucacccagauagccaugacagacacgacaccuuuuggccaacaacgcguguucaaagaaaagguagauacucgaaccccaaaggccaaaagagguacugcacagaucauggaagugacggcgaaauggcucugggguuucuugucccgcaacaagaaaccuaggauaugcacgagggaagaauuuacuagaaaaguacguucaaaugccgcaauaggagcuguuuucguagacgaaaaucaguggaacucggccaaggaggcaguugaggacgaaagguucugggaccucguccaaaaagaacgugaacuucacaaacaagguaagugugcaacauguguuuauaauaugaugggaaagagagagaagaaauuaggcgaauuugggaaggccaagggaucgcgggcaauaugguauaugugguugggagcuagguuuuuagaguucgaggcgcucggauucaugaacgaagaucauugguuuaguagggagaacucuuugucaggagucgaaggagaaggccugcauaaacugggauauauucugagagauauaaguaaaauaccuggaggaaacauguacgcugaugacacugcuggaugggauacuaggaucacggaagaugaccuccaaaacgaagcuaaaauuacagacauaauggaaccagaacacgcuuuguuagcaacaaguauauucaaacuaacuuaccaaaauaaaguuguaaggguacaaaggccagcgaaaaauggcacaguaauggauguuaucagucgucgcgaccaacgugggaguggccagguaggaacuuauggauuaaacacuuuuacuaacauggaggcgcagcuuauaagacaaauggaaagugaaggcauauuuuugcccucagaauuggagacaccuaacuuggcagaaagaguacuagacuggcuggagaaguacggaguagaaagauuaaaacgcauggcaauaagcggcgaugauugcguaguaaagccuaucgaugaccgauuugcaacugcauugaccgcauuaaacgauaugggaaagguacgaaaagacaucccucaaugggagccaucuaaaggauggaacgacuggcaacaagugccauucuguucucaucauuuccaucaacuuaucaugaaagacggacgggaaauaguaguuccgugcagaaaccaagacgaguuaguuggucgagcacgagucagucaaggugcugguuggucauuaagagaaacggcaugucuaggcaagaguuacgcccaaauguggcagcugauguauuuccauagacgggaucuccgacuugcugcaaacgccauauguagugcaguaccaguggacugggugccgacaucucgcacuacguggaguauucaugcacaccaucaauggaugacuacagaagauaugcucucaguauggaaucguguauggaucgaagaaaacccguggauggaagauaaaacacauguaaguucguggggagauguaccauacuuggguaaacgagaagaucaauggugcgguuccuuaauaggacuaaccgcaagagcaacgugggcaucuaacauccaaguugcaauuaaccagguaagaagacuaauuggaaacgaaaauuacuuagauuauaugacgucgaugaagagauucaaaaacgaaggagauccugagggggcccuaugguaa

SEQ ID NO: 21700 - RNA, 9879 nt, Artificial Sequence
  derived and/or modified CDS sequence (opt6) from DENV-1__GQ868611__SS-prME
ucaguaacuauguuuuuaauguuaaugcccaccgcacuugcauuucauuuaacaacaagggguggagaaccucauaugauagucagcaaacaagaacggggaaaaucauuacuuuuuaaaacuucagccggugugaauauguguacacuuaucgcaauggacuuaggugaacuuugugaggauacgaugacauacaaauguccccgcauaacagaaacagaaccagaugacgucgacugcugguguaacgcaacagacacauggguuacuuacggaacuugcucacaaacaggugaacacaggcgugacaaaaggagugucgcguuggcuccucaugucggcuuaggacuugaaacaagaacagaaacauggaugucaagcgaaggagcguggaagcaaauacaaaggguagaaacaugggcuuuaaggcacccuggcuuuaccgucauugcuuuguuucuagcacacgcaauaggaacuucuaucacacaaaaagguauaauauuuauauuacuaauguugguaacgccaagcauggcaaugagaugcguagguauaggcucuagggauuucguggaaggacugaguggggcuacuuggguagacguaguacucgaacacgggucaugcguaacuacuauggcaaaagauaaaccaacauuagauaucgaacuccugaaaacugaaguaaccaauccagcaguauuacgaaaauuauguauagaagcaaaaauaaguaauacaacgacagacucuaggugcccuacacaaggagaggcuacuuugguugaagaacaagaugcuaauuucguaugcagacgaacuuuuguagaccgaggguggggcaacgguuguggcuuauuuggaaaaggcucacuaaucacaugugcuaaauucaaaugcguaacaaaauuggaagggaagauuguacaguacgaaaacuugaaguauaguguaauaguaacuguacauacgggcgaccagcaccaaguuggaaacgagucgacggagcauggaaccacagcgacuaucacuccacaagccccaacgacagagauacaguugaccgauuacggagcacuuacucuugauugcucaccuagaacgggauuagauuucaaugaaaugguuuuacugacaaugaaagagaaaaguuggcuaguccauaaacaaugguuucucgauuuaccauugccuuggacaagcggcgcaucuaccucucaagaaacauggaacagacaagacuuauuaguuacauuuaaaaccgcucacgcaaagaaacaagaggucguaguucucgguagucaagaaggagccaugcauacugcucuaacaggcgcaacagaaauucagacuucagggaccacaaccauuuuugccggccaucuaaaaugccgacuuaaaauggacaaguugacgcuaaaagguaugaguuacgucaugugcacuggguccuucaaacuugaaaaggaacucgcugaaacacaacacgguacggugcugguucaaauuaaguaugaaggaacagacgcuccauguaaaauaccuuuuucuacacaggaugagaaggguguuacacaaaacggaagacuaaucacagcaaauccaauugugacagacaaagaaaaaccaguuaacaucgaagccgagccaccauucggcgagucauacauaguuaucggugccggcgagaaagccuuaaaacucaguugguuuaagaaaggguccucgaucggaaaaauguuugaagcuacagcaagaggugcuaggcgcauggcuauuuugggugauacugcaugggacuuugguaguaucgguggaguguuuacaucaguaggcaaacucguucaccagauauucggaaccgccuauggcguauuguuuucagguguaucuuggacaaugaaaauagguauaggaguauuauuaaccuggcuaggucuuaauagucgaucaacuucauuaucaaugaccuguauagcaguuggccuaguuacauuguacuuaggugucaugguacaggcagauucaggcugugugauuaacuggaaggggagagaauuaaaaugugguagcgguauuuucguaacgaaugaagugcacacauggacugaacaguauaaauuucaggcugauaguccgaaacgucuuagcgccgcgauagguaaggcuugggaagaaggcguaugugggaucagaagugccaccagacuugaaaacauuauguggaaacaaauaucaaacgaauuaaaucauauacuguuagagaaugacaugaaauucaccgucguugucggagacguggcaggcauucucgcacaaggcaagaaaaugauaagaccccaaccaauggaauauaaauacucuuggaaauccuggggcaaagccaaaaucaucggugcggacguacaaaauacaacguuuaucauagauggaccaaacacgccggaaugcccugaugaccaacgcgcauggaauauaugggaagucgaggauuauggcuuugguauuuucacuacgaauauauggcuaaaacuaagagacucuuauacacaagucugugaucacagauuaaugucggcugcuauaaaggauagcaaagcaguccacgcugauaugggauauuggauagaaucagagaaaaaugagacauggaaguuagcgcgagcaucuuuuauugaaguaaagaccugcauauggccgaaaucucauacucuauggucaaacggggugcuagaaagcgaaaugauaauaccuaaaauauauggcggcccuaucucgcagcauaauuauagaccaggauacuucacacaaacggccggcccuuggcacuuaggaaaauuggaacuugauuuugaccuuugcgaagguacaacuguagugguugaugaacauugugguaauagaggccccagucuaaggacaacaacuguaaccggcaaaauuauucaugaaugguguugccgcucauguaccuugccaccccuucgauuucgaggugaagauggaugcugguacgguauggaaauucggccggugaaagagaaagaagagaaucuggucaaaaguaugguaucugcuggcaguggagaaguagauucuuuuucuuuaggauuacuguguauaucuauaaugauagaggaaguuaugagguccagauggagucgaaagaugcuuaugaccggcacauuagccguauucuuucuguuaauaaugggacaauuaacauggaacgaucucauaagauuauguauaaugguaggugccaaugcgucggaccgcaugggaaugggaacgacguaccuggcucuaauggccacauuuaaaaugagaccuauguucgcaguuggcuuacucuuuagacgacuaacuagccgagaaguccugcugcuuacgauagguuugagucucgucgcuagcgucgaauuaccuaauucauuagaagaacuaggagaugggcuagccaugggaauuaugauccuuaagcuauuaacugacuuucaaucacaccaguugugggcaacccuauugucauuaacauucauuaaaacaacauuuagucuacauuaugcuuggaagaccauggcaaugguguuauccaucgucagcuuguuuccauuaugccuaucuacaacgucacagaaaacaaccuggcuaccaguucuccuugguagucuaggauguaagccauuaacgauguuucuuauagcugaaaauaaaaucuggggucgccguuccuggccuuugaacgaggggauuauggcagucggaauaguaucuauccuguuaucaucccucuugaaaaaugaugugccucuagcagguccguuaauugcaggagggaugcugauugcaugcuauguaauuagugggaguucugcugauuuaagccuagagaaagcugcagaaguaucuugggaagaggaagcggagcauucaggggccucccacaacauccuaguugagguacaagaugauggaacuaugaaaauuaaagaugaagagagagaugauacauuaacuauuuugcucaaagcuacuuuauuagcaguuaguggagucuacccucuauccauucccgcaacacuuuuuguaugguauuuuuggcagaagaagaaacaacgaagcggaguucucugggacacuccauccccaccggaaguagaacgugcaguucuugaugauggaauauacagaauuaugcagcgaggcuuguuaggacgaucacagguuggagucggaguguuucaagaaaauguguuccauacaauguggcacguuaccaggggugccguauuaauguaccaagggaaacgucuugaaccaucaugggccucgguuaagaaagacuuaauuucauauggaggaggauggagguuacaaggcucuuggaacaccggagaagaaguucaaguaauagcuguagaacccggcaaaaaucccaaaaacguacaaacugcgccagggacauucaaaacgccagaaggagaaguuggagcaauagcacuugacuuuaaacccggaaccagcggcaguccaauaguaaauagagagggaaagauaguugggcuguauggaaaugggguagugaccacuucugguacauaugucucagcuaucgcucaagcaagagcgucucaggaaggaccauugccagaaauagaggacgagguuuuucgcaaacgaaaucucaccaucauggauuuacacccagguuccgggaagacccggcgauaucuacccgcaauuguaagagaggcuauuaaacgaaaacuccgaacauuaauacuagccccuacccggguaguagcgucugagauggccgaagcacuaaaaggaaugccaauacgguaccaaacuacugcugugaaaagcgaacacacuggaaaggaaauuguugaccugaugugccacgcaaccuucacuaugagauuguugagcccaguaagagucccaaauuacaacaugaucauaauggaugaagcacauuuuacugauccaucaucaauugcugcuagagguuauaucaguacuagaguuggaaugggugaggccgcggcgaucuuuaugacagcaacuccaccagguucaguagaggcuuucccccagaguaaugccgucauacaagacgaggagagagacaucccggagagaaguuggaacucggguuacgaauggauaacggauuuuccagggaaaacagucugguuuguaccuucuauaaaauccgggaacgacauagcaaauugcuugcguaaaaacggaaagagagucauacaauugucaagaaaaacuuuugauacugaauaucagaagacaaagaauaaugauugggauuaugucgugacaacagacauuucagagaugggggcaaacuuccgugcugacagaguaauugacccgaggagguguuugaaaccagugauucuuaaggauggccccgaacgaguaauacuagcuggaccaaugccaguaacaguagcuucagcggcacaaaggagaggcaggauugguagaaaucauaauaaagaaggcgaccaauauaucuacaugggccagccuuugaacaacgaugaagaucaugcccauuggacagaagcgaaaauguugcuggauaauauaaauaccccggaagguauaauaccagcucuauuugaacccgaaagagagaaaagcgcagcuauugacggugaauacagacuacgaggggaggcacgcaaaacguucguagaguuaaugagacguggugauuugcccguaugguuaucguauaagguugcaucggaaggguuccaauauagugacagacgaugguguuuugacggagaacgcaacaaucaaguacuagaggaaaacauggacguagagaucuggaccaaagaaggugaacggaagaaacucagaccucgaugguuagacgcucggacuuauagcgauccguuagcccuucgcgaauuuaaagaauuugccgcuggaagaaggagcguaucaggagaccuaauacuagaaaucggaaaguuaccacaacaucuaacgcaacgcgcacaaaacgcccuagauaaccucguaaugcugcauaauagcgaacaaggagggagggcuuaccgacacgcaauggaagaacuuccggauacgauugaaacauuaaugcuucuagcacuaauugcggugcugacugggggagucacacuauuuuucuuaucaggaagggguuuaggaaaaacgaguaucgguuuauuaugcguaauggcuucuaguguauuguuauggauggccucgguggaaccacacuggauagcagcaaguauaauuuuagaguucuuucugaugguuuuacuuauacccgaaccagauagacagcgcacaccacaagauaaccaguuagcuuaugucguaauaggauuacuauuuaugauuuuaacgguagccgcaaacgaaaugggccuauuagaaacaacgaagaaagauuuaggcauaggacaugucgcuguagagaaccaucaccacgcugcaauguuagauguugauuugcauccggcaagcgcuuggacucucuaugcuguugccacuacgaucauuacuccaaugaugcggcauacuauagaaaacacuacggcaaauauuagucuaacagcaaucgcaaaccaagcagcaauacugaugggguuagauaaaggguggccgauuagcaagauggacauuggugucccacuccucgcauuagggugcuauucucaagucaacccacuaacguuaaccgcugccgucuuaauguuagucgcccacuacgcuaucauuggaccagggcuccaagcuaaagcuacccgagaagcacaaaaacgaacugccgccggaaucaugaaaaacccuacaguagauggaauaguagcaauagaucuagacccgguuguauacgacgcaaaauuugaaaagcaacuaggacagaucaugcuuuuaauacucuguacaagucaaauccuguuaaugagaacuacgugggcccugugugaaucuauuacacuagcaacaggcccacuaacaacacugugggaagguagcccugguaaauucuggaauacuacgauugcagugagcauggcaaauauauuuagaggcucguauuuggccggugcgggguuagcauucagucuaaugaaaucuuuaggcggagggcguagagguacaggggcacaaggagaaacguugggagagaaauggaaaagacagcuaaaccaacucucaaaaagugaguuuaacacguauaagcguucuggcauaauggagguagaucgaagugaagccaaggagggacugaaacgcggagagacaaccaagcacgcagugaguagagguacugccaaauugagaugguucguugaacgcaaccucgucaagccggaggguaaaguuauagacuuaggcugugguaggggaggauggucauauuauugugcuggccugaagaagguuacggagguaaagggauauacuaagggcgggccagggcacgaggagccaauucccauggcuacauacgguuggaaucucgucaaacuccauuccggaaaggauguauucuuuauuccaccagaaaagugcgacaccuuauugugugauauuggugaaucaucaccuaacccaacaauugaagaaggcaggaccuuacggguacuaaaaaugguggaaccaugguuacgaggcaaccaauuuuguauuaagauacuaaauccauacaugccgaguguaguagaaacccucgagcaaaugcaaaggaaacaugguggaauguugguaagaaacccucuuaguagaaauucuacacaugaaauguauugggucucgugcggcacuggaaauauagucucggcuguuaacaugacaaguagaaugcuuuuaaaccgauucacgauggcacacagaaagccaacuuaugaacgagacguggauuuaggagcagguacaagacauguagcuguagaaccagaaguagcaaacuuggauauaauaggacaacguauugaaaauaucaagcacgaacauaagaguacguggcauuaugaugaagacaauccuuacaagacuugggccuaucacgguaguuaugaaguaaagccgagugguagcgccucgaguaugguuaaugguguaguaaaguuauugacaaaaccuugggauguaauaccaaugguaacucaaauugcgaugacagauacuacuccuuuuggacaacaacguguuuucaaagaaaaaguugauacaagaacuccgaaagcaaaaagggggacagcucaaauaauggaaguaacggcuaagugguuguggggauuccugucuagaaauaagaaaccucgaauauguacucgggaggaauuuacgagaaaaguuaggucuaaugcggcaauaggagcgguuuucguagaugaaaaucaguggaacucagcuaaagaggcgguugaagacgaacgauuuugggacuuagugcacagagagcgagaauugcacaagcagggcaaaugugcgacuugugucuauaacaugauggggaagagagagaagaaacuaggagaauuuggaaaagccaaaggaucaagagcgauaugguacaugugguuaggagcucgcuuucuagaauuugaagcacuaggauuuaugaacgaagaucauugguuuagcagagaaaacucauuaagcgggguugaaggggagggauuacacaaauuagguuacaucuuacgcgacauuucaaaaaucccugggggaaauauguaugcagacgauaccgcagggugggauacgcggaucacggaagaugaucuucaaaacgaagcgagaaucacggacauuauggaaccugaacaugccuugcucgcuaaaaguauuuucaagcugaccuaucaaaacaaagucgucaggguacaaaggcccgcuaaaaaugguacgguuauggacgucauaagucgaagagaucaaagggggaguggacaaguaggcacauacgguuugaauacuuucacaaacauggaggcacaauugauucgacaaauggagucagaagggauuuucucgccaagugagcucgaaacacccaauuuagcggaaagaguccucgacugguuggaaaaauaugggguagaacgacuuaaaagaauggcaauaucuggcgaugauugugugguaaaaccuauagaugauagguucgcuacugcuuugacugcauuaaaugacaugggaaaaguacgaaaagacauuccacaaugggagcccucgaaaggauggaacgacuggcaacaaguaccguuuuguucgcaucauuuucaccaacugauuaugaaagaugggcgugaaauaguuguaccgugcagaaaccaagacgagcuaguagggagggcaaggguaucacaaggagccggauggucauugagagaaacugccugcuuaggcaaaucguaugcacaaauguggcaacucauguacuuucacagaagagaccugagguuagcagccaaugcaauuuguucugcaguuccuguugacuggauacccacaucacggaccacauggaguauccaugcacaucaucaauggaugacaacagaagauaugcuaucgguauggaaccgaguauggauugaagaaaauccauggauggaagacaaaacccacauaucaucguggggugauguaccauacuuaggaaaaagggaagaccaaugguguggcucguuaaucggucuuaccgccagagcaacuugggcgaccaacauccaaguugcuauaaaucagguaaggagauugauuggaaaugaaaacuauuuagacuacaugaccaguaugaagagguuuaaaaaugaaagcgacccagagggagcuuuaugguaa

SEQ ID NO: 21701 - RNA, 9879 nt, Artificial Sequence
  derived and/or modified CDS sequence (opt6) from DENV-1__FJ882555__SS-prME
aguguaacaaugcuacucauguugaugccgacagcguuggcuuuccauuuaacaacaagaggaggagaaccucacaugauaguaucuaaacaggaaagaggaaagagcuuguuauucaaaacaucagcaggagugaacauguguaccuugauugcaauggacuuaggugaauuuugcgaagauaccaugacguauaaauguccaagaauaacagaagcagaaccggacgacgucgacuguugguguaaugcaaccgacacaugggugacauauggaacguguucucaaacuggagaacacagaagagauaagagguccguugcauuagcaccacauguaggauugggcuuagaaacucgaacugaaacauggaugucaucagaaggggccuggaaacaaauucagagaguagaaacaugggcacuucgacauccagguuuuacaguuauugcucuauuucucgcacaugcaauuggaaccucaaucacucaaaaagguauaauauuuauuuugcuaauguuaguaacgccaucuauggcaaugcgguguguagggauaggaucgagagauuucguugaaggucuaaguggagcaacuugggucgaugugguauuagaacauggcaguuguguaacgaccauggcaaaagauaaaccuaccuuagacauagaacuauugaaaaccgaaguaacaaauccagcaguacuaagaaaauuguguauagaagcaaaaauuucaaacacgacuacagauagccguuguccuacacagggugaagcuacccuaguugaagaacaagaugcaaacuucguguguagaaggacguuuguugauagaggcugggggaauggaugcggacuauucggaaaaggcucacuaauaacaugcgcuaaauuuaaauguguuaccaagcucgaaggaaagauuguacaauaugaaaaccuaaaauacucugugaucguaacugugcacaccggcgaucagcaucaagucggaaaugaaaguacggaacacggaacuacggccaccauuacuccucaagcgccgucaaccgaaauucaacuuacagauuacggagcacugacauuggauuguucucccagaacaggguuggacuucaaugaaaugguacuacuaacaaugaaagagaaaagcuggcuaguacacaaacaaugguuccuagaucuuccuuugccguggaccucuggcgcaagcgcuucacaagaaacauggaaucgucaagaucuucuaguaacuuuuaaaacggcacacgcgaagaaacaagagguuguuguccuagguucacaagaaggagcaaugcacacagcauuaaccggugcaacagaaauacaaacaagugguaccacgaccauuuucgccggacauuuaaaauguagguuaaagauggacaaauuaacgcuaaagggaaugucguacguaaugugcacagguucauucaaacuagaaaaagagguagcagagacacaacaugguacuguauugguccaaaucaaauacgagggaaccgaugcgccuugcaaaauaccguuuucgacacaagaugaaaaagguguuacacagaaugggcgccucauaacugcuaacccgauagugacagauaaagaaaaaccuguaaacauagaggcugaaccgccauuuggagaaagcuauaucguuauuggugcuggagagaaagcgcugaagcuauccugguuuaagaaaggaucgucgauaggcaaaauguucgaagcaacugcaaggggagccagaagaauggcaauacuaggugacacggccugggauuuuggaucaauagguggaguguuuacgaguguaggaaagcucguucaucagauuuuuggaacugcauauggagugcuauucucagguguaucauggacuaugaagauuggaauaggaguuuuauuaacuugguuaggacuaaacaguaggaguacaucauuaaguaugaccugcaucgccguaggauuaguaacauuauaccugggaguaaugguccaagcagacagugguugcguaaucaauuggaaaggccgagaguugaaaugcgggucaggcauuuuugugaccaacgaagugcacacuuggacagaacaauacaaauuccaggcagauuccccaaagagacugucugcugcuauugguaaggcgugggaagagggugugugugggauaaggagcgcaacacguuuagaaaauauuauguggaaacaaaucagcaacgagcuaaaucauauauuauuagaaaacgauaugaaauuaacuguaguagucggugauguagcgggcauucuagcacaagguaaaaagaugauaagaccgcagccaauggaauauaaauacagcuggaaaaguuggggaaaagcuaaaauaauaggcgcugaugugcaaaauacuacuuucauaauagacggucaaaacacgccagaaugccccgaugaccaacgagcauggaacauaugggaaguggaagauuauggauuuggcauauuuacaacaaacauauggcuuaaauugagggacucauacacucaaguuugugaucacagguugaugagugcagccauaaaagauucaaaagcaguacacgcugauauggguuauuggauagagucugagaaaaacgaaacauggaaauuggcgagagccaguuucauagagguaaaaaccugcaucuggccaaaaucccauacguuguggucgaacggaguauuagaauccgagaugauuauaccaaaaauauauggaggaccaauaucucagcauaauuaccggccaggcuacuuuacccaaacugcuggcccguggcauuuaggaaaauuagaguuagauuuugauuuaugugaaggaacaacaguaguaguggacgaacacugcggaaacagaggcccuagucuucgaacaaccacggucacuggaaagauaauucacgagugguguugcagaucgugcacauuaccaccuuuacgauuuaaaggagaagauggcuguugguauggaauggagauacgaccuguaaaagagaaggaggaaaauuuaguaaaaucuaugguaucagccggcucuggugaaguugauaguuucucacuggguuuacuaugcauuaguauaaugaucgaggaaguaaugagaucacguuggucaaggaagauguugaugacuggaaccuuagcaguguucuuuuuacuuauaaugggccaauuaaccuggaaugaccucauaagguuauguauaauggugggugcgaaugcauccgauagaauggggaugggaacuaccuaucuagcauuaauggcgaccuuuaaaaugagacccauguuugcuguaggacuccucuucaggcgacuuacaucaagagaaguacuacuacuaacuauaggauuaucacuggucgcuucaguagagcucccgaacucuuuggaagaacucggagacggauuagccaugggaauaaugauccuaaaacuucuaacagauuuccaaagucaccaacucugggcuacccucuuaagcaugacauuuauacgaacuacuuuuucacuucauuacgcguggaagacuauggcaaugguacucuccauugucucacucuucccgcuuuguuuaagcacuacgagucagaagacaacuuggcugccagucuuauugggaucauuagggugcaaaccauuaacgauguuuuuaauagcagaaaauaaaaucuggggcagaaaaucuuggccgcuuaacgaaggaauaauggcuguuggaauuguuagcauccugcuguccagccugcucaaaaaugaugugccucuugccggaccgcuuauugccggggguaugcuaauagcaugcuacguaauuucugggucaagugccgacuuaaguuuggagaaagcugccguuguauccugggaagaggaggcagagcauucaggagcuucacauaacauccuaguugaaguucaagacgacggcacaaugaagauaaaagaugaagaacgugacgacacuuugacuauucuucuaaaagcuacacuuuuagcaguuaguggaguauauccacucaguauacccgcaacuuuguucguaugguacuucuggcagaagaagaaacaacgaaguggaguucuaugggacaccccaucuccaccggaagucgagagggcgguacuugacgaugguauauauagaaucaugcaaaggggucuuuuaggucgaagucaaguaggaguuggcguguuucaagaaaauguauuucauacgauguggcacguuacuagaggggcaguauuaauguaucaagguaaacguuuagaacccaguugggcaagcguuaaaaaggaccucauuagcuauggggguggguggcgauuacaaggaagcuggaauacuggagaagagguucaaguuaucgcugucgaacccggcaaaaaucccaaaaacguacaaacggcaccaggcacauuuaagacgucagagggcgagguaggagccauagcacuggauuucaagccagguacaucgggcucacccauuguuaaucgugaggguaagguuguaggcuuguauggaaauggcguaguuacaacgaguggaacguauguuucagcuauagcgcaagcaaaagcgucucaagaagggccacuaccugaaauagaagacgaagucuuccgaaaacgcaaucugacaaucauggauuuacauccagggucugguaagacucgcagauaucuaccagcuauaguaagagaagcaauaaaaagaaaacuacgcacacucauauuagcaccuacgcgugugguagcuagugaaauggcagaagcgcucaaaggaaugccgaucagauaucagacgacagcaguaaaaucggaacauacugguaaagagauaguggacuuaaugugucacgccacuuuuacuaugaggcuguuaaguccgguacgaguaccuaacuacaacaugaucauuauggacgaagcucacuucaccgacccuagcucaauagccgcgcgcggcuauauuucaacaaggguugguaugggagaagccgccgccauuuuuaugacagcaaccccaccuggaagcgucgaggcuuuuccgcagagcaaugcggucauucaagaugaagaacgggacaucccugaaagaaguuggaacuccgguuaugaauggauuacagauuuuccagguaagacgguaugguuuguaccaaguaucaagucgggcaaugacaucgcuaauugccuaaggaaaaauggaaagagggugauacaacuaucaaggaaaacauucgauaccgaauaucagaaaacuaaaaauaacgacugggacuacguuguuacuacugacaucucagaaaugggagcaaacuuuagagcagaucguguaauagauccacgaagaugucuaaaacccgugauacuuaaagaugguccagaacgagugauacuagcagguccaaugccaguaacaguagcgagugcugcacaacgacguggacgaaucggaagaaaucacaacaaagaaggagaucaauauauauauaugggacaaccucugaacaaugacgaagaucaugcgcacuggaccgaagcuaaaauguuauuagauaauaucaacacucccgaagguauuauaccagcucuauuugaacccgaacgagagaagagugccgcgauagacggggaauauaggcuaagaggagaagcacgaaaaaccuucguggaacuaaugaggagaggagaccuuccgguaugguuaaguuauaaaguagcuucugagggguuucaauauagcgaccgacguugguguuuugacggugaaagaaauaaucaaguauuagaagaaaauauggacguagagauauggacaaaagaaggugaaaggaagaaacuacgaccaagauggcuggaugcaagaaccuauagugacccguuagcccuaagagaguucaaggaguucgcagcuggacgaagaagcguauccggagaccuaauuuuggaaauugguaaacuuccccagcaucugacgcaacgcgcgcaaaaugcauuagauaaccucguuauguuacacaacucagaacagggaggucgcgcauacagacaugcgauggaagaacuaccagacacuaucgaaacgcucaugcuuuuagccuuaauagccguucuuacuggaggcgugacucuuuucuuuuuaagugggagaggcuuagggaagaccucaauaggacuuuugugcgucauggcaaguaguguauuguuauggauggcgucuguugaaccacacuggauagcagcuaguauaauuuuagaguucuuucuaaugguauuguugaucccugagccggacagacaaagaacgccccaagauaaucagcuagcauacgucgucaucggccugcuguucaugauauuaacgguugcugcuaacgaaaugggucuguuagaaaccaccaaaaaggacuuggguauaggacauguagcuguagaaaaccaucaccaugcagcuaugcuggacguagauuugcauccagcuagugcguggacccucuacgcaguagcaacaaccauaauaacacccaugaugagacacacaauugagaacacaacugcuaauauauccuugacagcuauagcgaaucaagccgccauccuaaugggacuagauaaaggauggcccauuucaaaaauggacauuggagucccguuauuggcccuagggugcuacucacagguaaauccguugacauuaacagccgcaguacugaugcuuguggcucacuaugcaauuauaggccccggcuugcaggcaaaagcgacacgggaagcucagaaaagaacagcugcagguauaaugaaaaacccaacaguugacgggauaguggcaauagaucuagauccaguuguauacgaugcgaaauuugaaaaacaacuaggacagauaauguuauuaauauuauguacaucacaaauauuauuaaugagaacuacaugggcauuaugugaguccauaacucuugcgacagggcccuugacaacauuaugggaagggaguccagguaaguuuuggaauacaacaauagcaguuucaauggccaauauauucagaggaucauaucuugcaggggcuggauuagcuuucaguuuaaugaagagucucgguggcgggaggagaggcacgggagcccagggagagacacuaggagaaaaauggaaaagacagcuuaaucaacuuuccaaaagcgaauuuaauacauacaaacgaaguggaauuauggaaguugauagaagugaagcaaaagaaggccucaagagaggagaaacaacgaaacaugccguaucacgugggacugcgaaauuaaggugguucguagaacggaaucuuguaaaacccgagggaaagguuauagaucuaggauguggucgugggggcuggucguauuacugugcagguuugaagaaaguuacugaaguaaagggcuauaccaaagguggcccaggacacgaagaaccaauaccuauggcuacguauggguggaaucugguaaaauuacacaguggaaaagauguguucuuuauaccgccagaaaagugugacacacuccucugcgauauuggagagagcucaccuaauccaacaauugaggaaggucgaacucugcgcguauuaaaaaugguagagccguggcugcgggggaaucaauucugcaucaaaauacuaaacccuuauaugcccuccgucguagagaccuuagaacaaaugcagcgaaaacacgguggaaugcucguccguaauccuuuaagucguaauucaacucaugaaauguauugggugaguugugguacaggaaacauaguuucagcuguaaauaugacgagcaggaugcuccugaaucgguucacaauggcgcauagaaaaccuacauaugaaagagacguagauuuaggugccggcacaagacauguugcgguggagccagaaguggccaacuuagacauaauaggccagagaauagagaauauuaaacacgaacacaaaucuacguggcauuaugaugaggacaaucccuacaagacaugggccuaccauggaaguuacgaagugaagccuaguggaucagcgaguaguaugguaaacggggucguaaagcuacuaacaaaaccaugggacguaauuccuauggugacacaaauagcuaugaccgacacaacacccuuuggacagcagagaguuuuuaaggagaaaguagacaccaggacaccgaaggcgaaaagaggaacagcacaaauaauggagguaacugccaagugguuaugggguuuucuuagcagaaauaagaagcccaggauauguacaagagaagaguucacacggaagguaaggucgaacgcugcgaucggagcaguguucguugaugagaaucaguggaauagugcgaaagaggcaguggaagacgaacgguuuugggauuugguccacagagaacgcgaacuucauaaacaagggaaaugugcuacguguguauauaacaugaugggaaagagagagaagaaauugggagaguucgguaaagcaaagggaucaagggcaauuugguauauguggcuaggagccagauuucuugaauuugaagcgcuaggcuucaugaaugaagaucauugguucagcagggagaauaguuuaagcggaguagaaggggaaggacuucauaagcuaggauauauacugcgggauauaagcaaaauaccgggcgguaauauguacgcugacgacacggccgguugggacacaagaauaacagaggaugauuuacagaacgaagcuaagaucaccgauauaauggaaccagagcacgcacuuuuagcgaagucaaucuuuaaacuuacauaucagaacaaaguugugcgaguacaacgcccggccaaaaauggcaccguuauggauguaauaucucgccgagaucaaagagguagcggccaagugggaaccuacggauuaaacaccuucacgaacauggaagcgcagcucauacgacaaauggaaagcgagggaauauucagucccucggaauuggagacaccuaauuuagcagguagggcauuagacuggcuagagaaacauggaguugagagguugaaaagaauggcaauaucuggagacgauugcguaguaaaaccgaucgacgaucguuuugcgacagcacugacugccuuaaaugauaugggcaaaguacggaaggauauuccccaaugggaaccuuccaaggguuggaacgacuggcaacaaguuccauuuugcucccaccauuuucaccaauuaaucaugaaagauggacgcgaaauaguagucccuugucggaaccaggacgaguugguagggagagcaagaguuucacagggagcaggcuggagucuaagagaaacugcaugucuggggaagucauacgcucaaauguggcagcucauguauuuccaccgaagagauuugcgccuugcugcgaacgcuaucugcuccgccguaccuguugauuggguacccacaaguagaacaacauggagcauucaugcccaucaucaauggaugacgacugaagacauguuaagcgucuggaauagaguguggauugaagagaacccauggauggaggauaaaacccacauaucuaguuggggagauguuccuuaccuagguaaacgggaagaucaguggugcggaucauuaauaggucuaacagcuagagcaacgugggcaaccaauauucaagucgcgauuaaucaagucagaagacuguuggguaaugagaauuaucuugauuauaugacaaguaugaaacgauuuaagaaugagagugauccggagggagcccugugguga

SEQ ID NO: 21702 - RNA, 9879 nt, Artificial Sequence
  derived and/or modified CDS sequence (opt6) from DENV-1__GQ199821__SS-prME
ucaguaaccaugcuuuugaugcuaaugccgacugcacuugccuuucaccuuacaacccgggguggagaaccccauaugauagucuccaaacaggaacgcggcaaaagucuacuguuuaaaacaucugccggcguaaacauguguacauuaauugccauggaucuaggcgaguucugugaagauacuaugacuuacaaauguccccgaauuacagaagcggaacccgacgacguggacugcugguguaacgcaacugauacauggguaacauacggcaccuguagccaaacaggugaacauagaagagauaaacguagcguugcgcuugcgccacauguuggucuaggacuagaaacaagaacagaaacguggauguccucagaaggugcuuggaaacaaauucaacgggucgaaacaugggccuuacgccauccaggguuuacaguuauagcccuuuuucuagcucacgcaauuggcacaaguauuacacagaaaggcauaaucuucauccuacuaaugcuggucacaccaaguauggcaaugcguugcguggguaucggaagucgcgacuuuguagagggauuaucaggagcuaccugggucgacgugguucuugagcaugguagcuguguuacaacuauggcaaaagauaaacccacacuagacaucgaauuauuaaagacagaagucacaaauccagcagucuugcgcaaguugugcaucgaagcaaaaauaucuaauacuacgacggauaguagauguccuacacaaggggaggcaacguuaguugaagaacaagaugcuaauuucguauguaggaggacauuuguggaucggggcuggggaaacggauguggauuguuuggcaaaggaucccuaauaacaugugcuaaauuuaaaugcguaacaaaacuugaaggaaaaacgguacaguaugaaaauuuaaaauauucagugauagugacggugcacaccggcgaucaacaccaaguaggaaaugaaaguaccgaacauggaacaacagcaacuauuacgccucaagcuccauccacagaaauacaacuaacggauuacggggcguuaacccucgacugcucaccccgaacuggacucgacuuuaacgagauggugcuacuaacaaugaaagagaaauccugguuagugcauaaacaaugguuuuuagaucuuccgcuuccauggacaaguggagcaagcacuucccaggaaacauggaaccgcaaagauuuauuaguuacauuuaaaacagcgcacgcaaagaaacaggagguaguaguccucgggagccaagaaggugcaaugcauacugcauugacgggagcaaccgaaauucagacaaguggcacaacaacaauuuuugcaggccaucuaaaauguagguuaaaaauggacaaacugacuuuaaagggaaugucauauguuaugugcacugggucuuucaaauuagaaaaagagguagcagagacucaacaugggacgguccuaguacaaaucaaguaugaagguacagacgccccuuguaaaaucccuuucaguacacaagaugagaaaggaguuacgcagaauggucgauugauaacugcaaauccuauugucacagacaaagagaagcccgucaauauugaagcagaaccaccauuuggagaaucuuauauaguaauaggcgcaggagaaaaggcacuaaaguuaucuugguuuaaaaagggcucaucaauaggaaagauguucgaagcaacggcucguggagcccgacgaauggcaauauuaggagacacagccugggauuuugggucgaucgggggcguuuuuacgucuguagguaaacuuguucaucaaauuuuuggcacggcauauggagucuuauuuagugguguuucauggacaaugaaaauaggaauugggguauugcucacauggcuuggucuaaauaguagauccacaucguuaucaaugacuugcaucguaguugggcuagucacuuuauaucuaggugugaugguccaggccgacagcggcugcguaauaaacuggaaagggagagaacugaagugcggaucuggaauuuuuguaacgaacgaagugcacacguggacggaacaauacaaauuccaagcugauucacccaaaagacucuccgcggcaauaggaaaggcaugggaagaagggguaugcggaauaaggucugcgacccgacuggaaaacauuauguggaagcaaauuucgaaugaacucaaccauauacuacuugaaaaugauaugaaguucacaguaguaguaggugacguagccggcauauuagcgcaggguaagaaaaugauaagaccccaaccuauggaauauaaguacaguuggaaaucguggggcaaggcaaaaauuauuggugcagacguacaaaacacuacauuuauaauugacggcccaaauacaccugaguguccggaugaccaaagagcguggaacauuugggaaguggaagacuaugguuuugggauauuuacgacuaauauauggcugaaauuaagggacucauacacgcaaguaugugaccacagauugaugagcgcggcuauuaaggacucaaaagcaguucacgcggauaugggguacuggauagagagcgagaaaaaugaaacuuggaagcuagcacgugcuucauucauagagguaaaaaccuguauuuggccuaaaagccacacauuguggucuaacgggguacuugaauccgagaugauaaucccgaagauauauggcggucccauaucacaacacaacuaccggccaggguauuucacacaaacagccggcccauggcauuuagguaaacucgagcuagacuucgaucugugcgaaggaacuacugucguaguggacgaacauuguggaaaccgaggaccgucacuaaggacaacgacggugacaggcaaaauaauccaugaauggugcugucguucauguacacucccaccauugcgauuuaaaggcgaagauggcugcugguaugguauggagauaagaccggucaaagaaaaggaagaaaaccugguaaaaaguaugguaucggcagguucuggugaaguggacucuuuuucauugggguuguuaugcauaucaaucaugaucgaagaaguaaugcgaucaagauggagucggaaaauguugaugacagggaccuuagcaguauucuuucugcugauuaugggucaauuaacauggaaugauuuaauacgcuuauguauaaugguaggcgccaacgcgagcgauagaauggguauggguacaacauaucuugcuuuaauggccacauucaaaaugagaccaauguucgcugucggauuauuauuuagaagauuaacaucccgagaaguauuacuauuaacaauuggcuugagucucguggcuucuguagaacugccuaacagucuagaagaacucggagauggacuagcaauggguaucaugauacucaaguuacuaacagauuuucaaucucaucaacucugggccacacuacucagcuuaacauuuauaaagacuacauuuagucuacauuaugcauggaagacuauggccaugguauuaaguauaguaucguuauuccccuuaugucuaaguacaacaagucagaagaccacauggcuuccugugcuucuaggcaguuugggguguaaaccacuaacuauguuucuaauagcagaaaacaaaauauggggaagaaaaaguuggccuuuaaacgaagguauaauggcagucggaauaguuuccauuuuauuauccucauugcucaaaaaugauguuccgcuagcagggccuuuaauagcggguggaaugcugauagccugcuauguuauaagugguaguagcgcagaucuuagcuuggaaaaagccgccgaaguuaguugggaggaagaggcggaacauaguggagccagucacaauauauuaguugaaguucaggaugacgguacaaugaaaauuaaagacgaagaacgcgacgacacgcucacuauucuacuuaaagcaacacuacuagcaguaucuggaguauauccgcuaaguauaccagcgacucucuuugugugguauuuuuggcagaagaagaaacaacgaucaggcguauuaugggauacuccgucaccuccagagguugagagggcgguauuagaugacggcauauacagaauaaugcaaagagggcuucuaggccguucccagguuggaguaggaguauuucaagaaaauguauuucauacaauguggcauguuacacguggugcgguacuaauguaucaaggaaaacgacuagaaccgucaugggcguccguuaaaaaggaucuaauaaguuacgguggagguuggagauugcaagguagcuggaauacaggagaggaaguacaaguaauugcuguggagcccgguaagaacccuaaaaacguucaaacagcuccagguacauucaagacaagugaaggagagguaggagccaucgcacuagacuucaagccaggaacaucgggaucgccaauaguuaauagagaaggaaaaauuguagguuuauauggaaauggcguuguuacaacuagcggaacuuacguauccgcuaucgcacaagcaaaagcaucacaggaaggaccucuaccugaaauagaggaugaggucuucagaaaaagaaacuuaacaaucauggacuuacauccgggcucgggaaaaacccguagauaccuaccugccauaguuagagaagcuauuaagagaaagcucagaacuuuaauacuagcuccgacgcgagucguugccagugaaauggcagaagcacuuaaagguaugccaauaagauaccaaacaaccgcuguuaagagugaacacacgggcaaggaaauuguagauuuaaugugccaugccacuuuuacuaugcgcuuguugaguccuguaagaguaccaaacuauaauaugaucauaauggaugaggcgcauuuuacagacccuucgucuaucgccgcuagggguuacaucucaacuagaguugguaugggcgaggcagccgcaaucuuuaugacagcgacgccuccuggauccguggaggccuuuccgcaauccaaugcaguuauacaagacgaagaaagggacauaccugaaagaucuuggaacucagguuacgaguggauaacagauuuuccuggaaagacggucugguucgugccgaguauaaaaucaggaaaugauauagcaaacugcuuacgcaaaaauggaaaaagagugauacaauuaucucguaaaacauuugauacugaauaucagaagaccaaaaacaaugacugggauuauguugucacuaccgacauuagugaaaugggugcaaacuuuagggcagauagaguaauagauccccgcagaugccuaaaaccaguuauuuugaaggaugguccggaacgaguuauauuagcugguccuaugcccguuacaguugccagugcagcacaaagaagagggcguauaggacgaaaccauaacaaagagggugaucaguacaucuauauggggcaaccacuuaacaacgaugaagaucacgcgcauuggaccgaggccaaaaugcuacuggauaacaucaauacacccgaagguauaauaccagcacuauucgaaccggaaagagagaaaagugcagcuauagacggugaguauaggcuaaggggugaagcacggaaaacauuuguagaacuaaugaggagaggagaccugccgguauggcuaucguauaaaguagcuucagaaggauuucaauacucggauagacgaugguguuuugauggugaaagaaauaaucaaguucucgaagagaauauggacguagagaucuggacuaaggaaggagagagaaagaaacuaagaccaagauggcuggacgcccguacguacucugacccgcuugcccuacgugaauuuaaagaauuugcggcaggaagaaggucaguaucaggugacuuaauacuagaaauaggcaagcugccccagcaccugacacagcgugcgcaaaacgcacuugacaaucucgucauguuacacaauucagaacaaggcgggagggccuaucgacaugcaauggaagaguuaccagacacaauagaaacuuuaaugcuguuagcauuaauugcugucuuaaccggagggguuacacuguucuuucugucagggagaggguugggaaaaacuucaauaggauuauuaugugugauggcguccuccgcccuauuguggauagccaguguugaaccgcacuggaucgcugcaaguauaauccuagaauuuuucuuaaugguauuacuaauacccgaaccagaucgccagagaacaccucaagauaaccaacuugcauauguugucauuggcuuauuauuuaugauuuuaacaguugcagcgaacgaaaugggauuacuagagacaacgaagaaagacuuaggaauuggacauguagcuguagaaaaucaccaccaugccgcaaugcuagacguagauuuacauccggcgagugccuggacucuuuaugcgguagcaacgaccauuauaacuccaaugaugagacauaccauagaaaauacaacagcaaauaucucacucacagcuauugcuaaucaggcagcaauucuaaugggauuggauaaagguuggccaauaucaaaaauggauauugguguaccccuucuugccuugggcugcuacagucaaguuaauccuuuaacacucacggccgcaguacucaugcuuguagcccauuaugcaauaauagguccaggacuacaagcgaaagcaaccagagaggcacagaaaagaacugcagcaggaauaaugaagaacccaacaguagauggcauaguagcuauagaccuggacccuguaguuuacgaugcuaaauuugaaaagcaacuuggucaaauaaugcuuuugauucuaugcacaagucaaauuuuauuaaugcgaacuaccugggcuuugugugaaucaauaacacuugcuaccggucccuuaacuacacuuugggaaggcaguccgggcaaauuuuggaauacaacgauagcaguuucaauggcaaauaucuuucgugguucuuacuuagcaggagcagguuuagcuuuuucgcuaaugaagaguuuggguggaggcagaagagggacgggggcucagggugaaacacugggagaaaaguggaagagacaauugaaucagcugucgaaauccgaauuuaauacauauaaaagaaguggaauuauggaagucgaccggagcgaagcaaaggaaggacuaaagagaggagagacuaccaagcaugccgugaguaggggaaccgcaaaguuacguugguucguggagagaaaucuaguaaaaccagaggggaaagugaucgaucuaggguguggucgaggagguuggucuuauuauugugcgggcuuaaagaaaguuaccgaaguaaaaggguauacaaaaggaggaccaggucaugaagaaccuauaccuauggcaacauacggcuggaacuugguaaaacuucauagugggaaagauguauucuuuauuccaccagaaaaaugcgauacauuauuaugugauaucggagaguccuccccaaacccuacgaucgaagaagggaggaccuuacgcguguuaaaaaugguagaacccuggcuaagggggaaucaauucugcauuaagauauuaaaucccuacaugccuaguguaguagagacacuugaacaaaugcagagaaagcauggaggaaugcuaguuagaaacccauugagucgaaauaguacucaugaaauguauugggucucauguggcaccggaaauauuguuagugccguuaauaugacguccagaaugcucuugaauagauuuacaauggcccaccgcaagcccacuuaugaaagagauguggacuuaggagcagguacccgacacguagccguagaaccugaaguugcgaaccucgacauuauuggacaacguauugagaacauuaaacaugaacacaaaucgaccuggcauuacgacgaagauaauccauauaaaaccugggcauaucaugggaguuaugaaguuaaaccauccggcagugcguccucuaugguaaaugggguaguuaaguuauugacaaaaccuugggacgugauaccuauggucacccaaauagcaaugacggauacgacucccuuuggucaacaaagaguauuuaaagagaagguagacaccagaacgccgaaggcuaaaaggggaacugcacagaucauggaaguaacugcaaaguggcuuuggggguuucucucaagaaacaaaaagccaagaauauguacacgagaggaauuuaccagaaaaguacgaucgaaugcagcuaucggugccgucuuuguggaugaaaaucaguggaauagugcgaaagaggcaguagaagaugaacgauuuugggaccuugugcauagggaacgagaauuacauaaacaagggaagugugcuacaugcguauacaauaugaugggcaaacgagagaagaaacucggcgaauuuggcaaagcaaaaggaaguagagccauaugguauauguggcucggagcucguuuucuggaauuugaagcacuuggauuuaugaacgaggaucauugguuuucacgugaaaacucccuaagcgggguugaaggcgaaggauugcauaaacuaggcuauauccuacgagauauauccaaaauuccuggagggaauauguaugccgacgacacagcaggcugggauacucguauaacugaggaugaccuccaaaacgaggccaaaaucacagauauaauggagccugaacaugcauuguuagcaaaaucaauauucaagcuaaccuaucaaaauaaaguaguucggguacaaaggccugccaagaauggaacgguaauggacgucauaagccgacgagaccaaagagguuccggacagguaggaacuuaugguuuaaacacauucacuaauauggaagcgcaacuaauacgucagauggaauccgaagguauauuuagccccagcgaguuggaaaccccaaacuuggcgggacgcguuuuagauuggcucgaaaaacacgguguggaacgucuaaaaagaauggccauaagcggggacgauugugucguuaaacccaucgacgacagauuugcaacagcacucaccgcacuaaaugauaugggaaaagugagaaaagacauaccucaaugggaaccgaguaagggcuggaaugauuggcaacaaguuccguuuuguucccaucauuuucaccaauuaauaaugaaagauggucgugagauaguagugccgugccgcaaccaggaugaauuaguaggcagagcucgcguuagccaaggggcaggauggucgcuaagagaaacggcuuguuuaggaaaauccuacgcacagauguggcaacuaauguauuuucacagaagagaucuucgucuggcggccaacgccaucuguuccgcaguaccaguggauuggguuccuacaagccgaacaacguggucaauacaugcacaucaccaauggaugacuacugaagacaugcucucugucuggaaucgaguguggauagaggaaaacccauggauggaagauaaaacgcauauaaguucauggggagauguaccauauuuaggaaagagggaggaucaauggugcgguagucuaauaggcuuaaccgccagagcaaccugggcaacaaauauccaaguagcgauuaaccaaguuagaagauuaauaggaaacgaaaauuauuuagauuacaugacuucuaugaagcgauuuaaaaaugaguccgauccggaaggagcguugugguag

SEQ ID NO: 21703 - RNA, 9879 nt, Artificial Sequence
  derived and/or modified CDS sequence (opt6) from DENV-1__FJ882556__SS-prME
aguguuacaaugcuauuaauguuaaugccaacagcacuugcuuuccauuuaaccacucgcggaggagaaccacauaugauaguuagcaaacaagaacggggaaaaaguuuacuuuuuaaaacuuccgcgggaguaaauaugugcacccugauagcaauggauuuaggugaauugugugaagauacuaugacauauaaauguccacgaauaacugaaacugaaccagacgauguugauuguugguguaaugcgacggauacuugggugacauauggaacuuguucgcaaacuggcgaacauagaagggauaaaaggucagucgcauuagcuccacauguuggccugggcuuagaaaccagaacugaaaccuggaugaguagugaaggagcuuggaaacaaauccaaagaguagaaaccugggcauuaagacauccuggauucacaguaauagcacuuuuucuagcccaugcaaucggcacaagcauuacucaaaaagggauaaucuuuauuuuguuaaugcuagucaccccuucgauggcgaugagauguguugggauaggcucuagagauuucguagagggacuaagcggggcuacauggguagacgugguacuggaacaugguucguguguaacuacaauggcuaaagauaaaccuacacuugacaucgagcuacuuaaaacagaaguaacaaauccagcuguacugagaaaauuguguauagaggcaaaaauuucaaacaccacaacagauagccgcugucccacacaaggagaagcaaccuuaguagaagaacaagaugcaaauuuuguuugcagacgaacuuucguggaucgggguugggggaacggguguggguuauuuggaaaaggaucauuaauaacuugcgcuaaauuuaaauguguuacgaaacuggaaggaaagauugugcaauaugaaaaccuaaaauauagcgugauaguuacaguccacaccggagaucaacaucaaguagguaacgaaaguacggaacauggaacgacagcaaccauaacaccucaagcaccuacaacugaaauacagcuuacagacuauggagcuuuaacguuggacuguucccccaggacaggauuggauuucaacgaaauggucuuguuaacgaugaaggaaaagagcugguuagugcauaagcagugguuucuagaccuuccacugccauggacaucaggcgcaucaacuucccaagaaaccuggaauagacaagaucuguuggugacguuuaaaacugcucacgcgaaaaagcaagaagucguuguucuaggcucacaggaaggugcaaugcauacagcacuaacaggugccaccgaaauacaaacuagcggaacaacgacaaucuucgcaggacaccugaaaugcagacucaaaauggacaaauugacccuuaaagggaugucauacguaaugugcaccggaucuuucaaacuggaaaaagaaguggcggagacacaacacgguacaguuuuaguacaaauaaaauacgagggcaccgaugccccguguaaaauaccauucucuacacaggaugaaaaaggaguaacucaaaauggaagguuaauaacagcaaacccaaucguaagcgauaaagaaaaaccugucaacauagaagccgaaccaccauuuggcgaauccuacauaguuauaggugcuggagaaaaggcuuuaaaauugucuugguuuaagaaaggcagcucuaucggaaaaauguucgaagcaacugcaagaggugcaagacguauggcaauauugggggauacagcgugggacuuugguaguauaggaggaguauuuacuagcguaggcaaauugguucaccaaaucuuugguacagcauauggcguguuguuuagcgguguauccuggacgaugaaaauagguauugggguucuauuaacuuggcuugggcuuaauucuagaucuacgucauuaucuaugacuugcauugcugugggauuggucacucucuauuuaggugugaugguucaagcagacagcgguugugugauaaacuggaaagguagagaauuaaaaugcgguucaggaauauucguaacgaaugaagugcauacauggacagaacaauacaaauuccaggcggacuccccgaaaagauuaagugcggcaauagguaaagcaugggaggaaggcgucugugguauucggucggcgacaagacuugaaaauauuauguggaaacagauuucuaacgaacugaaccauauuuuacuagagaaugacaugaaauuuacuguuguaguuggagauguugcgggcauucuggcgcaaggcaagaaaaugauucgcccccaaccgauggaauauaaauauucauggaagucuugggguaaagcuaaaauaauaggugcagaugugcagaacaccaccuuuauuauugauggacccaacacaccagaauguccagacgaucaaagggcauggaacauaugggaaguagaagauuaugguuuuggaauauucacaaccaauauauggcuaaaacuaagggauaguuauacucaaguuugugaucauagacuuauguccgcggcuauuaaagauucaaaagcaguccaugcggacaugggcuauuggauugaaucggagaaaaaugaaaccuggaaacuagcacgggccuccuuuauagaaguuaagacuugcauuuggccuaaaucgcauaccuuaugguccaacgguguccuggaaucagaaaugaucauuccaaaaauauacgggggcccaauuagucaacauaauuaccgccccggauauuuuacacaggcugcuggacccuggcaucucggaaaauuggaauuagacuuugaucuuugcgaaggaacuacgguuguagucgacgagcauugugggaauagaggaccuucauuaaggaccacgacgguaacaggaaaaauaauccaugagugguguugccggucaugcacauugccaccauugcguuuucgaggggaggauggguguugguaugguauggagauuagaccaguuaaggagaaggaggaaaacuuaguaaaaaguaugguaagugccgguaguggggaaguagauucuuucagcuugggucuacuaugcauaagcaucaugauagaggagguuaugcguucaagauggagccgaagaauguuaaugacagggacauuagcgguguucuuuuuacucauuaugggccaacugacauggaaugacuugauucggcuaugcauaaugguaggagcgaaugcaagugaucgaaugggaaugggaacgaccuaucuggcacuuauggccacauucaaaaugcguccuauguucgcaguaggucuacuuuuucggagauugaccagccgugaagugcuccucuuaacaaucgggcugucacucguggcaucaguagagcuccccaauagcuuagaagaacuuggagacggacucgcaaugggcaucaugauccugaaauuacucacagacuuucaaucucaucaauuaugggcaacacuuuugaguuugacauucaucaaaacuaccuuuucgcuucacuaugccuggaaaacgauggcaaugguacuaucaaucguuucucuuuuccccuuaugccugucaaccacaucucagaaaacgacauggcuaccaguacuauuagguagucuugggugcaaaccucucacuauguuucugaucgcagaaaacaaaauuugggguaggagaagcuggccgcugaaugaagguaucauggccguuggaauaguaaguauuuuacuaagcuccuuauugaaaaacgacgugccacuugccgggccguuaauugcugguggaaugcuaauagcauguuauguaauuagugggucgagugcagauuuaagccuagagaaagcagcugaaguaucaugggaggaagaggcagagcacucaggagcaucacacaauauacuuguggagguacaagacgacggaacuaugaagauuaaagaugaggaacgugacgacacccugaccauucucuugaaagcgacuuuacuugccgucucagggguguauccccuuucaauaccagcuacucuauucgugugguacuuuuggcagaaaaagaagcaaagaagcgguguacucugggauacuccaucaccuccugaggucgaaagagccgucuuagacgauggaauauaucgaauaaugcaacgagggcuuuuggguaggucucaaguaggcgucggcguuuuccaggaaaauguauuccauacgauguggcacguaacuaggggagcgguacuaauguaucaaggaaaacgucuugaaccuucuugggcaaguguuaagaaagaucucauaaguuacgguggaggcuggcgcuugcaagguucguggaauacaggugaggaaguacaaguuauugccgucgaacccggcaaaaaucccaaaaauguacaaaccgcucccggaaccuucaaaacaccugaaggagaagugggggccaucgcauuagacuuuaagccagguaccucaggcucaccaauugugaacagagaaggcaaaauagugggguuguacggcaauggagucgugacuacgagugguacuuacguuucagcuauugcccaagcuaaagcaucccaggaggggccacuaccggaaauagaagaugaaguauuucguaaacgaaaucuaacuauuauggaccuacaucccgguucagggaagacuagaagauacuuaccagcgauaguacgcgaagcuauaaaacgaaaacuaagaacacugauucuagcccccacacgaguaguugccagugaaauggcagaagcacuaaagggcaugccaaucagauaccaaacuacagccguaaaaagugaacacacagguaaagaaauuguagaucuaaugugccaugcuaccuucacgaugagacucuuaaguccugugcgagugccgaauuauaauaugauaauuauggacgaggcccacuucacagaccccucuaguauugccgcaaggggauacauuucuaccaggguggguaugggugaggcagcagccauuuuuaugacagcaacuccuccaggcuccguggaagcguucccgcagagcaacgcagugauacaagaugaggaaagagauaucccugagcguucauggaacucuggauaugaauggauaacagauuucccugggaaaacagugugguucguuccaucuauuaaaaguggaaaugauauagcgaacugucuccguaagaauggcaaaagggucauacaacuaaguaggaagacauuugauacugaguaccagaaaaccaaaaauaacgacugggauuauguggucacaaccgauauaucagaaaugggugccaacuuuagagcagacagaguaauagauccacgacgauguuugaaaccagucauauuaaaggacggaccugaaagaguuauucuugcgggcccgaugccagucacuguagcuucagcugcccagcguagaggaagaauaggacgaaaccauaauaaagaaggagaucaguacauauauaugggucagccauuaaacaaugaugaagaucacgcucacuggacggaggcuaaaauguuacuggacaauauaaauacuccugaagguauaauuccugcacuuuuugaaccggaacgugagaaaagcgcagcgauugacggggaauaucgccuucgaggagaagcaaggaagacauuugucgaauugaugcggagaggggacuugcccguaugguuaaguuacaaaguagcuucagaaggauuccaauauagugaccgucgguggugcuucgauggagaaaggaauaaccaaguccucgaggaaaauauggacguugaaauauggaccaaggagggggagcgaaagaaacucaggcccagaugguuagaugcaaggacguauucggauccgcuugcauuaagagaauuuaaagaauuugcugcgggacgccgaagcgucaguggagaccuaaucuuagagaucggaaaauuaccgcagcaucuaacacaacgagcccaaaaugcuuuagacaaucuagucaugcugcacaauagugagcagggugguagggcuuacagacacgcaauggaagaguuaccagauacuaucgaaacacuaaugcugcucgcauuaauagcgguauuaacggguggcgugacacuuuucuucuuaucggguagagggcuuggaaaaaccucaauaggacugcugugcguaauggcaucaucuguuuuacuauggauggcgaguguagaaccucauuggauagcagcgucgaucauucuagaguucuuucuuaugguacuauuaauccccgaaccagaccgacagcgaacuccacaagacaaucaacuagccuacguugucauaggucuccucuucaugauauuaacagucgcagcaaacgaaauggguuuacuugagaccacaaagaaagauuuggguaucggacacguggcaguagaaaaccaucaucaugcggcaaugcuugacguugacuuacauccagcuucugcauggaccuuauaugcuguugcaaccacaauaauaaccccgaugaugcgacacacgaucgaaaauacuacggccaacauaucgcuaacugcuauugccaaucaggcagcgauacugaugggauuagauaaagguuggccaauaucuaaaauggacauagguguacccuuauuggcucugggauguuauucucagguaaacccucuuacguuaacugcagcuguuuuaaugcuaguugcacauuacgcaauuauaggaccaggauuacaagcaaaagcaacgagagaggcucaaaagagaacagccgcuggcaucaugaaaaauccuacaguugacggaauuguugcaauagauuuagaucccgugguauaugaugcuaaauuugaaaaacaguuggggcagauuaugcuuuuaauccuauguacgagccagauacuauuaaugaggaccaccugggcuuuaugugaaaguauuacccuagcaacggguccacuaacaacuuuaugggaaggaagucccgggaaauuuuggaauacaacuauugcaguuucaauggcaaauaucuuucggggaagcuacuuagcaggagcuggauuagcauuuucccuaaugaagucucuuggcgguggacgacggggaacaggagcucaaggagaaacucuaggcgaaaaguggaagaggcaauuaaaucaacuuuccaaaucagaauuuaacacguacaaaaggaguggcaucauggaagucgacagaucagaagcgaaagagggucucaagaggggagaaacgacgaaacaugcagugagcaggggaacagcuaagcuaaggugguuuguagaaagaaaccuagucaaaccagaaggaaaaguuauugaccuaggaugcggucgaggaggauggaguuauuauugcgcaggucucaagaaaguaacugaaguuaaagguuauacaaaagggggaccuggacaugaggagccuauacccauggcuacauaugguuggaaucuaguuaaauugcacagcggaaaagacguauucuuuauaccacccgaaaaaugcgauaccuuacuuugcgauauuggagaaaguucaccaaacccaacaauugaggaaggucgaacguuaaggguuuuaaaaauggucgaaccauggcucagaggaaaccaauucugcauuaaaauauugaauccauauaugccaucagugguagaaacucuagaacagaugcaaaggaaacacgggggaaugcuaguacgaaaucccuuaagucguaacucaacucaugaaauguacugggucucaugcggcacgggcaauauaguuagugcgguaaacaugacuucacggauguuguuaaauagauuuacgauggcccauagaaaaccgacuuaugaacgugacguagacuugggagcuggaacuagacacguugcaguagagccagaaguagcaaaucuagacaucauugggcaacguauugagaacauaaaacaugaacauaaaucaacguggcauuacgaugaggauaacccguauaaaacaugggccuaccacggaaguuaugagguuaaaccgucagguucugccucuaguaugguaaaugggguaguuaaacuccuaacaaaaccaugggauguuauuccgaugguaacacaaauugcgaugacugacacgacaccauucggucagcaaaggguauuuaaagaaaaaguggauacaagaacaccgaaggcgaaacgcggcacggcgcaaaucauggaaguaacagcaaaauggcucuggggcuucuuaagcagaaauaagaaaccacguauaugcacuagagaagaguucaccagaaaaguccguucaaaugcggcgauaggggcaguguuugucgaugaaaaccaauggaauagcgcaaaagaagccguggaagacgaacguuuuugggaccuuguccaccgagaacgagaauuacauaaacaaggaaaaugugccaccuguguguacaauaugaugggaaaaagagaaaagaaacuuggugaauuuggaaaagcaaaggggucaagggcgauaugguacaugugguuaggggcaagauuucuagaauuugaggcccuaggcuucaugaaugaggaccacugguucucgagagagaauagcuuaagcggcguagaaggagaaggacuacacaaauuaggguauauuuuacgugacaucaguaaaaucccagguggaaacauguacgccgaugauacggcuggcugggauaccagaauuacagaagacgaucuccaaaaugaagcaagaauaacggauauaauggaaccagaacaugcuuuacuagcgaagucuauuuucaaacuuaccuaccagaacaaaguggugagaguucaacggccugccaaaaauggaacgguuauggacguuauaucccguagggaucaaaggggaucuggucaaguuggaacuuauggcuuaaauacauucacuaacauggaagcacaauugauacgccaaauggagagcgaaggaauauuuaguccuucagaacuagaaacaccaaaucucgcagaacgaguacuagauuggcuggagaaguacggugucgaaaggcuuaaaagaauggcuauuucaggagaugacuguguugugaaaccaauagaugauagauucgcuacugcuuuaacagcauuaaaugauauggguaaaguuagaaaagacauaccacaaugggagccgagcaaagguuggaacgauuggcaacaaguaccguuuuguucacaucauuuccaucaacuuauaaugaaagacgggcgggagauagucgucccaugcagaaaucaggacgaauuaguuggcagagcaagagucucacaaggcgcuggauggucacuccgcgagacagcgugucugggaaagucguaugcacagauguggcaauuaauguauuuucaucgaagggaccuucgacucgcggcuaacgccauauguucugcaguacccguagauuggauacccacuagcagaacaacauggaguauacacgcucaucaccaauggaugacgaccgaggauauguuaucaguauggaaucgaguauggauagaagagaacccuuggauggaagauaaaacacauauuucgucuuggggcgauguaccauauuuaggaaaacgagaagaccaauggugcggaagucucauaggacugaccgcacgcgcaacgugggcaacuaauauucaaguggcgaucaaucaagugagaagacuaauaggcaaugaaaauuaccuagacuauaugacuucuaugaaacgcuucaaaaaugaaagugauccagagggagcuuuaugguga

SEQ ID NO: 21704 - RNA, 9879 nt, Artificial Sequence
  derived and/or modified CDS sequence (opt6) from DENV-1__GQ199822__SS-prME
aguguaacaaugcuucugauguuaaugccuacugcucuagcuuuucauuuaacaacccggggaggagaaccacacaugauaguaacuaaacaagagcguggaaaaaguuugcucuuuaaaacaucagcgggagugaauauguguacguugauugcaauggacuuaggggaguuaugugaggauacgaugacauauaaauguccucgcauuacggaagcagagccugaugauguggauugcugguguaacgccacggacacguggguuacuuaugguacaugcucacaaacuggagaacaucguagagauaaacggucaguagccuuggcaccgcaugugggauuaggguuagagacuagaaccgagacuuggaugucgucggagggagccuggaaacaaauacaacguguagaaacaugggcucuaagacacccaggcuucacuguuauugcacuguucuuagcacaugcgauaggcacaaguauuacucaaaaaggaauaauuuuuauucuacuaaugcucguuacaccuuccauggcuaugcgauguguaggaauagguucgagagauuucguugaaggucuaucaggugcaacauggguugacguuguauuagagcacgguuccugcguuacuacaauggcaaaagauaaaccaacauuagauauagaacuauuaaaaacugaaguuacuaauccggcuguacuccgaaaacuauguauugaagccaaaauuuccaauacaacuacagauucacgauguccaacccaaggugaggcgacucuaauggaagaacaagacgcaaauuucgugugcagaagaacauuugucgaucgaggauggggaaauggguguggguuauucggaaaagggagucucauuacaugugcgaaauucaaaugugucacuaaauuagagggcaaaauuguccaauaugaaaaccuaaaauauuccguaauuguuacaguccacacaggggaucaacaccaaguggggaaugagucuacggagcacggaacaacagcaacgauaacuccccaagcaccaacuucagaaauacaacuaacagauuauggggccuuaacguuagauuguaguccuagaacaggcuuagauuuuaaugaaaugguauuauugacaaugaaagaaaaguccuggcuuguccacaagcagugguuccuggauuuaccauuaccauggacuuccggcgcuuccacaagccaagagaccuggaaucgucaagaccucuuagugaccuuuaaaaccgcacacgcuaagaagcaggaaguugugguacucggaucucaagaaggugccaugcacaccgcgcuuacaggcgcgacagagauacagacuucggguacaaccacgauauuugcuggacauuugaaaugccgauuaaaaauggacaagcuaacccuuaaagguauguccuauguaauguguacugguucuuucaagcuggaaaaagagguagcugaaacccaacacgggaccguccuaguacagauuaaauaugaaggcacagaugcaccgugcaaaauaccuuuuagcacgcaagacgaaaaaggcgugacccaaaauggcagacuaauaacugcaaaccccauugugaccgacaaagaaaaaccuguaaauauagaggcugaaccaccguuuggagaaaguuauauaguaaucggugcgggagagaaagcccuaaaauuaucuugguuuaagaaagguuccaguauaggcaaaauguuugaagcgacugcucggggugcucgaaggauggccauucuaggggacacggcaugggauuuugggagcguagguggcguuuuuacauccgucggaaaacuuguucaccaaaucuuuggaacggcauaugggguauuauuuaguggcgucagcuggacaaugaaaauuggaauuggagugcuacuaacaugguuagguuuaaauucacgaaguacuucgcuaucaaugacaugcauagcaguagggcuggugacgcucuauuugggaguuaugguucaagcggacaguggauguguuauaaacuggaaggguagggaacuuaagugcgggaguggaaucuucguuacuaaugaaguucauacauggacagagcaauauaaauuucaagcggauuccccuaaaagacucuccgccgccauuggcaaggcaugggaagagggaguuugcggcauacgguccgcaacccgacuugaaaauauuauguggaaacaaauuucuaacgaacugaaucauauacugcuagaaaacgauaugaaguucacaguggucguaggugauguagugggaauauuagcgcaagguaagaaaaugauucgaccucaacccauggaacauaaauauaguuggaagucauggggucgagcuaaaauaauaggagcggacguacagaacacaacuuucauuauagacgggccaaacacaccggaaugcccagaugaccaaagggccuggaacauuugggaaguagaagauuauggcuuuggaauuuucaccacgaacauauggcuaaaacuuagagacagcuauacacaaguaugcgaucauagacuuaugucagcagccaucaaagauagcaaagcugugcacgcggauaugggauauuggaucgaaagugaaaagaaugaaacuuggaagcuagcgagggccagcuuuaucgaagucaaaaccuguaucuggccgaagagucauacccucuggucaaacggagucuuagaaagugaaaugauuaucccgaaaaucuacggagguccuaucucucaacauaauuauagaccggguuauuuuacacaaaccgcaggcccauggcaccuagguaaguuggaauuagauuucgaucucugugaaggaacuacaguaguuguagaugaacauugugguaacagaggacccuccuugagaacaaccacaguaacagguaaaauaauucacgaaugguguuguagaucguguacgcuaccacccuuaagauuuaaaggagaagaugguuguugguaugguauggaaauacgaccgguuaaagagaaagaggaaaaccucgugaaaaguaugguuucggcaggaucaggugagguagauagcuuuucauuaggccuacugugcaucucaauuaugauagaagaaguaaugcgcaguagguggucucggaaaauguuaaugaccgggacacuugcaguguuuuuacuacugauaaugggacaacuaacauggaacgaccugauacgcuuauguaucauggucggagcaaaugcgagugauagaauggggauggguaccacuuaccuugcacugauggccacauuuaaaaugagaccuauguuugcugugggacuucuauuuagaagguuaaccucucgcgaagucuugcuauuaacaauuggacuaagucugguagcaucaguagaauuaccgaacucucuugaagaacuaggugaugggcuugcaaugggaauuaugauucuaaaacuucuaacugauuuccagucacaccagcugugggcgacacuucugagcuuaacauuuauaaaaacgacucuaucccugcauuaugcauggaagaccauggcaaugguauuauccauuguuucauuauucccauuaugucuaucgacuacuucucagaaaacuacauggcuucccguuuuauuaggcucucuagguuguaaaccacucacuauguuuuuaauuacggaaaauaaaauaugggggaggaaguccuggccacucaacgaagguauaauggcggugggcgucguaucgaucuuacucagcaguuuacucaaaaacgauguuccgcuagccggcccgcugauugcaggagggaugcuaauagcuuguuauguuauaagcgggaguucagcggaccucagcuuagagaaagcagcugagguaucaugggaagaagaagcagaacauaguggagcgagccacaauauauugguagaagugcaagaugauggaacaaugaaaauaaaagaugaagaacgagaugauacauuaacgauacuguugaaagcuacuuugcuagcuguaucagguguauauccacuuuccauacccgcaacauuauuugugugguauuuuuggcagaagaagaaacaaagaagcggagugcucugggauacaccuucuccgccugagguugaaagagcaguuuuggaugaugguauauaucgcauaaugcaaagagggcuauuaggacguagucaagucgguguaggaguguuucaggaaaacguauuccauacaauguggcauguuacaagaggggcaguuuuaauguaccaagguaaacggcuggaacccuccugggcuucaguaaagaaagaccuaauuagcuauggaggaggguggagguugcaaggcucauggaacaccggugaagaaguucaagugaucgcaguggagccaggcaaaaaucccaaaaauguacagacugcgccaggaacauucaaaacuccggaaggcgaagucggugccauagcauuggauuuuaaaccaggaacuucuggcucacccauugugaacagagaagguaaaauaguaggacucuacggaaaugggguugugaccacaaguggaacauaugugucggccauugcucaagcuaaagccagccaagaagggccauuaccagaaauugaagacgaaguuuuuagaaaaaggaacuuaacaauuauggaccuacauccgggcagcggaaaaacccgacgauaccuuccagcccuaguccgugaggcaauuaaacgaaaacuaaggacacuaauauuagcuccaacgcgaguaguagcaagugaaauggccgaagcccucaaagggaugccaauacgcuaucaaaccacugcugugaaaagcgaacauacugggaaagagauaguagacuuaaugugucacgcuaccuucaccaugcgguugcugucuccuguucgcguucccaauuacaauaugaucauaauggaugaggcacauuuuacugacccgucaagcauagccgcgcgaggauauauauccacuagagugggaaugggagaagcugcugccauauuuaugacagcuacuccaccagggucgguugaagcauuuccgcagucuaaugcgguuauacaggaugaggaacgagauauuccugaaagaaguuggaauagcggguacgaauggauaacagauuuccccggcaagacuguaugguucguaccuuccauuaagucagguaacgauauugcuaauugucuuaggaaaaauggaaaacgcgugauacaacuuuccagaaagacauuugauacggaauaucagaaaaccaaaaauaacgauugggacuaugugguuaccacagacauuucagaaaugggggccaacuucagagcugaccggguaauugauccacgaagauguuugaaaccggucauuuuaaaggacggaccagaacgugugauacuugcuggucccaugcccguaacaguugcgagcgcugcucaacguagaggaaggauugguagaaaucacaauaaagaaggagaucaauacauauauaugggucaaccgcuaaauaacgacgaggaccaugcacauuggacagaggccaagauguuacuugauaacauaaauacgcccgaggggauaaucccagcucuuuuugaaccugaacgagaaaaaucugcagccauugacggagaauauagauuacgaggcgaggcgaggaagaccuuuguugaguugaugcgaagaggugaccuuccggucuggcuaagcuauaaagucgcgucagaaggcuuucaguacucagauagaagauggugcuuugacggcgaacgcaauaaccaaguucucgaagaaaacauggacguugagauauggacuaaggaaggcgaaaggaagaaacugaggccuagaugguuggacgcacgcacuuacagugauccauuagcgcuuagagaauuuaaagaauuugccgcaggcagacgaucagucucuggagacuuaauucuagagauagggaaguugccucaacacuugacgcaacgagcacaaaacgcauuggauaauuuaguaaugcuccacaacucagaacaaggcggccgggcauauagacacgcuauggaagaacuaccagauaccauagagacuuuaauguuauuagcacuaauugcuguccuuacaggaggagucacauuauucuuucucagugguagagggcuugguaaaacuagcauuggacuauuguguguaauggcuucgagcguccuacuguggauggccucgguugaaccucacuggauagcggcgucuauuauuuuggaauuuuucuuaaugguccuacucauuccagaaccagacagacagcguacaccccaagauaaucaacuagcuuauguaguaaucgggcuccuuuucaugauauuaacggucgcagccaacgagaugggauuauuggaaacaacaaagaaagauuuaggcauaggacauguagcgguggagaaccaccaccaugcaacuaugcuugauguugacuuacauccagcaucagcauggacacuuuaugcaguugcaacaaccauaaucacuccgaugaugagacacaccauagaaaacacgacagcgaacauaucgcuuacagcgauugcaaaccaagcugcuauauuaauggggcuugauaaaggauggccuauauccaaaauggauauaggugucccgcuccuagcacucgggugcuauagucagguaaacccacuuacccuuacugcagcaguucuaauguuagucgcucacuacgcaauuauagggccgggacuacaagccaaagcgacacgugaagcccagaagagaacagcugcagguauuaugaaaaauccgacgguggacgggauuguugcuauugaucuagacccuguaguguacgaugcuaaguuugaaaaacaacuaggacaaauuaugcuuuuaauucucugcacuucacaaauuuugcuaaugcgaacuacgugggcucuuugugaaucaauaacccuggcuacaggaccacucacgacccugugggaagguaguccugggaaguuuuggaacacaacaauugcgguuagcauggcaaauaucuucagaggaucauaccuagcaggagcgggccuagcuuuuucauuaaugaaaagccuuggugguggcagacgaggcacuggagcacaaggggagacacucggcgagaaauggaaacggcaacugaaucagcuuucaaaaucggaauuuaauauauauaaaagaucugguauuauggaaguagauagaucugaagcgaaagaaggguugaagcguggcgaaacgacaagacaugcagucucacgaggaacugcgaaauugaggugguuugucgaacggaacuuagucaaacccgaggguaaagugauagauuuagguugugggagaggagguuggucauauuacugcgccggacucaaaaaggucacagaaguaaaagguuauacaaaaggggguccgggucaugaagaaccaaucccaauggcgacguacggcuggaaucugguuaaauugcauagugggaaagacgucuucuuuacaccaccagagaaaugcgauacacugcuuugcgauauaggagaaucaaguccaaauccaacgauugaagaagggaggacacuaagaguccuaaaaaugguggaacccuggcuucgcggaaaucaauuuuguauaaaaauauuaaauccguauaugccuucgguuguagaaacuuuagaacaaaugcaaaggaaacauggugguauguuagucaggaacccccucucaagaaauucaacacacgaaauguauugggucaguuguggaacaggcaauauuguaucagcaguuaacaugacauccagaaugcugcugaaccguuuuacuauggcucacagaaaaccuaccuaugaaagagauguagauuugggagcugguacgagacauguugcaguggaaccugaaguagcaaauuuggauauaauagggcaaagaauugaaaacauaaagcacgagcauaagucgacuuggcacuacgacgaagauaauccuuacaaaacgugggcguaccacggcucguacgaagugaaaccaaguggaucugccucauccauggugaauggagucguaaaacugcugacaaagccaugggacguuauuccaaugguaacacaaaucgcgaugacagacacaacaccuuuuggccaacaaaggguauuuaaggaaaaaguugacacacgaacaccaaaagcaaaaagaggaacagcacaaauaauggaaguuacagcccgauggcuuuggggguuuuugaguagaaacaaaaagccuaggauauguacuagggaagaauuuacgcgaaaaguccgcaguaaugcagcuaucggugccguauuuguugaugagaaucaauggaacucugcaaaagaagcaguugaagacgagagauuuugggaccugguacaaaaagagagggaauuacacaaacaggguaaaugcgccacaugcguuuacaacaugaugggaaagcgagagaagaaacuuggagaguucgguaaagcuaaaggaagucgcgcuauuugguauaugugguuaggugcgcguuuccuagaguucgaagcucuaggauucaugaacgaagaucauugguucagcagagaaaauucauuaucaggugucgaaggagagggacuacauaaauuaggauauauccuacgggauauaaguaagaucccagggggaaauauguaugccgaugacaccgcagggugggauacacgaauaacugaagaugaucuucaaaacgaagcuaaaauuaccgacauuauggagccggaacacgcauugcuagcaacgucaaucuuuaaauuaacauaucaaaauaaagucguccggguacaacgacccgcuaaaaacgguacgguaauggauguuauaaguagaagggaucaacgugguucuggacaggucggaacuuauggacuaaauacuuuuaccaauauggaagcacagcuaauacggcaaauggagucugaaggaaucuuuuugccaucggaacuugaaaccccuaacuuagcggagcgaguacucgacuggcuagagaaauacgggguagaacgcuuaaaacgcauggcuauuucaggagaugacuguguaguuaaaccaauagaugaucgauucgccacggcauuaacagcucuuaacgauaugggaaaaguacgaaaggauauuccacaaugggagccuaguaagggguggaaugacuggcagcagguacccuuuugcucacaucacuuccaucaguugauuaugaaggauggucgugaaauaguagugccaugcaggaaucaagaugaacuuguagggcgggcaagaguaucccaaggggcagguuggucauuacgagaaaccgccugccuaggaaaaagcuaugcgcaaauguggcagcuaauguauuuucaucgcagggauuuaagacuagcugcaaacgccaucugcucagccguuccuguggauugggugccuacuucgcgaacuacguggucaauucaugcacaucaccaauggaugacaaccgaggauaugcuuucuguauggaaucgcguauggauugaagaaaauccauggauggaggauaagacacauguaagcaguuggggagauguaccuuaucucggaaaacgggaagaucaaugguguggcaguuuaauaggcuuaaccgcacgagccacaugggcaucuaacauucaaguugcaaucaaucaaguuaggcgacuaauaggaaaugaaaauuaucuugacuauaugacaaguaugaaaagauuuaagaacgagggcgacccugaaggggcauuaugguga

SEQ ID NO: 21705 - RNA, 9879 nt, Artificial Sequence
  derived and/or modified CDS sequence (opt6) from DENV-1__FJ882557__SS-prME
ucaguaacuauguuacugauguuaaugccgacagcauuggccuuucacuuaacaacccggggcggcgaaccgcauaugauaguaucgaaacaagaacggggcaaaucgcuacucuucaaaacaagugcuggagucaacauguguacuuugauugcuauggaucuuggagaauuaugugaagacacuaugacguauaaauguccccgaaucacagaagcugaaccagaugauguagacugcuggugcaaugcaacggacacuuggguaacguauggaacguguucacaaacuggggaacacagaagggauaaacgcucaguggcacuagcgccccauguuggauuagguuuggaaacgcggacagagacauggaugucaucagaaggggccuggaaacaaauacaacgaguggaaacgugggcauuaagacacccagguuuuacuguuauagcacuauuucuggcacaugccauugguacaagcauaacacaaaaaggaaucauauucauacuacuaauguuaguaacaccgaguauggcaaugcguuguguugggauagguucaagagauuuugucgaagguuuaagcggagcaacauggguggauguaguucuagaacauggaucguguguuacaaccauggccaaagacaaaccaacuuuagauauagaauuacuaaaaacugaaguuaccaaccccgccguauugagaaaacuaugcaucgaagcaaaaauuagcaacaccacuacagacaguagauguccaacucaaggagaagcaacguugguagaagaacaagacgcaaacuucguaugccgccguacauuuguugaucgcggcugggguaacggguguggacuuuucggaaaagguaguuuaauaacuugcgcaaaauucaaauguguuacuaaacuagaagggaaaaucguucaguaugaaaaccuaaaauacagugucauaguuacaguacauacgggagaccaacaccaagucgggaaugaaucuacagaacauggaaccacggcaacuauaacgccucaagccccuacaacugaaauucaauuaacagacuauggggcauugacucuagacuguucaccacggacaggauuagauuuuaacgaaaugguacuacuuacuaugaaagaaaaaucuuggcuuguacauaaacaaugguuucuagaucugccucuacccuggacaucuggugcuucgacgucucaagaaacauggaaucgacaggaccuauugguuacuuuuaaaacagcacacgcaaagaaacaagaaguaguaguucuaggaucccaagaaggcgcgaugcauacagcauuaacaggugcuacugaaauccagacaucggggacuacgacaauauucgcuggacacuuaaaaugucgacuaaaaauggauaaacuaacucuaaaaggaaugaguuauguaauguguacugguuccuucaaacuggaaaaagaaguugcggaaacucaacauggcacgguauuaguccaaauuaaauaugaaggcacagacgcacccuguaaaauuccauucuccacgcaagaugaaaaaggaguaacacagaauggcagauuaauaacugcuaauccuauaguaacggacaaagaaaagccuguuaauauagaagcggaaccgcccuucggcgaaaguuacaucgucauuggggcuggcgagaaagcgcuaaaacugucaugguucaagaaagggucaagcauaggcaaaauguuugaagcuacagcuagaggggcgcguaggauggcaauauuaggugacacagcuugggacuuuggcaguaucggaggcguuuucacgagcguaggcaaacuaauccaccagauauuugguacugcuuauggaguacucuucucaggaguuucguggacuaugaagauaggcauaggagucuuguuaacauggcuaggccuaaauucuaggucaaccucgcucucuaugaccuguauagccguaggacuuguuaccuuguacuuaggagugauggugcaagcggacaguggaugugugauaaacuggaaggguagggaauuaaaaugcggaucaggcauuuucgucacuaaugaaguccacacuuggacugagcaauacaaguuucaggcagauaguccuaaaagacugagcgcagcaauuggaaaagcgugggaagaggguguauguggcauaagaucagcaacccguuuagaaaauauaauguggaagcaaaucagcaacgagcugaaccauauucuuuuagagaaugauaugaaacuuacaguggugguaggugacguagcaggcauccuuggacaggguaagaaaaugauacgaccgcaaccaauggaauauaaauauaguuggaagaguuggggaaaagcaaagaucauaggugccgaugcacaaaauaccacuuucauaauugacggaccaaauaccccagaaugcccagaugaucaaagagccuggaacauuugggagguagaagacuacggauuugguauauucacgacaaacaucugguuaaaacucagggacucuuacacucaagugugcgaucacagacuaaugucagcagccauuaaagauucgaaagcuguucacgcggacaugggcuauuggauagaauccgagaagaacgaaaccuggaaauuagcgcgagcguccuucauagagguuaaaacaugcauuuggccuaaaucacauacucuauggagcaaugggguucuugaguccgagaugaucauaccuaaaaucuacggaggcccgauuagccaacauaauuauagaccaggauacuucacucagacggcugggccuuggcauuuagguaaguuagaauuagacuuugaucuuugugaagggaccacagugguuguugaugaacacugcggaaacagagggcccucguuaagaacaacgacaguaacugguaaaauuauccaugaaugguguugucggucauguacacuaccucccuuacgauucagaggagaagauggauguugguacggaauggaaaucagaccuguaaaagaaaaagaagagaauuuaguaaaaagcaugguuucagcaggcucaggagagguagacucguuuagucuuggucuacuuugcauaucuauaaugauagaagaaguaaugcgaagucgauggagucgaaagaugcucaugaccggaacauuagcaguauuuuuccuguuaaucauggggcaacuaacguggaacgaucuuauaaggcuuuguauaaugguaggugcaaaugccuucgaccggauggguaugggaacaaccuauuuagcacuaauggcaacuuuuaagaugcgucccauguuugcagucggguuacucuuucgaagauuaacaucucgggaagugcuauuacuaaccaucgguuuaagccuuguagcaaguguugaacuuccaaauuccuuagaagaacucggugauggacucgcuaugggaaucaugauccuaaaacuacuaacggacuuucaaucacaccaauuaugggcgacgcuacuuagucuuaccuuuaucaaaacuacguucucuuuacauuacgcuuggaaaacaauggcaaugguacuuaguauugucagcuuauuuccccucugucuaaguacaacgucacagaaaaccacauggcucccuguccuauuaggcagucuaggaugcaagccucuaacuauguuccuaauagcagaaaauaaaauauggggaagaaagagcuggccuuuaaaugaagggauaauggccgucgguauaguaaguauucuccuaaguaguuuacuaaagaaugauguuccauuagcagggccucuuauagccgguggaauguuaaucgcauguuacguaaucucgggaucuucagcagaccuuucccucgagaaagcggcugaaguuagcugggaagaagaagcagaacauucuggugcuucucacaacauacucguggaaguacaggaugacgguaccaugaaaauaaaagacgaagaaagagaugacacucuuacaaucuuauugaaagcaaccuuacuugcuguaaguggagucuacccccugaguauucccgcaacgcuuuucguuugguauuucuggcagaagaagaaacaacguagcgguguucuaugggacacacccaguccacccgaaguagaacgugcaguauuagaugaugguauauacagaaucaugcaaagaggucuucuuggacgaagucaagucgguguuggcguuuuucaagaaaacguuuuucauacaauguggcacgugacgcguggugcaguauuaauguaucaagguaagagacuagagccaucgugggcaucugucaagaaagaccuaauaaguuauggcgguggauggagauuaagagggucuuggaauacgggcgaagaaguacaagucauugcgguggaaccaggaaagaacccuaagaacgugcaaaccgcaccugggaccuucaaaacuccugaaggagaagugggugcaauagcauuagauuuuaagccaggcacuucaggcuccccaauaguuaaucgagaagggaaaauaguuggauuguacggaaauggaguaguuacaacuucaggaacauauguuagcgcaauagcacaagcgaaggcgucacaggaaggaccacucccagaaauugaggaugaaguauucagaaaaagaaauuuaacgauuauggacuuacacccuggcucagguaaaacuaggagguaucuuccagcuaucguacgagaggcgauuaaaagaaaauuacguacacuaauucuagccccaacuagaguaguugcuagcgaaauggcagaagcacuaaaagguaugcccauacgauaucagacaacggcuguuaagagugaacacacggguaaagagaucguagacuugaugugccaugcgacauucacuaugagguuacuaucgccgguacgaguuccaaauuacaacaugaucauuauggaugaagcacacuuuacagaucccaguucaauugcggcaaggggguacauuucgaccaggguaggcaugggcgaagcagcggcaauauuuaugacugcaacuccgccagggucgguggaggcauuuccucaaagcaaugcugucauucaagaugaagaaagagauauaccagaaagauccuggaacucaggacacgaauggauuacagauuuuccagguaagacugugugguuuguuccaaguaucaaaucaggcaaugauauugcuaauuguuuacguaaaaaugggaaacgcgugauacagcucaguagaaagacguuugauacugaauaucagaaaacuaagaacaaugacugggacuacguagugaccacagauauaucagaaaugggagcaaauuuuagggcagauaggguaauagauccaagaagaugucucaaaccagugauacugaaagacgguccggaacgaguuauauuagcgggaccgaugccuguaacaguagcuuccgcugcgcaaagacguggaagaauuggccgaaaccacaacaaggaaggugaucaguacauauacaugggacaaccauuaaauaacgaugaagaucacgcacacuggacagaagcuaaaaugcuucucgacaauauuaacacuccagaaggcauuaucccggcauuauucgaacccgaacgggagaaaagugcagcugucgacggagaguauaggcuacgaggagaagcuagaaaaaccuuuguagaguuaaugcgcagaggggauuuaccgguuuggcuauccuauaagguugcgucagaaggguuucaauauucagauagaagguggugcuuugauggagaaaggaauaaucaaguauuagaagaaaauauggauguagaaauauggaccaaagagggugaaaggaagaaacuacguccaagaugguuagacgcacgaaccuauagugacccacuugcccucagagaguuuaaagaauuugcagcaggacgccguucuguuucuggugacuuaauacuagaaauugguaaacuuccacagcaccuaacccaaagagcacagaacgcacuugauaaucuugugaugcugcauaacuccgaacaaggcgggagggcauacaggcacgccauggaagaacugccggacaccauagaaacucugauguuacuagcauugauugcaguauuaaccggugggguaacauuauucuuucucucaggucgaggacuuggaaaaaccaguaucggauuacucuguguuauggcaucaucaguucuguuguggauggcaagcgucgaaccucacuggauagccgcaucaauaaucuuagaauuuuuccucaugguacuguuaauuccggaaccggaccgccaaagaacaccacaagacaaucaguuggcuuauguagucauaggucuguuauuuaugauacugacaguagcagccaaugaaaugggauuacuugaaacaacaaagaaagaccuuggaauuggccacguggccguagaaaaccaucaucaugccgcaauguuagauguagaucugcauccggcaucugcauggacacuuuacgccguagcuacaaccauuauaacccccaugaugagacauacaauugaaaauacuacagcuaauauaucacugacagcaauugcaaaccaagccgccauacugaugggucucgauaaaggauggccgauuaguaagauggauauuggagugccccuacuugcauuggguugcuacucucaagucaaucccuuaacaaugaccgcagcugucuugaugcuaguggcccacuacgcaauuauuggcccuggauuacaggcuaaagcaacuagagaagcacaaaaacgaacggcggcugguauuaugaaaaauccaacuguggaugggauaguugcaaucgaccucgauccaguaguauacgaugcgaaauuugagaagcaacuaggccaaauaauguuacucauacugugcaccagccaaauauuacugaugagaaccaccugggcgcuaugcgaaaguauuacuuuagcuacaggaccguuaacgacgcuaugggaagguagcccggguaaauuuuggaacacgacaauugcugucagcauggccaacauuuucagggguucauacuuagcgggagccggcuuggcuuuuaguuuaaugaaaucauugggaggagguagacguggaacaggugcacaaggagaaacguuaggagaaaaauggaaacgccagcuaaaucaacuuagcaaaagcgaauuuaacaccuauaagcguucggguauuauggaaguagauagaagugaagcaaaggaaggacuuaaaagaggugaaacaacaaaacacgcaguuucccgcgggacagccaaauugcgcugguuuguugagcggaauuuaguuaaaccagaaggaaaagucauugauuuaggauguggaaggggaggaugguccuauuauugugcaggacuuaagaaagucacugaaguuaaaggguauacaaaaggaggaccugggcaugaagaacccauaccuauggcaacauauggguggaaucuugugaagcuacacucagggaaggauguauuuuucauaccaccggaaaaaugugacacacugcuaugcgacaucggugagagcaguccgaauccuacaauugaggagggucgaacacuucguguacugaaaaugguugaacccuggcuucgagguaaccaauuuugcauaaagauccuaaauccguacaugccgucaguaguugagacccuagagcagaugcagcguaagcacgggggaauguuaguucgaaacccucuaucuagaaauucgacacaugagauguauuggguaucgugugggacuggaaauauaguuucagccguaaauaugacgucacgcaugcuauuaaauagguucacaauggcgcacagaaagccaaccuaugaaagagauguagauuuggggacaggaacuagacauguggccguugaacccgagguugcuaaccucgauauaauaggucaaagaauagaaaauauaaagcacgaacacaagaguacuuggcauuacgaugaagauaauccuuauaagacaugggcguaucauggauccuaugaaguuaaaccaagugggucggcgucaucaauggugaacgguguugugaaauuauuaaccaaaccaugggauguuauuccuaugguaacccagauugcaaugacggauacaacaccguuuggacagcagaggguauucaaggaaaaaguagacacucggacgccuaaagcaaaaagaggaacugcucaaauaauggaagucacugcacgaugguuguggggguuccuaucccgaaacaaaaagccaagaauuugcacacgugaggaauuuacaagaaaagugcgaucaaaugcagccauaggugcuguguucguugacgaaaaccaauggaauagugcaaaagaggccguggaggacgaaagauuuugggaucucguacacagagaaagagagcuucauaaacaagguaaaugugcgacaugcguuuacaauaugaugggaaagagggagaagaaacugggagaguucgggaaagcaaaagguaguagagccauaugguacauguggcuuggagcacgauuucuggaguucgaggcauuagguuuuaugaacgaagaccauugguuuucgcgugaaaauucuuuaagugggguggagggggaaggguuacacaaguuagguuauauauuacgagauauaaguaaaaucccaggugguaauauguacgcagacgacacugcaggaugggauacuagaauaacggaagacgacuuacaaaacgaggcaaaaauuacagacaucauggaaccugaacaugcucuacucgcaaaggcaauauuuaaauuaacauaccaaaauaaaguuguucguguacaaagaccagccaaaaacgggacagucauggacguuauaucacgccgugaucaaagggguaguggucaagucgguacauacggccucaauacuuuuaccaauauggaagcucaacuaauuaggcaaauggaaagcgaagggauauuuucuccauccgagcuagaaacaccuaaucuggccgaaagagcuuuagauuggcuugagaaauaugguguugagcgacuaaaaagaauggccauuagcggggacgacuguguagugaagccgauagaugaucgauuugcuacugcuuugaccgcacuaaaugacauggggaaagugcgaaaggacauuccucaaugggagcccuccaaaggcuggaaugacuggcaacaagucccauucugcucucaccacuuucaucaauuaauuaugaaagauggaagggaaauugucguuccguguagaaaccaggacgaguuagucggaagggcaagggucucacaaggagcagguuggagucuaagagagacagccuguuugggaaaaaguuacgcacagauguggcaauuaauguacuuccaucguagggaccuacggcuagcagcaaacgcgauaugcagcgccguaccaguagauuggguuccaacaagcagaacgacauggaguauccacgcacaccaccaguggaugacaacugaggauaugcuaucugucuggaacagaguuuggauagaggaaaacccauggauggaggacaaaacacacaucucaucuugggaggaugugccuuaucugggaaaaagagaagaucaguggugugggucccuaauaggacuaacggcgcgugcgaccugggcaacaaauauucaaguagcaaucaaucaaguucggagacuaauugguaacgagaacuacuuagauuauaugaccucgaugaaacgauuuaagaacgaaucugaucccgagggggcacucugguaa

SEQ ID NO: 21706 - RNA, 9879 nt, Artificial Sequence
  derived and/or modified CDS sequence (opt6) from DENV-1__FJ882558__SS-prME
ucaguaacuaugcuucugauguuaaugcccacggcauuggcauuucauuuaacuacuagagguggagaaccacauaugauagugucaaaacaagaaagggguaaaucgcuucuguucaaaacaagcgcggguguaaauauguguacucucauagcuauggauuugggagaguucugugaagacacaaugacuuacaaauguccaaggauaacggaagcugaaccagaugauguagauuguugguguaaugcaacagacacauggguaaccuacggaacuugcagccaaacgggagaacauaggagagauaaaagaagugucgcucuugcaccacaugucgggcuuggcuuggaaacgagaaccgaaacauggaugaguagcgaaggagcguggaaacaaauucaacgagucgaaaccugggcauuaagacacccaggcuuuacgguaauagcacuuuuucucgcacaugcuauuggaacuuccauuacacaaaaaggaaucauauucauuuuguuaaugcugguuacaccgucgauggcaaugaggugcgucggaaucgguucacgagacuucguugaaggucuaaguggugcuacuuggguagaugucguauuagaacacgguaguugcguaacaacaauggcuaaagacaaaccuacccuugacauagaauuacuaaaaacagagguuacaaacccagcaguucuacggaaacuaugcauagaggccaaaauauccaacacaacgacugauucacgaugcccaacacaaggugaagcaacuuuaguugaggaacaagaugccaacuuuguaugccggcguacauucguagacagaggauggggaaauggaugcggacuuuuugguaaaggcaguuuaauuacuugcgcaaaauucaaaugcgucaccaaacuggaggguaaaaccgugcaauaugaaaaccuuaaauacucgguaauagugacuguacauaccggggaccaacaucagguaggcaaugaauccacggaacauggaacaaccgcgaccauaacaccucaagcucccagcacggaaauucaauugaccgauuacggggcuuuaacacuugacuguucaccgagaacugguuuggacuucaaugaaaugguucuucuuacgaugaaagagaaaucguggcugguacacaaacaaugguuccuugaucuuccuuuaccguggacaaguggagcuucuacgagucaggagacauggaaccguaaggacuugcuaguuacauuuaagacugcucaugccaagaaacaggaaguaguaguccuuggcucccaggagggagcuaugcauaccgcacucaccggcgcuacggaaauccaaaccagugggacaacaacuauauuugcagggcacuuaaaaugccggcuuaaaauggauaaauugaccuugaaaggaaugucauacguaauguguaccggcagcuuuaaauuagaaaaagaagucgcagaaacgcaacacggaaccguacugguacagaucaaguaugaaggcacagaugcaccauguaaaauccccuuuucuacacaagacgagaagggcguuacucaaaauggaagguugauuacugcaaauccuauaguaacggauaaagaaaaacccguaaauauagaagccgaaccuccauuuggagaaucuuauauuguuauuggagcgggagagaaggcuuuaaagcugucuugguucaagaaaggaagcucaaucgguaaaauguuugaagcaacggcgagaggagcucgaagaauggcaaucuugggagauacggcgugggacuucgguucaauaggcggcgucuuuacuagcguuggaaagcucguacaucagauuuuugguaccgccuauggagucuuauucucaggaguaagcuggacaaugaaaauagggauaggggucuuguuaacuugguuagguuugaauagcagaagcacuucuuuaucaaugacaugcauagcaguuggcuuaguaacgcuguauuuaggcgugaugguacaagcagacucuggaugcgucauaaacuggaaaggacgcgaacuuaagugcggaucaggaaucuuugugacaaaugaagugcauacguggacagaacaauacaaguuccaggcagacaguccaaagagacuuucagcugcaauugguaaagcaugggaggaaggcguaugugguauaagaucagcuacuagacuagaaaauauaauguggaaacaaauaucaaaugaguuaaaccauauauuguuggaaaacgauaugaaguucaccgugguaguaggagauguugcaggcauuuuagcucaggguaaaaagaugauaaggccacaaccgauggaguauaaauacuccuggaaaucaugggggaaagccaaaauaauaggugcagauguucagaauacaacguuuauaaucgacggaccuaauacaccugaguguccagacgaucaaagagcuuggaacaucugggagguugaagauuacgguuucggaauuuucacuaccaauauaugguuaaaauuaagagauucguacacccagguaugcgaucauaggcuaaugagcgcugcaaucaaggauuccaaagcgguccacgcugauaugggauauuggaucgaauccgagaaaaaugaaacauggaaacuagcuagagcgucuuuuaucgaagugaaaacgugcauuuggccuaaaucucauacguuguggucuaaugguguuuuagaaagugagaugauaauuccgaaaaucuaugguggaccaauaucgcaacauaauuaucgaccaggguauuucacucaaacagcagguccauggcaucuaggaaaauuggaacuggauuucgauuuaugcgaaggaaccacagugguuguagaugaacauugugggaacagaggacccucacuacgaacaacaacuguaaccgguaaaaucauucacgaaugguguugcagaucaugcacucucccaccacuaagauucaaaggugaggaugggugcugguacggaauggagauuagaccggucaaggaaaaggaagaaaauuuaguuaagagcaugguuucugcaggaagcggagaagucgacagcuuuagcuugggauuguuguguaucuccauaaugauugaagagguaaugagaucgagauggucacgaaaaauguuaaugacaggaacuuuagcuguuuucuuucuucuuauaaugggucaacugacauggaaugauuuaauaagacuaugcauaaugguaggagccaaugcaagugauagaaugggaaugggaacuacauauuuggcucucauggcaacguuuaaaaugaggccaauguucgccgugggccuacuauuuaggagacuaacaagccgggaaguacuguuguuaacaauaggauuaaguuuaguagccagugucgagcuaccuaauagucuagaagaauuaggcgacgguuuagcuauggggauuaugauacuaaaacuuuuaaccgacuuccaaucacaucaguuaugggccacguuacuaucguuaacuuuuauaaagacuacauucucacuccauuaugcauggaaaacuauggcuauggugcuaaguauugucagcuuauucccguuauguuugucaacaacaucucagaaaaccacuuggcuaccaguucuacuagggucauuaggcuguaaaccgcugaccauguuuuuaauugcagagaauaaaauauggggacguaagagcuggccauugaacgaaggcauaauggcaguuggaauuguaaguauuuuacucaguuccuugcucaaaaaugauguaccacuagccgguccacugauagcgggaggaaugcuaauugcauguuacgugauuucgggcucgagugcagacuuaucccuagagaaagcagcugaaguaucgugggaagaagaagcugaacacuccggagccagucacaauauccuuguagagguccaagacgacggaaccaugaaaauaaaagaugaagaaagagacgacacacucacuaucuuauuaaaagcuacacuauugacaguaucaggaguuuauccuuuaucaauacccgcgacccuauuugugugguauuuuuggcagaagaagaaacaacgaagugguguauugugggauacacccucgccucccaagguagaacgagccguccuggaugaugguauuuauaggauuaugcaacgcggauuauuggggagaucacagguaggcguugguguauuucaagaaaauguauuccacacgauguggcauguuacuagaggagcuguauuaauguaccaaggaaaacggcuagaacccaguugggcaucggugaagaaagaccuaauaagcuacggagguggcuggagauuacaagguaguuggaauacuggagaggaaguucaaguuauagccguugagccuggcaaaaaccccaagaacguacagaccgcuccuggaacguucaaaacaucagaaggggaggugggcgccauugcauuagauuucaaaccgggaacuucggggucaccgauaguaaaccgagagggcaaaauaguaggauuauauggcaacggcguugugacaacaucugggacguacguaagugcaauugcccaagcgaaggccucccaagaagguccauuaccagaaauugaagaugaaguauuucguaagcgaaaccuaacgauaauggauuuacauccgggaucaggaaaaacacgcagauaucuucccgccauuguacgcgaagccauuaaaaggaaacuacguacucucauucucgcgccuacaagaguuguugccagugaaauggcugaagcucuaaaagguaugccaaucagauaucaaacaacagcagucaaaucagaacauacuggaaaggagauaguagauuuaaugugucacgccacauucacaaugcgucuucuaucaccaguccggguaccaaauuauaauaugaucauaauggacgaagcacauuuuaccgaucccucauccauagcugcgagagguuauaucucaacacguguuggcaugggagaagcagcagccauauucaugacugccacucccccaggcucaguugaggcuuuuccacaaucuaaugcugugauucaagaugaagaacgcgauauaccagaacguucuuggaauagugguuacgaauggauaacagacuuuccaggaaaaacagucugguucguaccaaguaucaaauccgggaaugauauugcaaauugucuucgaaagaauggaaagcguguaauacaacuuucccgaaagacuuucgacacagaauaccagaaaacgaaaaacaaugacugggauuaugucgugacuacggauauaagugaaaugggggcaaauuuccgagcagauagagugaucgacccuagaagauguuuaaaaccggucaucuuaaaagacgguccugaaagggucaucuuggcaggcccuaugccuguuaccguagcgagugcagcucagagacgcggaagaauaggacggaaucacaauaaagagggcgaccaauacauuuauaugggccaaccacugaauaacgaugaagaucacgcacacuggacggaagcgaaaaugcuuuuagacaacauuaauacaccagagggcauaauacccgcuuuauuugaaccagaaagggaaaagagcgcggcgaucgauggugaauauaggcuaagaggagaggcucggaagacuuucguagagcuaaugcguagaggagaucuaccaguauggcugagcuauaagguugcaucagaaggauuucaauacagugacagaagauggugcuucgacggagaacgcaauaaucagguguuggaggaaaauauggacguugaaauauggacaaaagaaggagagcgaaagaaauuacggccucguuggcuagacgcccggaccuauucagacccucuagcucugcgagaguucaaggaguucgcugccgguagacguuccguuaguggugaucuaauucuggagauaggaaaacuuccacaacaucugacucaacgagcacagaaugccuuggacaacuugguaaugcuacauaauagcgaacaaggugggagagcauaucgacaugcaauggaagaauuaccugacacaauagagacuaugaugcuauuagcauugauugcaguucuaacaggaggaguuacgcuauucuuucucagcggaagagggcuaggaaaaacuucuauaggauuauuaugugucauggcuagcagcguacugcucuggauggcuuccgucgaaccgcauuggauugcugcaucaaucauuuuggaauuuuucuugaugguacuauuaauaccggaacccgacagacaaagaacaccgcaagauaaucagcuagcuuauguaguuauaggccuacucuucaugauauugacaguagcugcaaaugaaaugggacuucucgaaacaaccaagaaagacuuaggaauaggucauguugcaguugaaaaccaucaccaugccgcuauguuggaugucgaucuucauccagcuagcgcguggacacuguaugcaguagcuacuacaauuaucaccccuaugaugagacauacuauugagaacaccacagcgaacauuagcuugacagcuauagcaaaucaagcagcaauucuaaugggucuagauaaaggauggcccauuaguaaaauggauauaggaguacccuuauuggcauuaggaugcuacucgcaaguaaacccauuaacguuaacugccgcugugcucauguuaguagcccacuacgcuauaauuggacccggauuacaagcgaaagccacccgcgaggcucagaaacgcacggcagcaggaaucaugaaaaauccaaccguagaugguauaguggcaauagacuuagauccgguuguguaugacgcuaaauuugaaaaacaauuaggccagauuaugcuacuaaucuuaugcacaucccagaucuuacugaugcguacaacuugggcuuuaugugagagcauaacuuuagcaaccgguccccuaacuacacuuugggaaggcaguccuggcaaauuuuggaauacaacaauugcggugucaauggcuaacauuuuccguggaucauauuuagccggugcaggauuagcuuuuagcuuaaugaaaagucugggagguggaagaagaggaacaggagcacaaggugaaaccuuaggugaaaaauggaaacgacaguuaaaucaacucucaaaauccgaguuuaauaccuauaaacguucagguauaauggaggucgaccgaucagaagcuaaagaaggccuaaagcgaggagagacgacgaagcacgccguaucaagaggaacagcuaaauuacgaugguuuguagagcggaauuuaguuaaaccugaagguaaggugauagacuuagguugcgguagagguggguggucguauuacugugcaggucuuaagaaagucacugagguaaaaggcuacacgaaaggaggaccaggacaugaggagcccauaccgauggcaacguauggauggaaccucguaaaacugcauucaggcaaagacgucuucuuuaucccacccgaaaaaugugauacgcuacucugugauaucggagagucuucaccuaacccuacuauagaagaagggagaacacugcgaguacugaaaaugguagaaccaugguuacgcggaaaucaauuuugcaucaagauccuuaacccauacaugccaagcgucguugaaacucuugaacaaaugcaacguaaacauggcgguaugcuuguuaggaauccguugucuagaaauucgacucaugaaauguacugggucucaugugguacuggaaacauuguaucagcuguaaauaugacaucucguauguuacuaaauagauuuacaauggcucaucgaaaacccacauacgaaagagacguagacuugggugcaggaacaagacaugucgcugucgaaccagaaguagcgaacuuagauauaauaggucagaggauagaaaauauuaaacacgaacauaaaucgacguggcacuaugaugaagauaauccauacaaaacgugggccuaccacggaucguaugaagugaaaccgucagggagcgcuaguaguaugguaaacggugucguaaaauuauuaacuaaaccuugggaugucauuccuaugguuacacagaucgcaaugaccgauacgacaccguucggacaacagaggguuuuuaaagaaaaggucgacacacggaccccuaaagcaaaacguggaacugcacaaauuauggaaguuacagccaaguggcuauggggcuuuuugaguaggaauaaaaagccgcggauuugcacaagggaagaauuuacaaggaaaguaagaucaaaugccgccauuggugcgguauuuguagacgaaaaucaguggaacucagcgaaagaagccgucgaagaugaaagauuuugggauuuaguacauagagaacgggaauuacauaagcaagguaaaugcgcaacauguguauauaauaugaugggaaaacgcgaaaagaaguuaggugaauuuggaaaggcgaaagguagcagagcaauaugguacaugugguuaggugccagauuuuuggaguucgaggcacugggauuuaugaaugaagaucauugguuuagcagggaaaauuccuuaucggguguggaaggugaagguuugcauaaacucggcuauauucugcgcgauauuucuaaaauaccuggaggaaacauguaugccgacgauacagccggaugggacacacguauuacugaagacgaucugcaaaaugaagccaagauaacagacauaauggaaccugaacacgcuuuacuagcaaagucaauauuuaaacucacauaccaaaauaaaguuguacgaguacaacgaccagcgaaaaauggaacaguaauggacguaauuucgagacgugaucaaagaggcucgggucaaguagguacauauggauuaaauacauuuacgaacauggaggcacaacugauacgacagauggaaucagaggguauauuuucaccuucagaacuagaaacuccaaaccuagcucgacgcguccucgacugguuggaaaaacacggcguagaaagauuaaagagaauggcuauaagcggcgaugauugcguuguuaaaccgauagaugauagauuugcuacagcucucacagcuuuaaaugauaugggaaaaguaagaaaagauaucccucaaugggaacccuccaaagguuggaacgauuggcaacaaguaccauucuguucucaucauuuucaccaauugaucaugaaagacggccgcgaaauuguaguacccuguagaaaucaagacgagcuagugggcagagcaagagucagucaaggagccggcuggagccugagagaaaccgcaugccugggaaagaguuaugcucaaauguggcaauugauguacuuccacagacgagaccuacgauuagcugcaaacgcaaucugcucagccguaccuguugauuggguaccgacaaguagaacaacuuggucaauccacgcacaccaccaauggaugacgacagaagauauguuaagcguauggaauagaguguggauagaagaaaaucccuggauggaagauaaaacacacaucagcucguggggcgauguaccguacuuggguaagcgugaagaccaguggugcggaagccuuaucggauuaacugcccgcgcaacaugggccacgaauauccagguagcgauuaaccaagugcgacgacuaauaggcaacgagaauuauuuagauuacaugaccucuaugaagagauuuaagaacgaaucagacccugaaggggccuuaugguaa

SEQ ID NO: 21707 - RNA, 9879 nt, Artificial Sequence
  derived and/or modified CDS sequence (opt6) from DENV-1__GQ199824__SS-prME
ucagucacaaugcugcuuaugcuuaugccuacagcguuagcuuuucaccuaacaaccagaggaggugaaccucacaugauaguuucgaaacaagaaagaggaaaaucacuauuauucaaaacuucggcgggaguaaacaugugcacccuuauugcaauggaucuaggagaauuuugcgaagacaccaugacauauaaaugcccucgaauaacugaagcagaaccagacgacguagauugcugguguaacgcaaccgauacauggguaacauacggaacuugcagccaaacaggagaacauagaagagauaaaagaaguguggcgcuagcgccacauguuggucucggacuugagacaagaacagaaaccuggaugagcuccgaaggagcauggaaacaaauacaacguguagaaacaugggcauugcgacauccaggguucacuguaauagcacuguuuuuagcacaugcuauaggaacaaguaucacccaaaaagggauaauuuuuauacucuuaauguuaguaacaccuucgauggcaaugagaugcgugggaaucggaagccgagacuuuguagaaggacugucaggcgcuaccuggguagauguuguuuuagaacacgguucguguguuacaacuauggccaaagauaaaccuacauuggacauugaauuauugaaaacugagguaacuaacccagcgguauuaaggaaacuuuguauagaagcaaaaauaucuaauacuaccacggauagccgaugcccaacccaaggugaagcaacccucgucgaggagcaagacgccaacuucguuugccggaggaccuuuguagacagggguugggguaauggaugcggguuauucgguaaaggcagcuugauaacaugugcgaaauuuaaaugcgugacgaaacuagaagggaaaaccguacaauaugaaaaucugaaauacucugugauaguaacgguucacacaggagaucaacaucaaguuggcaacgaaagcacagaacacggaacuaccgcaacuauuacgccacaagcaccaaguacugagauacaacuuacugauuauggcgcacucacacuagacugcagcccacggacaggauuagauuuuaaugagaugguccuccuuacuaugaaagagaaaagcuggcugguccauaaacaaugguucuuagaucuaccuuuaccuuggacaaguggagcuagcacaagucaagaaaccuggaaucgaaaagaucuacuuguaacauuuaaaacugcacaugcuaagaaacaagaaguggugguacuagggagccaagagggcgccaugcauacggcucuuaccggagcgacugaaauacaaaccucaggaacaacaacuauauuugcaggccauuuaaaaugcagacucaaaauggauaaauuaacacucaaagguaugucauacguaaugugcacugguucuuucaaacuagagaaagaaguagcugagacucaacacggcacaguccuaguucaaauuaaauaugaggguacugaugcuccaugcaaaauaccuuuuaguacacaagacgaaaaagggguuacccaaaaugguagguuaauuacugcgaacccaauaguuacagauaaagaaaaaccuguaaauauugaggcugaaccaccuuucggugagaguuauaucguaaucggagcgggagagaaggcuuuaaaauugaguugguucaagaaagguucaagcaucggaaaaauguuugaagcuacggcccgaggcgcaaggagaauggcaauauuaggcgauacugcgugggauuuuggaucaauaggagguguguuuacuucagugggcaagcuaguacaucagauuuuuggaacagcauaugguguucuauuuaguggaguauccuggacaaugaaaauaggcauaggggugcuuuugaccugguuaggauugaacucaagaagcacaaguuuaagcaugacuuguaucgcgguagggcuaguaacucuuuacuuaggaguuauggugcaagcugacucaggcugcguaauaaacuggaaggguagagaguugaaguguggaagcggaauuuuuguaacaaacgagguacauacuuggacagaacaauacaaauuucaagcugacagcccaaaacguuuaucugcggcaaucgguaaagcaugggaagaaggcguauguggaaucagaucugcaacuaggcuagagaauauaauguggaaacagauauuaaacgaauuaaaccacauucuucuugagaacgacaugaaauuuacggugguuguaggcgacguagcugguauucucgcacaagguaagaaaaugauuaggccacaaccuauggaauauaaauauagcuggaagucauggggaaaagcuaagauaauuggugcagacguacaaaacacuaccuucauaauagaugguccuaacacaccugagugccccgaugaucaaagagccuggaauauaugggaaguagaagauuauggauuuggaauauuuacaacuaacauaugguuaaaacuuagagauucauauacucaagucugugaucaucguuuaauguccgcagcaauaaaagauucuaaagccguccacgcggacaugggauauuggauagaauccgagaagaaugaaaccuggaaacuagcacgggcaaguuuuauugagguaaaaacauguaucuggcccaagagucacacacuauggaguaacgguguguuagaguccgaaaugauaaucccaaaaauauauggaggcccaauuagccaacacaauuauaggccaggauacuuuacgcagacagccgggccauggcacuuggguaagcucgaguuagauuuugacuugugcgaagguacgacaguaguaguagaugagcauugcggaaacagagggccaucauugaggacgacuacagugacggguaagauuauacaugaauggugcugcaggucguguacacucccaccgcugagguucaagggggaagauggguguugguacggaauggaaauccgaccaguuaaggaaaaagaagaaaaucuuguaaagucuaugguuucagccggcaguggggaaguggacaguuuuagcuugggcuuguuaugcauuucgauuaugauugaagaagucaugcgauccagauggagucgcaaaauguuaaugacaggaaccuuagcaguuuucuuucuacuaauaaugggacaguuaacguggaaugauuuaaucagacucugcauaaugguaggcgcgaaugcgucggacaggauggguaugggaaccacuuaucuggcauugauggccacuuuuaaaaugaggcccauguuugccguaggauuauuauucaggagauugacgagucgagagguuuuauugcucacgaucggucuaagucuugucgcaucggucgagcugcccaacaguuuggaagaacucggggauggcuuagcuauggguauuaugauucuaaagcuacucaccgacuuucaaucgcaucaauuaugggcuacauuacugagucuuaccuuuauaaaaacaacuuuuucgcuucauuacgccuggaaaaccauggcuaugguuuugucaauaguuucguuauuuccuuuaugccuuucuacaacuucacagaaaaccacaugguuaccagugcuauugggaaguuuagguugcaaaccacucacaauguucuuaauagcugagaacaaaauuuggggcagaaaauccuggccauugaaugagggaauaauggcugugggaauuguuagcaucuuguuaaguagucugcucaaaaaugauguuccauuagcgggaccucucauagcaggaggaaugcuaaucgcguguuacgugauuucgggaaguucagccgaucuuucucuggaaaaagcugcagaaguguccugggaagaagaagcugaacauagcggagcaagucacaauauuuuaguggaagugcaagaugauggaacuaugaaaauaaaagacgaagaaagggacgauacacuaacaauacuacuaaaggcaaccuuauuagcagucaguggagucuacccacuuaguauaccagcuacuuuauuugucugguauuuuuggcagaagaagaaacaacgcucugguguacuaugggauacaccaucgccgcccgagguggaacgagccgucuuagaugacgggauauacaggauaaugcaaagaggccuuuugggccgcagccaagucggaguuggaguuuuucaagagaacguauuccacacaauguggcacguaacuagaggagccguacuaauguaccaaggaaaaagauuagaaccaucuugggccaguguuaagaaggauuuaauaucauauggagguggcuggcguuuacaagguagcuggaacacaggugaagaaguccaagucaucgcugucgagccgggcaagaaccccaaaaacguacagacagcuccagggacauucaaaaccagcgaaggagaaguuggugcaaucgcguuagacuucaaaccuggaacuucgggcuccccaaucguaaacagagaaggcaaaauagugggacuguauggcaaugguguaguaacuacgucugguacguacguuucggcaauugcucaagccaaagcaagccaggaagguccauuaccugagaucgaagaugaaguauuccgcaaaaggaaccuaacaauuauggauuuacauccugggucuggaaaaacuagaagauauuuaccagccauaguccgggaagcuauaaagcgaaaacuacgcacgcuaauucuagcuccuacaagagucguggcaucugagauggcugaagcucucaaaggcaugccaauuagguaucaaacaacagcaguaaaaucagaacauaccggaaaggagaucguugaccuaaugugccaugccacuuuuaccaugagauuacuuucuccaguuagagucccuaauuacaacaugauaaucauggacgaggcucacuuuacggacccaucgucaauugcggcucgaggcuauauuaguaccagggugggaaugggagaggcagcagcaaucuuuaugacugcuacuccuccugguucaguagaggccuuuccacaaagcaaugcgguaauacaagaugaagagagagacaucccagaacguaguuggaacucugguuacgaauggauaacagacuuccccggcaagacggucugguuugugccaucgauaaaaucgggcaaugauauagcgaauugucuaagaaagaauggcaaaagaguaauccaacuaucaaggaaaaccuucgacaccgaauaccagaaaacuaagaauaaugauugggauuauguagugacuacggacauaucagaaaugggagcuaauuuuagagcugaucgugugauagacccucguagaugucuaaaaccagucauccuaaaggaugggcccgagagaguuauauuagcuggcccaaugccuguuacuguugcaagugccgcucaacguagagguagaauuggcagaaaccacaauaaagaaggcgaccaauauauuuacaugggacaaccauuaaacaacgaugaggaucacgcgcauuggacugaggccaaaaugcuacucgauaauauaaauacaccagaagguauuaucccagcacuuuuugaaccagaacgagaaaagagcgcugcaauagauggcgaauauagacuacggggugaagccagaaaaacuuucguagaacugaugaggaggggugauuugccagucuggcuauccuauaaagucgcaucagaagguuuccaauauagcgaccggcgguggugcuuugacggagagcgaaauaaucaaguauuagaagaaaauauggacguugaaauuuggaccaaagaaggagaaaggaagaaacuccguccuagaugguuagacgcuagaacauacucugauccacuagcucucagggaauuuaaggaguucgccgcugguagaagauccguaaguggugaucuaauuuuggaaaucgguaaauuaccucaacaccuuacucaacgagcacaaaaugcacuggauaauuuagugaugcuacauaauagugagcagggcggcagggcauauagacacgccauggaagaacugcccgacacaauagaaacacuaaugcuuuuagcacuuaucgcuguuuugacaggcggcgucacauuauuuuucuuaucgggucgaggucuagggaaaacaucaauaggucuacuaugcgucauggcgaguucaguucuacuauggauggcaucaguagaaccucauuggauagcagcaaguauaauauuggaguucuuucucaugguucuacugaucccugaaccagacagacaacgaacgccucaagauaaccaauuagcuuauguuguaauuggacuucuuuucaugauucuaacuguagcugcaaacgaaaugggacuucuagaaacuacgaagaaagaccuagguauugggcacguugccgucgaaaaucaucaccacgcggcaaugcuagacguugaccuacaucccgcaucagcauggacccuauaugcaguggcaaccacgauaauuacgccuaugaugcgacauacgauagaaaauacuacggcgaauaucucccuuacagcgauagcgaaucaagcugcuauacuaaugggacuggauaaaggauggccaauuagcaagauggauauaggaguuccuuuacuugcauuagguuguuacagucaaguaaaccccuugacauugacugcggccguuuugaugcuaguagcacauuacgcuauaauaggaccgggacuccaagcaaaagccacccgagaagcucagaaaagaaccgcagcugguauaaugaagaauccuacuguugaugggauaguagccauugaccuagauccaguagucuacgaugcaaaguucgaaaaacaacuaggacaaauuaugcuacuaauauuaugcacaucucaaauacuacuaaugagaacaacaugggcacugugcgagucaauaacucuagcaacugguccauugacgacacuaugggaaggaucgccagguaaauuuuggaauacaacaaucgcaguuucuauggcuaacauauuuagaggcucguauuuagcaggcgcggguuuagcauucuccuugaugaagagucucggcggaggcagacgggguacuggcgcacaaggagagacccuuggcgaaaaauggaaaaggcaguuaaaucagcuaaguaaaucggaauuuaacacguacaaacguucaggaaucauggaaguagaucggucagaggcuaaagagggccuuaaaagaggagaaacgacaaaacacgcggucucgcgaggcacugcgaaacugcgaugguucguagaacguaaucuggucaaaccagaaggaaaaguaauagauuuaggauguggucguggaggcuggucguacuacugugcaggacucaagaaaguuaccgaaguaaaggguuauacaaaaggugggccaggacacgaagaacccaucccaauggcaaccuauggguggaauuuagucaaauugcauucuggaaaagauguauucuuuauuccaccagagaaaugugauacccuguuaugcgacaucggcgaaucgucuccuaauccaacaauugaagaagguagaacucuacgcguucugaagaugguugagcccuggcuucgcggcaaucaauuuuguauuaaaauacucaacccauauaugccaucuguaguagagacguuagaacagaugcaacggaaacacggcggcaugcuuguccgcaauccucugucuaggaacucaacucaugaaauguacuggguuagcugcggcacagguaauaucguaagugccguaaauaugacaucuagaauguuauugaacagauucacgauggcacauagaaaaccaacguaugaacgugacguggaucuuggagcaggcacaagacauguagccguugagccagaaguagcuaacuuagacauaauaggacagcgcauugaaaauauuaaacaugaacacaaaagcacauggcacuaugacgaagauaaucccuacaaaacaugggcauaccauggcucuuacgaaguaaaaccguccgguucagcaaguucaaugguuaauggagucguuaaacuccuuacaaaaccuugggauguaauaccaaugguaacacagauagcuaugacagauaccacaccauuuggacagcagcguguauuuaaggaaaaaguggauacaagaacaccuaaggcaaagagaggaacagcacaaauuauggaaguuacugcaaaauggcucuggggauuuuuaucgagaaacaagaaacccagaauauguaccagagaggaguucaccagaaaaguucgaagcaaugcugcaaucggcgcaguauuuguagacgagaaucaguggaacucugccaaagaggcugucgaagaugaacgcuucugggacuuaguucaccgcgaaagagaacugcauaagcaagggaaaugcgcuacauguguauacaacaugaugggaaagagggagaagaaauuaggagaguucgguaaggccaaaggaucuagagcaauaugguauaugugguugggcgcuagauuccuugaguucgaagcauuaggguuuaugaaugaagaucauugguucucccgagaaaauaguuuaucgggcguggaaggagagggucuacauaaacucggauacauccuaagggauauuucaaaaauacccggggguaauauguacgcugaugacacagcagggugggauacucgaauaacagaggacgauuugcagaaugaagcaaaaaucacagauaucauggagccugaacaugcucuccucgcuaaaucaaucuuuaaauuaacauaccaaaauaaaguaguuagagugcaaaggccagcuaaaaacgguacugucauggacgucaucuccagaagagaucagcgcgggucaggucaaguuggaacguaugguuuaaauacuuuuacgaacauggaagcgcaacugauuaggcaaauggaaucagaaggcaucuucaguccaucagaauuagaaacaccgaacuuggcaggucgaguuuuagauuggcuagagaaacaugggguugagcgacuuaaacgaauggccauauccggugacgauuguguuguuaaacccauagaugaccgcuucgcuaccgccuuaaccgcgcuuaaugacaugggaaaaguacgcaaggacaucccgcagugggaaccaucuaagggcuggaaugacuggcaacaaguucccuucuguucacaccauuuucaucaacuuauaaugaaagauggcagagaaauaguagucccuuguagaaaccaagaugaguuaguugggcgagcacgugucucucaaggcgcgggauggucuuuacgagaaacugcuugccuaggcaaaucauacgcccaaauguggcaauugauguacuuucacagacgggauuuacgccuggcagcaaacgccauauguagcgcuguaccgguagacuggguccccacaucaagaacgacuuggucaauccacgcacaccaccaauggaugacuaccgaggacaugcucucuguuuggaauagaguauggauugaagaaaauccauggauggaagacaaaacacacauuucuuccuggggagauguucccuaucuggguaagagggaagaccaaugguguggcagcuuaauaggacuuacagcccgagccaccugggcuacaaauauacagguugcaauaaaucaaguacguagacugauaggcaacgagaacuauuuagacuauaugacaucuaugaaacguuucaaaaaugaaagugacccagaaggugcauuaugguga

SEQ ID NO: 21708 - RNA, 9879 nt, Artificial Sequence
  derived and/or modified CDS sequence (opt6) from DENV-1__FJ882559__SS-prME
uccgugacaaugcuauuaaugcucaugccaacagcauuggcuuuccaucugaccacacgcggaggugaaccacauaugaucguaucaaaacaagaacgagguaaaucuuugcuuuucaaaacuucggcuggugugaauauguguacucuuaucgcaauggauuugggugaauuuugugaagacacaaugacauauaaauguccuaggauuacagaagcagaacccgaugacguggauuguugguguaaugcaacagauacguggguaacuuacggaacuugcucacaaacgggagaacaucgaagggauaaaagaaguguagcucucgcaccucacguagggcuaggacuagaaacucggacagaaacuuggaugucaagugaaggcgcauggaagcaaauucaacgugucgaaaccugggccuuacgacauccaggauucacgguuauagcucuauuccucgcucaugcuauaggcacaagcauaacacaaaaaggaauuauuuucauucuuuuaauguuagucaccccauccauggcgaugcguugcguaggcauuggaagcagagauuuuguggaaggguuaucaggggcaaccugggucgacguuguccuagaacauggauccugcguaacuacaauggcuaaggauaaaccaacucuugacauagaauuacuaaaaacagaagucacgaauccagcuguuuugcgcaaguuguguaucgaggcgaaaauauccaacacaaccacagacagucguuguccuacacaaggcgaagcaacccuaguggaagaacaagacgcgaacuucguuuguagaagaaccuuuguugauagaggcuggggaaacggguguggucuauuugggaaaggaagccuuaucacaugugccaaauucaaauguguaacuaagcuagaaggaaagauuguccaauaugaaaaccuaaaguauucagucauuguaacagugcauacuggugaucaacaucaaguaggaaaugagaguacggaacacgguacgacagccacgauaacaccccaagcacccagcacagagauacaacuaacagauuacggagcacuuaccuuagauugcaguccucgaacuggcuuagacuuuaacgaaaugguucugcugacaaugaaggagaaaaguugguuaguacauaaacagugguuccuagacuuaccuuugccguggacaucuggagcaucuacuucacaagaaacuuggaaucggcaggaccuacuggucaccuuuaagaccgcacacgcuaaaaagcaagaagugguaguauuggggucacaagaaggagcaaugcacaccgccuuaacaggcgcaacugaaauccaaacaagcggaacaaccacuauauuugcaggacacuuaaaaugucgucuaaaaauggauaaauuaacgcuaaaaggaaugagcuauguaauguguacagguuccuuuaaauuagaaaaagaagucgcagaaacccaacacggcacggucuuaguacagauaaaauacgaagguacagaugcuccgugcaaaaucccuuucucuacccaagaugaaaagggcguaacccaaaauggccguuugauaacagcgaaucccauagugacagauaaagaaaaaccuguuaauauagaagcagaaccaccauucggugaauccuacauuguaauaggagcuggcgaaaaagcauuaaaacuaucgugguuuaagaaggggaguagcauaggcaagauguucgaagcaaccgcgcggggagcgagaagaauggcaauauuaggugauacugcgugggacuuuggaucgauaggaggagucuucacaagcguagggaaacuuguacaccaaaucuuugguacugcauacgguguauuguuuucuggcgugucuuggacaaugaaaauaggaaucgggguguuguuaacauggcuuggucuuaauagcagaucuacgucucuuucgaugacgugcauugccgugggauugguaacuuuauaucucgggguuaugguacaagcggacuccggcugugugauaaauuggaaaggcagagaauuaaagugcgguuccggaauauucgugacgaaugaaguucauacauggacugaacaguauaaauuucaagccgacucuccuaaaagacuuucugcugcaauagguaaagcgugggaagaaggaguuuguggcauucguucagccacaagauuagaaaauaucauguggaaacaaauuucuaaugaacuaaaccacauuuugcuggaaaaugacaugaaauuuacuguaguuguuggugauguugcaggcaucuuagcucagggcaagaaaaugauucgaccacaaccgauggaguauaaauauagcuggaaaagcuggggaaaagcaaggaucaucggagcagacguucaaaauacuacauuuauaauugauggcccuaauacaccggaaugcccagaugaucaacgagcguggaacauaugggaggucgaagauuaugguuucgggauauuuacuaccaacauuugguuaagauuacgugacaguuacacacaaguuugugaccacagacucauguccgcagcuauaaaagacagcaaagcaguccacgcagauaugggauauuggauagagagugaaaagaaugaaacauggaaauuagcccgggcuaguuucaucgaaguuaaaaccugcauuuggccuaaaucucauacucuauggaguaacgguguauuagaaucagaaaugauuauaccaaagauuuauggaggaccgaucagccaacacaacuauagaccaggauauuucacucaaacugccggaccauggcacuuagguaaacucgaauuagauuucgaucucugugaagguaccacugucguagucgacgaacacuguggaaaucgaggcccaucuuuacggacuacuacagugacugggaaaauaguccacgagugguguugcaggucaugcacacugccaccacugagguucaaaggcgaagacggaugcugguaugguauggaaauacgcccgguaaaagaaaaagaagaaaaucugguaaaaucuaugguaucagcagguuccggagaaguagauucuuuuucucugggauuacucuguauaagcauuaugaucgaagaaguuaugaggucaagauggaguagaaaaauguuaaugacgggaacacuggcuguauuuuucuuacucaucauggggcaguugacauggaaugauuuaaucagacuguguaucaugguaggagcaaacgcaucagacagaaugggaaugggaaugacauaccucgcuuugauggcgacauuuaaaaugcgaccuauguuugccgugggacugcuauuucggcgccuuacaagcagggaaguacuccucuuaacaauagggcuuucccuaguggcaucagccgaauuaccgaauagucucgaggagcuaggugauggauuagcaaugggcauaaugauacuaaaacuucuaacagauuuucaaucacaccaacuuugggcaaccuuacucucacugacauucauuaaaacaacauucagucuacacuaugcauggaagacaauggcaauggucuuaucgauaguuucucuguucccacuuugucugucuacuaccucacagaaaacgacuugguugccaguuuuacuagggaguuugggaugcaagccucuaacaauguuucugauugcagaaaacaaaaucugggggcguaaaucauggccccuaaaugaagguauuauggcaguaggaauagugucaauacugcuaaguuccuuacuaaagaaugacguacccuuagcagguccgcugaucgcgggugguaugcuaaucgcuugcuaugugauaagcggaucgucagcagaucucagccuugagaaagcggcagaaguaucuugggaggaagaagcagaacacaguggugcaagucacaacauacucguggagguucaagaugacggaacaaugaaaaucaaagaugaagagagagaugacaccuugacuaucuuauuaaaagccacccuacuagcgguuucgggcguauacccgcuuuccauucccgccacauuauucgucugguauuuuuggcagaagaagaaacaaaggaguggaguacuuugggacacacccagcccaccagagguugaaagggcaguucucgaugauggcaucuaucgaauaaugcaaaggggauuauuaggcagaucucaggucggagugggagucuuucaagaaaauguauuccacacgauguggcacguuacucgaggggcuguucuaauguaucaagggaaacgacuagaaccgucaugggcaucaguuaagaaagauuuaauaucuuauggcgguggauggcgccugcagggaagcuggaacacuggagaagaaguccagguaauagcaguugagccuggcaaaaauccuaaaaacguccaaacagcaccaggaacuuuuaaaacaucugaaggagaaguaggagccauugcauuagauuuuaaaccaggcaccaguggaagccccaucgugaauagggaagguaagauagucggccuauauggaaacgggguaguuacuacaucaggcaccuauguaucagcaauagcacaagcgaaggccucacaagaaggcccauugccagaaauagaggaugaaguuuuccggaaaagaaaucuaacaauaauggacuuacauccggguucuggcaaaacgagaagguaucuaccugccaucgugagggaagcaauaaagagaaagcugagaacacuaauuuuagcaccaacccguguuguugcuucggaaauggcagaggcacugaagggaaugccaauacgguaccaaacuacagcaguaaaauccgaacauacgggcaaggaaaucguugaccucaugugucaugcaaccuuuacaaugcgacuuuuauccccaguaaggguaccuaacuauaauaugauaauuauggaugaggcccauuucacggacccgaguucgauagcagcaagggguuauauaaguacuagaguuggcaugggggaggcagccgcaauauucaugaccgcuaccccaccuggaagcgucgaggcuuuuccgcagucaaaugcugucauucaagaugaggagcgagacauaccugagaggagcuggaacucgggguacgaauggauaaccgauuucccagguaaaacuguuugguucgugccaaguauaaaaaguggaaaugacauagcaaauugccuaaggaaaaauggaaaacgcguaauccaacuuucaagaaaaacuuuugacacugaauaucagaaaacgaaaaauaaugauugggacuauguuguaaccacugauauuagcgagaugggagcuaauuuccgagcggaucgggucauugauccgcgccguugcuuaaaacccguaauucugaaagaugggccagaaaggguuauacuagcaggaccaaugccagugaccguagcaagcgcagcgcaaagacgggggagaauuggaagaaaucauaacaaagaaggugaucaauacauauauaugggacaaccuuuaaacaacgacgaagaccacgcccacuggacagaagcgaaaauguugcuagacaacauaaacacaccagaaggaaucauacccgcucuauuugagccagaacgagagaagagugcagcuauagauggagaguacagauuaagaggagaagcucggaaaacuuuuguagaacuaaugcgaagaggggaucuccccguuugguuaagcuauaaagucgcuucagaaggauuccaauacucugaccgacgcuggugcuucgacggcgaacguaacaaucaaguauuagaggagaacauggauguagaaauauggaccaaagaaggcgaacgcaagaaacuuaggccaagauggcuagacgcccguacauauagugacccgcuugcguuaagggaauuuaaagaauuugcugcuggacgaaggaguguaucaggagaccucauucucgaaauagggaaauugccucagcauuugacucaaagggcgcagaacgcccuagacaaucugguaauguuacauaauagcgaacaaggagguagggcauaucgccaugcuauggaagaauuacccgacacaauagaaacuuuaaugcuacuagcuuugaucgcuguacuaacagggggaguaacacuauucuuuuuaaguggcagaggccuuggaaagacaaguaucggauugcuuuguguaauggcaucaucaguuuuauuauggauggccuccguugaaccgcauuggauugcagcuuccaucauacuugaauuuuuccuaaugguacuacuaaucccugaacccgacaggcaacgaacaccacaagauaaucaguuagcguauguaguaauuggguuauuauuuaugauacucaccguagcugcuaaugagaugggacuacuggagacuacaaagaaagauuuagguaucgggcacguagcaguagaaaaucaucaucaugcugcgauguuggaugucgauuuacauccagcgucugcauggacacucuaugcagucgccacuacaauuauaacuccgaugaugaggcacacaauagagaauacaacagcgaacaucucacuuacugccauagcgaaccaagcagcgauauuaaugggguuagacaaaggcuggcccauaucuaaaauggauauaggagugccauuacucgcacuuggauguuauagucaaguuaacccuuugacacuaacagcagcuguucugaugcuaguagcucauuacgccauuauugguccuggauuacaagcaaaagcaacucgagaagcgcagaaacggacugcugcaggaauaaugaaaaauccaacgguugaugguaucguugcaauagacuuagauccugugguuuaugaugcaaaauucgaaaaacaguuaggacaaaucaugcuacucauacuauguacaucgcagauauuauugaugcggaccacaugggcacucugugaaucaaucacauuagcaaccggaccacucacaaccuuaugggaagggucaccuggaaaauucuggaauaccacuauagccguaaguauggcaaauauauuuagaggcaguuauuuagcaggggccggauuggcuuuuagucucaugaaaucacuaggggguggaagaagaggaacgggagcacaaggcgagacauugggugagaaauggaaaagacagcugaaucaacucagcaaaucugaauuuaauacuuacaaaagaucuggaauaauggaaguugauagaagugaagcaaaggaaggacugaaacgaggagaaacuaccaaacaugcuguuucacgaggcacggcaaaauuaagaugguuuguggaaagaaauuuaguaaaaccagaggguaaaguaauagaccuuggauguggcagagguggguggucuuauuacugcgcugggcuaaagaaaguuacagaagugaaaggcuauacuaaaggcgguccuggucacgaggaaccaauuccuauggcuacguacggauggaaccuaguaagacuacauaguggcaaagacguauucuuuacucccccagaaaaaugugacacacucuugugcgauaucggcgaaucuaguccgaacccuacaauagaggaaggacgcacccuccgaguacucaaaaugguagaacccugguugagaggcaaccaguuuugcaucaaaauacugaacccauauaugccaucuguuguagagacauuggaacagaugcaacgaaaacacggcgggaugcuugugagaaaccccuugucacguaacuccacgcaugaaauguauuggguuuccugcggcacagggaacaucgugagugccguaaacaugacuucucgaaugcucuuaaacagauuuacuauggcacaucgcaaaccuacguaugagagagauguugauuuaggcgcggguacgcgacaugucgcuguggaaccugagguggcuaacuuggauauaauaggacaaagaauugaaaauauaaaacaugaacacaagagcacauggcacuacgaugaggacaacccauacaaaacaugggccuaucaugggucauaugaaguaaaaccaucagguagugcuucaucuaugguaaacggcgucgugaaguuacuaaccaaaccaugggaugucauaccuauggucacacaaauugcaaugacugauacaaccccauuuggucaacagcgcguauuuaaggaaaaaguagacacacgcacuccgaaagcgaaacgaggcaccgugcagauaauggaagugacugcaaaauggcuuuggggauucuuaucaaggaauaagaaaccgcgaauuugcacgcgggaagaauuuacacgaaaagucagaucuaaugcagcuauaggggcaguuuuuguagaugaaaaccaauggaacuccgcaaaagaagcaguagaggaugaaagauuuugggaucuuguacaccgagagcgggaguugcauaaacaaggaaaaugugcaacauguguauacaauaugaugggcaaacgcgagaagaaauugggugaguuuggaaaagccaaaggaucacgcgccauaugguauaugugguuaggagcaagauuuuuagaauuugaagcauuagguuuuaugaacgaagaccauugguuuagccgagaaaauagccuaucaggugucgaaggugaaggccuucacaaacucggauauauucuacgggauauuucaaagaucccuggcggaaacauguacgcagaugauacggcaggaugggacacucggauaacugaagaugacuuacaaaacgaggcaaaaauaacggacauaauggaacccgagcaugcauugcuagcaaaaagcauauuuaaacugacuuaucagaauaaaguuguacgaguacaacgcccagcgaagaacgggacagucauggauguuauuaguagaagagaucagaggggcucuggucagguaggcacauauggucuaaauaccuuuacuaauauggaagcacaguugauaagacagauggaaagugaagggauauuuucaccaucugaacucgagacaccaaacuuagcagaaagagcuuuggacugguuagaaaaacacggagucgaacguuuaaaacgcauggcgauaucuggagacgacugcguagugaaaccgauagaugauagauucgcgacugcauuaacugcuuugaaugacauggguaaagucagaaaagauauuccacagugggagccuucaaaaggguggaaugauuggcagcaaguaccauuuuguagucaucauuuucaucaacuaauaaugaaagauggaagagagaucguaguuccguguagaaaucaagaugaguuaguaggacgagcacggguuucacaaggagcaggauggagucuaagagaaacugccuguuuaggcaagagcuaugcccaaauguggcaacuuauguauuuccauagacgagaccuccgauuagcugcaaacgcaauauguucagcaguaccgguggacugggucccaacuagccguacuacaugguccauucaugcgcaccaucaauggaugacuaccgaagauaugcuaucaguuuggaaucguguauggauagaggaaaauccuuggauggaagacaaaacacauauuucaucauggggugacgugccauaccuagguaaaagagaagaucaguggugcggaagccuaauugggcuaacugccagggcuacaugggcaacgaacauacaaguggcuauaaaucaaguaagaaggcuuauuggcaaugagaauuauuuggacuauaugacaagcaugaagagguucaaaaaugaaagugaccccgaaggagcacuuugguga

SEQ ID NO: 21709 - RNA, 9879 nt, Artificial Sequence
  derived and/or modified CDS sequence (opt6) from DENV-1__GQ199828__SS-prME
ucuguuacaaugcuauuaauguuaaugccgacagcucuagcuuuucauuuaacaacgcgugggggagaaccacacaugauaguuucaaaacaagaaagaggcaaaucucugcucuuuaaaacguccgcaggaguuaauaugugcacuuuaauagcaauggaucuaggagagcuaugcgaggacaccaugacuuauaaaugcccacgaauaacugaagcggaaccugaugaugucgauugcugguguaaugcaacagacacauggguaacauauggaacuugcucucaaacuggggagcaucgcagagacaaaagaucaguggcgcucgcaccgcauguagguuugggguuagaaacgcgaacugaaacauggaugagcagugaaggagcuuggaaacaaauacaaagaguagaaacaugggcauuaagacauccuggcuuuaccguaauagcuuuauucuuagcacacgcuaucggaacaaguauaacacaaaaagguauaauauuuauccuuuuaaugcuaguuacgccuucaauggcaaugagguguguaggaauaggaucuagagauuuuguagaaggauuaaguggugcaacauggguagauguggucuuagaacaugggucguguguuacaacaauggcaaaagacaaaccuacuuuggauauugaacugcuuaaaacggaaguuaccaauccggcgguguuacggaaacuauguauugaagcuaaaauuagcaauacuacuaccgauagcagaugcccaacacagggagaagcaacuuuagucgaagaacaggacgccaauuucguuuguagaagaacuuuuguugaccgcggcuggggaaacggcugugguuuguuugguaaagggaguuuaauaacuugugcuaaauuuaaauguguuaccaaguuagaaggcaaaauuguacaauaugaaaauuuaaaauauucaguaaucguuacaguacauacaggugaccaacaucaaguuggaaaugaauccacagagcacgggacuacagcuacgauuacaccacaagcaccaacaacagaaauacaacuaacagauuacggagcucuuacauuagauuguaguccacgcacgggccuagauuuuaaugaaaugguacugcugacaaugaaggagaaaaguugguuaguacauaagcaaugguuccuugaucucccguuaccauggacaaguggcgcuuccacaagccaggaaacauggaauaggcaagauuuauuagucacuuucaaaacagcccacgcgaagaaacaagagguagugguuuuaggaucacaagagggugccaugcauacagcccuaaccggagcaaccgagauacaaacgagcgguacaacgacaauauuugcuggccaccuaaagugcagacuaaagauggauaaguuaacguuaaagggcaugucauauguaaugugcaccggaaguuuuaaacuagaaaaagaaguugcugaaacccaacauggaacugugcuaguacagauuaaauacgagggaacugacgcgccgugcaaaauaccauucucgacacaagaugaaaaaggaguaacacagaauggacguuuaauaacagcgaacccaaucguaacugacaaggaaaaacccguaaauauugaggcugaacccccguucggggaaucauauauaguaaucggcgcgggugagaaagcucuaaaauuaagcugguuuaagaaaggaagcagcauaggaaaaauguuugaagcuaccgcaagaggggcacgcagaauggcaauuuugggugacacagcaugggacuucggaucaaucgguggagucuuuaccuccgucggaaaauuaguacaucagauuuucgggacugcguaugguguacuauuuucugguguaucauggacaaugaaaauagggaucgguguucuucugacauggcucgguuuaaacucacguucaacuucuuuaaguaugacauguauugcugucggguuagugacuuuauaucucgggguuaugguucaagcggauagcggguguguaauuaauuggaaaggccgcgagcugaaauguggauccgggauuuuuguuacuaacgaagugcauaccuggacagaacaauauaaguuucaagccgauucuccgaagagacuaucagcagcaaucgguaaggcuugggaagaaggcguaugugggauaagguccgcaaccagauuagaaaauauaauguggaaacaaauuuccaaugagcuaaaccacauccuuuuggagaaugacaugaagcugaccguaguaguuggcgacguagcaggcauccucggacaaggaaagaaaaugauuaggccucaaccuauggaauauaaauacucuuggaaaagcugggguaaagcuaaaauaauuggugcugacgcccaaaacaccaccuuuauuaucgauggucccaacacuccggaauguccagaugaccaacgggcauggaauauaugggagguggaggauuauggauucggaaucuucacaacuaauauauggcuuaaauuaagagacuccuacacacaaguuugugaccauagacucaugucagcagcaauuaaagacucuaaggccguacacgcugauaugggauauuggauugaaagugagaagaaugaaaccuggaaacuugcacgcgcuucuuuuauugagguaaagaccugugucuggcccaaaucgcauacgcuauggucuaauggaguuagagaaucagaaaugauaauaccaaaaauauauggaggaccuaucucccaacauaacuacagacccgguuacuuuacacaaacggcaggcccuuggcaucuugguaaauuagagcuagacuucgaccugugcgaaggaacaacgguugugguagaugaacacuguggaaacaggggaccuagccuaagaaccacuaccguaaccgguaaaauaauucacgaaugguguugcagaaguuguacucuaccaccauuacgauuuagaggagaagacgguuguugguacgguauggagauacgcccugugaaagaaaaagaagaaaacuuaguaaaaaguaugguuagugcaggcucaggagaagucgacucauuuagucuagguuuacuuugcauaucgauaaugauagaagaagucaugcguucccgcuggucacguaagaugcugaugauaggcaccuuagcuguauucuuucuauuaauuaugggacagcuuacguggaacgaccuaaucagacuguguaucaugguuggggccaaugccucagauagaaugggcaugggcaccacauauuuggccuuaauggccacauucaaaaugaggccaauguuugccguuggucuguuauuucgacguuuaacaucgagggaaguguuguuacuuacaauaggacucaguuuaguggcaaguguagaauuacccaauagccuagaggagcuuggugauggucuagcaaugggaauaaugauuuuaaaacuucugacagauuuucaaucgcaucaauuaugggcuacccugcucucuuuaacauuuauuaagaccacauuuagccuacauuacgcauggaaaacaauggcuaugguuuuauccauuguuucuuuauuuccuuugugccuuucgacuacaucacagaaaaccacuuggcuuccuguacucuugggaucauugggauguaagccuuuaacgauguuccuaauugcagaaaauaagauaugggguagaaagucauggccccugaaugaagguauuauggcaguagguauaguaaguauuuuauuaucuagccuguuaaagaaugauguucccuuagccggacccuugauagcaggaggaauguuaauugcauguuacguuauuucaggaucuuccgcagacuuaaguuuagagaaagccgcugagguuucgugggaggaggaagcagagcauaguggugcuagucauaauauccuuguugagguacaagacgaugguaccaugaaaaucaaaaacgaggaacgugacgauacccuuaccauacuuuuaaaagcaacucuauuagcagucagcggaguuuacccuuugaguauaccagccacacuuuuuguuugguauuucuggcagaagaagaaacaaagaucuggagucuuaugggauaccccaucaccuccugaaguugaacgagcaguauuggaugaugguaucuauaggaucaugcaaagaggucuacuuggacgaucucaggugggagugggggucuuucaagagaauguguuucauacuauguggcacguaacacgaggugcaguacuaauguaucaagggaagcgucuagaaccuucaugggccuccguuaaaaaggaucuaauuucauacgggggagguuggagacuaagaggaucguggaauacaggagaagaaguucaagugauugcagucgaaccgggcaaaaaucccaagaacguacagaccgcgccagggaccuuuaaaacucccgaaggggaaguuggggcaaucgcuuuggauuucaaacccggaacaucagggagucccauaguaaaccgagaagggaaaauaguaggccucuauggaaacgguguugugacuacaucuggaaccuacguaucagcaaucgcacaggcaaaagcgagucaagaaggaccacugccagaaauagaagaugaggucuuuagaaagaggaaucuaacaauaauggauuuacauccuggaagugguaaaacuagacgauaucuaccugcaaucguuagggaagcgauaaagcggaaguuaagaacauuaauacuagcaccgacucgcgucguagcuucugaaauggcagaggccuuaaaaggaaugccuauuagauaucaaacaacugcaguaaagucggaacacacuggcaaagagauugucgaucuuaugugccacgccacguuuacaaugcgacuauugucccccguaaggguacccaauuacaacaugauuauuauggacgaggcgcauuucacagacccaucaagcauagcagcaaggggcuacauaucuacacgaguuggaaugggugaagccgcagcgauauucaugacagccacaccucccgguuccguugaagcauuuccucaaaguaaugccguuauacaggacgaagaacgcgauauuccagaaaggucauggaacucaggauacgaauggauuacagauuuuccaggcaagacggucugguuugucccuucuauaaagagcgggaaugacauugccaacugcuuaaggaaaaaugguaagagagugauccagcuaagccgaaaaacuuuugauacagaguaucagaaaaccaaaaauaaugauugggauuacguaguuacuaccgacaucucggaaaugggcgcgaauuucagggcagacagggugauagaccccaggcgauguuugaagcccgugauccuuaaggauggaccagaaaggguuauucuagcagguccaaugccuguuacaguagccucagcugcgcaacgaagagguagaauaggacggaaccauaauaaggagggagaucaauauauauauauggggcaaccguuaaauaaugaugaagaccaugcacacuggacagaagcaaaaauguugcuggauaacauuaauacaccagaagggauaauuccagcauuauucgaaccagaaagagagaaaagugccgcuguugauggcgaguauagacuuagaggagaagcgagaaagacauuuguagaacuaaugaggcggggagaucuaccuguauggcucagcuauaaaguagccucggaagguuuccaauauucggauagaagaugguguuuugacggcgaacgaaauaaucaaguacucgaagaaaacauggauguugaaaucuggaccaaagagggagaacgaaagaaauuaagaccccguuggcucgaugcccgaacauauagugacccacuugcauuaagagaauuuaaagaauuugcagcaggaaggcgaucaguuaguggugacuugauuuuagaaauagguaaguugccucaacauuuaacacaacgagcccaaaacgccuuagacaacuugguuauguuacacaacuccgaacaaggcggacgagcauauagacaugcuauggaagaacuuccagauacaaucgagacucuuauguuacuggcauuaauagcugugcuaacuggaggcgucacauuauucuuuuugucggguagagguuuagguaagaccagcauuggauuacuauguguuauggcaaguaguguacuuuuguggauggcuagugucgagccacauuggaucgcugcgaguaucauccuggaguucuuucuaaugguuuuacuaauaccugaaccggauaggcaacguacaccgcaagacaaccaacuugcguacgucgucauuggucuucucuuuaugauucuaacaguugcugcuaacgagauggguuuauuagaaacaaccaagaaagaucugggaauaggacauguagccgucgaaaaccaucaccacgcugcaaugcucgauguagacuuacauccagcaagugcuuggacgcucuacgccguagcgacuacaauuauuacaccaaugaugcgacacacaauagaaaauacuaccgcaaauaucagucuaacagcaauagcaaaucaggcugcgaucuuaauggguuuagauaaaggauggccuaucaguaagauggauauuggaguaccacuucucgcacuaggaugcuacucacaaguaaauccucugacuuuaacugcagcaguacuuaugcuaguugcgcauuacgcaauaauugguccugggcuacaagcaaaagccaccagagaggcucagaaaaggacagcugcagguauaaugaaaaaccccacaguggacgguaucguugcaauagaccuggauccagucguauaugaugccaaguucgaaaaacaauuaggucaaauaaugcuccugauacuaugcacaucccagauauuacuaaugagaaccacaugggccuuaugcgaaucgauaacacucgcaacuggaccauugacaacauugugggaaggaucucccggaaaauuuuggaacacgacaauugccgugucaauggcaaauauuuuccgggguuccuacuuagcuggagcgggcuuagcauuuucuuugaugaagucauuaggaggcggccgaaggggaaccggcgcucaaggugaaacuuugggugaaaaauggaaacgacagcuaaaucaauugaguaaaucagaguucaauacguacaaacguucgggaauuauggaaguggacaggagugaagcgaaagaaggacuuaagcguggagaaaccacaaaacaugccguaagccgaggcacagccaaauugcgaugguuuguugaaaggaaucuuguaaaaccugaagguaagguuaucgauuuaggguguggaagaggaggauggucauauuauugcgcuggccuaaagaaaguuacggaagucaaagguuacacgaaagguggacccggacaugaggaaccgauaccuauggcgacauauggguggaaucuagugaaguuacacucgggcaaagacguguucuucaucccacccgaaaaaugcgacacgcuauugugugauauaggagaaucuucaccgaauccaacaaucgaagaagguagaacauuacguguguuaaaaaugguagaaccauggcuuaggggaaaccaauuuugcaucaaaauccuaaauccauauaugccauccgugguagaaacucuugaacagaugcaaaggaaacauggagggaugcucguucgaaauccgcuaucaagaaacucgacacaugagauguacuggguuaguugcggcacuggaaauauaguuucggccguuaauaugacguccaggauguuacucaauagauuuacaauggcacauagaaagccgacauacgaaagagauguggacuuggggacagggacucgacacguagcgguugagccugaagucgcaaauuuagauauuauaggacaacggaucgaaaauaucaaacacgaacauaagucaacauggcauuaugacgaagacaaucccuauaaaaccugggcguaccauggcucauaugaagucaaaccuucuggaagugcaagcucaaugguuaaugggguaguaaaauugcugacaaaaccgugggauguaauaccaaugguaacgcaaaucgcaaugacggauacgacgccauuugggcaacagagaguguucaaggaaaaagucgauacucgaaccccuaaagcuaagagaggaacagcacaaauaauggaagugacugcuagaugguuauggggguucuuaucccguaauaaaaagccaagaauauguacucgagaagaauuuacacgaaaaguucguucgaaugcggcuauaggcgcaguauuuguggaugagaaccaguggaauagcgcaaaagaagcaguggaagaugagagauucugggaucuaguccacagagaaagagaauuacauaaacaagguaaaugugcuacguguguguacaauaugauggguaagcgagaaaagaaacugggugaauuuggaaaagcuaaagggaguagagccauaugguauauguggcuuggagcaagauuuuuggaguucgaagcgcuagguuucaugaaugaagaccacugguuuagccgagaaaauagucuaagcggaguugaaggggagggcuugcauaaacuugguuauauucuaagagauaucagcaaaauuccugggggaaacauguacgcagacgacacagccggaugggacacuaggauaaccgaagaugauuugcaaaaugaagcgaaaaucacggacauuauggaacccgagcaugcuuuauuagcuaaagcgauauuuaaauugacguaccagaauaagguugugcguguucaacggcccgcuaaaaauggaacuguaauggacgugauuucuaggagagaucaacgugggucuggucaaguaggaacuuacggcuugaauacguuuaccaauauggaagcacaacuaauuagacaaauggaaucagaagaaauuuuuaguccgucugaauuggaaacaccuaauuuagccgaaagagcguuagauuggcucgaaaaguacggaguagaacgauugaagcguauggcgaucaguggugaugauuguguaguaaaaccuaucgacgauagauuugcaacggcauugacugcacucaacgauauggggaaaguuaggaaggauaucccgcagugggagccgagcaagggauggaacgauuggcaacaaguaccguucuguagucaucauuuccaucaauugauaaugaaagacggaagggaaaucguaguaccauguagaaaccaagacgaacucguagguagagcacgaguuagucagggagcaggauggagcuugcgagagacugcuugccuugggaaaucauacgcucagauguggcagcucauguauuuucacagacgcgaucuaagacuagcugacaaagcaauugguagugcgguuccgguggacuggguuccuacgucuagaacaacuuggaguauucaugcacaucaucaauggaugacgaccgaagauaugcugucaguuuggaaucguguauggauagaagagaaucccuggauggaagacaaaacacacauuucauccugggaggacguaccguaccuuggcaaacgggaagaccaauggugcggcucauuaauuggacuuacugcacgcgcuaccugggccaccaauauucaaguagcuauaaaucaaguucgacgauuaauugguaaugaaaacuaucuagacuauaugacuucuaugaagagguucaaaaaugaaucugaucccgaaggcgcauuaugguaa

SEQ ID NO: 21710 - RNA, 9879 nt, Artificial Sequence
  derived and/or modified CDS sequence (opt6) from DENV-1__GQ199829__SS-prME
ucuguuacgaugcuucuaauguuaaugccaacugcucuagcauuccauuugacuacaagaggaggagaaccucauaugauaguaucaaaacaagagcguggaaaaucccucuuauucaaaacaagugcuggaguaaauauguguacgcuuaucgcaauggauuugggagaauugugugaagauaccaugacuuauaaaugcccuagaauaacggaaaccgaaccagaugauguagauuguuggugcaacgccacagauacaugggugaccuauggaacaugcucccaaacaggagagcaucgaagggauaaaaggucgguggcccucgcgccacacguaggacuuggucuagaaacaaggacagagacauggaugucguccgaaggggcauggaaacaaauucaacgaguugaaacuugggcacuuagacauccaggauucacgguuauugcuuuguuccuggcacacgcuaucggaacgucaauaacccaaaaaggaauuaucuucauacuauuaauguuaguaacuccgucaauggcaaugagaugcguuggaauugggaguagagauuucguggaaggccugagcggagcaaccuggguagauguaguucucgaacaugggucuugugucacuacaauggcaaaagauaaaccuacguuggacauugaguuacuaaaaacagaaguaaccaacccugcaguacucagaaaauuaugcauagaagcaaaaauuucuaauacgacaacagacucacggugcccgacucaaggugaagcuacacucguagaggaacaagaugcuaacuuuguaugcagaagaacauugguagauagagguuggggaaacggauguggguuauuuggaaaaggaucccuaauuacuugugcuaaauuuaaauguguaaccaaauuagaagggaaaauuguacaauaugaaaacuuaaaauauagcguaauugugacuguacacacuggugaucaacaucaagucggaaacgaaaguacagagcauggaacaacagcuacaauuaccccacaagcuccaacaaccgaaauucaacuuacggauuacggagcucucacccuugauuguucgccccggacuggauuagacuucaaugaaauggugcuauuaacuaugaaagagaaaagcuggcuuguucauaaacaaugguuucuggaccuaccguuaccguggacaagcggagcaucgaccucucaggaaacguggaaucgccaagaucuauuagugacuuuuaaaacagcacaugccaagaaacaggagguaguuguguuagguagucaggagggagcgaugcauacagcucucacgggagcgacagaaauccaaacaagcgguacaacaacuauauucgccggacacuuaaaaugcaggcugaaaauggauaaacuuacuuuaaaaggcaugucguauguaauguguacgggaaguuuuaaauuagaaaaagaaguagccgagacacaacauggaacuguccuuguccaaauuaaauaugaaggcacggacgcacccugcaaaaucccuuucagcacccaagacgaaaaaggaguaacacaaaacggucgauuaauaacagccaauccaauuguaacggauaaagagaaaccuguuaauauugaagcugaacccccauucggugagaguuacauugucauaggugcuggagagaaagcguuaaaauuaagcugguuuaaaaaggguaguucaauagguaaaauguuugaagcgaccgcgagaggagcgcguaggauggcaauauuaggcgauacagcuugggauuuugggagcauuggaggaguguucacuuccguaggaaaauuagugcaucaaauauucgguacggcguacggugugcuauuuucuggcgucucauggaccaugaaaaucggaaucgguguuuuacuuacuuggcuggguuuaaauucacgauccacaagucuaucaaugacauguauagcaguugguuuaguuacacuauacuuggguguaauggugcaagcagauucaggcugcguuauaaacuggaaaggcagggaacugaagugcggcaguggaauauuuguaacaaacgaaguacacacuuggacagaacaauauaaauuccaagcugauuccccaaaaaggcuaucagcugcaauagguaaggcuugggaggagggagucugcggcauucggagugcuacaagauuagaaaauauuauguggaagcaaauuaguaaugaacuuaaucauauacugcuagaaaaugauaugaaguuuaccguaguagucggagauguagcggguauuuuagcacaaggaaagaaaaugaucagaccucaaccaauggaauauaaauauucguggaaaucuuggggaaaagcuaaaauaauaggugcugaugugcagaacacuacauucauuaucgauggcccaaauacaccugaauguccagacgaucagcgagcguggaauauuugggaaguugaagacuacggguuugguaucuucacaaccaauauuugguuaaaauuacgggacagcuauacgcaaguaugcgaccacaggcuaaugagugcagccauaaaagauucuaaagccgugcaugcagacaugggauacuggaucgaaucagagaaaaacgaaacuuggaaacuggcuagggcuuccuuuauugagguaaagacguguaucuggccccguucucacacacucuggucaaacggaguuuuagaaagugaaaugauuauuccaaaaauuuacggcgggccaauaucgcaacacaauuacaggccgggguacuuuacacaagcggcuggaccauggcaucucgggaaacuugaauuagauuucgauuuaugugaagguacuaccguuguaguugaugaacauuguggcaauagaggaccaucacuucggacuacaacuguuacugguaaaauuauacaugagugguguugccgaucaugcacucuucccccacuaagauuuagaggagaagauggguguugguacggcauggaaaucaggccaguuaaagaaaaagaagaaaaucuagugaagucuaugguaagcgcagggucaggcgagguggacucauuuucacuggggcugcuauguauaucaaucaugauugaggaaguaaugcguagccgcuggagcagacguaugcugaugacaggaacucuagccgucuuuuucuuacugauuaugggacaacuuacuuggaaugauuugauucgccuauguauuauggugggcgcaaaugcuagcgacagaaugggaaugggcacaacguauuuggcauugauggcuaccuucaaaaugagaccaauguuugcaguuggucuacucuucagaagauuaacaucaagagaaguacugcuacuaaccauaggacuauccuuaguugcgaguguagaauuaccgaacucccuagaagaacuuggggauggacucgcuaugggaaucaugauauugaaacugcugacagauuuucaaucgcaucaguuaugggcaacucuucuuagccuaacauuuauaaagacaacuuucagucuccauuacgcauggaaaaccauggccaugguacuuucaaucgucucgcuauuuccauuaugccuuaguacaacaagucagaaaacuacguggcuuccgguuuuacuagguucuuuaggaugcaagccacugacuauguuucugauugcugaaaauaaaauaugggguagaagaucuuggccgcuaaacgaaggaauuauggcaguugggauaguaucuauucuacugucaucgcugcucaaaaacgaugucccacuagcggguccacuaauugcgggaggaaugcuaaucgccugcuacgugauaucaggaucaagcgcugaucucagcuuagagaaagcugccgaaguaaguugggaagaagaagccgaacacagcggagcuucgcauaacauauuaguagaaguucaagaugaugguaccaugaaaauaaaagacgaagaaagagaugauacacucacaauacuguuaaaagcaacccuauuggccguaucaggaguguauccacucucgauaccggccacucuguuuguaugguauuucuggcaaaagaagaaacagcguagcggaguacuuugggauacaccauccccuccugagguagaacgagcaguauuagaugacggaauauaucgaauuaugcaaagggguuuacugggccguagucaagucggaguaggagucuuccaagagaauguuuuucacaccauguggcauguuacuagaggagccguauugauguaucaaggcaaaagacucgaaccuucaugggcuuccgucaagaaagauuuaaucuccuauggcggagguuggcguuugcagggcucauggaauacgggugaggaaguacaagugauagcuguugaaccaggcaaaaaccccaagaacguucaaacugcaccugguacguucaaaacgcccgaaggggaaguaggagccauugcacuugacuucaagccgggaacauccggaaguccaauuguuaauagagaaggaaaaauuguuggauuauaugggaacggcgucguuacaaccagcggaacuuauguaucugcaauugcacaagcaaaagcaucacaagaaggaccccuaccagaaauagaggaugaaguguucaggaaacguaauuuaacgauaauggacuuacacccuggaagcggcaagacuagacguuaucuaccggcaaucguuagagaagcgauaaagcguaaauuaagaacuuuaauauuggcgccuacucgaguaguagcaucagagauggcagaagcucuaaaaggaaugccaauaagauaucaaacuacagcaguuaaaagugaacacaccgggaaagagauagucgauuuaaugugccacgccacauuuaccaugcgauuauuaucuccuguccgaguaccaaacuauaacaugauuauaauggacgaagcacacuucacagauccaucaaguauagccgcaagagguuacauuucaacacgugucggcaugggcgaggcugcugcuauuuucaugaccgccaccccuccgggaucuguagaggcauucccacagaguaaugcagucauacaggacgaagaaagagacauaccagaaaggaguuggaauagcggauaugaauggauuacugauuuuccugguaaaaccguuugguucguuccgaguaucaaaucagguaaugauauagcaaauugucuccgcaagaauggaaagagaguuauucaacuuaguagaaagacauuugacacagaauaucagaaaaccaaaaauaaugauugggauuacguggugacaacugacauuagugaaaugggcgcuaacuuccgugcugacagagugauagauccuagacgaugccuaaagccaguaauccucaaagaugguccagaacgcgucauucuugcugggccgaugccaguaacuguugccuccgcagcccaacgaaggggacgaauuggaagaaaucauaauaaagaaggagaucaauauauuuauaugggacaaccauuaaacaacgacgaagaucacgcacauuggaccgaagcaaaaauguuacucgauaauaucaacacuccugaagguauuauuccggcacuauucgagccugaacgcgagaaaucggcggcaauugauggggaguauagauuacguggagaggcacguaagacuuuuguagaacuuaugcgacgaggagaucuucccguguggcuuucguacaaaguagccuccgaagguuuucaauauagugacagaagaugguguuuugacggcgaacguaacaaccagguauuggaagaaaauauggacguugaaauuuggacaaaagaaggcgaaaggaagaaacuuaggccccgcuggcuggaugcacgaacauacucagacccucuagcguugcgagaauuuaaagaauuugccgcagguagacgaagugugaguggagaccuaauucuagaaauuggaaaauuaccgcagcacuuaacgcaaagagcacaaaacgcguuggauaaccuaguuaugcuacauaauucagaacaaggugggagagccuauaggcaugccauggaggaacuaccggauacaauugaaacucucaugcuuuuggcacuaauagcaguccuaacagggggcgugacccuauucuuucucucaggucgugguuuagguaaaacuucuauagggcuucuuugcguaauggccucuaguguacucuuauggauggcaucagucgaaccacauuggauagcagcgaguauuauucuagaauuuuuccuaaugguccuauuaauuccagagccagauagacagcggacgccucaagauaaucagcuagcauauguuguaauagggcuccuguuuaugauuuuaacagucgcggcaaacgaaaugggucugcuugagacuaccaagaaagaucuaggcauaggacacguagcuguugaaaaucaucaucaugcugcuauguuagacguugacuuacacccagccagcgcuuggacacuguacgcaguagcgaccacgauuaucaccccuaugaugaggcauacaauugaaaauacuacagcaaauaucaguuuaaccgcuauagcgaaccaggccgcgauucuaauggggcuugacaaaggcuggcccauaaguaaaauggauauuggcgucccuuuacuagcauuagguugcuauagucaaguaaacccuuuaacacuaacggcagccguuuugaugcuuguagcgcauuacgcaauuaucgggccaggacuacaagccaaagccacucgagaagcccaaaagcgcacggcagccgguaucaugaaaaaccccacugucgauggaauuguggcaaucgauuuagauccaguaguauaugacgcaaaauuugagaagcagcuagggcaaauaaugcuccuaauccuuuguacaucacaaauucuauuaaugagaacgacgugggcccuaugcgagaguaucacccucgcaacuggaccuuugacaacguuaugggaggguuccccaggaaaauucuggaacacaacuauagcuguauccauggcuaauauuuucagagguucguacuuagccggugcugguuuagcauuuucucuuaugaaaucacuuggaggugggcgacgagguacuggagcgcaaggagagacucuuggugaaaaauggaaaagacaauuaaaucaacuuucaaaaagugaauuuaauacuuacaaaaggucugggauuauggaaguagauagaagugaagccaaggaaggguuaaaacguggagagacgacaaaacaugcggucagucgagguaccgcaaaguuacguugguucguggaacgaaaccuaguuaaaccugagggaaaaguuaucgaucuuggauguggaagagguggauggaguuacuacugugcagggcucaagaaaguuaccgaggucaaaggguauaccaaaggugggccaggccacgaagaaccuaucccuauggcgacguacggauggaauuuagucaaguugcacagcgggaaagacguguuuuucaucccaccagagaagugugacacuuuauuaugugauauuggggagucuucaccaaacccuacaauagaagaaggaaggacauuacguguucuuaagaugguggaaccauggcugcgagguaaucaauuuuguauuaaaauauuaaauccauauaugcccucgguagucgaaacucuagaacagaugcagcgaaaacauggugguaugcuuguaaggaauccuuugucaagaaauagcacucaugaaauguacuggguaucgugcggcacugggaacaucguauccgcggugaauaugacaagccggaugcucuugaaccgcuuuacaauggcucaucgaaaacccacauacgaacgagacguggaucuaggagcaggcacacgacacguagcaguugaaccugagguagccaaccuagauauaauagggcaaagaauagaaaauaucaaacacgaacacaagagcaccuggcacuaugaugaagacaauccguauaaaacuugggccuaucauggaucauacgaagucaagccuucaggaagcgcaaguucaaugguaaaugguguugugaagcuguugacaaaaccuugggauguuauacccaugguuacacaaauagccaugacagauacaacaccuuuugggcaacaacguguauuuaaagaaaagguugacacgcgcacaccaaaagccaagagagggacugcucaaauaauggaaguaaccgcuaaaugguuauggggauuucuaucuagaaauaagaaaccaagaauuuguacccgagaagaauuuacaagaaaaguacgcaguaaugcugcgauuggagccgucuuuguugacgaaaaucaauggaacucggcaaaagaagcaguagaagacgagagauucugggauuuaguccacagagagagagaauuacauaaacaggguaaaugugcaacauguguuuauaacaugaugggcaaacgagagaagaaacuaggagaauuuggaaaagcaaaaggaucuagagcgauuugguauauguggcuuggagcgagauuccuagaauuugaggcuuuagguuucaugaacgaagaucauugguuuucgagagaaaauucacucuccggcguagaaggagaagguuuacacaaacuaggcuacauacuccgagauauuucaaaaauuccaggaggaaauauguaugcugacgacacugccgguugggauacacgaaucacggaagaugaccuacagaacgaagcaaggauaaccgauaucauggaaccugagcaugcacuacuggcaaaaucaauauuuaaacucacguaccaaaacaaaguagugaggguucaacgcccugccaagaaugggacaguuauggacguaauaagucgacgagaccaacguggaagcggucagguugggacauacgguuuaaacacuuuuacaaacauggaagcacagcuaauaagacaaauggaaagugaagggaucuucucgccgucggaauuagaaacucccaacuuagcagaacgaguccuagauugguuagaaaaauauggaguugaaagacugaaaagaauggcaauaucgggagaugacugcgucgugaagcccaucgaugaccguuuugcaacugcacuaacagcgcugaacgauaugggaaaaguacguaaagauauaccacaaugggaaccgucuaaggguuggaaugacuggcagcagguccccuuuuguucacaccacuuccaccaauuaaucaugaaagacggacgugaaauuguuguaccuugcagaaaccaagaugaacucguaggacgcgcgcgugugucacaaggcgcaggauggagucuuagagaaacagcuugcuuaggaaaaagcuaugcucagauguggcaauugauguacuuccacagacgagauuuacgucucgcugcuaaugcuauuuguucagcagugccagucgauuggauaccaacgucuagaacaacuuggucuauacacgcucaccaccaauggaugacaaccgaagacaugcuaaguguauggaauagaguuuggauagaggaaaauccauggauggaagauaaaacucauauuaguucguggggugacguuccauauuuagggaagcgcgaagaucaauggugcggaucacucaucggccuaaccgcacgugcgacuugggcuacaaauauacaaguagccauuaaucaaguacguagguuaauuggaaaugaaaauuauuuagacuacaugaccucaaugaaacgcuucaaaaaugaaagugauccagaaggagcuuugugguaa

SEQ ID NO: 21711 - RNA, 9879 nt, Artificial Sequence
  derived and/or modified CDS sequence (opt6) from DENV-1__FJ882562__SS-prME
ucaguuacuaugcuucugaugcucaugccaacugcgcuugcauuccauuuaacuacuagaggaggcgaaccacacaugauaguuagcaaacaagaaagaggaaaaagccugcuuuucaaaacgagugcugguguaaacaugugcacucucaucgcaauggaucucggagaauuaugugaagacacaaugaccuacaaauguccacgcauuaccgaagcugaaccggacgauguugauugcuggugcaacgcgacagauacauggguuaccuacggcacauguagccaaaccggggaacauagaagagauaaacgcuccguggcguuggcaccgcauguuggguuaggcuuagaaacucguaccgaaacuuggaugucgucugaaggcgcauggaagcaaauucaacgaguagaaacuugggcucugagacauccaggguuuacugugauagcacuauuccuagcacacgcuauaggaacaagcauaacacaaaaaggcaucauauucauacuguuaaugcuaguaacaccuucuauggccaugagaugcguuggaaucggaucucgcgacuuuguagaaggacuuucuggagccacaugggucgacguaguacuggaacaugggaguugcguaacaaccauggcaaaagauaaaccaacucucgauauagaauuacuuaaaaccgaagugacuaauccugcaguguuaaggaaacucugcauagaagcaaaaauuucaaauaccacaacagauucaaggugcccaacucaaggagaagcaaccuuagucgaagaacaagaugcaaacuucguguguaggaggaccuucguggauagaggauggggaaaugguugugggcuuuucggaaaaggcucgcugauaacgugcgcgaaauucaaaugcgucacaaaauuggaaggcaaaauaguucaauacgaaaauuuaaaauauucaguaauaguaacuguccauacaggggaucaacaucaagugggaaacgaaucaacagaacauggaaccacugccacgauaacuccccaagccccuacgacggaaauacagcuaaccgauuacggugcauuaacuuuggauugcucaccuaggacuggauuagauuuuaacgaaaugguuuuguuaacuaugaaagaaaaaucauggcuuguacacaaacagugguuuuuagacuugccccuuccguggacgaguggagcuaguacaagucaagaaacauggaauagacaggacuuauuaguaaccuuuaaaacugcacaugccaagaaacaagagguggucguauugggaucacaagaaggggcaaugcauaccgcgcugacgggcgcuacagaaauucaaacaucaggaacuacaacaaucuucgcagggcaccuaaaaugucgucuuaaaauggauaaacuaaccuuaaaagguaugaguuauguaauguguaccgggagcuuuaaacuugaaaaagaaguagcggaaacacaacauggaacgguguugguacaaaucaaguaugaaggaaccgacgcacccuguaagauuccuuucagcacacaagaugaaaaaggagucacacaaaacgggagacugauuacagcgaauccaauaguuacagauaaggaaaaacccgugaauauugaagcggaaccaccauucggggaaucauacauagucauaggagcgggcgaaaaggcucuaaaacucagcugguucaagaaaggaucgucaauagguaaaauguuugaggcaacagcacgcggcgccagaagaauggcaauuuuaggugauaccgcaugggacuucggaaguauaggaggacuauuuacgucagugggaaaacuuguacaccaaaucuuuggaacagcuuaugggguacucuucucaggaguaagcuggacuaugaaaauaggaauugggguccuauuaacaugguuaggguuaaacucuagaagcacuucacuaagcaugacuuguauagcgguuggauuaguaacuuuguacuuaggaguaaugguacaagcugacucgggaugcguaauaaauuggaaagggagggaacucaaguguggaagugguauuuuugucaccaaugaaguucauacuuggacugaacaauacaaauuccaagcugacuccccgaaacguuuaucugcugcuauuggcaaagcaugggaggaaggcgugugugguauucguucggcgacucgauuagaaaacauuauguggaaacagauaucgaacgaguuaaaccauauuuuauuggaaaaugauaugaaauuaacgguaguuguaggugauguagcaggcauacuugcacaaggaaagaagaugauccguccacagccuauggaguacaaauacucuuggaagaguuggggaaaggccaaaaucaucggagcagaugcacaaaacacaacauucauuauagacggaccuaauacgccagaaugcccugaugaccagcgagcauggaacauuugggagguugaagacuacggguucggaauauucacgaccaacauuugguuaaaacuaagagacucauauacacaggugugugaccauagacuuaugagugcugcaaucaaagauuccaaggcaguucacgcggacaugggguauuggaucgaaagcgaaaagaacgagacuuggaagcuagcacgagccucuuuuaucgaaguaaaaaccugcauuuggccaaaaucucacacguuauggaguaacgggguauuagagucugaaaugauuauaccgaaaaucuacggugggccuauuucacagcauaauuauagaccuggauauuucacucaaaccgcaggaccauggcauuuaggcaaauuagaauuggauuucgaucugugugagggcacuacaguaguagucgaugaacauuguggaaacagaggaccaucacugagaacaacuacuguuacaggaaaaauaauacaugaguggugcugucgaucaugcacccucccaccuuuacgauuuagaggugaggauggaugcugguacgguauggaaauccggccagucaaggaaaaagaagaaaauuuagugaaaucaauggucucggcgggaagcggggaagucgauucauucucauuaggacuguuguguauaucgaucaugauugaggaaguuaugcggaguagauggagccggaagaugcuaaugacgggcacuuuagccguauucuuuuugcucaucauggggcaauuaacuuggaaugaucuaauaagauuauguauaaugguuggcgcuaacgcauccgaucguaugggaaugggaaccacuuauuuagccuuaauggcuacauucaaaaugaggccuauguuugcgguuggccuuuuauucaggcggcucaccucacgggagguuuugcuacuaacaauaggucuaaguuuaguugcuaguguagaacucccuaauucucuggaagaacuuggcgacggacuagcaauggguauuaugauauugaaauuguuaacggauuuucagucucaccaacugugggcuacucuucuaucguuaacuuuuauuaaaacaacauuuucacuccauuaugccuggaagacaauggccauggugcuaucaaucguuucauuguucccacuuugcuuaagcacgaccucccagaaaaccacaugguugccaguacuuuuagggucacuugguugcaaaccguuaacgauguucuuaaucgccgaaaauaaaauauggggaagaaaaaguuggccacucaaugaggguauaauggcuguugguauaguaucaauucuccucucaagucuacuuaaaaaugacguaccccuagccggcccacuaauugcaggcgggaugcucauagcauguuauguaaucagcggaucaagugcagaucucucucuugaaaaagcggcagaagugucuugggaagaagaagccgaacacuccggugcuagccauaauauacucgucgagguucaagaugauggaacuaugaaaauaaaggaugaagaaagagaugauacgcuaaccauucuacuuaaagcaacacuucuagcaguuagcggugucuauccgcuaucuauuccagcaacccuauucguuugguacuuuuggcagaagaagaaacagagaagcgguguauugugggauacaccuagcccuccagaaguagaaagagcagugcucgacgauggcauauacagaauaaugcagcgcggguuacucggacgaucacagguggggguggguguguuccaagaaaauguauuucauacgauguggcauguaacucgaggagcagucuuaauguaucaagguaagcgacuggaaccaucuugggccagcgucaagaaagaucuuauaaguuacggugggggauggagauugcaaggguccuggaauacuggggaagagguucaagucauagcaguugagccagggaaaaaucccaaaaacguacaaacugcgccagguacguuuaaaacuccugagggagagguuggagcaauagcacuugauuuuaaaccaggcacaucagguucaccuauuguaaaucgcgaagguaaaauaguaggacucuauggaaacggcguggucacuaccagugguacuuauguaucagccauagcgcaagcgaaagcgucucaagaaggcccucuaccagaaauagaagacgaaguuuuucgaaaaaggaauuugacaaucauggaucuacaucccgguucaggaaagaccaggcguuaucuaccagcuauugugcgugaagcaauuaaaaggaaauugaggacuuugauucuugcuccgacaagaguaguggccagcgaaauggcagaggcuuuaaaaggaaugccaauaagguaccaaacuaccgcagucaagagugaacacaccggaaaggagauagucgaucucaugugccaugcuacguucacgaugagauuguugagcccggugcgaguaccuaacuauaacaugauaauuauggaugaagcacacuuuaccgacccuucaucgauagcagcaagaggauacauauccacacguguaggaaugggcgaagcugcagcuauauuuaugacggcuaccccgccgggaaguguggaagccuuuccacaaaguaaugcaguaauacaagacgaagaacgugauaucccggaacgcagcuggaacucaggcuacgaauggauaacagauuucccggguaaaaccguaugguuuguaccuucaaucaaaaguggaaaugauauugcaaauugcuuaagaaagaauggaaaacggguaauacaacuuucacgaaaaacuuuugauacagaauaccagaaaacuaaaaacaaugauugggauuaugugguaacuacagauauaucagaaaugggcgcgaauuucagagccgacagaguuauagauccucgaagaugccuaaaaccagugauacuuaaagaugguccggaaagaguaauacuggcuggaccaaugcccgugacaguugcaucagcugcucaaagacgcgguaggauagguagaaaucauaacaaggaaggagaucaauauauauacaugggccaaccccuaaauaacgaugaagaccaugcacauuggaccgaagcaaaaauguuguuagacaauauaaauacaccggagggcauuaucccugcauuauucgaaccagaaagagagaaaagugcagcaaucgauggagaauauagacugagaggcgaggcacgaaaaacauuuguagaacuaaugagacgaggagaucuaccgguuuggcugaguuacaaagucgcuucagagggcuuccaauauucugacaggcgguggugcuucgauggagaaagaaacaaccaaguucuugaagaaaauauggacguagaaaucuggacaaaagaaggggaaaggaagaaauuaagaccgagaugguuggaugcacguacauauucagaucccuuagccuuacgggaguucaaagaauuugcagcagguagaagaagugugucuggagaucuuauucuagagaucggaaaacuuccacaacaucucacacaacgggcccaaaaugcauuagacaaucugguuaugcuucacaauuccgaacaaggagggagagcauauagacaugcaauggaagaacuucccgauacaaucgaaacucuaauguuauuagcgcuaaucgcuguacuuacagggggaguaacauuauucuuucuaucuggcagggguuuaggaaagacgaguauugguuuacuuuguguuaugacaaguucuguucuucuauggauggcgucagucgagccucauuggauagcagcuuccauuauacuugaguucuuuuugaugguauuauuaauaccagaaccagauagacaaaggacaccgcaggauaaucaacuugcuuacguaguuauuggguuacucuucaugauccuuacaguagccgccaacgaaaugggauugcuugagacaacgaaaaaggaccuaggaauuggucacguagcaguugaaaaccaucaccaugcagcaaugcuggauguugauuugcacccugcuagcgcauggacacucuaugcuguagcuaccacaauaauaacgccgaugaugcgacacacaauugaaaauacaaccgcuaauaucagucuuacagccauagcaaaccaggcggccauacuaaugggccuagacaaaggguggccuaucucuaaaauggacauaggcguuccacuccucgcauuaggaugcuauucucaaguaaacccauuaaccuuaacagcugcgguauuaaugcuggucgcacauuaugcaauaauaggcccaggccuccaagcaaaagcgacucgagaagcacaaaaacgcacagcugcaggaauaaugaaaaauccaaccgucgacgggauuguagcaaucgaucucgacccaguaguuuaugaugcuaaauucgagaaacaacuuggacagauuauguuauuaauucuaugcacaucucaaauacuuuuaaugcguaccacaugggcgcugugugagagcaucacacuggcuacuggaccccuaaccacacucugggaaggaucaccuggaaaauuuuggaauaccacaauagcuguaucuauggccaacaucuucagaggaaguuaccuugccggugcaggguuagcuuucagccuuaugaaaagccucgggggaggaaggcgugguacgggcgcucaaggcgaaacauuaggggaaaaauggaaacgacagcuaaaucaacugaguaaaagugaauuuaacacauauaaacgaucgggaauaauggaaguagaccgaucagaagcuaaagaaggguugaagagaggagaaaccacgaaacacgcggugucuagaggcaccgcaaaacuucgaugguuuguugagagaaaucuaguaaagcccgagggaaagguaauagauuugggauguggucgagguggauggaguuacuauugugcaggacuaaagaaaguaacagaagucaaaggcuacacuaaagggggaccaggccaugaagaaccuauuccuauggccacguauggcuggaaccucgugaaauuacacucuggaaaggauguauuuuucauuccaccagaaaagugugacacucuauugugcgauauuggugaguccuccccaaacccaacuauagaagaaggcaggaccuuaaggguacucaagaugguugagccgugguuaagaggcaaccaauuuugcauuaaaaucuugaauccuuauaugcccucugugguagagacauuagagcaaaugcaaagaaagcacggugggaugcuggucagaaauccuuuaucaagaaauuccacacacgaaauguauuggguaucaugcggaacugggaacauaguguccgcagucaauaugacaucucggaugcuacugaauagauuuacaauggcgcaccgaaaacccaccuaugaaagagauguagaccuaggaacgggaacccgacauguugcagucgaacccgagguagccaaccucgacaucauuggacaaagaaucgagaauauuaaacaugaacauaaaagcacuuggcauuacgacgaagacaaucccuauaagacaugggcuuaccauggaaguuaugaggugaaaccuucuggcagugcguccucgaugguuaaugggguuguaaaacuauuaaccaaaccaugggauguaauaccuaugguuacucaaauagcaaugacggacaccacaccauucgggcagcagagagucuuuaaagaaaaaguagauacaagaacaccuaaagcuaaaagagguacagcacaaaucauggaaguuacugcgagguggcuuuggggguuucuuuccaggaauaagaaaccucguaucugcacccgagaggaauuuacacgcaagguacgauccaaugcggcuauaggugcugucuucguggaugaaaaccaauggaauagugcuaaagaagcaguagaagacgaacguuuuugggaccuaguucaccgugaacgcgaguuacacaaacagggaaaaugcgcaacauguguauacaauaugaugggcaagagagaaaagaaacucggggaguucgguaaggccaaaggaagcagggcgauuugguauauguggcuuggagcucgauuccuagaauuugaggcauuaggauucaugaacgaagaccauugguuuaguagagaaaauagcuuaagcggagucgagggagaaggcuuacacaaauuggguuauaucuugagggauauuucgaaaaucccagguggaaacauguaugcagaugauacagccgggugggauacgcggauuaccgaagaugacuuacagaacgaagcgaaaauaacagauauuauggagccggaacaugcccuacuugccaaagcuauauuuaaauuaacuuaucaaaauaaaguugugcggguacaacggccugcgaaaaauggcacugugauggacguaauuucccgacgagaucagcgaggcagugggcaaguggguacauauggauuaaauacauucacaaauauggaggcacagcuaauccgacaaauggaaagcgaagguauauuuucacccucagagcuggaaacaccuaacuuggcagaacgggcacuagacugguuagaaaaauauggagucgagcggcuaaaacgaauggcaaucagcggagacgacugugugguaaagccaauagaugacagauucgccacagcuuuaacggcguugaaugacauggggaaagugaggaaagacaucccgcaaugggagccaaguaaaggauggaaugauuggcaacaaguaccguuuugcagccaccauuuccaccagcugauuaugaaggauggucgggaaauaguuguaccaugcagaaaucaagacgaauuagugggacgggcaaggguuucacaaggagcggguuggagucuuagagagaccgcuugucuagguaagagcuacgcacaaauguggcaacuuauguacuuccaucgacgcgaucuaagacuagcugccaaugcgauaugcagugcaguuccaguagacuggguaccgaccucuagaaccacguggucaauacacgcccaucaccaauggaugaccacugaggacaugcuuucaguauggaacagggucuggauagaggaaaauccuuggauggaggauaaaacacauauaucaucaugggaagacguuccguaucuagggaaaagggaggaccaguggugugguucuuugauagggcuuacugcccgcgcuacaugggcgacuaacauacaaguugcaauaaaucagguuagaagacuaauaggaaaugaaaauuauuuggauuacaugacuuccaugaagagguuuaaaaaugaaagugacccagaaggggcacuaugguag

SEQ ID NO: 21712 - RNA, 9879 nt, Artificial Sequence
  derived and/or modified CDS sequence (opt6) from DENV-1__FJ882564__SS-prME
ucgguuacuaugcuucugaugcugaugccaacggcguuagcauuucacuugacaacuagaggaggggaaccucauaugauuguaacaaaacaagaacgcgguaagagcuugcuuuuuaaaacaagugcagggguuaacauguguacccuuaucgcaauggacuuaggggagcugugugaagauacuaugacguauaagugcccacgcauaacagaagcagagccggacgacguagauuguugguguaaugcuacagauacguggguaacguacgguacaugcagucaaacgggagaacacagaagagauaagcguucaguugcuuuggccccacacgucggacugggccucgaaacacguacagaaacauggaugucuucugaaggggcauggaaacaaauccaacgagucgagaccugggcuuuaaggcauccugguuuuacuguaauugcauuauuucuugcucaugcuauaggaacuuccauaacacaaaaagguauaauuuuuauauuguuaaugcuggucacuccgucaauggcaaugcgaugugugggaauaggauccagggacuuuguagaaggucugucuggagcuacuugggucgacguaguacucgaacacgguagcugcguaacaaccauggcaaaagauaaaccaacgcuugauauagaauuguuaaaaacugaagucacuaauccugcaguauuaaggaaacuaugcauagaagcaaaaauuaguaauacuacuacugauucucgcugcccaacacaaggagaggcaacuuuaauggaggaacaagacgcuaauuuugucugccgucgcaccuucguugaucggggauggggaaacgguugcggacucuuuggaaaagguaguuugauaacaugugcaaaauucaaauguguuaccaaacuugagggcaaaauuguacaauaugaaaacuuaaaauauucuguaauaguaaccguucacacgggggaccaacaccaaguggguaaugaaucgacagagcaugggacuacugcgacgauaacaccacaagccccaacuuccgaaauacaauuaacagacuauggugccuuaacacuagauuguaguccgaggacaggacucgacuuuaaugagaugguucuucuuacuaugaaagaaaaauccugguuaguccacaaacaaugguuuuuagauuuaccacuacccuggacaucgggcgccucuacuucacaagaaacauggaauagacaagaucuucuagugacguuuaaaacagcacaugccaagaaacaagaaguaguagugcuaggaucacaagaaggagccaugcauacagcucucacgggggcuaccgagauacaaacaagcgggaccacuacuauuuucgccggacaccucaagugccgacuuaaaauggacaaauugacauuaaaaggcaugucuuacgugauguguacugguaguuuuaaguuggaaaaggagguagcagaaacucaacauggcacaguauuaguccaaaucaaguaugagggaacugaugcgccaugcaaaaucccuuuuucuacucaagaugaaaaaggagugacgcagaauggcagguugaucacagcaaacccuaucguaacugacaaagaaaaaccaguaaacauugaagcggaaccacccuuuggugaaucauauauaguaaucggugccggagagaaagcacucaaacucucaugguuuaagaaagguucauccauagguaaaauguuugaagcaaccgcaagaggagcaagacguauggcaauccuuggcgauacagcaugggacuuugggucaauugguggagucuuuacaaguguuggaaaauugguucaucaaauauuugggaccgcauacggcguacuauucagcggcguaaguuggacgaugaaaauaggcaucggaguccugcucaccuggcuaggguugaauagucguucgacuucauugucgaugacauguauagcagucggucuggucacacucuacuuaggcguaaugguucaagcagauucaggguguguaaucaacuggaaaggcagggaauugaaaugcggaaguggaaucuuugucacaaaugagguacauacauggacugaacaauacaaauuccaggcugacucaccaaaaagacuaagugcggccaucggcaaggcaugggaggaaggaguaugcggaauuagaagugcuacuaggcuugaaaauauaauguggaaacaaauuucaaacgaauuaaaccauauacuguuagaaaauggaaugaaauuuaccguaguaguuggugaugugguaggcauucuugcgcaagggaagaaaaugauacggccacaaccuauggagcauaaguacucauggaaguccuggggaaaggcaaaaauaauuggugcagacgugcagaauaccacauuuauaauugacgguccuaacaccccagaauguccugaugaccaaagagcguggaacauuugggaagucgaagauuacggauucgguauauuuacaacuaacauuuggcuaaaacuucgagacaguuacacccaggugugugaccaccguuuaaugucagccgcaauaaaagauaguaaggccguucaugcagauauggguuauuggaucgaaucggaaaagaaugaaacguggaaacuugcacgugccucuuuuauugaaguuaaaacguguauauggccaaaaagucacacauuauggaguaauggaguacuagaauccgaaaugauuauaccgaagauuuauggagguccuauaagucaacauaacuauaggcccgguuacuucacucaaaccgcuggaccuuggcaccuggguaaacuagagcuagauuuugaucuaugugaagggacuacugucgugguggacgagcauugcgguaaucgaggcccuagucugcgaacuacaacagugaccggcaaaauaauacacgaaugguguugucgaaguuguacacugccgccacugagauuuaaaggugaagauggcuguugguaugggauggagauaagaccgguaaaagaaaaggaagagaauuuaguaaaaucaaugguuucagccgguucaggagagguagauagcuucucguuaggacuauuauguaccucaauaaugauagaagagguaaugcguagccguugguccagaaaaaugcugaugacugguacauuggcaguauuucuacuccuuauaaugggucaguuaacauggaaugaccucauacgucuguguauaaugguaggggcaaaugcaagcgauagaauggguaugggaacuacuuacuuagcccuuauggcgacuuucaaaaugaggccaaugguagcaguaggacuacucuuccgaagauugacgagucgagagguucuauuacuuaccaucgguuugucucuggucgccaguguggaauugccaaauucgcuugaggaacuuggugauggauuggcaaugggaauuaugauuuuaaaguuacuuaccgauuuucaaucucaucaauuaugggccacacuucuuucuuuaacuuuuauuaagacuacucugucauuacauuaugcuuggaaaacuauggcuaugguguuaaguauuguaucauuauuuccguuaugucuaucgacgacaagucagaagaccaccuggcuacccguauuauuaggcucucuuggauguaaaccacuaacaauguuucuuauugcagaaaacaagauaugggggcgaaaaucguggccacuuaaugaagguaucauggcagucggcgugguauccauccuucugaguagcuuacuaaagaacgacguaccucuagccggucccuuaauugcgggagguaugcuaauugccuguuacguuauuagcgguucgagugcggauuuaucgcuagaaaaagcagcugaagugucaugggaggaggaagcagaacauucaggagcaucucauaauaucuuaguggaaguccaagacgaugguaccaugaaaauaaaagacgaagaacgggaugacaccuuaacuauucuguugaaagcaacacuauuggcagucucuggaguguauccccuuuccaucccagcuacuuuauucgucugguauuuuuggcagaaaaagaaacaacgaaguggagucuuaugggauacuccgucaccaccagagguagaacgggcaguccuugacgaugguauuuaucgaauaaugcaacgagguuuacugggacguucacaaguugggguagggguguuucaagaaaacguguuucauacgauguggcacguaacgcgcggagcaguauuaauguaccaaggaaaacgacuggagccauccugggcgucagugaaaaaggaccugauuucauacggagggggauggcgguuacaaggcagcuggaauacuggugaggaaguacaagucauugcagucgaaccaggaaagaauccgaaaaauguacagacagcucccgguaccuuuaagaccccagaaggugaagugggagcgauagcacucgauuucaaaccuggcacuagcgguucaccaauuguuaacagggagggaaaaauagucggacucuaugggaaugguguugucaccaccagcgggacauacguauccgcaaucgcacaagcaaaagcaucccaagaagggccccuucccgaaauugaggacgagguauucagaaaacggaaccuuacaauaauggaccuacacccuggaucaggaaagacacguagguaucucccggccaucgucagagaagcuauuaaaagaaaguuacgaacccuuauucuugcaccaacgaggguugucgcaagugaaauggcugaagcauuaaaagggaugccgauaagauaucaaacaaccgccguaaaaagugaacauaccgggaaagaaauuguugaucucaugugucacgcgacuuucacaaugagauuauuaucaccaguacgagucccaaauuacaacaugauuauaauggaugaagcacauuuuacggauccaagcaguauagccgcuagaggguacauuagcacaagagucggaaugggggaagcagcugcaaucuuuaugaccgcuacaccaccaggauccguagaagcauucccacaaagcaacgccgucauacaagaugaagaaagagacauuccagaacgaucauggaauaguggcuacgaauggauaacggacuuuccagguaaaacugugugguuugucccaucuauuaaaucugguaacgacauugcuaacugucuaaggaaaaacggaaagcguguuauacaguuaagucguaaaacguuugauacagaauaucagaaaacgaaaaauaaugacugggacuacguaguuacgaccgauauaucagagaugggcgcaaauuuccgugccgaccgcguaauagauccgagaagguguuuaaaaccugucauauuaaaggauggaccagaacgagucauuuuagcaggcccaaugccagugacuguagcaucagcagcccaaaggagggguagaauaggucggaaucauaauaaagagggagaucaauauaucuauaugggacaaccacuaaauaacgaugaagaccaugcgcacuggacggaagcuaaaaugcuauuggauaacauaaauacaccggaaggaauaauucccgcuuuguuugaacccgagagagaaaaauccgcagccauagauggagaauaccgcuuaagaggagaagcccguaagacauucguagaacuaaugaggcgaggugacuuaccaguauggcuuagcuauaaaguugcgagugaagguuuucaauauagcgauaggcgauggugcuuugacggagagcgaaacaaccagguacuagaagaaaauauggaugucgagauuuggacgaaagagggagaaagaaagaaauuaaggccaagauggcuagaugcaagaacuuacucugacccccuagccuuacgagaauuuaaagaguucgcggcuggacguagaagcguaucaggcgauuuaauucuugaaauuggaaaguugccacaacaccucacacaacgggcccaaaacgcuuuagauaaucuugugauguuacauaacucggaacaagguggaagggcauaucgucaugcaauggaggaauuaccggauacaauugagacguuaauguuauuagcucuaauugcagugcuaacgggcggugugacauuauucuuucucucaggccguggccuugguaagacgucaauuggacuuuuaugcguaauggcuaguucaguacuacuauggauggcaaguguagaaccccauuggaucgcagccucaauuauucuagaauuuuucuuaaugguucuacuaauacccgagcccgaccgacagagaacgccacaggauaaccaacuggcauauguugucauuggccuucucuuuaugauacuaacaguugccgcaaacgaaaugggauuacuagaaacaacuaagaaagaccugggaaucggucauguagcaguagaaaaccaucaccaugccacaaugcucgacguggaccuacauccugcaucagcguggacuuuguacgcggucgcaacaaccauuauuacacccaugaugagacauacuauagagaacaccacagcaaacaucucucuuacggcaauagccaaucaagcagcuauacucaugggucuagauaaagguuggccuauuaguaaaauggauauagggguaccauuguuggcacucggauguuauagccaagugaaccccuuaacccugacagccgcgguccuaaugcuaguggcacacuacgcaauaauaggccccggcuugcaagcuaaagcaacacgagaggcgcagaaaaggacagcagcggguauaaugaaaaacccaacgguagauggcaucguagcgauagauuuagacccugugguuuaugacgccaaguucgaaaagcaguuaggucaaauaauguuacuaauuuuauguacaucacaaauuuuguugaugagaaccacaugggcacugugugagagcauaacucuggcgacagguccucuaacaacgcuaugggaaggcucaccggggaaauuuuggaacacaacuauagcagugucgauggcuaacaucuuccguggaucuuauuuagcuggagccggacuagcguuuaguuuaaugaagucuuugggaggcggccgucguggaacaggugcgcaaggugaaacuuuaggagaaaaguggaaacgacaacucaaucaauuaaguaaaucggaauuuaacauauauaaaagaucugggaucauggaaguagauagaagcgaggcaaaagagggcuuaaaacgcggugaaaccacgcggcaugccguaagucgaggaaccgcuaaauuaagaugguucguggaaagaaacuuaguaaaaccagaagguaaggucauagaucuaggcugugggagaggugguuggucauacuauugugcuggucuaaagaaaguuacagaagucaaaggguauacaaagggagguccuggacaugaagaaccaaucccuauggcgaccuacggguggaacuuagucaaauugcacuccggcaaagaugucuucuuuacaccacccgaaaagugugauacccucuugugugacauuggagaaucaucgcccaacccuacaauagaagaagguaggacuuuaagaguacucaaaaugguugaaccuuggcuuagggggaaucaguucugcauuaaaauauuaaauccuuauaugcccucuguuguugaaacgcuagaacaaaugcaaagaaaacaugguggaauguuagugagaaacccccucagucgaaacagcacacacgaaauguauugggugucuugcgguacugggaauaucguaucagcaguaaauaugaccucacgaaugcuauugaauagauuuacaauggcgcacaggaaaccuacauaugagagagacguagauuugggugcggggacgaggcacguagcgguugagccagagguugcuaaccuagauauaauaggacaacgaauagagaacauuaaacaugagcacaagucuacauggcauuacgaugaagauaacccauacaaaacgugggcauaccauggcagcuaugaagucaaaccaucaggcagcgcaucgagcaugguaaauggaguaguuaaauuauuaacaaaaccaugggauguuauaccuauggugacucaaauagcgaugacagacacaacccccuuuggacaacaacgaguuuucaaagagaaaguagacacaagaacuccuaaggcaaaaagagguacagcccaaauuauggaaguaacugcacgcugguuauggggauuucucaguaggaauaagaaaccgcgaaucugcacaagagaagaauuuacgcgaaagguucgaucaaacgcagccauuggcgccguguucguugacgaaaaucaauggaacagcgcuaaagaagccguagaggaugaacgguuuugggaccucguucaaaaagaacgcgaguugcacaaacagggaaaaugugcaacaugcguauauaacaugauggguaaaagagagaagaaauuaggugaauuugggaaagcuaagggaucaagggcaauaugguauauguggcuaggggcaagauuuuuagaguuugaagcauuaggguucaugaaugaagaccauugguuuucacgagaaaauucacuuucgggaguagaaggcgagggucuccauaaauuagguuacauacuuagggauauuucaaagauuccaggcgggaauauguaugcugaugacacagcaggaugggauacaaggauaacagaagaugaucuacaaaacgaggcaaaaauaacugacauaauggagccagaacacgcacuauuagcgacaaguauauuuaagcugacguaucaaaauaagguuguaagaguacaaagaccugccaaaaauggcacuguaauggauguuauuagucgccgggaucagagaggaaguggacaaguugggacauacggauuaaacacguuuacuaauauggaagcccaauuaauucgucaaauggaaucggagggaaucuuucuaccaagugaauuggaaacuccuaauuuggccgaacgaguacuugauugguuagaaaaauauggcguagaaagauuaaaaaggauggcaauaagcggagaugauugcgugguuaagcccauugaugaccgcuucgcuacugcacuaacagcauugaacgacauggguaaagugagaaaagauauuccacaaugggagccaagcaaaggauggaaugauuggcaacaaguccccuuuugcucucaucauuuucaucaauugaucaugaaagacgggagagaaauugucguaccaugcaggaaucaagacgagcuaguaggcagagcaagaguaucccaaggggcuggauggaguuuacgagagacggcgugcuuaggaaaaaguuaugcccaaauguggcagcuaauguauuuccacagaagggaucugagacuggcugcaaacgcaauaugcuccgccguuccaguugacuggguuccaacuucccggacaacguggaguauacaugcccaccaucaauggaugacuacagaagauaugcucagugucuggaauagggucuggaucgaagaaaauccauggauggaggacaaaacgcaugucuccagcuggggagaugugcccuauuuagguaagcgcgaagaucaauggugcgguucgcuaauagguuugacagcuagagcuacuugggcaucuaauauccaaguagcgauaaaucaaguccguagauuaauagggaaugaaaauuaucuggauuauaugacaucaaugaaacgcuucaaaaaugaaggugacccagagggagcucuaugguaa

SEQ ID NO: 21713 - RNA, 9879 nt, Artificial Sequence
  derived and/or modified CDS sequence (opt6) from DENV-1__FJ882565__SS-prME
agcguaacuaugcuacugaugcuaaugccaacugcacuugcauuucauuuaacaacccggggaggagaaccacacaugauaguaacuaaacaagaacguggaaaaagccuucuuuuuaaaacaucugcaggcguaaacauguguacuuugauagcaauggacuuaggcgaauuaugugaagauacaaugacauauaaauguccacgcauuacugaagcagaaccagacgauguagacuguugguguaacgcaacagacacaugggucacauaugggacuuguucacaaacuggugaacauagacgcgauaaaagaucggucgcgcuagcaccacacgugggucuaggacuagaaacucggacggaaacauggaugucuucagaaggcgcauggaaacaaauccaacgaguugaaaccugggcuuuaaggcaucccgguuucacaguaauagcucuguuucuagcacacgcaauagguacaucuauuacacaaaaagggauaauuuucauccuccuaauguuagugacaccaaguauggcgaugcgaugugucggcaucgguagcagagauuucgucgaagggcuuagcggagcuacuuggguagauguaguccuagaacauggaaguuguguaacaacgauggcaaaagauaaaccaacgcucgauauugaauuguugaagacggaaguaacuaacccagccguauuacgcaaauuguguauagaagcgaaaauuagcaauaccacaaccgacaguagaugcccgacacaaggugaagcaacacuuauggaagaacaagaugcuaacuucguaugucggaggacuuuuguagaccgugguugggggaauggaugcggacucuucggcaagggcagucuaaucaccugugcuaaguucaaaugcguaaccaaacuugaaggaaaaaucguccaauaugaaaacuuaaaauacucggucauuguaacuguucacacuggagaucaacaccaagucggcaaugaaaguacggagcacggaacaacagcuacgauuacaccccaagcaccuacaucugagauacaauuaacagauuauggagccuugacauuagacuguagccccaggaccggacuagauuuuaacgaaauggucuuauuaaccaugaaagagaaaagcuggcuaguucauaaacaaugguuuuuagaucugccgcuucccuggacaucaggagcgagcacaucucaagaaacguggaacaggcaagaucuauuagucacuuuuaaaacagcccaugcgaagaaacaggagguaguaguacuagguucucaggaaggggcuaugcacacugcacuaacaggggcaaccgaaauacagacgagcgguaccaccacaauauuugcaggccaccuuaagugccgacuaaaaauggauaaacuaacauugaaaggaauguccuacgucauguguacuggguccuucaaacuagaaaaagagguagcagaaacacagcauggaacaguuuuaguucaaauaaaguacgaaggaacugaugcgccauguaaaauacccuucaguacacaagaugaaaaagguguuacacaaaauggcagauuaauuacagcaaacccuauuguaacagacaaagaaaagccaguaaacauagaagcagagccacccuuuggagaaucauacauaguaauaggugcaggagagaaggcccucaaauuaaguugguuuaagaaagggagcaguauuggaaaaauguuugaagcaacagcucguggugcgaggcgaauggccauccucggagacacagcaugggacuucggguccauaggcggaguauucacuagcguuggaaaacuugugcaccaaauuuucggaaccgcuuacggaguuuuauuuaguggaguuuccuggacgaugaaaaucggcauagguguucugcuaacuugguuaggcuugaauagcaggucuacauccuuaucgaugacguguauagcaguaggacucguuacacuuuaccuuggcgucaugguucaagcggauagcggcugcguuaucaauuggaaaggacgagaguugaagugugguagcgguauauuuguuaccaaugaaguccauacuuggaccgaacaauauaaauuucaagcagauagcccaaagagacuuucagcagcuauugguaaggcuugggaagaagguguuugcgggauaagaagcgcuacacgauuagagaauauuauguggaaacaaauuagcaacgaauuaaaccauaucuugcuagaaaacgauaugaaauucaccguaguugucggagaugugguggguauuuuagcucaagguaaaaagaugauucgaccucaaccgauggagcacaaguacuccuggaaauccuggggaaaagcaaagauaauaggagcagacguucagaauacaaccuucaucauugaugguccuaauacaccggaauguccugaugaucaaagagccuggaauauuugggaagucgaggauuauggguuugguauauuuacuacaaauauauggcuuaaacuacggggcaguuauacucaaguaugugaccauagacuuaugagcgcugcuauuaaagacucaaaagcaguacaugcggacaugggauauuggauugaaucagagaaaaaugaaaccuggaaacuagccagagccagcuuuauagaggugaagacaugcauuuggccuaagagccauaccuuaugguccaauggaguacucgaaucagaaaugauuauaccuaaaauauacgggggaccuauaucgcaacauaauuaucgaccagguuauuuuacacagacagcaggcccauggcaccucgguaaauuggaacuugacuucgaccuaugugaaggaacaacaguuguagucgaugaacacuguggcaacaggggaccuagccucagaacgacuacgguaacugggaagauaauucacgaguggugcuguagauccugcacuuuaccaccguuacgcuuuaagggagaagacgguugcugguacgggauggagauuagaccuguaaaagagaaagaagaaaaccugguaaaaucaaugguaagugcuggcaguggagaaguggauaguuucagccuuggauuguuauguaucucaauaaugauugaagaggucaugaggucacguuggucacggaagaugcuaaugacagguacauuagcaguguuccucuuacugauaauggggcaauuaacuuggaacgauuuaauaagacuuuguauaaugguaggggcuaacgcaucugauagaauggggaugggaacaacauacuuggcacugauggcgacauuuaagaugagacccauguuugcagugggucuucuauuccgcaggcucacuucucgugaaguauuguugcuaacaauaggacuuucucuagucgcaucgguggaauuaccuaauucuuuggaggaauuaggagauggauuagcaauggggauaaugauacugaaauuauuaacugauuuucaaagucaccaguuaugggcgacacuccugaguuuaacguuuauaaaaacaaccuuaucauuacauuaugcuuggaaaacaauggcuaugguguuaagcauagucucgcucuuuccccucugccugucaacaacaagucagaaaaccacuugguuaccaguucuguuaggcucacucggaugcaagccacuuaccauguucuuaauagcagaaaacaaaaucuggggcagaaaaucguggccccuaaaugagggaauuauggcgguaggagugguuagcauuuugcuaucaagucuguugaaaaaugacguaccauuagcaggacccuuaauugccggugguauguuaauagcaugcuaugucauaagcggaucuucagcagacuugucacuugaaaaagccgccgaaguuucgugggaagaagaagcagaacauucaggggcuagucacaacauccucguugaaguacaggacgacggaacaaugaagauuaaggacgaagagagggaugauacuuuaacgauacuacuaaaagcaacauuauuagccgucucaggaguuuauccucuaucaaucccagcgacauuauuuguuugguacuucuggcagaagaagaaacaaaggucagggguucuuugggauacaccaucaccgccugagguugagcgugcaguccuugaugauggcauuuaucgaauaaugcaaagagggcuauuaggcagaucacaaguugguguuggcguguuucaagagaauguuuuucauaccauguggcaugucacucguggcgcaguuuuaauguaucaaggaaaacgucuugagccgaguugggccagugucaagaaagauuuaaucucuuacggcggaggauggagauugcaaggaucuuggaacacuggugaggagguccaagugauagcaguugaaccgggcaaaaaucccaagaacguccaaacugccccaggcaccuuuaaaacgcccgaaggugaaguaggagccaucgcacucgacuucaaacccggaaccagcgggucgcccauaguaaauagagaagguaagauaguaggcuuguauggaaauggaguagugacaacaucggguacauacgugagugcuauugcacaggcaaaggccagucaagaaggcccucuaccggagauagaagaugagguauucagaaaaaggaauuuaacuauaauggauuuacacccaggguccggcaagacuagaagauaucuaccagcuauagucagagaggcuaucaaacguaaacucagaacauuaauucuagcaccuaccagaguuguugcuagcgaaauggcggaagccuuaaaaggcaugccaauacgauaccaaaccacggcugucaaaucggaacauaccgguaaagaaaucguggaccugaugugccacgcuacauuuaccaugcgacuauuaucgccugugagaguuccaaauuauaauaugauuauuauggacgaggcacauuucacggacccaaguucaauugcagcgcguggauauaucucaacaagaguagguaugggagaagcggcugcaauuuucaugacugccacaccuccggggucgguggaggcuuuuccccaaaguaaugcgguaauucaagacgaagaaagagauauaccugaaaggagcuggaauaguggguaugaauggauuacugauuuuccugggaaaacuguaugguuugucccaucaauaaaaucaggcaaugacauagcaaauugucugaggaaaaauggaaagagggugauacaauuaaguaggaaaacguuugauacagaauaucagaaaacuaaaaacaaugauugggauuacguuguaacgacagacauaucugaaaugggggcgaacuuuagagcggauagaguaauugacccgcggagguguuuaaagccaguuauccuuaaggauggaccagagagagucauccuggcggggccuaugcccgugacgguagccagcgcggcacaacgacgugguagaauuggaaggaaucacaauaaggagggcgaucaauauauauauaugggacaaccacucaauaacgacgaggaucaugcacauuggacagaggcuaaaaugcucuuggacaauauuaacacgccagaagguaucauaccagcauuauuugagccagaaagagaaaaaucagcugcuauugauggagaauauagguuacgaggagaagcccgaaagacguuuguagaauuaaugcguaggggagaucugccgguauggcuaaguuacaaaguggcaucagaaggguuucaauauagcgaccggagaugguguuuugacggcgaaagaaauaaccagguacucgaagagaauauggauguugagaucuggacaaaggaaggugaaagaaagaaauuacguccccguugguuagacgccaggacauauucagaccccuuggcauuaagggaguuuaaggaguucgcagccgggcgaagaucaguuagcggggaucucaucuuagagauaggaaaguuaccccagcaccuuacacaaagagcacaaaacgcuuuagacaaucuaguaauguuacacaauucagagcaaggaggacgagcauauagacacgcgauggaggaacuaccagauacaaucgaaaccuugauguuacuugcacugauugcuguacuuacgggcgguguaacccuguucuuucuaucugguagaggucuaggaaaaacaucaauaggacuacuauguguaauggcaagcaguguguuacuguggauggcaucaguggaaccucacuggauagcagcauccauuauuuuagaguuuuucuuaauggugcuucugauuccagagccagauagacaaaggaccccgcaggacaaccaacuugcuuacguagugauugggcugcuauuuaugauucuuacggucgccgcaaacgaaaugggacuucucgaaaccacaaagaaagauuuaggaaucggccauguugcgguagagaaucaucaucacgcaacaaugcuagauguugaucuucauccggcuuccgcuuggacuuuauaugcaguggcaacaacaauuauuacaccuaugaugcgccacaccauagaaaauacaacagcuaacauaucuuuaacugcaaucgccaaucaagcagcaauacucauggggcuggauaaagguuggccaauaaguaaaauggacauuggcgugccacuacuugcccuaggauguuacagucaagucaaccccuugacacuaacggcugcuguacuaaugcuuguagcacauuacgcaauaauuggacccggacuucaggccaaagcuacccgcgaagcacagaaaagaacggcagcaggaauaaugaaaaauccaacggucgacggaauuguagcuauagaucuagacccagucguuuacgacgcaaaauuugagaaacaauuggggcaaaucaugcuuuuaauuuugugcacaucacaaauucuccuaaugcgaacuacaugggcacuaugugagucuauuacacucgcgacaggcccauuaacuacauuaugggaaggaagcccaggaaaauuuuggaacacuacaaucgcaguaagcauggcaaacauuuuucgcgggaguuauuuagcaggagcaggucuugcauucucauuaaugaaaucacuaggaggaggacgacgggggacgggagcccaaggugagacguuaggagaaaaauggaaaagacaacucaaucaacuaucaaagagcgaguucaauauuuauaaacgaucaggaaucauggaagucgaccgauccgaggccaaagaaggcuuaaagagaggagagacaacucgucaugcuguaucaagagggaccgccaaguugagaugguucguagaaagaaauuuaguaaaaccagagggaaaagugauagacuuaggaugcggcagggguggaugguccuacuacugcgccggacucaagaaagucacagagguuaaaggauacacuaagggaggacccgggcacgaggaaccaauaccgauggcgacauauggauggaauuuaguaaaauugcacagcgguaaggaugucuuuuucacgccgccagaaaagugugauacauuguugugcgauauuggagaaucuucuccgaaucccacaauagaggaggguagaacauugcggguccuuaagauggucgaaccguggcugagaggaaaucaguuuuguauaaaaauucuuaauccauauaugccuagugugguagaaacuuuagaacaaaugcaaagaaagcauggaggaaugcucguaagaaacccacugagccggaacucuacgcacgaaauguacuggguuuccugcggaacagggaacauugugagcgcaguuaacaugacaucgcgcaugcuacuaaauagauucacgauggcgcaucguaaaccgaccuacgaacgagacgucgaccuuggagcugguacacgacauguggcaguugagccugaaguagcaaacuuggacauaaucggacaaaggauagagaauaucaaacacgaacauaaaagcacauggcauuacgacgaagauaaccccuauaaaaccugggcauaucacggcucguacgaagugaaaccaucugguucggccucaagcaugguaaauggggucguaaaacuguuaacaaagccgugggauguaauaccaaugguaacucaaaucgcuaugaccgauacaacgccuuuuggacaacagcgaguauuuaaggaaaaaguugauaccaggacuccaaaagcaaaaagggguaccgcacaaauaauggaagugacagcuagauggcuuuggggguuucucucgcgaaacaaaaagccucgaauauguaccagagaggaguuuacgagaaaaguacgaucaaacgcagcaauaggagccguuuuuguagacgaaaaucaauggaacucagcaaaagaagcggucgaagaugagcgguucugggauuuaguacaaaaagaaagggaauugcauaaacaagggaaaugcgccacaugcguauauaauaugaugggcaaaagagagaagaaauuaggagaguuuggaaaagcgaaagguucaagggcgaucugguacaugugguugggugcaagauuccuagaguucgaagcacucggguucaugaacgaagaucacugguucucgagggaaaauucauuaucugggguggaaggagagggucuccauaaacuugguuauauacuaagagauauaucuaaaaucccaggaggcaauauguaugccgacgacacugcaggaugggacacccgaaucacugaagacgacuugcaaaaugaggcaaaaauaacggauauuauggagcccgaacaugcacuacuagcuacaucgauauucaaacuaacuuaccaaaauaagguuguaagaguucaaagaccagccaaaaaugggacgguuauggacgucauauccaggagagaccaaagaggcagcggucaagucgguacuuauggacuuaauacuuuuacaaauauggaagcacaacuaauucgccagauggaaagugagggaauauuccucccaucagaauuagaaacuccaaaccuagcagaacgaguucuagauugguuggaaaaguacgguguggaacguuuaaagaggauggcaauuagcggugacgauugcgugguaaaaccgaucgacgauagguuugcuaccgcguuaacugcuuugaacgauauggguaaaguccgaaaagauaucccgcagugggaaccuaguaaaggauggaaugauuggcaacaagugccguuuuguucacaucauuuucaucaacuaaucaugaaggauggccgugaaauagugguuccaugcaggaaccaggaugaacuugucggucgcgcuagagugucgcaaggagcagguuggagucugagagaaacggcauguuuaggcaagucauaugcgcaaauguggcaauuaauguauuuccaucgucgugauuuaagacuggcugcaaacgcaauaugcucggcaguaccaguugauuggguacccacaaguagaacuacuuggagcauccacgcacaucaucaauggaugacgacagaagauaugcuaagcguauggaauaggguauggauugaagaaaacccuuggauggaagauaaaacucaugugucauccuggggugacguaccauauuuaggaaaacgagaggaccaauggugugguucacuaauuggacuuacggcaagagcuacaugggccucaaauauccaaguugcuaucaaucaggugcgcagguugaucggcaaugagaacuauuuagacuauaugaccaguaugaaaagauuuaaaaacgaaggcgacccggaaggagccuuaugguga

SEQ ID NO: 21714 - RNA, 9879 nt, Artificial Sequence
  derived and/or modified CDS sequence (opt6) from DENV-1__FJ882567__SS-prME
aguguaacuaugcuauuaaugcuaaugccaacagcucucgcuuuucacuugacgacacgcggaggcgaaccgcauaugauaguuacaaagcaagaaagagguaaaucauuauuauuuaaaacuucggcagggguaaacauguguacauuaauagcuauggaucuaggagaacuaugugaagauacaaugaccuauaaguguccgaggauaacugaggcugaaccugacgauguagacugcugguguaacgcgacugacacauggguaacauacggaacauguagucaaacuggcgagcauaggagggacaaacguaguguagcacuugcaccacauguuggguuaggacucgaaacccgaaccgaaacuuggaugucaagugaaggagcauggaaacaaauucaaagggucgaaacaugggcacuucgucacccgggauucacagugauugcacuauucuuagcgcacgcaauaggaacaucuauuacccaaaaagggauuauauucaucuuacuaaugcucgugacaccgucuauggccaugcgaugcguugggauaggcucgagagauuuuguagagggauuaucaggggcgacuuggguugauguagucuuagaacacggaucuugugugacaacgauggcaaaagacaaaccuacucuggauauugaacuguuaaaaacagaaguaacaaacccagcgguguuacguaaauuauguauugaagcaaaaauaucaaacacaacuacggacaguagaugccccacacagggagaggcaacccuuauggaagaacaagaugcaaacuuugucugcagacguacuuucguagacagaggauggggaaacgguugcggccuauuuggaaaaggaucauuaauaacaugugcgaaauucaaaugcguaacaaaacuugaagggaaaauaguacaauacgaaaauuugaaauacagcguuauaguuacgguacacaccggugaccaacaucagguagguaaugaaucuacugaacauggaacaaccgcuacaauaacaccccaagcaccuacgucggaaauccaauuaacagauuauggagcucucacuuuagauugcucuccuagaaccggauuggauuucaaugaaaugguucuccuuacaaugaaagaaaagagcugguuaguucauaagcaaugguuucuugaucuaccguugccuuggacaucaggugcaucuacaucccaagaaacauggaacagacaagaucuauugguuacguuuaaaacagcgcacgcaaagaaacaagaagucguuguccuaggaagucaagaaggagccaugcacacagcauuaaccggugcaacggaaauccaaacauccgggacaacuacgauauuugcaggucaucuuaaaugcagacugaaaauggauaaacugacucugaaggggaugagcuauguuauguguaccggauccuucaaauuagaaaaggagguagcggaaacacaacauggaacaguacuuguacagauaaaauacgagggaacagacgcgccaugcaaaauucccuuuaguacacaagaugaaaaaggagugacccaaaaugguagauuaauaacagccaauccaaucgucacagauaaagaaaagccuguuaauauugaagccgagccuccauuuggugaaucguacaucgucauaggcgccggcgagaaagcauuaaagcuaaguugguuuaagaaaggaucuucgauagggaagauguucgaagcuacugcuagaggagcaaggagaauggcuauccuuggggacacugcaugggauuucggaaguaucggagggguguuuacaucuguuggaaaauuaguccaucaaauauucgguacagcauaugguguauuauucagcgguguuucuuggacaaugaaaaucggaauaggaguauuauuaaccuggcuugguuuaaauagucgaaguaccaguuuaaguaugaccugcauugccgugggucuaguaacacuauaucuagggguaaugguucaagcugauucaggcuguguaauaaauuggaaaggaagagaauuaaaaugcggcucaggcauuuucgucacgaaugaggugcacacguggacagagcaauacaaauuucaagcagauucaccaaaacgauugucugcugcaauaggaaaggcuugggaggaggguguaugugggauaagaagugcaacaagacuagaaaacauuauguggaaacaaauaucuaaugaguuaaaccauauuuuguuagaaaacggaaugaaauucacaguagugguuggagaugugguagggauauuagcacaaggcaaaaagaugauaagaccacaaccuauggaacauaaauauagcuggaaaucuuggggaaaggcaaagauuauaggcgcggacguccaaaauaccacuuucauaaucgauggaccaaauacaccugaauguccagaugaccagcgagcguggaauauaugggagguugaagauuacggcuuuggcauauucacgacuaacauuugguuaaaauugcgagacagcuacacucaaguuugugaucaucgacuuaugucagcggcaaucaaggauaguaaagcgguccacgcagauaugggauauuggauugagucggagaaaaaugagaccuggaaauuagcuagagccucguucauagaggugaagacaugcaucuggccuaagucucacacucuguggagcaaugguguacuggagagcgaaaugaucauaccuaaaauauauggaggaccuauaucgcaacauaauuacagaccuggauacuuuacacaaacggcggggccauggcauuuagggaaacucgaguuggauuuugaucuaugugaaggcacuacgguagucguugacgaacacuguggaaacagggguccgaguuuacggacgacuacaguuacaggaaagaucauucaugagugguguuguagauccuguacucuuccaccccuacguuucaaaggagaagacggguguugguacgguauggagauaagaccggucaaagaaaaagaagaaaaucuagucaagucaauggucucggcuggcucaggagaaguagauagcuuuucauugggucuauuaugcacuuccauaaugaucgaggaaguaaugagaucucgguggucaaggaagauguuaaugaccggaacacucgcaguuuuccuccuccuaauaaugggucaacucacauggaaugaucuuauuaggcucuguaucauggugggagcuaaugcaagugacaggaugggaaugggaacaacuuacuuagccuugauggcuacuuuuaagaugcgcccaauguuugcaguaggucucuuauuuagacgucuaaccaguagagaaguacuucuacucaccauaggacuaagucuagucgcaucuguugaauuaccgaauagcuuagaggaauugggagauggucuagcgaugggcauuaugauauugaagcugcuaacugacuuccagagucaucaauuaugggcaacguugcuaagucuuaccuuuaucaaaacaacuuuaucacuucacuacgcguggaagaccauggcuaugguauuaucgauuguuuccuuauuuccguugugcuugucuacaacaucucaaaagacuacuugguuacccguccuauuaggauccuuagguuguaagccacuaacuauguuccuaaucgcagaaaacaagauauggggccgcaaaagcuggccauuaaacgaagggauaauggcagugggaguagugagcauacucuuaaguucauuacucaaaaacgacgugccccuagcggggcccuuaaucgcaggggguauguugauagcauguuaugucauaagugggagcagugcggaucugagccuggaaaaggcugcagaagucuccugggaggaagaagccgagcauagcggggcuagucauaauauuuuaguagaaguucaagacgauggaacgaugaaaauuaaagaugaagaacgcgacgauacgcuaacaauuuuacuuaaggcgacauuacuagcugugaguggagucuacccacuauccauacccgcgacucuauuuguaugguauuuuuggcagaaaaagaaacaacgaaguggaguacucugggauacuccaagcccuccggagguugagcgugccgugcuggaugauggcauuuacagaauaaugcaacgaggacugcugggucgaucgcagguaggggucgguguguuccaggaaaacgucuuucauacuauguggcauguaacccggggugcgguacuaauguaccagggaaaaagauuagaaccaucaugggcgaguguuaagaaagaccuaauaucuuauggagggggauggagacuccaaggaucauggaauacgggggaagaaguacaaguuauagccgucgagccuggcaaaaaucccaaaaacguucagacagccccaggcacguucaaaacaccugagggugaggucggugcaauugcccuugacuuuaaacccgguacaucggguucaccaauugucaacagggaaggcaaaauuguagggcuauacggaaaugggguaguaaccacgucuggaacguauguaucugccauagcucaggcgaaagcaucacaggaaggaccuuuacccgagauugaagaugaagucuuucggaaacgaaacuuaaccauaauggaccugcauccuggaagcggcaagacuaggcgauaccuuccagcuauagugagggaagccaucaaacgcaagcuaagaacuuugauacucgcuccgacuagaguaguugccucagaaauggcagaagcguuaaaaggcaugccaauaagauaccaaacaacugcuguuaaaucugaacauacggguaaagaaaucguugaucugaugugucaugcuacuuuuacuaugagacuacuaucuccgguaaggguaccgaauuacaauaugauaauuauggaugaagcacauuucacagauccuagcucaaucgcugcaagggguuacauaucaacccguguggggaugggagaagcugcggccaucuuuaugacagccaccccuccgggaucaguugaggcguuuccccagaguaaugcgguaauacaagacgaagaaagagauauaccggagcggucuuggaauagcggguaugaauggaucaccgauuucccugguaaaacuguaugguuuguaccaagcauuaaaucagguaaugacauagcaaauugccuuaggaaaaauggcaaaagaguaauccagcuauccagaaaaacuuuugauacagaauaccagaaaaccaaaaauaaugauugggacuauguuguaacaaccgauauuucagagaugggugccaauuuuagagcagacagaguaauugacccacguaggugucuaaaaccaguaaucuugaaggacggucccgaacguguuauucuugcuggaccaaugccaguaacaguagcaucagcggcacaacgaagagguagaauugggcguaaccauaacaaagaaggcgaucaauauauuuauauggggcagccgcuaaacaaugaugaagaccaugcccauuggacagaagcuaaaaugcuucuugauaauauuaauacaccugagggaaucauuccagcacuauuugaaccagagagagaaaaaucagcugccauagauggggaauaccgucugaggggcgaggcgaggaagacauuuguugaacuaaugcgaagaggugaucucccaguuugguuaucauauaaaguugcgucggaaggauuucaauauagcgauagaagguggugcuuugacggugagagaaauaaccaaguauuagaagaaaauauggacguugaaauuuggacaaaagaaggugaacgaaagaaacuaaggccaagaugguuagaugcaagaacauacagcgacccacuggcauugagagaauuuaaagaauuugcagcgggucgcagguccgucucaggcgaccuuauacuagaaauagguaaauugccgcaacauuugacgcaaagagcucaaaacgcauuagauaauuuaguaaugcuacauaauuccgagcaaggagggagggcguauagacaugcaauggaagaauugccagacacaaucgaaacauuaaugcuguuagcgcuuauagcaguacuuaccggaggaguaacgcucuuuuucuuaucaggaagaggucuugguaaaacuuccauaggacuccuauguguaauggcguccucgguccuuuuguggauggcauccguugagccucacuggauagcagcgaguauuauacuagaguucuuuuuaaugguacuucuaaucccagagccugacaggcaaagaaccccgcaagauaaucaacuugcauauguuguuauuggccuuuuguuuaugauacuaacuguugcggcgaaugagaugggucuauuagaaacaaccaagaaagaucuagguauagggcacguagcaguagagaaucaucaccaugcgaccaugcuagaugucgaccuacauccugcuagugcauggacacuuuaugcgguagcaacuacaaucaucacaccaaugaugagacauacaauugaaaauacaacagcgaacauuuccuuaacugcaauugccaaucaagcagcuauacuaaugggauuagauaaagguuggccaauauccaagauggauauagggguuccacuguuggcucuaggauguuauucucagguaaauccucuuacgcugacagccgcuguucuaaugcuaguggcacacuaugcuaucauuggaccaggucuucaagcgaaagcaacucgugaagcgcagaagagaacagcugcagggauuaugaaaaauccaaccguugacggaauuguagcaauagaucuagauccuguaguguaugaugcuaaauucgagaaacaauugggccagauaaugcuguuaauccuuuguacuucucaaauacuuuuaaugagaacaaccugggcucucugugaaaguauaaccuuagcaacuggaccgcucacaacuuuaugggaagguuccccuggaaaauucuggaauacaacaauagcagugagcauggcaaauaucuuuaggggauccuaccucgcuggcgcgggccuagcuuuuagcuugaugaagucacucggaggcgggagaagaggcaccggagcucaaggugagacucuuggagagaaguggaaaagacaauuaaaucaacucucuaaaagugaauuuaacauauauaagagaucuggaauaauggaaguagauagauccgaagccaaagaaggauugaaaagaggagaaaccacaagacaugcuguuucgcgaggaacugccaaauuacgaugguucguagaaagaaaccuaguuaaaccggagggaaaaguuauagauuuaggcuguggacggggcggauggagcuauuauugugcgggcuugaaaaaggucacggaaguaaaaggcuacacuaagggagguccaggacacgaggaacccauaccaauggcuacauacgguuggaaucugguuaaacuucacucagguaaggauguauucuuuacaccuccggaaaaaugugauacauuauuaugugauaucggagaaucuucuccaaauccaacgauagaagaaggaagaacauuacggguucuuaagaugguagagccguggcugcgugggaaucaguucugcauaaagauacuaaauccauauaugccaucaguaguugaaacucuagaacaaaugcaacgaaaacauggaggaauguuaguuagaaauccauuaagucguaauucaacacacgaaauguacuggguaaguugcgguacgggaaauauagugagugcaguaaauaugacaucucgaauguuacugaacagguucacaauggcacaucguaagccgacuuaugagcgggauguagaucuaggcgcagguacaaggcauguagcaguggaaccugaaguugcaaaccuugauauuauuggucaaagaauagaaaacauaaaacacgagcacaagucaacauggcauuaugaugaagacaaccccuacaaaacgugggccuaucaugggucuuacgaagugaaaccgagugggucugccaguuccaugguuaauggagucguuaaauuguugacaaagccaugggauguuauacccaugguuacucaaauagcaaugacugacaccacaccauuuggccaacaaagagucuuuaaggagaagguagauacucgaacaccaaaagccaagcgugguacagcacaaauaauggaagugacagcucgaugguuauggggcuuuuuaucaagaaauaaaaagccccgaauauguacaagagaagaguucacucgaaaaguccgaaguaacgcagccaucggagcugucuucguggaugaaaaccaguggaacucagcaaaagaggcuguugaagaugaacgcuucugggacuuaguacagaaagaacgagaacuucacaagcagggaaagugugcaacuuguguuuauaacaugauggggaaaagagagaagaaacuaggugaguucggaaaagcuaaagguucacgcgcaauuugguacauguggcuaggggcacgauuuuuagaauuugaagcucugggcuucaugaacgaagaucacugguuuucccgcgaaaacuccuuaucaggaguagaaggagaaggacugcauaaacuaggcuauauccuucgagauauaucuaaaauaccuggcgggaauauguacgcagacgacacggcgggaugggacacaagaauuacagaggacgaucuucaaaaugaagcaaaaauaaccgacauaauggaaccagaacacgcgcuucuagccacgucuauauucaaauugacguaccaaaacaagguugugaggguacaaagaccagcuaaaaauggcacuguuauggauguaauaucuagaagagaccaaagaggaagcgggcaaguagguaccuauggucugaacacauuuaccaacauggaagcccaacuuaucagacaaauggaaucggaaggaauauucuuaccaagugaauuagaaacaccaaauuuggcagaaagaguauuagacugguuagaaaaacacgggguugaaagacuaaaaagaauggcaauauccggugaugacuguguaguaaaaccaauagaugaucgguucgcuacggcacuaacagcacugaaugauauggguaaaguacgcaaagauaucccucaaugggaacccucuaaggguuggaaugacuggcagcaagucccguuuugcagucaccacuuccaccaacuaauaaugaaagauggcagagaaauuguggugcccugcaggaaccaagaugagcugguggguagagcaagaguuucccaaggugcgggauggucucuacgcgaaacugcaugucuuggaaaaaguuacgcucaaauguggcaauuaauguauuuucaucguagagacuuaagauuagcagcaaacgcaaucugcagcgcugugccaguugauuggguaccaaccucuagaacaacaugguccauccaugcacaucaucaauggaugacaacugaagacaugcuaucaguauggaacagggucuggaucgaagagaacccauggauggaggauaagacacaugugucuucguggggagacguuccauauuuggguaaacgagaagaccaauggugcgguucucuuaucggguuaacagcccgugcuacaugggcaucuaacauccaaguugcaaucaaucaaguacgucgacuuauugguaacgagaauuauuuggauuauaugacgagcaugaaaagauucaagaacgaaggugauccagagggcgcuuuaugguag

SEQ ID NO: 21715 - RNA, 9879 nt, Artificial Sequence
  derived and/or modified CDS sequence (opt6) from DENV-1__GQ199831__SS-prME
aguguuacgaugcuauugaugcugaugccgacugcccuggcauuucauuuaacuacuagaggaggagaaccccauaugauaguaacuaaacaagagcguggcaaaucacuccucuuuaagacuucugccggaguaaauauguguacgcuuaucgcgauggaucugggggagcuuugugaagauacuaugaccuauaaauguccccgaaucacugagacagaaccugaugacguagauuguuggugcaaugcuacagauacauggguaacguaugguacgugcucucaaacaggugagcacagacgagauaaaagaagcguagcauuggcaccgcaugugggacuuggguuagaaacacgaacugaaaccuggaugucuuccgaaggcgcuuggaaacaaauacaaaggguugaaacaugggcauuaagacaccccggauucacuguuauugcccuauuucuggcucaugcaauaggcaccagcauaacgcaaaagggaauaauuuucauacuuuugaugcucguaaccccgucaauggcaaugcggugugugggcauagggagccgugacuuuguugagggcuugaguggcgcaacguggguugacguaguacucgaacauggcucuugcguuacaacuauggcaaaagacaaacccacgcuagauauugaacuacuuaaaaccgaaguaaccaacccagcuguuuuaagaaagcucugcauugaggcgaaaaucucaaauaccaccacugauucucguuguccaacacagggagaagcaacguuaauggaggaacaagaugcaaauuuugucugccgacgaacauuuguugaucgaggcuggggaaauggauguggucuauucggaaaaggcagucuuauuacuugcgcuaaguuuaaaugcguuacaaaacuugaggggaagauaguacaauacgaaaaucuuaaauauucagugauuguaacuguacauacgggagaucaacaccaaguaggaaaugaauccacugagcacgguacaacagcuaccauaacaccgcaagcuccaacauccgaaauacaauuaacggacuauggagcauuaacccucgacugcaguccuagaacagguuuagacuucaaugaaauggucuuacuaacaaugaaagaaaagaguugguuaguucacaaacaaugguuuuuggaucuuccacuaccauggacuucaggagccucuacaagucaagaaacauggaauagacaagaucuauuaguaaccuuuaaaacugcacaugcaaagaaacaagagguaguaguucuugguagccaagaaggugcgaugcacacagcgcuaacaggcgcuaccgagauacaaacaaguggaacaacgacuauuuucgcuggacauuuaaaauguagacugaaaauggauaaauuaacauuaaagggaaugaguuacgugaugugcacaggaucauucaaauuagaaaaggaaguggcugagacacagcacggcacaguccuuguacagauuaaauaugaaggaacugacgcccccuguaaaauaccauucaguacacaagacgagaaaggcguuacacaaaacggacgauuaauuacggcaaauccuauagucacagacaaagagaaaccaguuaauauagaggcugaaccaccuuucggcgaaagcuacauagucauuggagccggugaaaaagcacuuaaauuaaguugguucaagaaaggaagcaguauagguaaaauguuugaggccacagcaaggggagcucgacggauggcaaucuuaggagauacugccugggacuucggaucaaucggaggcguguucacaaguguuggaaagcugguccaccagauauucgggacagcauacggcguucuauuuuccggagucucauggacgaugaaaauaggaauaggaguacuacuaacauggcuaggacuuaacucacguuccacaagucuaucgaugacauguaucgcaguaggccuaguaacucuuuauuuagguguuaugguacaggcagauucugguugcguaauaaauuggaagggucgcgaacugaaauguggaagcgggauuuucguuacgaaugaaguccauacauggacugaacaauauaaguuucaagcggauucuccuaaacgcuuaagcgcugccauaggaaaagcaugggaagaaggagugugugguauaagaucagcaacaagauuggaaaauauuauguggaagcaaauaaguaaugaguuaaaucacauucuuuuagaaaacgacaugaaguucacaguuguaguuggcgaugucgucgguauauuagcacaggguaagaaaaugauuaggccucaaccaauggagcauaaguauaguuggaaaucgugggguaaagccaagauaauaggugccgauguucaaaauacaaccuuuauaauugauggucccaauaccccagaauguccugaugaccaaagagcauggaauauaugggaagucgaagacuauggcuuuggaauauuuacuacuaauauauggcugaagcuacgcgauucuuacacucaagugugugaucauagacucauguccgcagcgauuaaagauaguaaggcgguucacgccgacaugggguacuggauagaaucggaaaagaacgaaacauggaaacuggcaagggccaguuuuaucgaagucaaaaccugcauuuggccuaaaucucacacucuuuggucuaauggaguucuggaaagugaaaugauuauaccuaagauauacggaggcccaauuucccagcauaacuaucgaccgggauauuuuacccaaacagcugguccauggcaucuaggaaaacuagagcuagauuuugaucuaugcgaaggaacgacaguagucguagaugaacauuguggaaaucguggacccucucuucggaccacgacagucacagguaaaauaauucaugagugguguugcagaucgugcacauuaccaccacuccgguuuaaaggggaagauggauguugguacgguauggaaauucguccugucaaagaaaaagaggaaaauuuaguaaaauccauggucuccgcugguagcggugaagucgauaguuucucacuagguuuacuguguaucuccaucaugauagaagaaguaaugcggucacgcuggaguagaaagaugcuaaugacaggaacacuggcaguauuucuauuacuuaucauggggcaacucaccuggaaugaucucauaagauuauguauaaugguuggggcaaacgcgagugaucggaugggaauggguaccacauaucuggcucuuauggcaacguuuaaaaugagaccaauguucgcgguaggauugcuuuuuagacgauugacaagucgcgaaguauugcuccucaccauaggcuugagccucguagcuagcgucgaacuuccuaacucgcuugaagaauuaggagacggacucgccaugggaauuaugauauugaagcuacuaaccgauuuccaaucgcaucaacuaugggcgacccuccuaagccuaaccuucauaaaaacaacuuuaucacuucauuaugcauggaaaaccauggcaaugguuuuaaguauagugaguuuauuuccacuaugcuugagcacaaccucacagaagacuacauggcucccgguauugcuagguagccucgguugcaagccacugacaauguuucuaauagcugaaaacaagauaugggguagaaagaguuggccccuuaaugaggggauuauggccguaggcguaguaagcaucuuacuuaguucauuacuuaaaaaugacguuccguuagcgggucccuuaauugcuggugguaugcuuauagcgugcuacguaauaagcgggagcucggcggacuugagucucgaaaaggcugcugaaguuucgugggaagaagaagcagaacauaguggcgcaagucauaauauucucguagagguucaagacgaugguacaaugaaaauaaaagaugaggaaagagacgauaccuugacgauacuauuaaaggcuacauugcucgcuguaucgggugucuaccccuuaucaauuccggcaacucuuuuugucugguacuuuuggcagaagaagaaacagcgcucuggcgucuugugggacacaccaaguccgccggagguagagagagcggugcucgaugacgguauuuaccggauuaugcaaagggguuuacuaggacgcagucaaguuggaguuggcguguuucaagaaaauguauuucacacaauguggcauguaacaagaggugcuguauuaauguaucaagguaaaagacuugaaccaaguugggcgagcgugaaaaaggauuugauuaguuacgguggaggguggagacuacaagggucauggaauacaggagaggagguccaagucauagccguggaaccugggaaaaauccgaagaauguacaaaccgcgccuggaacauuuaaaacuccugagggagagguaggggcuauagcacuugacuucaagcccgggacaaguggaucaccaauagugaaucgugaagggaagauaguuggacuauaugggaacggaguaguuacgacgagcgguacuuaugucagcgcaauugcacaagccaaggcaucucaggaagguccguuaccggaaauugaagacgaagucuucagaaagagaaauuugacaauuauggauuuacacccuggaucugguaaaacccgaagauaccuuccugcuauagucagagaagcaaucaagaggaaacuaaggacccucaucuuggcgccaacuagagucguggccucagagauggcagaagcacuuaagggaaugcccauacgcuaccaaaccacagcuguuaagucagaacauacggguaaagaaauaguagaucuaaugugucaugcaaccuuuacaaugcgauuacugagccccguaaggguuccuaacuacaauaugauuauaauggaugaagcucauuucaccgacccaucuagcauagcagcuagaggcuacauaucaacaagaguagggaugggcgaagcugcggcaauauuuaugacagcgacgccacccggaucaguggaagccuuuccgcaaucgaacgcuguuauacaggaugaggagcgugacauaccugaacgcucauggaauagugguuaugaauggauaacagauuuuccaggcaagacaguaugguuuguaccaaguauuaaaucugggaacgauauagcaaauugcuuaagaaagaauggaaaacgaguuauacaacuaagucgaaaaacauucgauaccgaauaccagaaaacuaagaauaacgauugggacuacguuguaacuacagauauaagugaaaugggugcuaauuuucgagccgacagagucauugauccaagacgaugccugaagccuguuauacuuaaagacgguccugaacgaguuauauuggcggguccaaugccagugacaguugcuagugcagcacaaagacgagggagaauaggaaggaaccacaauaaagagggugaccaauacauuuacauggggcaaccuuuaaauaaugaugaagaccacgcgcacuggacugaagccaagaugcuacuugauaauaucaauacuccugaagguaucauuccggcucuauucgaaccagaacgugaaaaaucggcagcaauagacggugaguaucgacuacguggagaagcaagaaaaacauucguugaguuaaugcgucguggcgacuugccuguuuggcuaucauacaaagucgcuagugaaggcuuccaguauucggacagacgaugguguuucgauggagaaagaaauaaucaaguacuugaggaaaauauggacguagaaauauggaccaaggaaggagaaagaaagaaacuacggccuagguggcuggacgccagaaccuauucggauccccuagccuuaagggaguucaaagaguucgcagcagggcgaagaagugugucuggagauuuaauacucgaaaucggaaaguugccucaacauuuaacacaaagggcccaaaacgcguuagauaaucuugucauguugcauaauucagaacaaggcgggagagcauaucgacacgcuauggaagaacuccccgacaccauagaaacuuuaauguugcuagcacuuaucgcuguacuaacuggagguguuacguuguucuuuuuaagcgggcggggacuuggaaagaccucaauuggccuacuaugugugauggcuuccucaguccuguuguggauggcaucgguugagccucacuggauagcugcaucgauaauacuagaauuuuuccuaaugguauuauugaucccugaacccgacagacagagaacuccccaagauaaucaacuugccuauguggugauagggcuuuuguucaugauacuaacaguggcagccaaugagaugggguuauuagagacaaccaagaaagauuuaggcauuggacaugucgccgucgagaaucaucaucacgccacaauguuagauguggauuuacauccagcgagcgcauggacauuguaugcuguagcaacuacaaucauaacaccaaugaugcggcacaccauagaaaacacaaccgcaaacauaagccuuacagcuauugcuaaucaagcggcaauacucaugggacuagauaaaggauggccaauuucuaaaauggacauagguguaccgcuccuugcacuagggugcuauagucaagucaacccucuuacccuuacggcagcgguucuaauguuggucgcgcauuaugcuauuaucggaccuggucuacaagcgaaagcaacucgagaagcgcagaagagaacagcugcagguauaaugaagaauccaacuguugacggaauaguugcgauugaccucgaucccgugguuuaugaugcgaaauucgaaaaacaacuaggacaaauaauguuauuaauccuguguacgagccagauucuacuaaugagaacaacuugggcccuaugugaaucgauaacucuagcgacggguccauugacaacguuaugggaaggcucaccuggaaaauuuuggaauacaaccauagcagucucuauggcaaauaucuuuagaggaucauaucuagcgggagccggucuugcauucaguuuaaugaaaucauuagguggcgggaggagggguacuggagcccaaggugaaacacucggagagaaauggaagcgucaauuaaaccaauugagcaagucggaguucaacauauauaaacgcucaggaaucauggaagucgauagaagugaagcgaaagaaggccucaaaaggggcgagacaacuaggcaugcaguuagucgcgguacagcaaaacugagaugguucguagagagaaauuuaguaaaaccugaaggaaaaguaaucgaucuugguuguggaagggguggcuggaguuacuacugugcuggguuaaagaaagucacagaaguaaaagguuacacuaaaggcgggccugggcacgaagaaccgaucccaauggccacauaugguuggaaccuaguaaaauuacauagugguaaagacgucuucuuuacucccccagagaaaugugauacuuugcuaugcgacauuggggagaguaguccaaauccuacuauugaggaagguagaacauuaagggucuuaaaaaugguagaaccuugguugagagguaaucaauucugcaucaaaauacuuaauccguauaugccaucgguaguagaaacauuagaacaaaugcaacgaaaauacggagggaugcuuguuaggaaccccuuaucacgaaacaguacgcacgaaauguauuggguaucuugcggaacagguaauauuguauccgcgguuaauaugacaucucgaauguuauuaaauagauuuaccauggcucaccgaaaaccuacauaugagagagacguagaucucggugcuggaacuaggcaugucgcugucgaacccgaaguagccaauuuagauauaauaggucaacggauagaaaauauuaagcaugaacauaagucgacauggcauuaugaugaagauaauccauauaaaacaugggccuaccacgguagcuaugagguaaaaccuuccggaagugcaaguucuaugguaaacgggguugugaaauuauugacaaaaccaugggaugucauacccaugguaacgcagauagcaaugacugacacaacaccuuuuggacaacaaagagucuucaaagaaaaagucgauacaagaacuccuaaagccaaaagagggacagcucaaauuauggaaguaacagcaagaugguuaugggguuuucuuagcagaaauaagaaaccucgcauauguaccagggaggaguuuacaagaaaagugaggagcaacgccgcuaucggugcagucuucguagacgaaaaucaauggaacuccgcaaaagaagcgguugaagaugagcgauucugggaccuaguccaaaaagaaagagaauuacacaaacaaggaaaaugugcgacauguguguacaauaugauggggaaaagagaaaagaaguuaggagaguuuggaaaagcuaaaggaagccgcgcaauaugguauauguggcuuggagcgagauuuuuagaauuugaagcacucggauuuaugaaugaagaucacugguucucuagagaaaauucacugagcgguguggaaggagaaggauugcacaaacuuggauacauacuaagggacauuucaaaaauacccggagggaauauguacgcagaugauacugcaggaugggacacaagaauaacugaagaugaccuucagaaugaagcaaaaauuaccgacauaauggaaccagaacaugcauuauuagcaaccuccauauuuaaauuaacguaucaaaauaaggucguacgaguucagcgcccagcaaagaacgguacugucauggacguaauaucuagaagagaccaacgugguucaggacaaguaggaacauauggccuaaauacauuuacaaauauggaggcucaacuuauaagacaaauggaauccgaggguauauuucucccauccgaauuagagacaccgaacuuagcugagagaguauuagauugguuagagaaauauggaguagaaaggcuaaaaagaauggcaauaagcggugaugauuguguugucaagccuauagaugacagauuugccacugcauuaacagcuuuaaaugauauggguaaaguacgaaaagauauaccgcagugggaacccaguaaaggauggaaugauuggcaacagguccccuucugcucccaccacuuccaucaguuaauuaugaaggacggucgagaaauagucguuccaugucggaaucaagacgaauuaguaggcagagccagagucucucaaggugccgguuggucuuuacgugagacagcauguuuagguaaaucuuaugcacaaauguggcaacucauguauuuucacaggagagaucuaagauuagccgcaaaugcgauuugcucagccgauccuguugauuggguccccacaucacgaacgacuuggaguauucacgcccaucaucaguggaugacaacagaagauauguuaagcgucuggaauagggucuggaucgaagaaaaccccuggauggaggauaaaacacacguuucauccuggggcgacgugccuuacuuaggaaaacgggaagaucaauggugcgguaguuugauagggcuuacagcucgggcaaccugggcuucaaacauacaaguggcaauaaaucaaguccgaagacucaucggaaaugaaaacuaucuagacuauaugacuuccaugaaaagauucaagaacgagggggaccccgagggagcacuaugguag

SEQ ID NO: 21716 - RNA, 9879 nt, Artificial Sequence
  derived and/or modified CDS sequence (opt6) from DENV-1__GQ199832__SS-prME
ucaguuacuaugcucuuaauguuaaugcccacggcacuagcuuuucacuugacgacuaggggaggagaaccucauaugauugugacuaaacaagaaagggguaaaagucuccuguuuaaaacuucggccgguguaaauaugugcacauugauagccauggaccuaggugaacuaugcgaagacacaaugacuuacaaaugcccacguauaacagaagcagagccagaugacguggauuguugguguaaugcaacagacacguggguaacauaugggacaugcagucagaccggagaacacagaagagacaaaaggagcguggcucuggcaccgcauguagguuuaggguuagaaacaagaacagagacguggaugucaucagaaggcgcuuggaaacagauacagagaguagagacaugggcguuacgacauccaggauuuacaguaaucgcacuauuuuuagcucaugcgauugggacaaguauuacucaaaaaggaauuauauuuauacucuuaauguuaguuacaccaucaauggcgaugagauguguaggaauagggagucgggauuuuguagaaggguuaucaggggcaacaugggucgacgucgugcuagaacaugguagcugcguaacaaccauggcuaaagauaaacccaccuuagauaucgagcugcuuaaaacugaagugaccaaccccgcagucuuacggaaacuauguauagaagcaaaaaucucgaauacuacaaccgacucucgcugcccaacucagggagaagcaacucuaauggaagaacaagaugcaaacuuuguaugccgucgaaccuuuguagauagagguuggggaaacggauguggacuauucggaaaaggauccuuaauuacuugugcuaaauuuaagugcgucaccaaacuagaaggaaaaauaguacaauaugagaaccucaaauacucagugauuguuaccguacauacaggagaccagcaucaaguuggaaaugaaucaacggaacaugguacuacagcuacuaucaccccgcaagcaccuacaagcgagauacaacuuaccgacuauggggcgcugacccuagauugcagcccuaggacaggacuagacuucaacgaaaugguccucuuaaccaugaaagagaaguccugguuaguacacaaacaaugguuccuagacuuaccacuucccuggacaucuggugcuucuacaagucaagaaacuuggaaucgacaggaucuauuagugacauucaagaccgcucacgcgaaaaagcaagaggucgugguauugggaucgcaagagggagcuaugcacacugcacuaacgggugcaacugaaauucagacaucaggaacuaccacuauauuugcuggacaccuaaagugccgcuuaaagauggacaaauuaacgcuaaaaggaaugucuuauguaaugugcaccggcagcuuuaaacuagaaaaagaaguugcagaaacacaacacgggacaguacuuguccagaucaaauacgaagggacagaugcaccgugcaagauaccuuucucaacacaagacgaaaaaggagucacccaaaacggacgauuaauaacugcaaacccaaucgugacugauaaagaaaaaccaguaaauauugaagcagaacccccuuucggcgaaagcuauaucguaauuggagcuggugaaaaagcacugaaacuuucgugguuuaagaaagguucgaguauugguaaaauguuugaagcaacagcaagaggcgcuagaagaauggcaauucuuggugacacggcaugggauuuuggauccaucggaggcgucuuuacgagugucggaaagcuaguacaccagauuuuuggaacagcauacggaguucucuucucaggggugucauggacaaugaaaauagggauuggaguccuuuuaacauggcugggccuaaauagcaggagcacaucuuuaucuaugacaugcaucgcuguaggauugguaacauuauaucuaggcguaaugguacaggcagauaguggaugugugauuaacuggaaagggcgugaauuaaaauguggcaguggaaucuucguuacaaaugaagugcauacauggacggagcaauauaaauuccaggcagacagcccaaaacgauuaagcgccgcuauagguaaagcgugggaagaaggaguaugcggcauaagaagugcgacaagacuagaaaauauaauguggaaacaaauauccaacgagcuuaaccacaucuuacucgaaaaugguaugaaauucacuguaguugucggagauguagucggcauucucgcacaagggaagaaaaugauacgaccgcagccaauggagcacaaauauucauggaaauccuggggcaaagcuaaaaucauaggugcugaugugcagaauacuacuuucauaauagauggucccaauacgccugaauguccugaugaucaaagggcuuggaauaucugggaggucgaagauuacggauuugguauauuuacaacuaacaucuggcuaaaacuccgggauaguuauacccaagugugcgaucaccgauuaauguccgcggcaauaaaagauucaaaagcaguacaugcagacauggguuauuggauugaaagugagaaaaaugaaaccuggaaauuagcaagagcaaguuuuauugagguuaagacauguauuuggcccaagucacacaccuuauggagcaacggaguauuggagagugaaaugauaauuccgaaaauuuauggugggccaauuucacaacauaacuauaggccuggcuacuuuacgcagaccgccggaccauggcauuuggguaaacuagaauuagacuuugacuuaugcgaaggaaccacgguuguaguagaugagcauugugggaauaggggaccuucgcuucguacgacuacagugacggguaaaauaauacaugaauggugcugccgaaguugcacauuaccuccccuucgcuuuaaaggggaggacggaugcugguauggcauggaaauaaggcccgugaaagaaaaagaagaaaacuuagugaaguccauggugucagccgggaguggagaaguugacucauuuucccuaggguuacucugcacgaguauaaugaucgaggagguaaugagaagccgcuggaguaggaaaaugcugaugacaggaacccuagcaguauucuuauuguugaucaugggucaacuaacuuggaaugaucuaauacgucucugcauaaugguaggugccaaugcuagcgauagaaugggaaugggaacaacauaccuggcauuaauggcaacguuuaagaugcguccuauguuugcaguaggacuacuuuuccgcaggcugaccagucgcgaaguauugcuucugacaauuggucuuagucucguagcaagcguugaacucccaaacucauuggaagaauugggugacggacuagcaauggggauaaugauacuaaagcuccugacagauuuccagucacaucaauuaugggcaaccuugcucucucuuacuuuuauuaagacgacacuaucauugcacuaugcguggaaaacuauggcaaugguacuauccauuguaagucuauuuccacuaugccucaguacuacaucacagaaaacuacauggcuaccaguacuuuuggguucucucggcugcaaaccguuaacuauguuucuuauagcugaaaacaaaauaugggguaggaaaaguuggcccuuaaacgaagguauaauggcaguaggcguggucucuauauuauugagcaguuuacugaagaacgauguaccauuagcugggccucucauugcaggaggcauguuaaucgcuugcuacguuauuucaggaagcucagcugaccuuucacuugaaaaagccgcagaagucaguugggaagaggaggccgaacauucaggagccucgcacaauauccuuguugaagugcaagaugacggcacgaugaaaauaaaagacgaagaacgagaugacacgcuaacuauuuuacuaaaagcaaccuuacucgcuguauccggaguauauccacuuucaauuccagcgacucucuucgucugguauuucuggcagaagaagaaacaaagaaguggaguacuuugggacacaccuaguccacccgaaguagagcgugcaguucuugaugacgguauuuaccguauaaugcaaaggggguuacuagguagaucacagguaggcguagguguauuccaagaaaauguauuucauacaauguggcauguaacucgcggagcuguucugauguaccaagguaaaagacuugagcccaguugggcuagcgugaaaaaggaccuaauaaguuaugguggaggauggcgauugcaaggcuccuggaauacuggagaggaaguucaaguuauagcuguggaaccugggaagaacccuaaaaauguucaaacggccccugguacuuuuaaaacgccggagggugaaguuggcgcaauagccuuagauuuuaaaccugguacaucugggagucccauuguaaauagagaaggaaaaaucguaggguuauacgguaauggagucgucacaacuucuggaacauacguuucagcgaucgcacaagccaaggcuucacaggaaggaccacuaccagaaauagaggaugagguuuuccgaaaaagaaaccuaacuauuauggaucugcauccugguagugggaaaacgcgcagguaucuacccgcaauagugagagaagcaauaaaacgaaaauuaagaacuuuaauacuagcaccuacccgugucgucgcauccgaaauggcagaagcucuaaaggggaugccuauaagauaccagacgacugcggucaagucagagcauacggggaaggaaauuguggaucuaaugugucacgcuacauucacaaugaggcuucucucucccgugagaguccccaacuacaacaugauaauaauggaugaagcucauuucacagauccuucgaguauagcggcaagaggauauaucucaacuaggguagguaugggugaagcagcugccaucuuuaugacggcuacaccaccagggaguguagaagcguuuccucagucaaacgcaguaauacaagacgaggaaagagacauuccugagaggucuuggaacucaggcuaugaguggaucacugauuuuccgggaaaaaccgugugguuugugccuagcauaaaaaguggaaaugauauugcaaauugccuuaggaagaauggaaaaagaguaauucaguuaucccgcaagacuuuugauaccgaauaucaaaagacgaagaauaacgacugggacuauguaguaacuaccgauauaagcgaaaugggcgcuaacuuucgggcagaucgggugauugauccaagacggugucucaagccgguaauccugaaggauggaccagaaaggguaauuuuagcggguccaaugccgguaacgguggcuucggcagcacaacgcaggggucgaauuggaagaaaucacaacaaggaaggagaccaguauauuuauaugggacaaccguuaaauaacgacgaagaccaugcgcauuggacagaagcaaaaaugcuuuuagacaauauaaauacaccagaaggaauaauacccgcacuguucgaacccgaaagagagaaaagcgcagccauugauggagaguauaggcuacguggggaagcacggaaaaccuucguagaacugaugagaagaggagaucucccagucugguugaguuauaaaguugcaagcgaaggauuucaauacucagauaggagguggugcuucgacggugaacgcaauaaucaaguuuuagaggaaaauauggacguggagauuuggacgaaggaaggagaaagaaagaaauuaaggccacguuggcuugacgcaagaacauacucugacccacuagcacugagagaauuuaaggaguuugccgcaggacguagaucgguaagcggagacuuaauccucgagauuggcaaguuaccacaacaccuaacucaacgugcccaaaacgcacuggauaaccuuguuaugcuccacaauucagaacaggguggacgugcuuacaaacacgccauggaagaacuuccagauacaaucgaaacucucaugcuacuugcgcuaauagcggucuuaacuggaggcgugacgcuauucuuucuuaguggcagagguuuaggcaaaaccagcauaggacuuuuauguguuauggcauccaguguucuguuauggauggcaucaguagagccucacuggauugccgcuagcauuauauuagaguucuuuuuaaugguacuacuaauaccagaaccugauaggcaacgcacaccacaagauaaucaguuagcauauguugugauaggauuacuuuucauaauauuaaccguagcggccaaugaaaugggauuauuggaaacaacaaagaaagaccuaggaaucggacacguggccguagaaaaccaucaucacgccaccauguuagauguagauuuacacccagcuagugcauggacauuauacgccguagcaacaacgauuaucacaccgaugaugagacauacuauugaaaacacgaccgcuaacauaucauuaaccgcgauagcaaaucaggcggcgauauuaaugggccuagauaagggauggcccauauccaaaauggauauaggagugccauuauuagcgcuuggcuguuacucucaaguaaacccauuaacucucaccgcugcaguucuuaugcuaguugcccacuaugcaauuauaggcccaggacugcaagcaaaagcaacacgugaggcacaaaagaggacagcugcgggaauaaugaaaaauccaacuguggacggaaucguagcuauagaucuugauccggugguuuacgaugcgaaguuugaaaaacaauuaggacagauuauguuacuuauucuuugcacgagucaaaucuuauuaaugcguacaacuugggcguuaugcgaaaguauaacccucgcuacagggccccugacuacucugugggaggguucacccgguaaauucuggaauaccacgauugcaguaucuauggcaaacaucuuccgaggcucauaucuugcgggggcaggauuggcguucucucuaaugaaaaguuuaggaggugggcguagagguacaggugcacaaggugaaacuuugggggaaaaguggaagcgccaauugaaucagcuaucgaaaucagaauuuaauaucuauaaacgaagcggaauaauggagguagauaggagcgaagcuaaagaagggcugaagcguggggaaacaacaagacacgcgguuaguagagguaccgccaaauuacgaugguuuguagaaagaaacuugguaaaaccagaaggaaaaguaauugaccuaggaugcggacgaggagguuggucauauuacugugcaggacucaaaaagguuacagaaguaaaagguuacaccaagggcgggccugggcacgaagaaccaauaccaauggcuacuuauggcuggaauuuaguaaaacuacacagcgggaaggacguauucuuuauaccuccagaaaaaugugauacccuacuuugugauaucggagaaucgucgcccaauccaacaauagaagaaggaagaacacuacggguauuaaaaauggucgaaccuuggcuucgaggcaaucaauucugcaucaagauucucaaucccuacaugccauccguaguagaaacuuuagaacaaaugcagaggaaacauggcggaaugcuuguaaggaauccgcucagcagaaauucuacacacgaaauguauuggguaucuuguggaacaggaaacauaguaucagcaguaaauaugaccagucgaaugcuuuuaaauagauucacgauggcccauagaaaaccaacauacgagcgugauguagauuuaggagcgggaacaaggcauguagcuguagaaccagaagucgcuaauuuagacaucauaggacagaggaucgaaaauauaaagcacgagcacaagucuacauggcauuaugaugaagauaauccguacaagaccugggcauaucauggaucuuaugaaguaaaaccuucaggaagcgccucaagcaugguaaacggaguuguuaaacuauuaacuaaaccaugggacgucauaccuaugguaacucaaauagccaugacagauacaacgccauuuggucaacaaagggucuucaaagaaaaaguagauacucguacaccgaaagcaaaaagggggacagcgcagauuauggagguaacugccagauggcuguggggauucuuaaguagaaauaagaaaccccguauauguacgcgcgaggaguuuacgcgcaaagucaggucaaaugcggccauaggggcaguguuuguugaugaaaaucaauggaacucagcaaaagaggcaguugaagacgagagguucugggaucuaguacaaaaagaacgagaacuccacaaacaaggcaaaugugccacaugugucuacaauaugauggguaagagagagaagaaacuuggggaguuuggaaaagccaaagggaguagagcaauaugguauaugugguuaggagcaagguuucuggaauuugaggcuuuagguuucaugaaugaagaucauugguuuucaagagaaaauucauuaucagggguagagggagaaggacuacauaaacucgguuacauucugagggacauaucaaaaauaccugggggcaauauguaugcagaugauacagccggaugggauacaagaauuacagaagaugaccuucaaaacgaggcuaaaauaaccgauauaauggaacccgagcaugcauuauuagcaacaucaaucuuuaaauuaacuuaccaaaacaagguuguucgugugcaaagaccagccaaaaacgggacuguuauggacgugauaagccgaagagaucaacguggaucagggcaaguagguacauacggauuaaacacguucacaaauauggaagcucaguugaucagacaaauggaaucugagggaauauuccuaccuagugagcuagaaacgccaaauuuagcugaacgaguucucgauuggcuugaaaaguauggggucgaaagacucaaacgaauggcaauauccggcgaugacuguguuguaaaaccgauagaugaucguuucgcgacagcccugacagcgcuaaacgauaugggaaaaguaagaaaagacauuccacagugggagccaaguaaaggauggaaugacuggcaacaaguaccuuucuguagucaucacuuccaucaauuaaucaugaaagauggccgggagaucgucgugccgugccgaaaccaagaugaauuaguggguagggcucguguaagucagggagcggguugguccuuaagggaaacugcaugcuuaggaaaaucauaugcacaaauguggcaacuuauguauuuucaccgaagagauuuacgucuggcagcaaacgcuauauguucggcuguaccgguagacugggucccuacaagccgcacgacuuggaguauacacgcacaccaccaauggaugacaacagaagauauguuaaguguauggaaucguguguggauagaagaaaauccguggauggaggacaaaacccauguaucaucguggggagauguuccuuauuugggaaaacgugaagaccagugguguggaucuuuaaucggauuaaccgcaagagcaacuugggccucgaauauucaagucgcaauuaaccaaguaaggagacuaauuggcaaugagaacuauuuggacuauaugacaagcaugaagcgauuuaaaaacgaaggugauccagaaggagcccuaugguaa

SEQ ID NO: 21717 - RNA, 9879 nt, Artificial Sequence
  derived and/or modified CDS sequence (opt6) from DENV-1__FJ882568__SS-prME
ucaguuacaauguuacugauguuaaugccuacagcguuagcauuucaccuaacgacuaggggaggugaaccgcacaugauagugacgaaacaagaacgugguaagagcuuacuguucaaaacauccgcuggagucaacauguguacucugauugcaauggaucugggugaacugugcgaagauacaaugacuuauaaauguccacgaauaacagaagccgaaccagaugacgucgauugcugguguaacgcgacagauacgugggugacauauggaacuugcagccaaacaggagaacaccgcagagauaaaaggucaguggcauuggcgccgcaugucggauuaggacucgaaacaagaacagaaacuuggaugagcagcgaaggagcauggaaacaaauacaaagaguugaaaccugggcacuucgacaccccggauucacuguaauagcacuguuccuggcucacgccauugggacaucaaucacucaaaaagggaucauuuucauucuauuaauguugguuacacccagcauggcaaugaggugcguuggaauugggagcagggauuuuguagagggguugucaggagccacauggguggauguuguuuuggaacacgguucguguguaacaacuauggcgaaagacaaaccuacuuuggauauagaacuacuaaaaacagaagucacaaauccugcaguccuacgaaaauuaugcauugaagcuaaaauuuccaauacaacaacagauaguagguguccuacacaaggggaggcgacauuaauggaagaacaagaugcuaacuucguaugcagaaggacagucgucgauagagguugggguaacggauguggauuguuugggaaaggaucucuaaucacaugugcuaaauuuaaauguguuaccaaacuagagggaaagauaguucaauacgaaaacuuaaaauacuccguaauaguuaccguacauacuggagaccaacaccaaguagggaacgaaucgacggagcauggaacuacagcuacuauuacaccacaagcaccgacaagcgagauucaauuaacagacuauggagcucucacucuggacuguaguccacguacgggcuuggacuucaaugagauggugcuacuaacuaugaaagaaaaauccugguugguucacaaacaaugguuuuuggauuuacccuuaccuuggacaucaggagcuucaacaagucaagagacuuggaacagacaagaccuucuaguuacuuucaaaacagcacaugccaaaaagcaggaaguuguugucuugggaagucaggaaggagcaaugcauacugcguugacgggcgccacagaaauacaaacuucaggaacgaccacaauauucgcugggcaucuuaaaugucguuuaaaaauggacaaguuaacguugaaaggaaugaguuauguuauguguacagguucuuucaaauuggaaaaagagguagcugaaacgcaacaugguacggugcugguucaaauuaaauacgagggcacagacgcaccuugcaaaauuccauuuuuaacucaagaugaaaagggaguuacacagaaugguaggcuaauaacggcaaaucccaucguuacagauaaagagaaaccaguaaauauagaagcugaaccaccauuuggugaaaguuauauuguaauaggagcuggugaaaaggcauuaaaacuaaguugguucaaaaaggguagcagcaucggcaaaauguuugaagcaacagcacgcggagcuagaagaauggcgauccucggagauaccgcaugggauuuuggaaguauaggagguguauuuacgucaguaggcaaauuaguccaucaaauauuugguacagcauauggggucuuauucagcggggugaguuggacuaugaaaaucggaauaggugucuuauuaacauggcucggguuaaauucuagauccaccucgcugucuaugacaugcauagccguaggcuuaguaacacuguauuuaggaguaaugguccaagcggauucgggcugcgugaucaacuggaaaggaagggaacucaagugcgguuccgguauuuuuguaaccaacgaaguacauaccuggacugagcaguauaaguuucaagccgacaguccaaaaagauuaucagcggcuauaggaaaagcgugggaagaaggagucugugggauaagaucugcuacccgauuagaaaauauuauguggaaacaaaucucgaaugaauuaaaccacauauuauuggagaaugguaugaaauuuacaguagucguuggagaugugguggggauccuggcacaaggcaagaaaaugauacgaccucaacccauggaacacaaauacaguuggaaauccuggggcaaagcuaaaauaauuggugcugauguacaaaacacaacauucaucauagauggcccgaauaccccugaguguccugaugaucaaagagcuuggaauauuugggaggucgaagauuauggcuuuggcauuuuuacgacgaauauauggcuaaaauugagggacucuuauacgcaaguaugugaucaccggcuaaugucugccgcgauuaaagauuccaaagcaguacaugcagauaugggcuauuggauugagagcgagaaaaaugaaaccuggaaguuagcaagagcaaguuuuauagaaguaaaaacaugcauauggcccaaaucucacaccuuauggaguaaugguguauuggaaucagaaaugauaauacccaaaauuuacgguggcccaauaucacaacauaauuaucguccuggauacuuuacacagaccgcaggaccauggcacuuggguaaacuagaacuagauuuugaucuuugugaaggcaccacaguuguaguagacgaacacugugguaauagaggaccaucauuaagaaccacaacugucacaggaaaaaucauccacgaauggugcuguagaagcugcacguuaccuccucuucgauuuaaaggugaggauggauguugguauggcauggaaauaagacccguaaaggaaaaagaagaaaaccuagugaaaucgaugguuagcgcugguucaggcgaaguggauucauuuagucucgggcuacucuguacaucgaucaugauugaggaaguaaugagguccagauggucucgaaaaaugcuaaugacagggacacuggcaguauuucuuuuacugauuaugggccaacuaaccuggaaugaccuuauaagauuguguauaauggucggagcaaaugcuucugaccgcaugggcaugggaacaacauaucuagcguuaauggccaccuuuaaaaugcgaccaauguuugccgucgguuuguuguuuagaagacuuacgaguagggaaguauugcuauuaacgaucggguuaucccuuguagcuucgguagaauugccgaauagucuagaagaguuaggugacgggcuagcaauggguaucaugauacuaaaacuacuaacagacuuucagagccaccaacuaugggcaaccuugcuaaguuugacguucauaaagaccacacuauccuuacauuaugcauggaaaacgauggcgauggugcuuaguauuguuagucucuuuccauuaugccucaguacgacaucucaaaagacgaccuggcucccagugcuauuggggucuuuaggauguaagccccuuacaauguuuuuaaucgcagaaaauaaaauauggggccguaaaucauggccacuuaaugaagguauaauggcaguuggugugguuucaauacuacucucuagccuacucaagaacgacgucccacuagccggaccccuaauagcaggaggaauguuaauagcuuguuacguuauuucuggcucaagcgcagacuuaucacuagaaaaagcugcggaagucagcugggaagaggaagcagagcauuccggggcgucucauaauauucuuguagaagugcaagaugacggaacgaugaagauaaaagaugaagaacgcgacgauacucucacuauauugcuaaaggcuacgcuccuagcuguaucgggcguuuauccgcuaagcauaccugcuaccuuauucguaugguacuucuggcagaagaagaaacaacguucgggaguguuaugggauacaccuagucccccugaaguagaaagagccguacucgaugacgggaucuaucguauaaugcaacgagguuugcuaggacguagucaagucggcgugggcguauuucaggaaaauguguuucauacuauguggcauguaacuagaggggcagugcuuauguaucaaggaaaacgucuagaaccaucaugggcaucuguuaaaaaggacuuaauuucauacggcggaggauggagguugcaaggaagcuggaauacuggugaggaaguacaaguuaucgcuguugaaccgggcaaaaaccccaaaaauguacaaacggcaccgggcaccuuuaaaaccccggaaggugagguaggugcuauagcgcuggauuuuaaacccgggacgagcgggucaccuaucguuaacagagagggcaagauuguaggacucuaugguaaugguguggucacuacaagcggcacauacguaagugcaauagcucaggcaaaagcaucucaagagggaccguuaccagagauugaagacgaaguauucagaaaaagaaaccuaacaauaauggacuugcauccaggcucagguaaaacaagaagauauuugccugcaaucguacgggaagcaauuaaaagaaaacugcguacucucauauuagcaccuacaagaguuguggcuucugaaauggcugaggcauugaagggaaugccaaucagauaucaaacgacagcaguaaagucggaacauacugguaaagaaaucguugauuuaaugugccaugcuacguuuacaaugcgauuguuaagccccguccgcgugccgaauuauaauaugaucauuauggacgaagcacauuucaccgacccuucaucuaucgccgccagaggguacauuucgacgagaguaggaaugggagaggcggcagcaauauuuaugaccgcaacgccgccuggaucaguugaggcuuucccacaaucaaacgccguaauacaagaugaggagagggauauccccgaaaggaguuggaacucaggguacgaauggaucacagauuuuccugggaaaacugugugguucguaccaucaauaaaaucaggaaaugauauagcaaauuguuuaaggaagaaugggaaacgcguaauucaauuaaguagaaaaacguuugauacagaauaccagaaaaccaaaaauaaugauugggacuacguagugacaacagauaucucagaaaugggcgcaaacuucagagccgacagagucauugacccucgccgaugccuuaaaccaguaauccuaaaagaugggccagaaagaguaauuuuggcaggccccaugcccguaaccguagcaucagcagcgcaaagacggggacgcaucggacguaaucauaacaaagaaggggaccaauauauuuacaugggccaaccauugaauaacgaugaagaccaugcgcauuggacugaggcaaaaauguuacuagacaacauaaacacgccugaagguaucauccccgcacuauucgagccugaacgagagaaaagcgcugcuauugacggagaauaccgacuucgaggggaggcccgaaaaacguuugucgaacuaaugcgucgaggagaucugccuguuugguuaucauacaagguagcuagcgagggguuucaauacagcgaccgacgcuggugcuuugauggugaacgcaacaaucagguauuagaagaaaauauggauguugaaauuuggacuaaagaaggagagaggaagaaacugagaccaagaugguuggacgcaagaaccuacagcgauccacuagcuuuacgagaguuuaaggaguucgcagcaggacgaagaucuguuagcggagauuuaauacuagaaauaggcaaguugccacaacaccugacacaacgggcgcaaaacgcuuuagauaauuuagugauguugcauaacagugaacaagguggacgcgccuauagacaugcaauggaagaauuaccugauacuaucgaaacucuuauguuacuggcuuuaauagcaguucuaacaggcggagugacacuauuuuuccuuucgggaagaggauuaggaaagacaucgaucggucuauuaugcgugauggcaucuaguguccuguuauggauggcuaguguugaaccucauuggauagcggccaguauuauauuggaguuuuucuuaaugguauuauugauuccugaacccgauagacaacguacuccacaagacaaccaauuagcuuaugucguuauaggucucuuauuuauuauacuaacaguugccgccaaugaaaugggguuauuagagacaaccaagaaagauuugggaauagggcacguagccguagaaaaucaccaccaugcgacaaugcuagauguagaucugcauccagcaucagccuggacuuuauaugcaguggcuacgacgaucauaacuccgaugaugcgacauaccauagaaaauaccacugccaacauuaguuugacagcaaucgcuaaccaagcagcaauauuaaugggccuggauaagggcuggccaauuaguaaaauggauauaggagucccacuacuagcccugggcuguuacagucaaguuaacccgcuaacccugacagcugcuguauuaaugcuuguugcucacuaugcuauaauaggcccaggacuacaggcuaaagccacaagagaggcgcagaaacggacugcagcuggcaucaugaaaaauccuacaguggauggaauaguugcgauagauuuagauccggucguuuacgaugcaaaauuugaaaaacaauugggucagauuaugcucuuaauacugugcacuagccaaauauuacuaaugcguacaacaugggccuuaugcgaguccauuacacuagcaacaggaccguuaacuacuuuaugggaaggaucccccggaaaauuuuggaauaccacaauagcagucagcauggcaaacaucuuucgcggaagcuaccucgcuggugcuggguuagcguuuucacugaugaaaucacuaggcgggggacgaagagggacaggagcucagggugaaacuuuaggugaaaaauggaaacggcagcuuaaucaauugucgaaaagcgaguucaauaucuauaaaagauccggaauuauggaaguagaucgcucugaggccaaagaaggcuuaaagcgaggugaaacaacaaggcacgcgguuaguaggggaacagccaagcuacguugguucguggaaagaaaccugguaaaaccagaaggaaaaguaauugaucuaggauguggccgaggcggguggucuuauuacugcgcuggcuugaagaaaguaacugaaguuaaaggguauaccaagggugguccaggucacgaagaacccaucccgauggccaccuauggcuggaaccuaguaaaacuacauucagggaaagauguguucuucacgccacccgaaaaaugcgauacacuacuuugugacauuggagaaucaucgccgaauccaaccauagaagaaggaagaacacugagaguucucaagaugguagaacccugguuaagaggcaaucaauucugcauuaaaaucuuaaacccauacaugccaucgguagucgaaaccuuagaacaaaugcaacgaaaacauggcgguaugcuuguuaggaacccuuugucaagaaauuccacacacgagauguauugggucucauguggaacaggaaauaucguguccgcaguaaauaugaccagcaggauguuacucaaucgauuuacgauggcccauagaaaaccuacuuaugaaagagaugucgauuugggagcggggacuaggcaugucgccguagaaccagaaguugcuaaucuugacaucauuggucaacggauagaaaauauaaaacaugaacauaaaucgacguggcauuacgaugaagauaauccauauaagacuugggcauaccaugggaguuaugaaguuaaacccagcgggagcgcauccucaaugguaaacgguguggucaaacuacuaacaaagccgugggacguuauaccaauggugacgcaaauagcaaugacugauacgacgccuuucggacaacaacguguauuuaaagaaaaaguugauacacguacaccaaaggcaaaacguggaacugcucaaauaauggaggucaccgcuaggugguuaugggguuuccuauccaggaauaagaaaccuaggauaugcaccagagaagaguucaccagaaaagugcgcucuaaugcggcuaucggagccguguucguggaugaaaaucaauggaacucagccaaagaggcaguagaagacgaaagguucugggaucuaguacaaaaggaaagagaauugcauaagcaaggcaaaugcgcaacuugcguauauaacaugaugggaaaaagggagaagaaauuaggugaauuugggaaggccaaagguaguagggcuauaugguacaugugguuaggagcuagauuucuggaauuugaagcccugggcuucaugaacgaagaucauugguuuuccagagaaaauucauuaagugguguugagggggaaggacugcacaaacugggcuauaucuuaagagauauaucuaaaauacccggaggcaacauguaugcugaugacacggcaggaugggauacaagaauaaccgaggaugaucuucaaaaugaagcaaaaauuacggauauaauggaaccagagcaugcgcuguuggcuacuucaaucuuuaaauuaacauaucaaaauaaggucguacgaguacaaaggccugcuaaaaauggcacggucauggacguaauaucaagaagagaucagcguggcucgggacagguggggacauauggacuaaacacauucaccaacauggaagcacaauuaauuaggcagauggagucugaggggauauuucuuccuagugaacuugaaacgccgaacuuggcugaacguguguuagacugguuggaaaaguacgguguggaaagauuaaaaagaauggcaauuucuggagacgacuguguaguuaaacccauagacgaccgguuugcuacggcacucacggcucuaaaugauaugggaaaagucagaaaggauauaccacaaugggaaccuaguaaggguuggaacgauuggcagcaaguuccuuuuugcagucaucauuuucaucaacuuauaaugaaagacggcagggagauuguagucccuugucgaaaucaggacgaguuagucggcagggcacggguaagucagggggccggguggucccuuagagaaacagcaugucuaggcaaaaguuacgcucaaauguggcaacuuauguacuuucacagaagagaucuaagacuagcagcaaaugcaauaugcucagcaguacccguagacuggguaccuacaucacggacuacuuggaguauacaugcacaucaccaauggaugacaacagaagauaugcucaguguuuggaaccguguuuggauagaagagaaucccuggauggaagauaaaacccauguaucuucauggggcgauguaccuuaucugggaaaaagagaagaucaguggugugggucuuuaauaggacuaacagcaagggccacuugggcaucuaauauccaaguggcaaucaaucaaguaagacggcuuauaggaaaugaaaauuauuuagacuauaugacauccaugaaaagguucaaaaaugaaggcgaucccgagggagcgcuaugguga

SEQ ID NO: 21718 - RNA, 9879 nt, Artificial Sequence
  derived and/or modified CDS sequence (opt6) from DENV-1__FJ882569__SS-prME
uccguuacuauguuacuaauguuaaugccaacggcucuagcuuuccacuugacaacaagaggaggagaaccccacaugauugugacuaaacaagaaagagggaaaucgcuucuguuuaaaacaucagccgguguuaauaugugcacacuaauagcgauggaucucggugaacuaugugaagauacuaugacuuauaaaugcccucguauaacggaagcagaaccagaugauguagacugcuggugcaaugcaacugacacauggguaacauauggaaccuguucacaaacgggagaacaccgcagggauaaacgauccguugcauuagcaccacacgucggacucgggcuggaaacaagaacggaaacuuggaugaguagugaaggagccuggaagcaaauucaaagaguugaaacuugggcuuugcgacacccuggguucacaguaauagcucuauuccuagcacaugcaauaggaacuucaauaacccaaaaaggaaucauauucauuuuacucauguuaguaacuccaucaauggcaaugagguguguugggaucggaucaagagacuuugucgaaggacuuaguggagccaccuggguagaugucguucucgaacauggaucaugcguaacaacuauggcaaaagauaaaccuacacuugauauagaacuuuuaaaaacagaagugacaaacccagcaguacuacguaaacuaugcauagaggcgaaaauaaguaauacaacuacugacucucgcuguccaacacaaggagaagcaacgcuuauggaagaacaagaugccaacuucgucugcagacggacuuuuguugaucgagggugggguaaugggugcggucucuucgggaaaggaucuuugauaacaugugcaaaauuuaaauguguaacgaaacuugaaggaaagauuguucaauaugaaaaucucaaguauuccgucauugucacuguacauacgggagaucaacaucaagugggaaaugaaaguacugagcauggaacuacagcuacaauaaccccacaagcaccaaccuccgaaauccaauuaacugacuauggugcauuaacucucgauuguaguccgagaaccgguuuagauuuuaacgaaaugguuuuacuaacgaugaaagaaaaaucauggcugguacauaaacaaugguucuuagaccucccgcuucccuggacaagcggagcaucuacaagucaagagacuuggaaucgucaagaucuauuaguuacauucaaaaccgcgcacgccaagaaacaggaagucgucgucuugggaagucaagagggagcaaugcacaccgcucuaacaggagcaacugaaauccagacuucugguacuacaacaauuuuugcgggacaucuuaaaugcagacuaaaaauggauaaacuaacgcuaaaagggaugaguuauguaauguguaccggauccuuuaaacucgagaaagaaguugcagaaacacaacaugguacugucuuaguacaaauaaaauaugagggcacggacgcacccugcaaaaucccauucaguacacaagacgaaaaagggguaacucaaaacggacgucuaauuaccgcuaauccaauugucacggacaaagagaaacccgucaauaucgaagcugaaccuccauuuggagaaucguauauugucauaggugccggagaaaaggcuuuaaaauuaaguugguucaaaaaggggucguccaucggaaaaauguucgaagcaaccgcgcgaggagcuagaaggauggcaauccucggagacacugcaugggauuuuggcuccaucggagggguauucacaucagucggaaaauuaguacaccaaauuuuugguacggcuuauggcguccuuuuuagcggaguuagcuggacuaugaaaauagguauaggugucuuguuaacuugguuaggacuuaacaguagaagcacgucguuaucgaugacuugcauagccgugggccucguuacgcuuuauuuaggaguuauggugcaagcagacucagguugcguaauaaacuggaaaggacgagaauuaaaaugcgguagcgguaucuuugucacuaaugaagugcauacauggaccgaacaguacaaauuccaagcggacagcccuaaaagacucucagcggccauagggaaagcaugggaagaagguguuugugguauuagauccgcgacacgacuggagaauauaauguggaaacaaauaucuaaugaauugaaucacauacuucuagaaaacggcaugaaauucacgguggugguaggggauguaguuggcauucuugcacaagguaagaaaaugauuagaccacagccuauggaacauaaauacucauggaaaucaugggguaaagcgaaaaucauuggagcagauguucagaacacaaccuuuauaauugauggaccaaauacacccgaauguccugaugaucaacgagcauggaacauaugggaagucgaagauuaugguuuugguauauuuacuacaaauauuugguuaaaacuaagggacaguuacacccagguuugugaucaccgcuugaugucagcugcaauaaaagacuccaaagcagugcacgcugacauggguuauuggauugagagcgagaaaaaugaaaccuggaaacuugcaagagcgaguuuuauagaagugaaaacuuguauuuggcccaagucucauacgcucuggucuaauggcguuuuggaaagcgaaaugauaauaccaaaaauauauggcggucccaucagucaacacaauuaccgccccgguuauuuuacgcaaacugcgggcccauggcaccuugguaaauuagaauuagauuucgacuuaugugaagggacuacagucguaguagaugaacacuguggaaacagagguccaagucuaagaacuacgacgguaacaggcaagauaauccaugaaugguguugccgaucauguacgcuacccccgcuuagauuuaagggggaagaugguugcugguaugggauggagauaagaccaguaaaggaaaaagaggaaaaucugguaaagucaaugguaucagcggguucaggugaagucgauagcuuuucguugggcuuauuaugcacaucaaucaugauugaagaaguuaugcgaucacgauggucaagaaaaauguuaaugacuggcaccuuagcugucuuucuccuacugauaaugggccaacuaacguggaacgacuugauacgguuauguaucaugguaggggcgaaugccucugaccguaugggaaugggaacuacuuaucucgcauugauggcuaccuucaaaaugagaccuauguuugcaguaggacuacucuuucguagauuaaccucacgagagguccuuuuauugaccauuggauuaucauuaguugccucaguggaacuccccaacagucuggaagaauuaggcgaugggcucgcaaugggaauuaugaucuuaaaauuacuaacagauuuucaaucccaccaguugugggcaacuuuacucucauugacauucaucaaaacaacccucucccuucauuacgcauggaaaacuauggcaaugguccugucaauuguaucacuauucccacuuugucuuuccacaaccucccagaaaacaacguggcuaccagucuuauuggguucucuaggcuguaaaccucugacaauguuucuaauagcagagaacaagauuuggggcagaaggagcuggccccuuaaugaaggcaucauggcuguagguguaguaucaauucuauuaucuagccuucuuaaaaaugacguuccauuagcugguccauuaauagcaggaggaaugcucauugcuuguuacgucaucucaggauccagugcugaccuuucccuagaaaaagcugcugagguuucaugggaagaggaagccgaacacucaggugcaucacacaacauccuaguagaaguccaagaugacgguacaaugaaaauuaaagacgaagaaagagaugacacguuaacuauuuuauuaaaagcuacgcugcuagcaguuuccggaguauacccacugucgauaccagcuacuuuguuuguuugguacuucuggcaaaagaagaaacaacgaucuggaguucuaugggauaccccaagcccaccagagguagaaagggcgguucuagacgaugguaucuaccgaauaaugcaaaggggguuacuuggaaggucgcaaguaggagucggcgucuuucaagagaauguuuuccacacuauguggcacguuacaagaggagcgguuuuaauguaccaaggaaaacgguuggaaccgucgugggccucuguaaagaaagaucucauaaguuauggcgggggcuggcgucuucaagguagcuggaacaccggagaagaaguccaaguaauagcuguugagccaggcaaaaauccgaagaacguacaaacagccccagguacuuuuaaaacgcccgagggggagguaggagccaucgcacuagauuuuaagccugggacaucaggcucaccaauaguaaaccgugaaggcaaaauuguagguuuauacgggaacggaguuguuaccacaagugguacuuacguaucagcaauagcacaagcuaaagccucgcaagagggcccgcucccggaaauagaagacgaaguauucaggaaacgaaacuugacuauaauggaccuacacccagggucugggaagacacgaagguacuuaccggcaauuguccgggaggcgauaaaaagaaaacuuagaacuuuaauuuuagcaccaacaagagugguggcauccgagauggcugaggcccuaaaggguaugccaauaagauaucagacaaccgcugugaaaagugaacacacagguaaagagauaguagaccuaaugugccaugcaacauucacaaugagacuauugucaccuguccgcguaccuaacuacaauaugauuauaauggacgaagcucacuuuaccgauccuaguucgaucgcugcgcgaggauauauuucuacucgcguugguaugggugaagccgcagccauauucaugaccgcaacuccuccggguagugucgaagccuucccgcaaucaaaugcagugauacaagaugaagaaagagauaucccagaaagaucuuggaacucgggauacgaauggaucacggauuucccgggaaaaacuguaugguuugucccaucgauaaaaucugguaaugacauagccaacuguuuaaggaaaaauggcaagaggguaauucaauuaucgagaaaaacauuugacacagaauaucagaaaacuaagaacaacgacugggauuacguuguuacuacagauauaagugaaaugggagccaauuucagagcagaucgagugauagauccuaggaggugucuaaaaccgguaauucucaaagauggaccagagagaguaauauuggcaggaccuaugccgguuacugucgcgucagcagcacaaaggagaggaagaauuggacguaaucauaacaaagaaggugaucaauauauuuacaugggacaaccucuuaacaaugacgaagaccacgcacacuggaccgaggcaaaaauguuacuagacaauauaaauacuccugaggggauuauacccgcguuguucgaacccgaaagggaaaaauccgcagcaauagauggagaauaccgacuccgaggagaggcacgcaaaacguucguugagcuaaugcgacggggagaucuccccguauggcugucauacaaaguugcauccgaaggauuucaguauuccgacaggagaugguguuucgauggagaacguaacaaucaaguucuagaggaaaacauggacgucgagauuuggacuaaagaaggcgaaaggaagaaacugaggccccgcuggcuugaugcuaggaccuacagcgacccucuggcacuacgugaauuuaaagaauuugccgcaggacgccgguccgucaguggcgauuuaauacuagaaauaggcaagcuaccacagcauuuaacacaaagagcacaaaacgcacucgacaacuuaguaaugcuccauaauucggagcaaggggguagagcauaccgacacgccauggaagaauuaccugacacuauagaaacucugauguuauuggcuuuaauugcaguuuuaaccggagggguaacacuauucuucuuaucaggaagaggccuuggcaaaacaucuauugguuuauuaugcguaauggccucaaguguacugcuguggauggcauccguagaaccucauuggauagccgcaucaauaauucuggaguucuuucuuauggugcuucuuauaccagagccugauaggcagagaacuccucaggauaaucaauuggccuacgucguuauuggccuauuguuuaugauucuaaccguggcagcgaacgagaugggacuauuagaaaccacuaagaaagaucuaggaauaggacauguugcagucgaaaaucaucaccaugcaaccaugcucgacguagauuuacaccccgccucggcauggacgcuauaugcagucgcuacuacaaucauuacucccaugaugcgccauaccauagaaaauacaacagcuaauauaagccucacagcgaucgccaaucaagcagcaauuuuaaugggauuagauaaaggauggccgauauccaaaauggacaucggggucccucuacucgcucuaggaugcuauucccaaguuaauccucucacauuaacagcagcuguuuuaaugcuaguugcucacuaugcuauaauagguccaggucuacaagccaaagcuacaagggaggcucagaaaagaacagccgcuggcauaaugaaaaacccaacaguagacggaauaguagccauugaucuagauccuguuguguaugacgcuaaauuugagaaacaacuaggucaaauaaugcuacuaauuuuaugcaccucucaaauauuguuaaugagaacaaccugggcauuaugugaaucaauaacguuagcgacggggccauuaaccacucuaugggaaggcagcccuggcaaauucuggaauacaacuaucgcggugucuauggcaaauauuuucagagguucauaucuggcgggagcaggguuagccuuuaguuuaaugaaaucccuuggaggcggaaggcggggcacuggagcucagggugagacucuaggugaaaaauggaagaggcaauuaaaccagcugucaaaaucagaguucaauauuuauaagagaagugguauaauggaaguagauagaagugaagccaaggaaggguuaaaacgaggggaaaccacacgacaugcuguaaguaggggaacugcaaaauuaagaugguuuguggagcgaaaucuagugaaaccggaggggaagguaauugacuuaggcugcggaaggggagguuggucuuacuacugcgcaggccuaaagaaaguaaccgagguaaaaggguacacuaagggagggccugggcaugaagaacccauaccaauggcuacauauggauggaacuuaguaaaauuacacucagguaaagacguauucuuuacacccccugaaaaaugcgauaccuuacugugugauauuggagaaagcaguccgaauccuacuauagaggaaggucguaccuuaagaguccuaaaaaugguagagcccuggcuacgcgguaaucaauucuguauaaagauacuuaaucccuacaugccauccguuguugagacauuagaacagaugcaaagaaaacacggaggaaugcugguaagaaauccauugagccgcaauagcacgcacgaaauguauugggugagcugcgguacggguaauaucguaagcgcugugaacaugacuucaagaaugcuccuaaaccgcuuuacaauggcucaucgaaaaccaacuuacgaacgagauguugauuuaggagcggggacuaggcauguggcaguagagccggagguagcgaaucuggacauuauaggacagcguauagaaaacaucaaacaugaacauaagucaaccuggcauuacgaugaagauaacccuuauaaaaccugggcuuaccacggaucuuaugagguaaaaccaaguggaucugccaguucaaugguuaauggaguugugaaacugcugacaaaaccaugggacguuaucccuaugguaacucaaauagcuaugacggauacaacuccuuuuggccaacaaagaguauucaaggagaagguagacacccgaacaccaaaagcaaagcggggcacugcacaaaucauggaagucacggcacgaugguuguggggauuccuuagccgaaacaagaaaccuagaauuuguacgagagaggaguuuacccgaaaaguuagaucaaaugcagccauuggagcgguauucguugaugaaaaccaauggaacucagcgaaagaagcaguugaagacgaacgauuuugggaucuaguacagaaggaaagagaguuacauaagcaggguaaaugugcuacgugcguuuauaacaugaugggaaaaagagagaagaaacugggagaguucggaaaggcaaaaggaagcagagcaauuugguauauguggcugggggccagauuuuuagaauuugaagccuugggcuucaugaaugaagaccauugguuuucaagagaaaauucguuaucgggugucgaaggggaaggucugcauaaauuagguuauauucuaagagauauuucuaaaauaccgggagggaauauguaugcagacgauacggcagggugggauacaagaaucacugaagaugauuugcaaaacgaagcaaaaauuaccgacauuauggaaccagaacacgcgcuauuggcaacuucuauauuuaaauugaccuaucaaaacaaaguuguacguguccaacguccagcuaaaaaugggacaguuauggauguaauuagucgaagagaucaaaggggaucuggucaaguaggaacuuauggacugaauacauucacaaauauggaagcacaacuuauaagacaaauggaaucugagggaauauuucucccaucagaauuggaaacgccaaacuuagcagaaaggguacuagacugguuggagaaauaugggguugagagacuaaaaagaauggcaauuagcggagacgauugugucguaaaaccaaucgaugacagguucgcuaccgcguugacagcucucaaugauaugggaaaaguacgcaaagacauuccacagugggagccaaguaaaggguggaaugacuggcaacaaguccccuuuuguagccaccacuuccaccaacuuauaaugaaagaugggcgagaaauuguagugccguguagaaaucaagacgaauuaguagggcgggcacgaguaucgcaaggcgcagguugguccuuacgagaaacagcaugucucgggaaauccuaugcucaaauguggcaacucauguacuuucauagaagagacuuaagauuagccgccaaugcaauauguagugcaguaccaguggacuggguaccgaccucucgaacgacauggucgauacaugcacaucaucaauggaugacaacggaagacaugcuuucaguauggaaucgaguguggaucgaggaaaauccauggauggaggauaagacccauguaaguucuuggggcgacguuccauauuuaggaaaaagagaagaccaguggugugguucuuuaauuggguuaacagcaagagcaacaugggcgagcaauauacaaguugcuauuaaccaaguaagacgucuuaucgguaaugaaaauuauuuggacuacaugaccaguaugaaacgguuuaaaaacgaaggggauccagaaggggccuuaugguga

SEQ ID NO: 21719 - RNA, 9879 nt, Artificial Sequence
  derived and/or modified CDS sequence (opt6) from DENV-1__GQ199833__SS-prME
agcguuacaauguuauugaugcugaugccaacggcguuagcguuccacuuaacgaccaggggaggcgaaccacauaugauagucaccaaacaagaacgggggaaaucauuacuauuuaaaacaagugccggaguuaauauguguacgcucauagcgauggauuugggugaauuaugugaagauacuaugaccuacaaaugccccagaauaacggaagcggaaccagaugauguugauuguugguguaaugcaaccgacacguggguaacguauggaacaugcucacaaacaggggaacaucguagagacagaagaucugucgcauuagcuccacacguuggguuggguuuagaaaccaggaccgaaacauggaugucuagcgaaggggcguggaagcaaauucaaagaguagagaccugggcucuuagacacccugguuuuacugucauagcccuauuuuuggcacacgcaauagguacauccaucacucaaaaaggaauuauuuuuaucuuauuaauguugguaacacccucaauggcaaugagaugugugggcauuggcucgagggacuuuguagaaggccucaguggagcuacauggguagaugugguauuagaacauggaagcugcguuacuacaauggcgaaagauaaaccuacguuagacauagaacugcucaagaccgaaguaacuaauccggccgucuuacguaaacuaugcauugaagcaaaaaucagcaacacgaccacugauucuagauguccaacccaaggggaagccacacuuauggaagaacaagaugcuaauuuuguauguagaagaacauuuguugaucgagguugggguaaugggugugguuuguuugguaaagggagcuuaauuacuugugcuaaauucaaauguguuacaaaacuugaaggaaagauaguucaauacgaaaaccugaaauauucugugauuguaacuguacauacaggggaccaacaccaagucgguaaugaaaguacagaacacgguaccacugcuacuaucacaccacaagccccgacguccgaaauacaacuuacagacuacggagcucuaacauuggacugcucaccacgaacggguuuagauuuuaaugaaaugguguuauuaacaaugaaaggaaaaucuuggcuuguccauaaacaaugguuccuugaccuaccauuaccauggaccuccggugcuuccacaucgcaagaaaccuggaaucgucaggaucuuuuaguaacuuuuaagacggcacacgcuaagaagcaagaagugguaguccuagguagccaagaaggagcaaugcacacagcauugaccggagccaccgaaauucaaacgucaggaaccacaacuauuuuugcagggcauuuaaaauguagguuaaaaauggauaaacugacgcuuaaggguaugucuuacguuaugugcacaggaaguuucaaacuagagaaagagguugcugaaacucaacaugggacugugcuaguucaaauaaaauaugaaggcacagaugcuccguguaaaaucccguucaguacucaggaugaaaagggggucacccagaauggacgccuuauuacagccaacccaauaguaacagacaaggagaagccagucaauauugaagcagaaccgccuuuuggagagucauauauaguuauaggagcuggagagaaagcguuaaaauuaucaugguucaagaaaggaagcucuauugguaaaauguuugaagcaacagcucgaggagcaagacggauggcgauauuaggggacacugcaugggacuucggaaguaucggagguguuuuuaccaguguagggaaacucguucaucagaucuuuggcaccgcuuacgguguuuuauucucgggcgucucguggacaaugaaaauaggaauuggagucuuacuuacaugguuaggauuaaacagccgcucgacaucuuuaaguaugaccuguauagcuguagguuuaguaacacuuuaccuuggaguaaugguacaagcagauucgggauguguaauuaacuggaaaggucgagagcuaaaaugugguagcggaauuuucguaacuaacgaaguucauacauggacugaacaauacaaguuucaagcagauuccccaaaaagacuaucggcugcaauuggaaaggcaugggaggaaggagucugcgguauaagaagugcaacaagacuagagaacauaauguggaaacaaauaaguaaugaacucaaccauauucuauuagagaauggaaugaaguuuacaguaguagugggugacguugucggcauuuuagcccaagggaagaaaaugauccguccacaacccauggaacauaaguacucauggaaaagcuggggaaaagcaaaaauuauuggcgcagauguucagaauacuacguuuauaauagauggaccgaacacaccggaauguccagaugaucagcgagcuuggaauauaugggaaguugaagacuacggguucggaauuuucacaacaaacauauggcuaaaacuuagagauucauacacucaaguaugugaccaccgauuaaugagugcagccaucaaggauuccaaagcuguacacgcagacaugggauauuggaucgaaagugaaaagaaugaaacguggaaauuagcaagagcaucauucauagaaguuaaaacuugcauauggccgaaaagucacacgcuuuggucuaacggaguucuagaaagugaaaugaucauaccgaaaauauacgguggccccaucucucaacauaacuaccguccaggauauuuuacgcaaacagcaggaccauggcaccucggaaaacuagagcuugacuuugaccugugcgaaggaacgacggucguaguggacgaacacugcgggaaccgaggcccuagucuaagaacaacuacaguaacaggcaagauuauucaugaaugguguugucgcucguguacccuaccaccauuaagguucaaaggagaagacggcuguugguacgguauggaaauucggccuguuaaagaaaaggaagaaaauuuggucaaaucaauggugucugcgggcaguggagaggucgauucauuuucucucgguuuacuguguauaucaaucaugauugaagaaguuaugagaucuagauggaguaggaaaaugcuuaugaccggaacacuagcuguuuuucuauugcuuaucaugggucaauugacauggaaugauuuaauacgauuaugcaucauggucggagcgaaugccuccgaucguauggggaugggaacaacuuauuuagcuuuaauggcaacuuucaaaaugagaccaauguucgcugucggucuguuauuuaggagacucacaagccgugaaguauuauuacucaccauaggacuaucguuaguagcaucaguagaacuaccuaacucacuagaggaacuuggagacggucuggcaaugggaauaaugauucuuaaacuucuuaccgacuuucaaagucaccaguugugggccacucuucugucgcucacauucauaaaaacuacgcuaucccuacauuacgcguggaaaacgauggcaauggugcuaaguauaguaucccuuuucccccuaugcuuaagcacaacuucacagaaaacuaccuggcugccuguacuuuuaggaaguuugggcuguaagccccuaacaauguucuugauagccgaaaacaagauuuggggaagaaagaguuggccuuuaaacgaagggauaauggcgguggguguggugucuauauuauuaucuucacuacuuaaaaacgauguaccacuagcagggccacuaauagccgguggcaugcuaauugcuuguuaugucauaucgggcaguucugcagacuuaucucucgaaaaagcagcugagguaaguugggaggaggaagcugaacauucuggagcuagucauaauaucuuaguggaaguacaagacgacggaacaaugaaaauuaaagacgaagaaagagaugacacuuugacaauacuguugaaagcgacucugcuagcagugucagggguuuacccauuaaguauaccugcuacauuguuugugugguacuucuggcaaaagaagaaacaaaggaguggcguacuuugggacaccccuucaccuccagaaguagaacgugcuguacuugacgaugggauauaucggauaaugcaaagaggccuacuggguagaucacaaguaggaguuggagucuuucaggaaaauguauuucacacaauguggcacguaacacgcggagcaguguuaauguaucaaggaaaacgucuagagccgagcugggcuucgguaaagaaagauuugauuucauauggcggcggauggcgacuacaaggaaguuggaacacgggagaagaaguacaaguuauugcgguugagccugguaaaaaucccaaaaaugugcaaaccgcaccaggaacauucaaaacgccagaaggagaaguaggcgcgaucgcccuagacuucaagccuggaacaaguggaucacccaucguuaacagggaagguaagauugucggguuauauggcaauggcguaguaacuacgagugggacauauguaucagcgauagcccaagcaaaagcaagccaagaaggcccccucccugaaaucgaggacgaaguauuucggaaacgaaaccuuacaauuauggaucuucauccugguucuggaaaaacccggagauacuuaccagcaauaguaagagaggcuauuaagcgaaaacuuaggacguuaauauuagcuccaacgagggucguagcaagugagauggcagaagcacucaaagggaugcccauaagauaccagacaacagcggugaaaucagagcauacaggaaaagaaauaguugaccuuaugugucaugcaacauuuacaaugcgccuguuauccccuguacgcguaccaaauuauaauaugauuaucauggacgaagcccauuuuacugauccgagcaguauagcggcccgaggauauauaucgacacgaguugggaugggagaggccgcagcuauauuuaugacggccacaccaccugggucuguagaagcauuuccacaguccaacgcaguaauacaggacgaggagcgggauaucccagaaagaagcuggaacucggguuaugaauggauaaccgauuuuccaggaaaaacgguuugguucgucccuagcauuaaaagugguaaugacauagcaaauuguuuaaggaaaaaugggaagagaguuauacaacuaagucgaaaaaccuucgacacggaauaccagaaaacuaaaaauaacgauugggauuaugucgugacgacugauauauccgaaaugggugcuaacuucagagcagaccguguuauugauccucgaagaugucuaaaaccggugauccuaaaagacggaccagaaagagucauauuggcuggccccaugccaguaacaguugcaucugcagcccaacgacguggacgcauaggaaggaaccacaacaaggaaggugaccaguauaucuacaugggccaaccauuaaacaaugacgaagaccacgcgcacuggacugaagcaaaaauguuacuagauaauauaaacacuccagaagguauaauuccugcgcuuuuugagcccgaacgagagaaaucagcagcuauagacggugaguaccgguuacgaggagaagcaaggaagacuuuuguagaacuuaugagacgcggagaucuccccguguggcuuucuuauaagguagcgucggaaggauuucaauacagcgauagacgaugguguuucgauggagaacggaacaaccagguauuagaggagaauauggauguggaaauauggacuaaggagggagaaagaaagaaacugagaccacguuggcuagacgcacggacauacagcgauccucuagcacuaagggaauuuaaagaauuugcugcgggaagaagaagugucucuggugaucugauccucgaaauuggaaaauuaccucaacaccuuacacaacgagcacagaaugcccuggauaauuugguaaugcuacauaauagcgaacagggaggcagggcuuaccgacacgcaauggaagaacuucccgacacgauagagacgcuaaugcucuuggcauuaauagcaguacugacaggaggaguaacccuuuucuuccuuagcgggcgaggucucgguaaaacuucuauaggauuauugugcgugauggcaucuagcguacuauuauggauggcaaguguugaaccucacuggauugcugcaaguauuauacuagaguucuuccuuaugguacuacuuaucccagaaccagaccgucaaagaacgccucaagacaaccaacuugcguacguuguaauuggauuacuauuuaugauccuuacagucgcugcgaacgaaaugggauuacucgagacuaccaagaaagauuuagguauaggucacguagccgucgaaaaccaucaucacgcgacaauguuggauguggaucugcauccagcgagugccuggacccuauacgccguggcuacaacaaucauuacaccaaugaugaggcacacaauagaaaacacaacagccaacaucucccuaaccgcaauugccaaucaggcugcaauacugaugggauuagauaaagguuggccgauuagcaaaauggauauuggagucccccuccuagcguuggguuguuacagucagguaaacccgcuaacacugacagcagcgguucugauguugguugcucauuacgcgauaauugguccuggguuacaagcaaaagcaacuagagaagcacagaaaagaacugccgcagggauaaugaaaaauccaacaguagauggcauaguagccauugaccuagacccuguaguauaugaugccaaauuugaaaagcagcuuggccaaauaauguuacuuauacuauguacgucucaaauucucuuaaugagaacaacuugggcacuaugugaauccaucacgcuugcaacugguccuuugacuacauuaugggagggcagccccgggaaauucuggaacacaacaauugccguaaguauggcgaauauauuucgaggaucauaccuagccggcgcaggacuagcguuuagucuaaugaagucccuugguggaggccgaagagguacuggggcacaaggugaaacucuaggagagaaauggaaaagacagcuaaaucaacuaucgaagucugaguucaauaucuauaaaaggucagggauaauggagguugacagaagugaggcuaaggaaggacuaaagaggggagaaaccacaagacacgcugucucucgaggcacagccaaauuaagaugguuugucgagagaaauuuaguaaaaccugaagggaaaguaauugaccuagggugugguagaggaggaugguccuacuacugugcaggucuaaagaaggugacugaaguuaaaggauauacaaaggguggcccugggcaugaggaaccuauuccuauggcuacuuauggauggaaccugguuaaguugcacaguggaaaagacguauucuuuacacccccagaaaaaugugacacuuuguuaugugauauaggggaaucaagcccuaacccaacaauagaggagggccgaacacugagaguuuugaaaaugguagaacccuggcuccgaggaaaucaauucugcauuaaaauuuugaauccuuacaugccaaguguaguggaaacauuagaacagaugcaacguaaacacggaggaaugcuagugaggaacccauuaucucgcaacucuacacacgaaauguauuggguaaguugugguacaggaaauauuguuucagcaguaaacaugacaagcagaauguuacuaaauagguuuacgauggcacaucggaaaccaacauaugagagagauguggaucucggagcggggacaaggcacgucgccguagaaccugagguugccaaccucgacauaauaggucaacgaauagaaaauauaaaacaugaacauaaaucaacuuggcacuaugaugaagauaauccauauaaaaccugggccuaccauggcucuuacgaaguaaaaccuucgggcagcgcaucaucgaugguaaacggugucguuaagcuguuaacgaaaccuugggacguuauuccaaugguaacacaaauugcgaugacagauacaacuccuuuugggcagcaaagaguuuucaaggagaagguagacacaagaaccccaaaagccaaacgaggaacggcccaaauaauggaagucacagcaagaugguuauggggauuucuauccagaaacaagaaaccaagaauauguacgagagaggaguuuacaagaaagguucguucaaaugcggccauaggagcaguauucguugacgaaaaucaguggaauagugcaaaagaagcgguggaagaugagagauuuugggauuuaguccagaaagaaagagaacuacauaaacaagguaagugcgcaaccuguguuuauaauaugauggguaaaagggaaaagaaacuuggagaguucggaaaagcuaaagguucuagagcaauuugguauauguggcugggcgcaagauucuuggaguucgaagcgcuuggauuuaugaaugaggaucacugguuuucacgcgaaaauagccuaucaggagucgaaggugaaggguuacauaaacucgguuauauacuucgugacaucagcaaaaucccugguggaaacauguaugcagaugacacugcagguugggacacacgaaucaccgaggacgaucuacagaacgaggccaagauuacagacauaauggaaccggaacaugcacuacuggcaacuuccauuuuuaaacuuacguaccagaauaaaguggugcgaguucaacgcccagccaaaaacggaacuguaauggauguaauaaguaggcgagaucaacgagguucuggucaagugggaaccuauggauuaaauacauuuacuaauauggaagcacaauuaauuagacagauggaaucagaagguauauuuuugccuucagaacuggaaacgccaaaucuagcggaaagaguucuugacugguuagaaaaauauggaguggaacgucucaaacgaauggcaauaucgggggaugacuguguaguaaaaccgauagaugauagauuugcgacugcucuuacugcucuaaaugacaugggaaaaguucguaaagauauaccucaaugggaaccuucaaaaggcuggaaugauuggcaacagguaccuuucuguagccaucauuuccaucaauugauuaugaaagauggccgagaaaucgucgugccgugcagaaaccaagacgaauugguaggcagggcgcgagucucccaaggagcaggauggagucuaagagaaacugcgugucuaggaaagucauaugcacagauguggcaauugauguacuuucacagaagggauuugcgauuagcggcaaaugccauuuguuccgcaguuccaguggauuggguaccaacuucccgaacaacguggucgauacacgcccaucaucaauggaugacaacugaggauaugcuaucaguuuggaauagaguguggauagaagaaaauccauggauggaagauaaaacacauguaaguaguuggggagacguuccauauuuggguaagcgagaggaccaaugguguggaucuuugaucgguuuaacagccagggcgaccugggcgucuaacauacaaguggcaaucaaucagguaagaagacuaauuggaaacgaaaauuauuuggauuauaugaccucgaugaaacgauucaaaaaugagggcgauccugagggggcucuaugguga

SEQ ID NO: 21720 - RNA, 9879 nt, Artificial Sequence
  derived and/or modified CDS sequence (opt6) from DENV-1__FJ882570__SS-prME
ucaguaacuauguuacuaauguugaugcccaccgcuuuagcuuuucaccuaacaacacguggaggagaaccucauaugauuguaacaaaacaagaaagaggaaaaagccucuuauucaaaacuucugcaggaguaaauauguguacauuaaucgcaauggacuuaggcgaacuaugugaagauaccaugacauacaaaugcccccgaauuacggaagcagaaccugaugauguugacuguuggugcaacgcuacagauaccugggugacuuacggcacauguucgcaaacaggugaacaccgccgagauaaacguucuguugcacuagcuccacauguuggacuaggucuggaaacgcggacugaaacuuggauguccagugagggagcauggaaacaaauucaaaggguagagacgugggcuuugaggcaccccgguuuuacuguaauagccuuauuccucgcacaugcaauaggaaccucuauaacucaaaaagguauaauauucauacuguuaauguuaguaacgccaagcauggcuaugagauguguaggaauaggauccagggauuuuguugagggccuuucaggugccaccuggguugauguugucuuagaacauggaucaugcguaacgacgauggcaaaagauaaaccaacauuagacaucgaacuauugaaaacugagguaacuaauccugcagucuuaagaaaauugugcauagaagcaaaaauaagcaacacaacuacggauaguaggugcccaacacagggugaagcgacacuuauggaggaacaggaugcaaacuucguaugcagacggaccuuuguggacagaggguggggcaauggaugugggcuauucggaaaaggaagccuaauaaccugcgcuaaauuuaaauguguuacuaaacuggaaggaaaaauuguacaguacgaaaauuugaaauauucuguuaucgugacaguucacacuggagaccagcaucaagugggaaacgagagcacagagcacggaaccacagccacaauuacaccacaagcaccgaccucagaaauucagcucacagacuauggugcgcuuaccuuggacugcaguccuaggacugguuuagauuuuaacgaaauggucuuacuaacgaugaaagagaaaucaugguuaguucacaaacaaugguuucucgaccuaccgcuaccuuggacaucgggugcuaguacuagccaagaaacauggaauagacaagauuuauugguaaccuuuaaaacugcucacgccaagaaacaagaaguuguaguauugggaagucaggaaggagcuaugcacacugcccucacaggagcaacggagauucagacaagugggacuacaacuauauucgcuggucaucucaaaugcagacucaaaauggauaaauuaacgcuaaaagguaugagcuauguaaugugcacggggucuuucaaauuggaaaaagaaguggcggaaacacaacacggaacgguuuuaguacaaauuaaauaugaaggcacagacgccccuuguaaaauuccguuuucaacucaagacggcaaaggugucacacaaaacggaagacucauuacggcaaauccgauaguuacagacaaagaaaaaccaguaaauaucgaagcggaaccacccuucggugaaucauauauuguaauaggcgcuggggagaaagcacuaaaacucuccugguuuaagaaaggaucauccauuggaaagauguucgaggcuaccgcgcguggagcucgccgcauggcgauauuaggcgacacugcgugggacuuugggucuauaggaggcguguucacaucuguaggcaaauuggugcaccaaaucuuugguacagcauauggaguacuauucucgggaguauccuggaccaugaaaaucgguauugguguauugcuaacguggcucggauuaaacucaagaucaacuucuuugucaaugacuuguaucgcagucggguuaguaaccuuauacuugggagugauggugcaagcagacucugguugcguaaucaacuggaaggggagagaacuaaaaugugguucaggaauauuuguuacuaacgaggugcauacguggacagagcaguacaaauuucaagcagacaguccuaaaagacuaucggcugcgauugguaaggcuugggaggaagggguauguggaaucagaagugcuacuagauuagaaaauauaauguggaaacaaauaaguaaugaauuaaaucacauacuacuagagaaugggaugaaauucacaguagucguaggagaugucguaggaauccuugcucaaggcaagaaaaugauacguccacagccaauggagcacaaauauucauggaaaaguuggggaaaggcuaaaaucaucggagccgauguucaaaauacuacguuuauaaucgauggaccuaauacacccgagugcccagacgaucaaagagcauggaacauaugggagguagaagacuacggguuuggaauuuuuacgaccaauauauggcucaaacucagagauucuuauacucaaguaugcgaccaucgauuaaugucagccgcaauuaaggauucuaaagcgguccaugcagauaugggauauuggauagaaucugagaaaaacgaaacauggaaacuugcccgcgcuaguuuuauagaagugaaaacuugcauauggccuaaaagucacacucuauggucaaauggaguacuugaaucagagaugaucauaccgaaaauauacggaggaccgauaucucagcauaauuauagaccaggguauuuuacacaaaccgcaggaccauggcauuuaggcaaauuggaacuugauuuugaccucugugaagguacaacggucguuguugacgagcacugugguaaucgcgguccaucacugaggacuacaacgguaaccgguaaaauaauacaugaaugguguugucgaucaugcacucuacccccacugagauuuaaaggcgaggacgguugcugguauggcauggagauuagaccaguaaaagaaaaggaagaaaaucuggucaaguccauggugucagcaggaaguggugaaguagauucauuuucauuaggccuucuauguaccucgaucaugauagaagaaguaaugagaucacgauggucucguaagaugcuuaugacaggaacuuuagccguauuuuugcuacuaauuaugggacaauuaaccuggaacgaccuuauacgcuuaugcauuaugguuggagcuaacgcguccgaucggaugggcaugggcacuacauaccuugcucuuauggccacauucaaaaugagaccaauguuugcagucggcuuacuauuuagacgauugacaucccgagaaguacucuuacuuacgauaggccuuagcuuaguagcaucagucgaacuacccaauagcuuagaagaacuaggcgacgggcuagccauggguaucaugauucuuaaauuacugaccgauuuucaaagccaucagcugugggcgacccuacucaguuuaacauuuaucaaaacgacucuaucauuacacuaugccuggaagacaauggcaaugguccucucaauuguuucacuuuuuccccuuuguuuaucuacgaccagccaaaagacuacauggcuccccguuuuauuaggaucacucgguugcaaaccuuugacgauguuccucauagcugaaaauaaaauuugggggcgcaagagcuggccacuaaaugaagguauuauggcagugggcgucguuuccauucuacuaucgucucuguugaagaacgacgugccccuagcaggcccguuaaucgcuggcgguauguugauagcauguuaugucauaaguggaaguucggcugaccuuagccuugagaaagcggcagaggucucuugggaggaagaagcugaacauucuggggcgagucauaauauuuuuguagaaguccaagaugacggaacaaugaaaauuaaagaugaggaaagagaugauacauuaacaauuuuacuuaaagcuacgcuuuuagccgucagcggaguauauccguuaucaauuccagcgacacuguuuguuugguauuucuggcagaagaagaaacaacgaucuggagugcuaugggauacuccaucaccaccagaaguugaaagagcagcuuuagacgacggaauuuaucgcauaaugcaacgcggauugcugggucgcagccaagugggagucggaguauuccaagaaaacguguuucacacaauguggcaugucacgagaggagcagucuuaauguaucaagggaaaagacuagaaccaagcugggcgagcgugaagaaagauuuaauaagcuacggggguggguggcgacuacaaggaucuuggaacacaggagaagaggugcaagugauagcaguugaaccaggcaaaaauccuaaaaauguacagacugcaccaggaacuuucaagacgccagagggugaaguuggcgcgauugcauuagauuucaaaccagguacaaguggaaguccuauagucaauagagaaggaaagauuguugggcuguacggaaacggaguaguuacuacaagugguaccuacguuucagccauagcacaggcgaaagcaucacaagaagguccauugccggagauugaagaugaaguuuuuagaaagagaaaccuaacuauaauggauuuacacccugggucaggcaaaaccagaagauauuuacccgcgauuguaagagaagccauaaagcgaaaacuacguacucugauauuggcucccacccgcgucguagccagugagauggcagaagcucuaaaagguaugccgauccguuaucagacuacugcaguaaaaagugagcacacaggaaaagaaauaguagaucuaaugugucacgcuacauucacuaugagacuauuauccccaguacgaguaccaaacuauaauaugauuauaauggacgaagcacauuucacugauccuaguucaauagcagcucguggcuacauuucuacacgaguagggaugggggaagcagcagccauauuuaugacagcaacaccaccggguucugucgaagcguuuccucagucaaacgcgguuauucaagaugaggaacgcgauauuccggagcgaaguuggaacucugguuacgaguggauuaccgacuucccggggaaaacaguaugguuugucccgucaaucaaaaguggcaaugauauagcuaacuguuugagaaagaauggaaaacgaguuauucaacugucacgaaaaaccuucgacaccgaauaucagaaaacuaaaaauaaugacugggacuacguugugacaacagauauaagugagaugggggcgaacuuucgcgcagauaggguaauagauccuagaagaugucuaaaacccgucauacugaaagacgggccggaaagaguaaucuuggcaggaccaaugcccguuacuguagcaagugcagcgcagcgacgcgguagaauuggacgaaaucacaauaaagaaggugaucaguauauuuauauggggcaaccauuaaacaacgaugaagaucacgcccacuggacugaagcgaaaaugcuauuagauaauauaaauacgccugaaggaauuauaccagcacuauuugaaccagaacgggagaaaagugccgcaaucgauggugaauauagguuaaggggagaagcucggaagacauucguggagcucaugagaagaggagacuugccgguaugguugaguuacaaaguagcuuccgaaggguuucaguacagugaucgaaggugguguuucgauggugaacguaacaaccagguuuuggaggaaaacauggaugucgagauauggacaaaggagggagaaagaaagaaauuaagaccgcgcugguuggacgcaagaacguauagcgacccgcuggcccuacgcgaguuuaaagaguuugcagcuggccgaaggagcgucucaggcgauuuaauauuagaaaucggaaaacuuccacaacaccugacacaaagagcgcagaaugcauuagacaaucuagugaugcuucauaauagcgaacaaggagguagggcuuaucgacaugcaauggaagaauuaccugacacuauagagacucucauguuacuagcauuaauagcaguucuaaccggaggggucacauuauucuuuuuaaguggacgaggucucggcaaaaccaguauagguuugcuuugugucauggcuucaucaguacuuuuguggauggcuucaguggaaccacauuggauagcugcaucaaucauccucgaguuuuuccuuaugguucugcuaaucccugaacccgaccggcaacguaccccucaggauaaucaacuagcauauguaguaauaggacuucuuuuuauuauucuaacaguggcagccaaugaaaugggacuacuagaaacaacuaagaaagaucuugggauaggccaugucgcaguugaaaaucaucaccacgcgacaauguuagacguugaccuacacccggccucugcuuggaccuuguaugcuguugccacuacaauaauaacuccgaugaugcgucacacaauagaaaauacuaccgcaaacaucagucuuacagcaauugcgaaucaagcagcuauacuuaugggucucgauaaaggcuggccaaucaguaaaauggauauaggaguaccacuauuagcauuaggcuguuacucacaaguuaauccacuaacucuaacagcugcaguauugauguuagucgcacacuacgccauaauugggccaggcuuacaagcaaaagccacacgcgaggcucaaaaacggaccgcugcagguauuaugaaaaacccgacaguagaugggaucguugcgauugauuuagauccaguuguguaugaugcaaaauucgaaaaacagcuaggccaaaucaugcuacuaauauuaugcacaagucaaauuuuauuaaugagaaccacuugggcgcucugcgagaguaucacccucgccacaggaccauugacuacacugugggaaggaaguccggguaaauuuuggaauacuacuaucgcuguaaguauggcaaacauauuuagaggaaguuaucucgcgggggcaggguuggcguucucucuaaugaagucgcuuggagguggaagaagaggaacaggcgcacaaggcgagacccuuggagagaaguggaaacgccaauuaaaccaacugagcaaaagcgaguucaacaucuacaaaagaucgggaauaauggaaguggauaggucagaggcuaaagaaggacuaaagagaggggaaacaacaagacaugcuguuucccguggaacagcaaaauuaagaugguuugucgaaagaaaccuugucaaaccagagggcaaaguuauugauuuaggaugcggcaggggagguuggucuuauuauugcgcaggacugaagaaagugacugaaguaaaaggauauaccaaaggagggccgggacaugaggaaccaauuccaauggcaacguacggguggaacuuaguuaaauuacauagcggcaaagauguauucuuuacaccaccugaaaaaugugauacgcuauuaugcgauauaggagagucuuccccuaauccuacuauugaagaaggaaggacccuaagaguccugaaaaugguagagccaugguuaagaggaaaucaauuuuguauuaaaauacuaaauccguacaugccaagugugguggaaacacucgagcagaugcaaagaaagcacggagggauguugguacgaaacccuuuguccagaaauucuacgcacgaaauguauuggguuaguugcggaacuggaaauauugugucagcggugaauaugacaucacguaugcucuugaacagguuuacaauggcucaucggaagcccacguaugaaagagaugucgaccuaggagcuggaacuagacacguggcaguggaaccagaaguagccaaucuagacauuauuggccagcguauugaaaauaucaagcacgagcacaaaucaaccuggcacuacgaugaggauaauccauauaaaacgugggcauaucacgguucuuacgaaguaaaacccagcggcagugcuucaucaauggugaacgguguuguaaaguuacuuacgaaaccuugggaugugauuccgaugguaacucaaauagcaaugacagauaccacucccuuuggucaacaaagaguuuuuaaagaaaaaguagauacgcggacaccaaaagcaaagaggggcaccgcucaaauaauggagguaacugcuagauggcuauggggauuuuuaucgaggaauaagaaaccgagaauuuguaccagggaggaauuuaccagaaagguccgaaguaacgcggcaauuggagcgguuuucguugaugaaaaccaauggaauagugcaaaagaagcuguugaagaugagcgauuuugggacuugguacagaaagaacgagaacuacauaaacagggcaagugcgcaacauguguuuacaauaugauggguaagagagagaaaaagcuaggagaauuuggcaaagccaaagggaguagagcgauuugguauauguggcuaggugcgagauucuuggaauuugaggcccuaggguucaugaacgaagaccacugguuuucaagagaaaauuccuuaucggguguggaaggagaaggucuccauaaauuagguuauauccuacgggauauaucaaaaauuccaggugguaacauguaugcagaugacacggccgguugggauacgcggaucacagaagaugauuuacaaaacgaagcaaagauaaccgauauaauggagccugaacaugcacuuuuagcgaccucaauauucaaauuaacauaccaaaauaaggucguaagaguucagcgccccgccaagaacggaacugugauggacguuaucagccggcgcgaucaacgaggaaguggucaaguuggcacauacggucuaaauacguucacuaauauggaagcgcaacucauacgacaaauggaaucagaaggaaucuuucuacccucugagcuagagacaccuaaccuagcugaaaggguguuagauuggcuagaaaaauacgguguagaaaggcuuaaaaggauggcgaucucaggcgaugauugcguagucaagccgauagaugacagauuugcaacagcucuaacagcacuaaaugauaugggaaagguacgcaaagauauaccgcaaugggagccaucuaaagguuggaaugauuggcaacaaguaccuuucuguucucaucauuuucaucaacuaauuaugaaggaugggagggaaauuguaguuccuugucgcaaucaagaugaacuugucggcagggcccgaguaagccaaggagccggauggagccuaagggaaaccgcauguuuaggaaaaucuuaugcucaaauguggcaauuaauguauuuucauaggcgggaucucagacuugcagcgaacgcgauuuguucugcaguaccaguugacugggucccuacguccaggacaacauggaguauacacgcgcaccaccaauggaugacgaccgaagauaugcuauccguauggaaccguguguggauagaggaaaauccauggauggaggacaaaacacacgugucuaguuggggugacguuccguaccuugguaaacgggaagaucaauggugugguagccuaauaggauuaacugcgcgagcaacaugggcuaguaacauccagguggccaucaaucagguuagaagguuaauagguaacgaaaauuaucuggauuauaugacgucaaugaaaagauuuaagaaugaaggcgauccagaaggagcgcuuugguaa

SEQ ID NO: 21721 - RNA, 9879 nt, Artificial Sequence
  derived and/or modified CDS sequence (opt6) from DENV-1__GQ199834__SS-prME
uccguuacaaugcuucuuaugcuaaugcccacugcccucgcuuuucauuuaaccacucgaggaggggaaccgcauaugauaguaacgaaacaagaaagagguaaaucauugcuuuuuaaaacaagcgccggaguaaacaugugcacuuuaauugcaauggauuugggugaauuaugugaagauaccaugacauacaaaugcccuagaauuacugaagcagaaccugaugauguggauuguuggugcaacgcaaccgauacuugggugacuuacgguaccuguagccaaacaggagaacaccgaagagacaaaagaaguguggcauuagccccacacguuggacuaggguuggaaacacggacagaaacuuggaugucaucugaaggugcguggaaacaaauacagcgaguagaaacaugggcccuaaggcauccagguuucacaguaauagcguuauuucucgcacaugcaaucggaacuucaauaacgcaaaaagguauaauuuucauacugcuaauguugguuaccccaucuauggcaaugcgauguguagguauugggucgcgggauuuugucgagggccugucaggagccacguggguagaugugguauuagagcacggcucaugcgucaccacaauggcgaaagauaaaccuacacuagauaucgaauuacuaaaaacugaggucacaaaucccgccguacuucgcaaacucuguauugaagcaaaaauaucuaauacgacaacugauucaagaugucccacgcaaggugaagccacacuuauggaagaacaagacgcuaacuuugugugccgucgaacauucguagaccggggaugggggaacgguuguggcuuauuugguaaaggaucauuaaucacuugcgcaaaauucaaauguguuacgaaauuagagggaaaaauugugcaguaugagaacuuaaaauauagcgugauaguaacuguacauacuggagaccaacaucaaguggggaaugaaagcacagagcauggaacaaccgcaacaauaaccccacaagcgcccacuagcgaaauacaacucacagauuacggugcacuaacacuggauugcucaccgaggacgggcuuagauuucaacgaaaugguguuacuaacuaugaaagagaaaagcuggcuaguacauaaacaaugguuccuggauuuaccuuuaccuuggacgucaggagccucgacuucucaggaaaccuggaauagacaagaucugcucguuacguuuaagacggcacaugccaagaaacaagagguuguaguacuugggucgcaggaaggggcaaugcacacggcguuaacgggcgccacugaaauacaaaccuccgggacaaccacaauauucgccggccauuuaaaauguagauuaaaaauggauaaauugaccuuaaaaggaaugucauacguaauguguacaggauccuuuaaauuagaaaaagaacuagcagaaacacagcacgguacaguuuugguccagaucaaauaugaagguaccgacgcaccuuguaaaauccccuuuagcacacaagaugaaaaaggcgugacacaaaauggccgcuuaauaacugcaaauccgauugugacagauaaagagaagcccguuaauauagaagcagaaccacccuuuggugaaaguuacaucguaauaggagcaggagagaaagcacuaaaacuaaguugguuuaagaaagguaguaguaucggcaaaauguucgaagcgacagcgagaggagcuagaaggauggcuauauuaggagacacggcaugggauuuuggguccauaggaggggucuucacguccguaggaaaauuaguccaccaaauauucggaacagcauauggcgugcuauuuucuggagucaguuggacuaugaaaauaggaaucggagucuuacuuacgugguuaggcuuaaauaguaggucgaccagucuaucaaugacuugcauagcaguuggacuuguuacgcuguauuugggaguaaugguacaagcugauucuggaugugugauuaauuggaaggggcgggaacuaaaaugcggcucuggaauuuuugugacuaaugagguacacacuuggacugaacaauauaaguuccaagcggauucuccgaagcgucuuagugcugcaaucgggaaagcaugggaagaagguguaugcggcauaagaucugcgacaagauuagaaaauaucauguggaaacaaauaucgaacgagcuaaaccauauucuccucgaaaacgggaugaaauuuacugucguaguuggagacgucgauggcauucuagcgcaaggcaagaagaugauaagaccacaacccauggaacacaaauauucauggaagucuuggggaaaagcuaaaauaauaggugccgauguucaaaauacaacuuuuaucauagauggcccuaacacaccugaaugcccagacgaccagagggcguggaacauaugggaaguagaagauuauggcuuugguaucuucacuacuaacaucugguuaaaauuaagagacaguuacacucaaguuugcgaccaucgccuaaugucugcagcaauuaaagauuccaaagcagugcaugcagauaugggcuacuggauagaaucagagaaaaaugagacguggaaacuagcacgagcaucauucauugagguuaaaacauguauuuggccuaaaagccauacacuuuggaguaauggaguucuggaaucagaaaugaucauaccaaagauauacggcggacccauaagucaacacaauuauaggccaggauauuuuacgcagacugcgggaccauggcauuuaggcaaguuagaguuagacuuugacuuaugugaaggaacuacagucguaguggaugaacacugcgguaauagaggaccuucacuccgcacaacaaccgugacgggaaaaaucauucaugaauggugcugucgcucaugcacucuacccccuuuaagauuuaaaggugaagaugguugcugguaugguauggaaauucgaccgguaaaagagaaagaggaaaaucuagucaaaagcaugguaucagcagggagcggagaaguagauucuuuuagccuaggacuacuuuguauuuccauaaugauagaagaaguaaugagaaguagauggucaagaaagaugcuaaugacugggacacuugcagucuuccuccuacucauuaugggacaacuuacuuggaacgauuuaauucgauuaugcauaauggugggugcuaaugcgagugaccggaugggaaugggaacaacuuaccuagcguuaauggcaacauuuaaaaugaggccaauguucgcagucggacucuuauuuagaagacuaacuucgcgugaaguacuuuuauuaacgauuggucuuucuuuaguugccaguguggaacuaccuaauucauuagaggaacuuggugauggccuagcaaugggcauaaugauucuaaaacuguugacagacuuucaaucucaucaguuaugggcaaccuuguuaagucuuacuuuuauaaaaacaacauuaaguuuacauuacgcauggaagacaauggcaaugguucucagcauuguuucguuguucccgcuaugccuaaguacuacaagucagaaaacuacaugguugcccguuuuauuaggaucacuaggguguaaaccucuuacuauguuccucauugcagaaaauaaaauuugggggaggaaaagcuggccauugaacgagggcaucauggcagucggaguugugucaauucuauuaucaucgcuucucaaaaaugacgugccauuggccggaccuuuaauagcaggagguaugcuaauagcauguuauguaauaagcggaagcagcgcugauuuaaguuuagagaaagccgccgaagugagcugggaagaagaggcagaacauucaggcgcgagucauaacauccuuguagaaguacaagaugacgggacuaugaaaauuaaagaugaggaaagagaugacacacuaacgauucuccuuaaagcgacguuauuagccguauccggcgucuauccacuuaguaucccagcaacccuuuucgucugguauuuuuggcagaagaagaaacaaagaaguggcguguuaugggauacuccuucuccacccgaggucgaacgugcgguguuggaugauggaauauauagaauuaugcaacgaggcuuauuagguaggucucaaguuggcgucgguguauuccaagaaaaugucuuucauacaauguggcauguaacgcgcggagcgguucuuauguaucaagguaagagauuagaaccaucgugggcgucuguuaagaaagaucugaucucauacggaggcggauggagauuacagggaucauggaacaccggugaggagguucagguaauagcuguugagccuggcaaaaauccgaaaaacguccaaacggcuccugggacguuuaaaaccccagaaggagaagucggugccaucgcuuuggauuuuaaaccaggcacuucugggucaccaauagucaacagagaaggaaagauugucggacuuuaugguaaugguguagucacgaccucagggacauauguaagcgcaauagcccaggcuaaagcaagccaagaaggcccuuuaccagaaaucgaagacgaaguuuucagaaaaaggaauuugaccauaauggaucugcacccuggaucaggaaaaacacgaagauaccuuccugcaaucgucagagaagcaauuaaaagaaaacuacgaacauuaauccucgcgccuacucgagucguagccagugaaauggcagaggcacuaaaagguaugccaauuagauaucaaacgaccgcugugaaaagcgaacauacugggaaagagauuguggaucuuaugugucacgcgacauucacaaugcgccugcuaucaccaguucgaguaccaaauuauaauaugauaauaauggacgaagcacauuucacugauccaagcucgauugcagccaggggcuacauuuccacgagaguaggaaugggagaggcagccgcgaucuucaugacagcuacuccaccaggaucuguugaagcauuuccacaaaguaaugcggugauccaagacgaagaacgagauauaccagagagaucauggaauagcggauacgaauggauuacagauuucccagguaaaacgguaugguucgugccuaguauaaaaaguggaaaugacaucgccaauugucucaggaaaaacggaaaaagaguuauacaauugucaaggaaaacauucgacacagaguaucagaaaacuaagaauaaugauugggacuauguaguaacgacugauauauccgaaaugggagcaaauuuccgagccgacagaguaaucgauccacgccgauguuuaaaaccuguaauacuaaaggauggccccgaaagggugauucuagcaggccccaugccuguaacugucgcaagugcggcgcaaagacgaggaaggauaggaaggaaucauaacaaagagggagaccaauauaucuauaugggucaaccgcuuaacaaugaugaagaccacgcccacuggacggaagcuaaaauguugcuugauaauauaaauacacccgaagguauaauacccgcacuuuuugaaccggagcgggagaaaucagcagcaaucgauggcgaauaucgguuaaggggugaagcgaggaaaacauuuguagaacucaugaggcgaggugacuuaccaguauggcuaucauacaaaguagcaagugaggguuuccaauauagcgaccgacgauggugcuucgauggagaacggaauaaucagguacuugaagaaaauauggacguagagauauggacuaaagaaggagaaaggaagaaauuaagaccgcgcuggcuagacgcacggacauacucugauccccuagcucuacgggaauuuaaagaguuugcagccggcaggagaaguguaucaggagauuuaauucuugaaauaggaaaauuaccccagcacuugacccagagggcucaaaaugcccuagauaaucuagugaugcuacauaauuccgaacaaggcggacgagcauaccgccacgcaauggaagaacucccagauacaauagagacacuaaugcuacucgcucuaauugccguacuaacaggaggagugacacuuuucuuccuaucaggccgaggauuggggaagacuagcauaggguuguuaugugucauggcuuccaguguauuacuauggauggcuucaguggaaccgcauuggauagcggcaucuauuauuuuagaguucuucuugaugguauugcuaaucccagagccagauaggcaacguacaccucaagauaaccaacuggcauauguaguaauuggcuuacuguucaugauuuugaccguugcugcgaacgagaugggauuacuggagacgacgaagaaagacuuaggaauaggacacguagcuguagaaaaccaccaccacgcgacaauguuagauguggacuuacauccagcaucggcauggacguuguaugcuguggcaaccaccauuauaacacccaugaugcgucauacuauagaaaauacaacugcgaauauaaguuuaacugcuaucgcuaaucaggcagcgauucuaaugggccuagauaaagguuggcccauaucuaagauggacauuggcgucccacuuuuagcacuagguuguuauucacagguaaacccauuaacacugaccgcugccguucuaaugcuaguagcacauuaugcaauaaucgguccuggauuacaagcaaaggccacucgugaagcacagaaaagaaccgcagccggaauuaugaaaaauccaacuguggacggcaucguagcuauugacuuagauccggucguuuaugacgcaaaauucgaaaagcaacuugggcaaauuaugcuucuaauacuauguacaucucaaauauuauugaugcguacuaccugggcuuuaugcgagagcauuacauuggcuacggguccauuaacaacacucugggagggaagcccuggaaaauuuuggaacacaacaauagcaguuaguauggcgaacauauucaggggcucguauuuagcaggagcgggguuagcauuuuccuuaaugaagucauuaggaggcggaagacgggggacuggggcccagggugaaacacuaggugaaaaauggaagcgacaacugaaucaguugaguaaaagugaguuuaauauuuacaagagaucagguauaauggaaguagaucgaucggaagcaaaggaaggauugaaacgaggugagacaacuaggcaugcaguuucaagaggaacagcaaaauugagaugguuuguagaaagaaacuuaguaaaaccggaaggaaaaguaauugaucuaggaugcgggagaggagguugguccuauuacugugccggucucaagaaaguaacagagguaaaagguuauacaaaagggggaccuggccaugaagaaccgauaccaauggcaacuuauggguggaauuuaguuaaguuacacucuggaaaagauguauucuuuacgcccccugaaaaaugugauacuuuauuaugcgauauuggagaaaguucacccaauccgacuaucgaagaaggacgaacacuacgaguccuuaaaaugguggaaccaugguugagaggaaaucaauucuguaucaagauccugaaucccuacaugccuucaguagucgaaacguuagagcaaaugcaacgcaagcauggaggaauguugguucgcaaucccuuaucccggaacucaacacacgaaauguauugggugaguugcgguaccgguaacauaguaucagcagucaauaugacuucacggauguuguuaaaccguuucaccauggcacaucguaaaccuaccuacgagagagauguagaucuaggagccggcacgagacaugucgcaguagaaccggaaguagccaacuuggacauaauuggacaaagaaucgaaaauauuaagcaugaacauaaaaguacauggcauuaugaugaagauaauccuuauaaaaccugggcguaccacgggucauaugaagucaaacccaguggaagcgcaucaaguaugguaaaugggguugugaaauuauugaccaaacccugggauguaaucccaauggucacacagauagcaaugacugauacgacaccuuuuggccaacaaagaguauuuaaagagaaagucgacacuaggacucccaaagccaaaagagggacagcucaaaucauggaaguaacagccagauggcuguggggauuuuugaguagaaacaagaaaccucguaucugcacuagagaagaguucacucgaaaaguucgaucaaaugcagcaauuggagcagucuuuguagacgagaaccaauggaacucugcaaaagaagccguugaagaugaaagauuuugggaccuugugcaaaaagagcgagaacuacauaaacaaggaaaaugcgccacauguguauacaauaugauggguaagcgcgagaaaaagcucggagaguucggaaaagcaaagggaucuagagcgaucugguauaugugguugggggcgagauucuuagaguucgaagcguuagguuuuaugaaugaagaucacugguucagccgagagaacucucuaagcggaguggagggggaagguuuacauaaacuagguuacauacuuagagauauaucuaaaaucccuggaggaaacauguacgcagacgacacagcggguugggauacacguauaaccgaagaugaucuccaaaaugaagcaaaaauuacagauauuauggaaccagaacaugccuuacuugcuacaagcauauucaagcuaacuuaucagaauaaggugguaaggguacaaaggcccgcgaaaaacggaacagucauggauguuauuagcagaagagaucagcgagguucuggucaggucggaacuuauggacuaaacacauuuaccaacauggaagcacaauugauuagacaaauggaaagcgaagggauauuucucccaagugagcuggaaacacccaaccuugcugaacgaguucucgauuggcuggagaaguacggaguagagcgucuaaaaaggauggcgauuucgggagaugauuguguagugaaaccuauagaugaucgguuugcaacagcccuaacagcgcuuaacgauauggggaagguuagaaaggacauuccucaaugggagccaucuaagggauggaaugauuggcagcaagucccuuucuguagccaucauuuccaucaauugauaaugaaagauggccgugagauuguuguucccugcagaaaccaggaugaacuggucggcagagcaagaguaucgcaaggcgcuggguggucacuaagggaaacagcaugccuagguaaaucauaugcacaaauguggcaauuaauguacuuccacagacgagacuuaagauuagcggccaacgcuauuuguagugcggucccaguagacugggucccaaccaguagaacgacauggaguauacaugcacaucaucaauggaugacuacggaagacauguugagugucuggaaucguguauggauugaagaaaauccguggauggaagacaaaacgcaugucaguucauggggugauguucccuaccuaggaaaacgagaggaucaguggugcggauccuuaaucggcuuaacagcaagagccacaugggcaucaaauauucaaguugcuauaaaccaaguaagaagacugauagguaaugaaaacuacuuagacuacaugacuucuaugaagcgcuucaaaaacgagggugauccggaaggcgcacucugguaa

SEQ ID NO: 21722 - RNA, 9879 nt, Artificial Sequence
  derived and/or modified CDS sequence (opt6) from DENV-1__GQ199835__SS-prME
uccguaacuauguuacugaugcuaaugccuacugcgcuugcauuucauuugacaacuagagggggcgagccacacaugauagugaccaaacaagagagaggaaaaucacuacucuuuaaaacaucggcagggguaaauauguguacccuuauugcgauggaccuuggagaacucugugaagauacaaugaccuauaaauguccccggauaacagaagccgaaccagaugauguugauuguugguguaacgcaacagacacauggguaacguacgguacaugcucacaaacuggagagcauagaagagauaaaagaaguguagcuuuagcuccucauguugguuuaggauuggaaacuagaacggaaacauggaugagcagugaaggagcuuggaaacagauucaacgcguagaaacaugggcucuaagacacccaggauuuacuguaauagcuuuguuccucgcacaugcgaucggaacaaguauaacucaaaaagguauuauauuuauuuuguugauguuagucacgccgucaauggcaaugagaugcgucgggauagggucgagagacuuuguugaggguuuaucuggugcaacaugggucgauguaguccuugaacauggaucgugugucacaacuauggccaaagacaaaccaacacuagauauugagcuauuaaaaacggaagugacuaauccagcuguauugagaaaauuguguauagaggccaaaauaucuaauacaaccacagauucuagguguccuacucaaggugaggcuacacuaauggaggagcaagaugccaauuuuguaugccgacggacauuuguugaccgggguuggggaaauggaugcggacuuuuuggcaaaggcagucugauaacaugugccaaauuuaaauguguaacuaaacucgaagggaaaauaguucaauacgaaaacuuaaaauacucuguaaucgucacuguacauacuggagaucaacaccaagucggcaaugaaagcacugaacacgggacaaccgcaacuaucacaccacaagcuccaacgucagaaauccaauuaacagacuacggugcccuaacucucgauugcucuccacgaacaggcuuagacuucaaugaaaugguauuauuaaccaugaaagaaaaaucuugguuaguacauaaacaaugguucuuagacuugccuuugccuuggacaaguggagcgagcaccagucaagaaacuuggaacagacaagaccuguuaguuacuuuuaaaacagcucaugcuaagaaacaggaaguaguagucuuaggaucgcaagagggcgcuaugcacacagcacuuacaggagcaacugagauccaaacgucugggacaacaacaauuuuugcgggacaucuuaaauguagauuaaaaauggauaaacuuacccuaaaagguaugaguuauguaauguguacagguucguucaagcuagaaaaggaaguggcggaaacacaacacggaacuguauuaguccaaauuaaauaugaagggaccgacgcgccauguaagauaccuuucucgacccaggaugagaaaggagugacgcaaaauggucgacucauuacagcgaauccaauuguaaccgacaaagagaaaccagugaauauugaagcugagcccccguuuggagaaucguauauuguaauuggcgccggagagaaagcccuaaaauuaaguugguuuaagaaaggaucgucaaucggaaaaauguucgaagcaacugccaggggagcacgacguauggcuauacuaggugauacggcaugggacuuuggcucgaucggaggugucuucacgucuguugggaaguugguacaccagauuuuuggcacagcguauggaguacucuucaguggugucucuuggacuaugaagauagguauaggaguucucuuaacaugguugggacugaacagucgaucgacaucacucucaaugacuugcauugcagugggacuuguuaccuuguauuuaggaguaaugguucaggcagacucaggaugcguuaucaacuggaaaggaagagagcucaaauguggcucuggaauauucgugacaaacgaggugcacacuuggacggaacaauacaaguuucaagcagauucacccaaacgauuaucagcagcuauugggaaagcgugggaagaagggguuugcggaauuagaagcgcuacaagacuugaaaacauaauguggaaacaaauuucuaaugaauugaaucacauacuucuagaaaacgacaugaaauuuacggucguugucggugauguuguggggauauuagcucaaggcaaaaagaugauaagaccucaacccauggagcacaaguauucuuggaagaguuggggaaaagccaagauuauaggugcugacgugcaaaauacaacuuuuaucauugacggacccaauacaccagaaugcccagacgaccaacgagcuuggaauauuugggagguagaggacuacggcuuuggaaucuuuacuacgaauaucuggcuaaagcucagggauuccuacacucaagucugugaccacagacuuaugagugcugcgauaaaagauucaaaagcuguacaugcugacauggguuauuggauagaaagugaaaagaacgaaacauggaagcuggcacgggcuucguuuaucgaaguaaaaacaugcauuuggccaaagucucauacauuguggucgaacggcguacuggaaagugaaaugauaauuccaaagauuuacggagggccaaucagucaacauaauuauaggccaggauauuucacacaaacagcuggaccuuggcauuuagguaaguuagaauuagauuuugaucuuugcgaaggaacaacuguaguaguagaugagcacugugggaacagggggccaucuuuaagaacaacaaccgucacugggaaaauuauacaugaaugguguuguagaucauguacacucccuccauuaagauucaagggcgaggauggauguugguacgggauggagauucgaccuguaaaggagaaagaggagaaccuagucaaaaguaugguguccgcugggucuggagaaguagauucguuuagccuaggauuacuuugcauuaguaucaugauagaggaaguuaugaggagccgcuggucaaggaaaaugcuaaugacagguacacuugcugucuuuuuauuacuuaucauggggcaauuaacguggaacgaucugauacgccucuguaucaugguuggagcaaacgcaucugaccguaugggaaugggaacaacguaucuuacauuaauggcuacguuuaaaaugagacccauguucgcuguaggacuguuacuuaggcgacugacgagcagagagguauuguuacuaaccauuggauuaaguuuaguagcuagcguggaauuaccaaauagccuagaggaacuaggugauggccuagcuaugggaauuaugauacugaaauuauugacagacuuccagucucaucagcuuugggcaacccuguuaucauuaacauuuaucaaaacaacucuaagccuccacuacgcuuggaagacuauggcaaugguauuaagcauaguuagcuuauuuccacuaugcuuaagcacaacaagccaaaagacaacuuggcuuccaguacuccuugggucuuuaggcuguaaaccacuaacaauguuccuaauugcagaaaacaagauauggggaagaaaaaguuggccacugaaugaggguauuauggcaguuggaguugugucaauucuguuauccucgcuacucaaaaaugauguaccacucgccgguccacuuauagcgggugggauguuaauagcuuguuacgugauaucaggaucuagugcggaccuuaguuuggaaaaagcagcggaagucagcugggaagaagaagcugagcacaguggcgccucacacaacauauugguagaaguccaagaugauggaacaaugaaaauaaaggacgaagaacgagacgauacgcuaacaauauuacugaaagcaaccuuguuggcgguuucuggaguuuacccacugagcauuccagcuacuuuauucguuugguauuuuuggcagaagaagaaacaaagaucuggaguacuaugggauacuccgucuccgcccgaaguagaacgugcaguguuagaugacggaauuuaccgaauaaugcaaagagguuuguuaggcagaagucagguaggugucgggguguuucaagaaaauguguuucacacgauguggcauguaacccggggagcugugcuuauguaucagggcaaacgccuagaaccgucaugggcaucugucaagaaagauuuaaucaguuaugguggaggguggcgcuugcaagggucguggaauacuggugaggagguucaaguaauagccguagagccagguaaaaauccuaaaaacguacaaacagcgccugguacguuuaagacaccugaaggagagguaggugcuauagcacuagauuuuaaaccagggaccagcggaucacccauaguuaauagagaagguaaaauuguaggucuuuacggcaauggggucguaaccacauccggaacauaugugagcgccauagcucaagcuaaagcaucacaggagggcccauuaccagagauugaagacgaaguguuuaggaaaagaaaucugacuauaauggacuuacaccccggcucagggaaaacuagaagauacuuaccagcuauaguuagagaggcaaucaaaagaaaauuacggacacuaauucucgcuccaacgagaguaguugcuucagaaauggcagaggcauuaaaagguaugcccauuagauaucaaacgacugcuguaaaaucggagcacaccggaaaggagauagucgauuuaaugugucaugcuacauuuacaaugcggcuauuaaguccgguuaggguaccaaauuauaauaugauaauaauggaugaagcacauuuuacagacccuucuucaauagcagccagaggauauauaaguacuagaguaggcaugggggaagccgcggcaauauuuaugacagcaacacccccaggaaguguugaagccuucccccaaucuaacgcggucauacaagaugaagaaagagacauccccgaaagaucauggaacuccggguaugaguggaucacagacuuuccugguaaaacagugugguuuguaccgagcaucaaaucugggaaugacauagcaaauugucuucggaaaaauggaaaaagagucauccaauugagcagaaagacauuugauacagaguaucagaaaacuaaaaauaaugauugggacuaugucguuacaacagauauaucggaaaugggcgcgaauuuccgugcagaucgaguuauugacccaaggcggugcuugaaaccggucauccuuaaggauggcccagaacgcguuauccuugcaggccccaugccagucacaguugcaucagcugcacaaaggagggguagaauaggcagaaaucauaacaaagagggugaucaauauauauacaugggacaaccacuaaauaacgacgaagaucaugcacauuggacagaagccaagaugcuccuugauaacaucaauacgccggagggcauaauaccggccuuauuugaaccugaaagggagaaaagcgcugcaauagauggugaguaucggcuuagaggggaagcgagaaaaacguuuguagaacuuaugagacgcggagacuuaccgguauggcucucauauaaaguagcgucagagggcuuccaauacagugacagaaggugguguuuugacggcgagagaaauaaccaagucuuggaggaaaauauggauguagagaucuggacuaaagaaggcgaaaggaagaaacugcgcccaagaugguuagacgccagaacuuacucagauccacuagcccuucgggaauuuaaagaauuugcagcagggcguaggagcgucagcggagaccuaauucucgaaaucggaaaacuuccacagcaucucacucagagggcccagaaugcacucgacaacuugguaaugcuacauaauucagaacaaggagggcgggcuuaucgucaugcaauggaagaacuaccugauaccauugaaacucuaauguuacuagcucuuauagcgguacuuacuggaggggugacccuauucuuucugucggggagagggcuaggcaagaccaguauaggacuacuaugcgucauggcauccaguguucuauuguggauggcaagcguagaaccccacuggauagcagcaagcauuauacuagaauuuuuccuaaugguacugcuaauaccagaaccugauaggcaaagaacaccacaagacaaucaacuugcuuauguuguuauagguuuacuuuucaugauucucacaguugcggcuaacgagaugggacuauuagaaacuacuaagaaagaccuagguaucggacacguugcugucgaaaaccaucaccacgcaacaauguuggacgucgaccugcauccagcaagugcauggacucuuuaugcaguggcuacuacuaucaucacgccaaugaugcgacacacaaucgaaaauacuaccgcaaauauaagucuaacagcaauugcaaaucaagcagcaauuuuaaugggguuagauaaaggauggccaaucucuaagauggauauaggcgugccucuacucgcauuagguugcuauucacaagucaauccuuuaacauugacagcagccguguuaaugcuaguagcucacuacgcaauuauaggcccagguuugcaggcaaaagcuacacgagaagcccaaaagcggacugcagcaggaauuaugaaaaauccaacagucgauggaauaguagcgauagauuuagacccaguaguuuacgaugcuaaauucgaaaaacaacuaggucagauuaugcuacuaauauuauguacgagccagauccuucuuaugagaacuacaugggcuuuaugcgaaaguaucacacuagcuacggguccacuuacaacacuaugggaaggcucaccgggaaaguuuuggaauacgacaauagccgugucuauggcgaacaucuuccggggcaguuauuuagcaggagccggcuuagcuuucagcuugaugaagucauugggcggaggaagacggggcaccggcgcccagggagaaacuuugggagaaaaauggaaaaggcaguugaaucaacugucaaaaucugaguuuaacauuuauaaacgcagcgggauaauggaaguagaucguagugaagcuaaagaagguuuaaagcgaggagagacaacucggcaugccguuucacgcggaacagccaaauuaaggugguucguugaaagaaaucuuguaaaaccagaaggaaaagugauagaucugggaugugguagaggaggauggucauauuacugcgcugggcuaaagaaaguuaccgaaguaaagggauauacgaagggagggccagggcaugaggagccaaucccaauggcuacuuauggcuggaaccuaguuaaacuucacagcgguaaagauguauucuuuacuccacccgaaaaaugcgacacccuacuuugugauauaggcgaaucaucucccaaccccaccaucgaggagggucgaacucuucgaguacuaaaaaugguagaaccauggcuaagggguaaucaguucuguauaaaaauuuugaauccauacaugccuaguguaguagaaacccuagagcaaaugcaacgaaaacauggaggcauguugguuaggaauccacuuucacggaacagcacgcacgaaauguacuggguuaguugcggaacugguaauauaguaucagcugugaacaugacaaguaggauguugcugaacagguuuacaauggcgcauagaaaacccacauacgaaagggauguggaccuuggagcaggaaccaggcauguggcaguugaaccagagguagcaaacuuagauauuaucggccaacgcauugaaaauauaaaacaugagcauaaaagcacauggcauuaugaugaggauaauccguauaaaaccugggcauaccaugguagcuacgaaguaaaaccaagugguucggccucaagcaugguaaauggugucguuaagcuauuaacaaagccaugggauguaauaccaaugguuacacagauagcaaugacggauacaacuccauucggucagcaacgaguauucaaagaaaaaguggauacucgaacaccuaaagccaagcgggguacggcucaaauaauggaagucacugcgagaugguuauggggcuuuuugucucgcaacaagaaacccaggauauguacgcgcgaagaguucacaagaaaaguuagauccaacgcggcuaucggugcaguuuucgucgaugaaaaucaguggaacucggcuaaagaggcgguggaagaugagcguuuuugggaucucguucaaaaagaaagagagcuacacaagcaaggcaaaugcgcaacauguguauauaauaugauggggaaacgugagaagaagcuaggagaguucggaaaagcaaagggaucacgugccaucugguauauguggcuaggagccagauucuuagaguucgaagcacuggguuuuaugaaugaagaccauugguuuagccgugagaacucuuuauccggaguagagggugaagguuuacauaaauuagguuauauucuccgugacauuucaaaaauacccggaggaaacauguaugcugacgauaccgcggguugggauacccguauaacugaagacgauuuacaaaaugaagcaaagauaacagauauuauggaaccagagcaugccuuauuagccacaucuaucuuuaaauuaacauaucaaaauaaaguagucagagugcagagaccggccaaaaauggcacaguuauggauguaaucucucggcgagaucagcgaggaucuggacaaguaggcacuuacggacugaacacauuuaccaauauggaagcucaauugauacgacaaauggagagugagggaauuuucuugccuucggaguuggaaacgccgaauuuagcagagagaguguuagacugguuggaaaaauaugguguagaacgacucaaacgaauggcuauuucuggugaugauugcgucguuaaaccgaucgacgacagguucgcgacugcacucaccgcucuaaaugauaugggaaaaguuagaaaagauauaccccaaugggaaccaucaaaaggauggaacgauuggcagcaaguuccuuuuuguagccaccauuuccaucaacuuaucaugaaggaugguagagaaauaguaguuccuuguagaaaccaggaugagcugguagguagagcacgaguuagucaaggcgcggguugguccuuaagagaaacagcaugccuuggaaaaucauaugcacaaauguggcaauugauguauuuucacagaagagaucugcgauuagcagcaaacgcuauauguagugccgugccaguugauuggguaccaaccagccguacuacauggaguauacaugcgcaccaucaauggaugacgacagaagauauguuaucuguauggaaucggguauggauagaagaaaacccauggauggaagauaaaacucacguuucauccuggggcgacgucccauaccuaggaaaacgagaagaccaaugguguggcucguuaaucggauuaacagcaagggcuaccugggcaucuaauauacagguugcuauaaaucaagugaggagguugauaggaaaugaaaauuacuuggauuauaugacaucgaugaaaagguuuaaaaaugaaggagauccggaaggagcauuaugguag

SEQ ID NO: 21723 - RNA, 9879 nt, Artificial Sequence
  derived and/or modified CDS sequence (opt6) from DENV-1__FJ898386__SS-prME
agugucacuaugcuucugaugcuaaugccuacugcauuagcuuuccauuuaaccacccgagguggggaaccucacaugauagugacaaaacaagaaagggguaaaucccuacuuuuuaaaacaagugcgggcguaaauaugugcaccuuaauugcaauggacuuaggugaacuaugugaagauaccaugaccuauaaauguccucgaauaacugaagcugaaccagaugauguagauuguuggugcaaugccacagacacauggguuacguaugguaccugcucacaaacuggugaacacagacgcgacaaacgaucaguggcauuagccccucacgucggcuuagguuuggaaacacguacagagacauggaugagcucagaaggggcauggaaacaaauacaacgaguggaaacaugggcuuuacgacacccuggguuuacagucauagcacuuuuccuagcacaugcaauaggaacaaguauaacccaaaaagguauaaucuucauccuauugaugcuggucacaccgaguauggcaaugagauguguuggaaucggaaguagagauuuuguagaaggccuuagcggagcgacuuggguggauguaguccuugaacacggaucuugcguuacaacuauggcuaaagacaaaccgacucucgacauagaacuucugaagacagaagugaccaaccccgcaguguuaaggaagcuauguaucgaagcaaaaauaucaaauacaacuacagacucgaggugccccacccaaggcgaagcuacucucauggaagaacaagacgcaaauuuuguauguaggagaaccuuuguagauagaggaugggguaacgguuguggucuguuugggaaagguucauuaauaacaugcgcgaaauuuaaaugugucacgaaauuagagggcaaaauaguucaauaugaaaacuuaaaguauucaguuaucguaacgguucauacaggcgaccagcaucagguagguaaugaaagcacagaacacgguacgacugccaccaucacgccucaagcaccgaccagugaaauucaauugaccgauuauggagcacuaacguuagacugcucuccuaggacaggcuuagauuuuaaugaaauggucuuauugaccaugaaggagaaaaguugguuaguucauaaacagugguuuuuagauuugccacucccguggacuucgggggcuagcacgucacaagaaaccuggaaucgucaagaucucuuggugacauuuaaaacggcgcaugccaagaaacaagaaguaguaguacuagguucacaggagggugcaaugcacacagcacuaacuggcgcaacagagauucaaacaaguggaacaacaacuauuuucgcuggccaccuaaaaugccgccucaaaauggauaaguuaacauugaagggaaugucauaugucaugugcaccggaaguuuuaaauuagagaaggaggucgccgaaacgcaacacgggacugucuuagugcaaauuaaguaugaaggcacggaugcucccugcaaaauaccauuuucuacucaagacgaaaaaggcgugacucaaaacggacgacuuauaacggcaaauccgauagucaccgauaaagaaaaaccuguuaauauagaagcggaaccaccauuuggagaaaguuauauugugauuggagcuggcgaaaaagcucuaaaauugaguugguucaagaaaggaucaucaaucgguaaaauguucgaagcaaccgccagaggcgcuagacgaauggcgauccuuggugauaccgcuugggauuucgggucuauugguggcguuuuuacuuccgucggaaaguugguucaccaaauuuuugguacagccuauggugugcuuuuuaguggcguauccuggaccaugaaaauuggaauaggcgugcuauugaccuggcucggucucaacuccagaagcacaaguuugaguaugacaugcauagcugugggcuugguuacacuauaccuaggaguaaugguccaagcugacucagggugcguuauuaauuggaaaggacgggagcuuaagugcggauccgggaucuuuguaaccaaugaaguacacacuuggacugaacaguauaaauuccaggcugauucccccaaacgauugucggcagcgauaggcaaagcaugggaggaaggaguaugcggcauacgaagugcgacccgccuggaaaacauaauguggaaacaaaucucaaaugaauugaaccauauuuuauuagaaaacgauaugaaauuuacgguaguaguuggggauguaguagguauccuugcccaggggaagaaaaugaucaggccacaaccuauggaacacaaguauucauggaaaucguggggcaaagccaagauuauaggagcagauguacaaaauacgaccuucauaauugacggcccaaauacaccagaaugcccagacgaccaaagagcguggaauaucugggaaguagaggauuacggcuuuggcauauuuacaacaaacauuuggcuaaagcuacgcgacagcuauacccaaguaugcgaccauagacugaugucugcagcuauaaaagacagcaaagcgguccaugcagacaugggguacuggauugaaagcgagaaaaaugagacauggaagcuggccagggcuucauuuaucgagguaaaaacauguauauggccaaagagucacacacucuggucaaauggaguauuggaaucugagaugauuauaccaaaaauauacggugguccuauaucacaacacaauuauaggccagguuacuuuacucagacugcgggcccuuggcauuuaggcaaacuagaacuagacuuugaucuaugcgaaggaaccacaguuguagucgaugagcauugcggaaaucggggcccuagucuucgaacuacuacuguuaccggaaaaauaauucaugaguggugcuguaggaguuguaccuuaccgccucuacgauucaaaggagaagauggauguugguauggaauggagauuaggcccguaaaagagaaggaagaaaacuuaguuaagucaauggugucagcggguucgggugaaguagauucauuuucuuuaggucugcuuuguaucaguauaaugauugaggagguaaugcgcagcagauggagccgaaaaauguuaaugacgggaacuuuagcaguuuuucuucuucuaauaauggggcaauugacauggaacgacuuaauuagguuaugcauuaugguaggagcaaaugcuagcgauagaaugggaaugggcacaacuuaucuagcgcuuauggccaccuucaaaaugagaccgauguucgcaguagguuuacuuuucagaagacucacuucaagggaagugcuauuacugacgaucggauuaagccuaguugcgucuguagagcuaccaaauucccuagaggaacuuggugauggguuggcaauggguauaaugaucuuaaaacuucucacagacuuucaaucacaucaauuaugggcaacuuuacugagucugacguuuauaaagacuacauuauccuuacacuacgcuuggaaaacuauggcaauggucuuaucaaucguaucauuauuuccacuaugcuugucgacaacgucgcaaaagacgacaugguuaccaguauuacuggggagccuagggugcaaaccgcucacgauguuuuugauagccgaaaauaagauauggggucgcaagaguuggccucuaaaugaaggaauuauggcggucggcguuguaucuauacugcucucauccuugcucaagaacgacgucccgcuugcaggaccauugauagccgggggaaugcucauugcgugcuacguaaucaguggaucuagugcagaucuuucacucgaaaaggcagcugaaguuucaugggaagaggaagcggaacacucaggagcaucacauaauauccuaguugaaguccaagaugaugguaccaugaaaauaaaagaugaggaacgugaugauacccucacaauucuucuuaaagcuacuuuauuagccguaagcgguguguauccacuauccauaccagcuacauuauuuguaugguauuucuggcagaagaagaaacagcgguccgguguacuuugggacacaccaaguccacccgagguugaaagagccgugcuugaugauggcaucuacagaaucaugcagagagggcuauugggacgcucgcaaguagggguuggaguauuucaagaaaacgucuuucacaccauguggcaugucacuagaggagcuguuuuaauguaccaaggaaaaagauuggaaccaucgugggcuaguguaaagaaagauuuaauuagcuaugguggggguuggaggcuacagggaaguuggaacaccggugaggaaguacaaguuauugcuguagagccgggcaaaaauccuaagaauguccaaacagcaccaggaacguucaaaacaccugaaggcgaaguaggugcaauagcacuagauuuuaaaccagggacaagugguucuccaauaguuaaucgugaaggcaaaauaguugggcuuuaugggaauggaguugucacaacaucaggaaccuaugugucggcaauugcccaagcaaaagccagucaagaaggacccuugcccgaaauagaagaugaaguauuccgaaaacgaaaccuaacgauaauggacuugcacccgggaucugggaaaacaagacguuacuuaccagcaaucguucgagaagcuaucaaaaggaagcuccgaacguugauucuagcuccaacucguguuguagccagcgaaauggcugaagcauuaaaaggaaugccuauacguuaccagacaacugcuguaaagucugagcauacugguaaagaaauaguagacuuaaugugucacgccacauuuacaaugagauuacuuaguccgguccgcguacccaauuacaauaugauuauaauggaugaggcucauuuuacagacccgagcaguaucgcagcaagaggcuacauaucgacacgcguuggcaugggugaagcagccgccauauuuaugacugcaacaccuccgggaucuguagaagcauuuccacaaucuaaugccgugauacaagaugaagaaagagacauacccgaacguagcuggaacaguggauaugaauggauuacggauuucccaggaaaaacuguuugguuuguuccaucuauaaaaagcggaaaugacauugcgaauuguuuaaggaagaauggaaaacgaguaauccaacuaaguagaaaaacauucgauaccgaguaccagaaaacgaaaaacaaugacugggacuaugucguaacgacagacauuagcgaaaugggcgcgaacuucagagcugauagaguaauagauccgcgaagauguuuaaagcccguaauauugaaagaugguccggagagaguuauuuuggcuggcccaaugccaguaacaguagcgagugcagcccaacguaggggaagaauuggaagaaaucauaacaaggaaggagaccaauauaucuacaugggacagccauugaacaaugaugaagaucaugcgcacuggacagaagcaaagaugcuacuugauaacauaaauaccccugaggggauaaucccagcacuauucgaaccugaaagagagaaaagugcagcuauagauggugaauauagacuacgaggugaagcacgcaagacuuucguggaauuaaugcgaagaggagaccucccagucugguugaguuauaagguggcaucagaagguuuucaauacucagaucgaagaugguguuucgacggggaaaggaauaaucaagucuuagaggaaaauauggauguugagauauggacaaaagaaggagaaagaaagaaauugaggccaaggugguuagaugcccguaccuacucagacccucuagcccuuagagaguucaaagaguuugcagcagguagaagaucgguaucaggagaucuaauacuugaaauagguaaauugccacaacaucugacccaacgcgcacaaaaugcucuagauaacuugguaauguugcacaauucugaacaggguggacgagcguaucgacaugcgauggaagaauuaccagacacuauugaaacauugauguuacuagcgcucauugccgucuugacagguggagucacuuuauucuuucuaucaggucgaggacuugguaaaaccucgauaggcuuacucugugugauggccucgucaguuuuacuauggauggcuaguguagaaccacacuggauugcugccucaaucauucuagaauuuuuccuaaugguacuauuaauaccagaaccugacagacaaagaacaccccaagacaaucaauuagcuuauguaguaauaggauugcuauucaugauucuuacaguggcugcaaaugaaauggguuuguuagaaacgaccaagaaagacuugggcaucggucacguagcaguggagaaccaccaccacgcuacaauguuggauguagaccuucaccccgcgucagcuuggacucuuuaugcagucgcgacaacgauaauaacgcccaugaugagacacacaauugagaacacaacagccaauauuucguuaaccgcaaucgcgaaucaagcagcuauacuaaugggguuagauaaaggauggcccaucucaaaaauggauauagguguaccucuucuagcuuuagggugcuacagucaaguaaauccacuaacuuuaacugccgcaguguuaaugcucguugcgcauuacgcuauuauugguccagggcuucaggcaaaagccaccagggaggcgcagaaaagaaccgcagcuggaauaaugaaaaacccuacgguggauggaauaguugcuauagacuuagacccagucguauaugaugcuaaauucgaaaaacaacuaggucaaaucauguuguuaauucuuugcaccucacaaauacuacuuaugcgaacaacaugggcauuaugugaaaguaucacacuggcaacuggacccuugacaacauugugggaaggaaguccugguaaauucuggaacaccacaauugcgguauccauggcgaauaucuucagaggaagcuaccucgcuggagccggccuggcauucucgcuuaugaaaucucuuggcggcggacguagagguacuggagcgcaaggugagacacucggagaaaaauggaaacgacagcuaaaucaacuaucgaaaagcgaauuuaauauauauaagagaaguggaauaauggaaguugauagaucugaagcaaaggagggauugaaaaggggugaaacaacucgacacgcgguuucaagggguacugcuaagcuaagaugguucguagaaagaaaucugguaaagccggaaggcaagguaauagaccuuggcugcggccgaggaggguggucuuacuacugugcaggacucaagaaagugacagaagucaaaggauauaccaaaggaggaccaggucaugaagaaccgauucccauggcaacauacggauggaaucuugucaaauuacauucagguaaagauguauuuuucacacccccugagaaaugcgacacuuuauugugugacaucggcgaaucaucacccaaucccacaaucgaagaaggucgaacacuuagaguccuaaaaaugguugaacccuggcuuagaggcaaucaauucuguauaaaaauccuaaauccuuacaugccuaguguaguggaaacacuagagcagaugcagcgcaaacacggaggaaugcuuguaaggaacccguugaguagaaauuccacacaugaaauguauuggguuaguugcgggaccgguaauauaguuagugccgucaauaugacuagccgcauguuauuaaacagauuuacaauggcgcacaggaaacccacauaugaaagagacguggacuuaggugcuggaacuagacacgucgcaguugaaccagagguugcgaaccuugauauuauaggucaacgcauagaaaacauaaaacaugaacacaaaucuacauggcauuacgacgaggauaauccuuauaaaacaugggcauaucauggaucauaugaaguuaaaccuucugguucagcauccagcaugguaaauggcguaguuaaguuauuaacaaaacccugggauguuauuccaaugguuacgcaaauagcaaugacagacacgacgccuuuugggcagcagcgaguauucaaagaaaaggucgauacgcguaccccuaaagccaaaagaggaacagcucaaaucauggaaguaacugccagaugguuguggggauuuuugagcaggaauaaaaagccgcgaauaugcacuagagaagaauuuacuagaaagguuagaaguaaugcugcgauuggagcagucuucguugaugaaaaucaauggaacagugcuaaggaagcuguggaagacgaacgauuuugggaccuaguacagaaggagcgggaacuacacaagcaaggcaaaugugcaaccuguguauauaauaugaugggcaaaagggagaagaaauuaggcgaguucgguaaagcaaagggaagccgagcuaucugguacaugugguugggugcaagauuuuuagaauuugaagcacuuggauucaugaacgaggaccauugguuuucucgagaaaacaguuuaaguggggucgagggagaaggacuacauaagcucggauacauauuacgagacauaucaaaaauuccaggcgguaauauguaugcagacgauacugcuggaugggacacgcguauaacggaggaugauuuacaaaacgaagcaaaaaucacagacauuauggagccagaacaugcucugcuagcuacaucaauuuuuaaauugacguaucaaaauaagguggucaggguucaacgucccgccaaaaauggaacuguaauggauguuauaucucgucgagaucaacguggaagugggcaagugggcacauacggcuuaaauaccuucacuaauauggaggcacaacuuauacgacaaauggaaucggaaggaauauuccuaccuucugaacuagaaacaccuaaucuagccgaacgcgucuuggacuggcuagaaaaauauggaguggaaagauuaaaaagaauggcgauuucgggcgacgacugcguuguuaagccaauagaugauagauuugcgacugcacuaaccgcauuaaaugacauggguaaaguacgaaaagacauaccacaaugggaaccaaguaaaggauggaaugauuggcaacaggucccauuuuguagccaucacuuucaucaacugauaaugaaagauggaagagaaauugugguuccuugucgaaaccaagacgagcuagucggaagggcuagaguuagccaaggugcaggauggagcuuacgggaaacggcguguuuagggaaaaguuacgcgcaaauguggcaauuaauguauuuucauagaagggaucuacgcuuagcagcaaaugcaauauguagcgcuguacccguugacugggugccuacaucgaggacaacgugguccauucaugcccaucaccaauggaugacuacagaggauauguuaaguguuuggaacagagucuggauagaagaaaauccuuggauggaggauaaaacgcauguauccucaugggaggauguaccauacuuaggaaagcgagaagaccaauggugugguucguugauuggacucacagcuagggcaacuugggcaucuaacauucaaguagcaauuaaccaagugcgccgacuaauaggaaacgagaauuaccucgacuauaugaccucaaugaaaagauuuaagaaugaaggggacccagaaggagcguuuugguag

SEQ ID NO: 21724 - RNA, 9879 nt, Artificial Sequence
  derived and/or modified CDS sequence (opt6) from DENV-1__FJ898387__SS-prME
ucgguaacaauguuauuaaugcuuaugccaacggcuuuggcuuuccauuugacgacuagagguggcgaaccucauaugaucgucagcaaacaagaacgugguaaaucccuucuuuuuaaaaccagcgcaggcguuaauaugugcacacucaucgcaauggaccugggugaauuuugugaagauacuaugacauauaaauguccucgaauuacagaagcagaaccugaugauguggauugcugguguaacgcgacagauacgugggucacauauggaaccuguucucaaacaggagaacaucgaagagacaaaagaagcguagcguuagcuccacacguagguuuaggucuugaaacacguacggaaacguggaugagcagugaaggggcauggaaacaaauacaacgagucgaaacaugggcauuaagacacccagguuucacaguaauagcacuauuuuuggcgcacgcaauagguaccuccauaacccagaaaggaauaaucuuuauucuacugaugcuagucacuccaagcauggcuaugcgauguguggggaucgguagccgugacuucguggaaggucuuagcggggcuaccuggguggauguaguguuggaacacggaucauguguuacuacuauggcuaaagauaaaccaaccuuagauauugaauuacuaaaaacugaagucaccaauccagccguacuacguaaacuuuguauagaagcuaaaauuucuaauacgacaaccgauaguagaugcccgacacaaggagaagcuaccuuggucgaagaacaagacgcuaacuucgucuguaggagaacauuuguugauagagguuggggaaauggauguggacucuuuggaaaagguucacuaauuacaugcgcuaaguucaagugugugacuaagcucgaaggcaaaacaguacaauaugaaaauuuaaaauacucaguaauagucacuguucacacuggagaucaacaccaagucggaaaugaauccacagaacauggaacaacagcaacuauaaccccacaagcuccaucgacagaaauccagcucacugauuauggugcuuuaacacuagauuguucccccagaacaggucuugacuuuaaugagaugguuuuacuaaccaugaaagaaaaaucuuggcuuguacacaagcaaugguuucuugauuuaccauuaccauggacaucuggagccaguaccucucaagaaacauggaauagaaaagaucuauugguaacauuuaaaacagcucacgccaagaaacaagaagucgugguacuaggaucacaagaaggugccaugcauacagcgcuaacaggcgccaccgaaauacaaacaagugguacgacuacaauauuugccgggcacuuaaaaugccguuuaaaaauggauaaacuaacucuaaaaggcauguccuacgucaugugcacagguucguucaaacuagaaaaagaaguugcagaaacacaacauggaaccguacugguccaaauuaaauacgaaggaaccgaugcgccguguaagauuccauucaguacacaagacgaaaagggcguuacgcagaaugggagacuuauaacugcuaauccaauaguaacggacaaagaaaagccgguuaacauagaggcugaaccaccuuucggagaaucuuacauaguaaucggggcgggugaaaaagcucugaaauugucaugguucaagaaaggaucuucaauaggaaaaauguuugaagcgacggcacggggagcccguagaauggcaauccuuggagauacagccugggauuucggaagcauuggcggaguauuuacgucagucgguaaacucgugcaccaaauauuugggacugcuuacggugucuuauucucgggcguaagcuggaccaugaaaauaggaauugguguucuucugacuugguuaggacuaaauucacgcuccacaucauuaucuaugacaugcauagcaguaggucucguuacgcuuuauuugggggucaugguucaggcagauaguggauguguaauaaauuggaaagggagagaacuaaaaugcggaucggguauuuucgugacaaaugaggugcauacauggacugagcaguauaaauuucaagcugacucaccaaaacgguuaucagcagcaauugguaaagcaugggaagaaggggugugcggcauaagaucagcuacaaggcuagaaaacauaauguggaaacaaaucuccaaugaacuuaaccacauucuucuagaaaaugauaugaaguuuacaguaguagugggcgauguugcgggcauacuugcucaaggaaagaaaaugauacgaccucaacccauggaguauaaauauucuuggaaaucauggggaaaagcuaaaauaauaggugcugauguccaaaauacaacguucauuauagacggaccgaacacaccagaaugcccugaugaccaaagagcauggaauaucugggaaguagaagauuacggauuugggaucuuuaccacuaacauuuggcugaaauuaagggauucauacacucaaguaugcgaccauagauuaaugagcgcagcuauuaaggacaguaaggcuguacaugcagauaugggcuauuggaucgaaagugagaaaaaugaaaccuggaaauuggcaagagccagcuuuauagaaguuaaaacaugcauuuggccaaaaucccauacguuauggagcaauggagugcuagaauccgaaaugauaaucccuaagaucuacggcgguccaauaagccaacauaauuacagaccaggauacuucacacaaacagcagguccuuggcaucugggaaagcuagaauuagauuuugauuuaugcgaggggacaacaguagucguagacgaacacugcgggaaucgaggcccgucucucagaacuacaaccguuaccgguaaaauuauacaugaauggugcugucggucaugcacguuaccuccacuacgauucaaaggagaggacggaugcugguauggaauggaaauccggccagucaaggagaaggaggagaaucuugucaaaagcaugguuagugcggguagcggggagguagacuccuucagcuuagggcuauuaugcauaagcaucaugauagaggaagucaugcgcucucgauggagcagaaagaugcuuaugacuggaacguuggcagucuucuuuuuacuuaucaugggccaauuaacauggaacgacuuaauacgucuuugcaucaugguaggagcaaaugcuagugaccguaugggaauggguaccacguaccuagcucucauggcaaccuucaaaaugagaccuauguucgcagugggacuccuguuccgacgucuaaccucacgagaaguacucuuguuaacaauaggucuuaguuugguagcgagcguagaauugccuaacucauuggaagaauuaggggauggguuagccaugggaaucaugaucuuaaagcugcucacugacuuccaaucacaucagcuuugggcaacauuguugucuuuaacguuuauuaaaaccacguuuucgcuucauuaugccuggaaaaccauggccaugguacucagcauaguaucauuguuucccuuauguuuaaguacaaccucgcagaaaacuacguggcuacccguucuucuuggaucgcuuggcuguaaaccucuaacuauguuucucaucgccgaaaauaagaucugggggcguaaguccuggccacuaaacgaagguauaauggcagucggaauaguaaguauauuauugaguagucucuuaaagaacgauguuccauuagcuggaccuuuaauagcuggaggaauguuaauagcauguuacguaauaagcggcucaagugcugaucuauccuuagaaaaggcugccgaagucucaugggaggaagaagcugaacauaguggcgcaucacauaauauacugguggaaguacaagaugaugguacaaugaaaauuaaagaugaagaacgcgaugauacguuaaccauauuacugaaagcgacucuacuggcgguaucagguguauauccacuuaguaucccagcaaccuuguuugugugguauuuuuggcagaagaagaaacagaggucagggguacuaugggauacaccuaguccacccgaaguagagagggcuguacuugacgauggcauauauagaauaaugcaacgagguuugcucggucguucccagguugggguuggaguauuucaggagaacgucuuucacacaauguggcacgugacucggggugcggucuugauguaucaggggaaacgucuagagccaucgugggcgagcguaaagaaagacuuaauuucguacggaggagguuggcgauuacagggaucguggaauacaggugaagagguccagguuaucgcaguagaacccgguaaaaaccccaaaaacguacaaacagcaccagggaccuuuaaaaccagcgagggugaaguaggagccauagcacuagauuucaaaccuggcacaaguggaaguccaauagucaauagggaggguaaaauagugggauuguacgguaauggaguugucacaacuuccggcaccuacguaucugccauagcucaggcuaaagcaucacaagagggacccuuacccgagauagaagacgaaguauuuaggaaaagaaaccugacgauaauggaucugcauccaggauccgggaagacaagacguuauuuacccgcaauuguucgagaagccauaaaacguaagcugagaacacuuauccuugcaccaacucggguaguagcgucagagauggccgaagcgcuaaagggaaugccaauuagguaucagacgacagcaguaaaaucagaacauaccggaaaagaaaucguagaucuaaugugccaugcaacauucacuaugagauuauugucgccggucagaguaccaaacuauaauaugaucauaauggaugaggcacauuucacggacccuaguucuauugccgccagaggauacaucaguaccagggucggaaugggggaagcggcagcuaucuucaugacggcaacgccgccuggaagcguagaggcauuuccccaaucaaaugcaguaauacaggaugaggaaagagauauaccagaacgaaguuggaacaguggauaugaauggauaacggauuuucccgggaagacaguaugguucguuccaucaauaaagucuggcaaugacauagccaacugucugagaaagaaugguaaaaggguuauucaguuaaguagaaaaacguucgauaccgaauaucagaaaacuaaaaacaaugauugggauuauguaguaacgacugauauuagugaaaugggugcgaacuuucgugcagaucggguuauugauccucgcagaugccuaaaaccaguaauucuaaaggacgggcccgaaagaguaauccuagcuggaccuaugccuguuacagucgcaagugcugcacaaaggagaggacgaauaggaagaaaccauaacaaagaaggagaucaguauauauauaugggacaacccuugaacaaugaugaggaucaugcgcauuggacugaagcuaagauguuauuagacaauauuaauacuccggaaggaauaauaccugcauuauuugaacccgaaagagaaaaaucggcagccauugacggagaauaccgguuaagaggagaagcuagaaaaacuuuuguggaauuaaugcgaagaggugauuuaccaguaugguuaaguuauaaagucgcuagugaaggguuccaguacucggaucgacguugguguuucgauggcgaaaggaauaaucaaguuuuagaagagaauauggauguagagauauggacaaaagaaggcgaaaggaagaaacuccgcccaagguggcuugaugcuaggaccuauucugauccauuagcguugagggaauuuaaagaguucgcugcaggccguagaucaguaaguggagaucugauacucgaaauagguaaacuaccacaacaucucacacaaagggcucaaaaugcacuugauaaccuaguaauguuacauaacuccgaacagggugguagggccuauagacaugcaauggaggaacucccagacacgaucgagaccuuaaugcuauuagcuuugauagcgguuuuaacaggggguguaacauuauucuuccuuagugguagaggguuagggaagacauccaucggauuauuaugcguaauggcaaguagcgucuuacuuuggauggcaaguguagaaccccauuggaucgcugcaagcauaauauuagaguucuuucuaaugguccuacugauaccagaaccagauaggcagcguaccccacaagauaaccaacuagccuaugucguaauaggcuuacuguucaugauucuuacaguagcagccaacgaaaugggucuauuggaaacaaccaagaaagaucugggaaucggacacguagcaguugaaaaccaccaucaugccgcaauguuagacgucgaucuacacccagcgucugcuuggacacuuuacgcgguugcgaccacaauuaucacaccuaugaugcgucauacaauugaaaauacaacagcaaacauaucacuaacggcgauagcgaaccaagccgcaauuuuaaugggucuggauaaaggcuggccaauauccaaaauggauauugguguuccgcucuuagcucuaggguguuauucucaaguaaauccacugacgcuaacagcggcgguucuuauguuagucgcgcacuacgcuauaauaggucccggcuugcaagcgaaggccacacgugaagcacaaaagagaacagcggcugguauuaugaaaaauccaacaguugacggcauuguugcaauagauuuagauccagugguauacgacacaaaauuugagaagcaauugggacagaucaugcucuuaauauuaugcacuucacaaauacuacuuaugcguacaaccugggcacucugugagagcauaacucucgcuacagguccccuaacuacgcucugggaggguucacccggaaaguuuuggaauaccacaauagcgguaucaauggcgaacaucuucagaggaucauaucuagcgggugcaggucuggcauucucguuaaugaagucguuagguggaggcaggagggguacaggugcacaaggcgagacauuaggagaaaaguggaaacgacaacuuaaucagcuaucuaaguccgaguucaacaccuauaagagaucuggaauaauggaaguagacagaagugaagcgaaagaaggacugaaaagaggugagaccaccaaacaugcaguauccagagguacagccaaacuaagaugguucguggaaagaaauuuagucaagccagagggaaaagugauagacuuaggaugcggaagggguggguggucauacuauugcgccggauugaagaaaguaacugaaguaaagggauacacaaagggaggaccagggcaugaagaaccaaucccaauggcaacauacgguuggaacuuaguaaaacuucacucagguaaagaugucuuuuucauuccgccagaaaaaugugauacacugcuaugugacauaggagaaagcucaccaaauccaacuauugaagaggggcgcacacuuagaguguuaaaaaugguagaaccguggcucagaggcaaccaauucuguauuaagauucucaauccauauaugcccucaguaguagaaacauuagaacaaaugcaaaggaagcauggagguaugcuugucagaaacccccuuucccggaacagcacacacgagauguauuggguaucaugcggcacugguaauaucgucagcgcugucaacaugacaaguagaaugcuuuuaaauagauuuacuauggcacaucgaaagccaacuuaugagcgugacgucgauuuaggagcggguacgcgucacguagcuguagagccugaaguggccaaucuagacaucauaggucagaggauagaaaauauaaaacacgaacacaaaaguacauggcacuaugacgaggacaaucccuauaagacuugggcauaccaugguaguuaugaaguaaaaccuagugggagcgcauccuccaugguaaaugguguaguuaaacuucucacaaaaccaugggauguuaucccaauggugacacagauagcaaugacugauacaacaccauucggucagcaacgaguguucaaagaaaaaguagacacaagaacaccgaaggcgaaacguggaacggcacaaaucauggaaguaacagccaaaugguuauggggauuuuuaucaaggaacaagaaaccucguauauguacucgagaggaguuuacacguaaaguaagaagcaaugcagcuaucggggcaguauucgucgaugagaaccaauggaacucugcaaaagaagcugucgaagacgagagauucugggauuuaguucauagagaaagggaacuacacaagcaaggaaagugugccacgugugucuauaacaugauggguaaaagagagaagaaacugggggaauuuggcaaagcuaaaggaucacgugcuauaugguacauguggcuaggugcaagauucuuagaguucgaagcgcuagguuucaugaaugaagaccauugguucucuagggaaaauucucuaagcggcguugagggugaaggacuacacaaacuuggauacauauuaagagacaucucgaaaaucccuggcggcaacauguacgccgaugauacagcgggcugggauacacgaauaacagaagaugauuuacaaaaugaggcaaaaaucacugauauaauggaaccagagcacgccuuguuagcaaaaucgauuuuuaagcuaacauaucaaaacaagguugugcguguccagcgaccagccaaaaauggcacaguaauggauguaauaaguagaagagaccaaaggggaucaggucaaguaggaacguauggcuuaaacacguuuacgaauauggaggcgcaacuuauaaggcaaauggagucugagggcauauuuagcccaagugagcuugaaacaccgaauuuagcaggacguguacucgacuggcuugaaaaacacgguguagaaagacuuaaacguauggcuaucucgggcgaugauugugucguaaaaccaauagacgauagguuugcuacugcucuaacagcauuaaaugauaugggaaaaguaagaaaagauauuccucaaugggaaccuucaaaaggauggaaugacuggcaacaaguacccuuuuguucucaucauuuccaccaacuaauaaugaaggauggaagagaaauaguuguuccaugccgaaaucaggaugaauuggucggucgcgcgagaguaagucaaggcgcuggauggucacugagagaaacggcauguuuggguaaaaguuaugcccaaauguggcaauuaauguauuuucauaggcgcgauuuaaggcucgcugcaaaugccauaugcagcgccgucccgguagacuggguuccaacaucacgaacaaccuggaguauccaugcccaccaucaguggaugacaacugaggauaugcuuaguguuuggaacaggguuuggauagaagaaaauccauggauggaagacaagacacacauaucaaguuggggagaugugccauacuuaggcaagcgugaagaucaguggugcggaucgcuaauaggauugacagcacgggcaacaugggcaacgaauauucaaguagcuauaaaucaaguaaggaggcuuauagguaacgagaauuauuuagacuauaugacgucuaugaaaagguuuaaaaacgagucggauccggaaggugcucuaugguag

SEQ ID NO: 21725 - RNA, 9879 nt, Artificial Sequence
  derived and/or modified CDS sequence (opt6) from DENV-1__FJ898389__SS-prME
ucagugacgauguuacugauguuaaugccuacggcucuugcuuuucauuuaacaacgagaggaggcgaaccucacaugauagugaccaaacaagaaagagggaaauccuuacucuuuaaaacgagcgcuggggucaauauguguaccuuaauugccauggauuuaggagaacuaugcgaagacaccaugacguacaaauguccuagaauaacugaagcagaaccagaugauguugauuguugguguaaugcaacugauacauggguuacauacgggacauguagccaaacaggugagcacagaagggauaaaaggucgguugcgcucgcaccgcacguuggacuuggauuagaaacucgaacagaaacuuggaugagcucagaaggcgcauggaaacaaauacaacguguggaaacuugggcguuaagacauccagguuuuacuguaauagcuuuauuucuagcacaugcuauuggaacaucaauuacucaaaaaggcauaauuuuuauauuguugaugcucgucacacccuccauggcgaugcgaugugucgguauaggaucccgagacuucguugaaggacuaucuggggcuacauggguugacguaguuuuagaacauggaucuugcguaacuacaauggcuaaagacaaaccaacacuggacauagaacuauugaaaacugaaguuacaaaccccgcaguauuaagaaaacucugcauugaagccaaaauuucaaauacuaccacagacucucguugcccaacccaaggggaagcuacuuuaauggaggaacaagaugcuaacuuugucuguaggcgaacguuuguagauagggggugggggaauggcuguggauuauucgggaagggcucuuuaauuacgugcgcaaaguucaaguguguuacaaaacuggaagggaagaucguccaauaugagaaucuuaaguauagcguuauugugacaguacauacgggcgaucaacaccaaguaggcaacgaaucaaccgagcacgggaccacugcaacuauaacaccucaagcaccaacuucggaaauacaauuaaccgauuauggugccuuaacuuuagacuguaguccgaggacuggauuagacuucaacgaaaugguacuuuuaacgaugaaagaaaaaucuugguugguacauaaacaaugguuuuuagauuuaccgcucccguggacguccggagcuagcacuucucaagaaacuuggaaucgucaagaccuacuuguaacuuucaaaacagcccacgcaaagaaacaagagguuguaguauugggaagucaagagggugcaaugcacacagcuuuaacgggagccacagaaauucagacauccggaacgacuacaauuuucgcaggucaccuuaaaugucgacuuaagauggacaaauugacacuuaaagggauguccuaugugaugugcacggguaguuucaaauuagaaaaagagguugcagaaacacaacacgggacaguuuuaguacagauuaaauacgaaggaaccgaugcucccuguaagauuccauucucuacccaggaugagaaagguguuacucaaaacggaaggcucauaacagcuaauccuauagucacagacaaagagaagccaguuaauauagaagcugagccgcccuuuggagagaguuacaucgugauuggagccggcgaaaaagcauuaaaacuguccugguucaagaaaggaucuucaaucgguaaaauguucgaggcgacagcacgaggagcacggagaauggcuauccuaggugauacagcaugggauuuuggcuccauuggcggagucuucacuucagugggaaaacugguacaccaaauuuucggaacagcauauggaguguuauuuucggggguuucguggaccaugaaaauaggcauaggaguacucuuaaccugguuaggacuaaauucuagaaguacaagccucagcaugacuuguauagcaguuggcuuaguaaccuuauaucuagguguaaugguacaggccgauucgggcugcgugaucaauuggaaaggacgagaguugaaguguggauccgguauauuugucacgaaugaaguccauacauggaccgaacaauauaaguuucaggcugauuccccaaaacgacuuucggcugcaauaggaaaggcaugggaagaaggaguaugcgggauaagaagugccacaagguuggaaaauaucauguggaaacaaauaaguaaugaauuaaaccacauuuuauuggaaaaugauaugaaauucacgguagucgugggggaugucguaggaauccuugcucagggcaagaaaaugauacgaccucaaccaauggagcacaaguacucguggaaaucgugggguaaggcaaaaaucauaggggcagacguacaaaauacgaccuucauaaucgaugguccuaacaccccagaguguccggacgaucagagagcauggaacauaugggaggucgaagauuacggauuugguauuuuuacaacgaauauauggcuuaaacuuagagauucauauacucaagugugcgaccauagguuaaugagcgcagcaauaaaggauucuaaagccguucacgcggacaugggauacuggauagaaucugagaagaaugaaacauggaaguuggccagagcaucuuuuauagaggucaagacaugcauauggccgaaaucacauacauuauggucuaacggaguauuagaaucugagaugauaauuccgaaaauauacggaggaccuauaucacaacauaacuacaggcccggguacuuuacccaaacagccgguccuuggcauuuggggaaauuagaauuagauuucgauuuaugcgagggaaccacuguaguuguagacgagcacuguggcaaccgaggaccaaguuuacgaacaacgacaguaaccggaaagauaauucaugaauggugcugccgcaguuguacccugccuccccucagguucaaaggagaagacggcugcugguauggcauggagauuagaccagugaaagaaaaagaagaaaaucuagucaaaucgaugguaucagcuggaaguggggaaguagauaguuucaguuugggcuugcuuuguaucaguauaaugauagaagaggucaugagaucgagauggagccgcaaaauguuaaugacuggcaccuuggcggucuucuuauuucugauuaugggacaauuaacuuggaacgaucuaauccggcucugcauaaugguaggcgcuaaugcauccgacagaauggggauggguacaacuuaucuggcccuaauggcaacauuuaagaugcgaccaauguucgcgguaggacuauuauuucgucgauugacaucacgugaaguuuuauuacuaacaaucggauuaucucuuguagcaucaguugaauuacccaauagccuagaagaguugggggaugguuuagcaauggguaucaugauauuaaaauuacuaacagacuuucagagccaccaauuaugggccacacuauuaaguuuaacauuuaucaaaacaaccuuaucauugcauuaugcguggaaaacaauggcaaugguccucuccauaguuagccuauuuccuuuaugucuaucaacgacuucacagaaaacaacuugguuaccuguauuauuaggaaguuuuggaugcaaaccacuugcaauguuucuaaucgcggaaaacaaaauuuggggacgcaaaucauggccguuaaaugaagguauuauggcugugggaguuguuaguauucucuuaagcucuuuacuaaagaaugacgugcccuuagccggaccacucauugcuggaggcaugcuuauagcuugcuacguaaucaguggaucuagugcagaucugucuuuagagaaagcagcagaaguaucaugggaagaagaggcggaacauaguggcgccucccauaauauauuaguggaaguacaagacgauggaacuaugaaaauaaaggaugaagagagagaugauacuuuaaccauauuacuuaaggcaacauuauuagcaguuucgggaguauacccucuuuccauuccagcuacauuauucguaugguauuuuuggcagaaaaagaaacaaagaagcggaguucuuugggacacuccaucuccgccagaaguggagcgggcgguccuugaugacggaaucuauagaauaaugcaaagaggucuguugggcagaucacaaguagguguugguguauuccaagaaaauguauuccauacgauguggcacguuacaaggggcgccguacuuauguaccagggaaaaagauuggagcccagcugggcuuccguuaagaaagauuuaaucuccuacggaggugguuggaggcuacagggaucauggaacacaggggaagaaguucaggucauagcaguugagccaggaaagaaccccaaaaauguacaaacagcuccgggcacguuuaaaacgccugagggcgaaguaggggcaauagcauuggauuuuaaaccagggacaagcggcaguccaauaguuaacagggaaggcaagaucguuggacuuuacgguaacggcguuguaaccacauccggcacauacguaucagcaauagcucaggcuaaagcgagccaagaaggaccgcuaccagagauugaagacgaaguauucagaaaaagaaaucuaacuauaauggaucuucauccuggaucggguaaaacacgcagauaucucccugcaauaguacgcgaagccauaaagcgaaaacuaagaacacuaauuuuggcgccuacaagaguagucgccuccgaaauggcggaagcucucaaaggaaugccuauacgguaccagacgacugcuguuaaaucggaacacaccgguaaagaaaucgucgaccugaugugccaugcuacguucacaaugagauuacuuucgccaguucgggugccaaauuacaauaugauaauaauggaugaggcacauuuuacugauccuuuuaguauugcggcacguggcuacauaagcacccgcguaggaaugggagaggcugcggcgauauuuaugacugcgacaccuccugguuccgucgaagcguucccucaguccaaugcgguuauacaggacgaagagagggacaucccagaaagaucauggaauaguggauacgaguggauaacggacuuccccgguaagaccguuugguuuguaccuucaaucaaaaguggcaaugauaucgcgaacugccuaaggaaaaauggaaagcgggucauucaacuaaguaggaaaacuuucgacacagaauaccagaaaaccaagaacaacgauugggauuaugucguaacaacggacauaagugagaugggugccaacuuuagagcagacagggucauagauccacgucgaugccugaaaccaguaauucucaaagacggaccugaaagaguaauccuagcgggacccaugccagucacuguugcuagugcagcgcaaaggagaggacguauagguagaaaccacaauaaagaaggugaccaauacauauauaugggccagccacuaaauaaugaugaggaucaugcccacuggacagaagccaaaaugcuucuggauaauauaaacacaccugaaggaauuaucccggcacuuuucgagcccgaacgagaaaaaucggcagccauagauggcgaauaucguuugaggggagaagcaagaaaaaccuucguagaacuuaugcgacguggcgaucuaccaguuugguuauccuacaagguugcaucugaaggauuccaauauucagauagacgguggugcuuugacggagaacggaacaaccaaguacuagaagaaaacauggacguggaaauuuggacuaaagaaggagaaagaaagaaauuaaggcccaggugguuagacgcucgaacuuacagcgacccacuagccuugagagaguucaaggaguucgccgcaggucgccguagugucagcggagacuuaauauuggagauuggaaaacugccacaacaccugacacaacgagcgcagaacgccuuagauaaccucguaaugcuucauaauagcgaacaaggaggcagagccuauagacaugcuauggaagaacucccugacacaaucgaaaccuugauguugcuagcacuaauagcaguacucacuggaggagugacauuguucuucuugaguggcagggguuuaggaaagacaaguauuggacuacuauguguaauggccaguagcguauuguuauggauggccucaguagaaccacacuggauugcugccagcauuaucuuagaguucuuccuaaugguacuauuaauaccugaacccgaucggcaacggaccccucaagacaaucaacucgcauauguaguuauugggcugcuguucaugauucuaacaguggcagcgaacgaaaugggguuacuugaaacaaccaagaaagaucuagggaucggccauguagcgguagagaaucaucaccacgcaacaauguuggaugucgaucugcacccugccucagcauggacccuauaugcagucgcuacaacaauaauuacgccaaugaugcgacauacuauagaaaacaccacugcuaauaucagccuaacggccaucgcaaaucaagcagcuauauuaaugggguuggauaaaggauggccaauauccaagauggauauuggcguaccuuuacuagcauuagguugcuacagucagguuaauccauugacacuaacagcugcgguuuuaauguuaguagcacauuacgcuaucauuggcccaggucuacaagccaaagcuacaagggaagcacaaaaacgaacagcagcaggaauaaugaaaaacccuacuguggaugguauuguggcaauugaccuggauccaguaguauacgaugcuaaauuugaaaaacagcuaggacaaauaaugcuguuaauucuguguacgucacagauucuuuugaugagaacaacuugggcucucugugaaagcauaacccuggccacaggcccucuaacuacauuaugggaaggaaguccuggaaaauuuuggaauacaacaauagcgguauccauggccaauauuuucaggggaucauaucuagcaggcgccggccuugcguuuucauuaaugaaaucacucgggggagguagacgaggaacgggagcacaaggagaaacacucggagaaaaauggaagagacaacuaaaccaauuaucgaaguccgaguucaauaucuauaagcggagcgguauaauggaaguugaccguucggaagcuaaagaaggcuuaaaaagaggagagacuacgagacacgccguuagucgcggaacagcuaaacuacgcugguuuguagaacguaaucuagucaaaccggaaggaaaaguuauugauuuggguugcggaagaggagguuggagcuacuacugugcugguuugaagaaagugacugaaguaaagggauauaccaaggguggaccuggucaugaagaaccaauaccgauggcgacuuacggauggaaucucguuaaauuacauagcgguaaagacguauucuuuacgccaccugaaaaaugugacacuuuacuuugcgauauaggugagaguaguccuaauccaacaauugaagagggcagaacccuuagaguccugaaaaugguagaaccguggcuacgagggaaucaguucuguaucaaaauacugaacccuuauaugccaucagugguagaaacacuggaacagaugcagagaaaacacggcggaaugcucguuagaaauccccuaucuaggaacucaacacaugagauguacugggucuccugcgguacaggaaauauaguaucugcaguaaauaugacuucccguauguuguuaaauagauuuacgauggcacacagaaaaccuaccuaugaaagagauguggauuuaggggcaggaacucgacaugucgcaguugaaccagaaguagcaaauuuagauauaauaggacaacgaaucgaaaauauaaagcacgaacauaagaguacauggcauuaugaugaagacaacccauacaaaacuugggccuaucaugguaguuacgaaguaaaacccaguggaagugccuccucaaugguaaacgguguaguaaaauugcuaacaaaaccuugggauguaauacccaugguuacucagauagccaugacugacaccacaccauucggccaacagagaguuuucaaagaaaagguugauacacgaacgccuaaagcgaaacgaggaacagcacaaauaauggaaguuaccgcccgauggcuauggggauucuugucuagaaacaagaaaccucguauuuguacgagggaagaguuuacgcgaaaaguucgcucaaacgcagcaauaggugcaguguuuguagacgaaaaccaauggaacucagccaaggaagcuguugaagaugaaagguuuugggaucucguccaaaaagaaagagaguuacauaaacaaggcaaaugcgcuacuugcguauauaauaugaugggcaagcgugagaagaaauuaggagaguuugggaaagcuaaaggaucgagagcaauaugguauauguggcugggugccagauuccucgaguuugaagcccuaggcuucaugaacgaggaucacugguuuucuagggaaaauaguuuauccggaguagaaggggagggacugcacaaacugggauauauucuacgagauauuucuaagauccccgggggcaauauguaugcagaugauacggccggaugggauacaagaauuacagaagaugaccuacaaaacgaagcaaagauuacggacaucauggaaccugaacaugcuuugcuugccaccaguauauuuaaacuaacuuaccaaaauaaggugguaagaguacagagaccagccaaaaauggcacagucauggacguaauaucuagacgcgaccaaaggggaucuggucaaguuggcacuuauggccuaaauacauuuacaaauauggaagcacaacuaauaaggcaaauggaaucggaaggaauauuuuuacccucugaacuggaaacccccaaucucgcggagagaguacuagauuggcuugaaaaauaugguguggaaagauuaaagcgaauggcgauuucgggagaugauuguguaguaaagccaauagaugauagauuugcuacagcccuuacagcgcuaaacgacauggguaaaguaagaaaagauauaccacaaugggagccaaguaaaggauggaaugacuggcaacaaguaccguuuugcagccaucauuuucaccaacucaucaugaaagauggacgagagauugucguuccaugucguaaucaagaugaguuaguaggacgagcaagaguaucacaaggagcugguuggucccuucgagaaacagcgugucuuggaaaaucuuaugcucaaauguggcaacuaauguacuuccacagaagagauuugagacuagcagcgaaugcuauauguucggcaguaccaguagauuggguuccaacaucucgcacgacguggucgauucaugcacaucaccaauggaugacaaccgaagacaugcuuaguguauggaacagagucuggauugaagaaaaccccuggauggaggacaagacucauguaagcuccuggggagauguuccuuacuugggaaagagagaagaccaaugguguggguccuuaaucgggcugaccgcgcgagcuacaugggccucaaauauucaaguugcuaucaaucaagugcgacggcuaauaggaaaugaaaacuaucucgauuauaugaccucuaugaagcgguucaaaaacgaaggcgauccugaaggggcccuaugguaa

SEQ ID NO: 21726 - RNA, 9879 nt, Artificial Sequence
  derived and/or modified CDS sequence (opt6) from DENV-1__FJ898390__SS-prME
aguguaacgaugcuguuaaugcuuaugccgacugcauuggcauuucauuuaacuacaagaggaggggaaccacacaugauagugacgaaacaagaacgugggaaaaguuuguuauuuaaaaccagugcagggguaaauauguguacgcuaauugcaauggaccuaggcgaacugugcgaagacacuaugaccuauaaauguccacgcauuacggaagcagaaccagacgauguggauuguuggugcaacgcaacagacacgugggucaccuacggaaccugcagccagaccggggaacauagacgagacaaacgaucagucgcgcuagcaccucacguaggacucggccuagagacaagaaccgaaaccuggaugaguagcgaaggugcauggaaacaaauucaacguguagaaacaugggcauugcgccacccaggcuuuacuguuauugcacuuuuccuggcgcaugcuauaggaacuucaauaacccaaaaagguaucauuuuuauucucuuaaugcucgugacgccaaguauggcaaugagaugugugggaaucggaucgcgagacuucguggaaggucugucaggugcaacauggguggacgugguauuagaacacgguaguugcgugacaaccauggcaaaagacaaaccaacuuuagauauugaacuucuuaaaacugaaguuacaaaucccgccguacuucgaaaauuauguaucgaggcuaaaauuucaaauacgacaacagacagcagaugcccuacccaaggagaagcgaccuugauggaggaacaagaugcaaauuuuguuugucgaagaacuuucguugaccgagguuggggaaauggauguggacuauucgguaaaggcucucuaauuacaugcgcuaaauucaaaugcguuacaaaacuugaaggaaaaauuguccaauaugagaaccucaaauauagcguaauaguaacaguacacacuggagaccaacaccaaguggguaaugaaucgacagaacacgguacuacagccacaauuaccccucaagcuccgacaagcgagauacaauugacggauuauggugcauugacauuagacuguucaccgcguacuggcuuggauuuuaaugaaaugguucuacuaacgaugaaagagaaaaguuggcuaguccacaaacaaugguuucucgaccuaccacucccauggacgucgggcgcuucuacgucgcaggaaacauggaaucgucaagaucuucuggucacuuuuaaaacagcucaugccaagaaacaagaaguuguuguccugggcagucaagaaggugcaaugcauacggcauuaaccggugcaaccgaaauacaaacaagugggacaacuacaauuuuugcugggcauuuaaaaugcagauugaaaauggacaaacugacguuaaaaggcaugagcuacgucaugugcacagguagcuucaaauuagagaaagaaguugcugaaacucaacacgggacaguguuaguccaaauuaaauaugagggaacggacgcaccaugcaaaauuccguuuuccacacaagaugaaaaagggguaacgcaaaacgggcgucucauuacagcaaacccaauagucacggauaaagaaaaacccguaaauauugaagcagaaccgccuuuuggggagucuuauauaguaaucggagugggggagaaagcccugaaacucucaugguuuaagaaaggcucauccaucgguaaaauguucgaagccacagcccgaggggcucgacguauggcuauacuaggagauacugcuugggauuucggaagcauaggagggguuuuuacguccguagggaaacugguccaucaaauauuuggcaccgcauauggggugcuauuuaguggagucucuuggacuaugaaaauagguauagggguacuacuuacauggcuaggacuaaacucacguucaaccaguuuaagcaugacgugcauugccguaggauuagucacguuauauuuaggcgugaugguccaagcugauaguggauguguuauaaauuggaaaggacgcgaguuaaaaugcgggucuggaauuuucgugacuaaugaaguccacacauggacagagcaauacaaauuucaagcagacuccccaaaaagacuuuccgccgcuauagguaaggcuugggaagagggaguauguggcauaagaucagcaacacgcuuagaaaauauaauguggaaacaaauuaguaaugaacuuaaucacauuuuacuggagaacgauaugaaauucacuguagucguaggugauguaguuggcauauuagcccaaggcaagaaaaugauccgcccccaaccuauggaacauaaauacaguuggaaaagcugggguaaagcaaaaauaauuggugcagacguccaaaauacaacauuuauuauugacggcccaaacacacccgaguguccugaugaccaaagggccuggaauauaugggagguggaagacuacgguuucgguauuuucacgacuaauauuuggcuaaaauugagagauucauauacgcaagugugugaucaucgacugaugagugcagcuauaaaagacuccaaggcgguucaugcagauaugggauacuggauagagagugagaaaaaugaaacuuggaaguuagcgagggccagcuuuauagaaguaaaaaccuguauuuggccaaagucucacacucuuuggucaaauggaguuuuagaaucugaaaugauaauuccuaaaaucuauggugggccaauaucacaacacaauuauaggccaggauauuuuacacaaacagccggaccguggcaucugggcaaauuagaacuggauuuugaccuaugcgaaggcacuacuguggucguagaugagcauugugguaacagaggaccaaguuuacguacaaccacaguuacagguaaaaucauacaugaguggugcugccguuccugcacacucccuccacugcgcuucaaaggagaagacgguuguugguacggcauggaaauaaggccagugaaggaaaaagaggaaaaccuaguaaaaucaaugguaucggcugggucaggagaaguggauaguuuuucguuaggauuacuuuguauaaguaucaugaucgaagaaguaaugaggagucguuggucaaggaaaaugcuuaugacaggcacgcucgcaguauuucuucuuuugauaaugggccaauuaacauggaacgaccugauucgauuguguaucaugguuggugcaaaugcauccgaccgaaugggcaugggaacaacauacuuagcgcuaauggcaacguucaaaaugagaccaauguucgcgguaggacuacuuuucagaagacuuacgucacgcgaaguucucuuacuuacuauaggccucagccucguagcgagcguagagcucccaaacucacuugaggaauuaggagauggacuugcaauggguauaaugaucuuaaaacucuugacagacuuccaaucucaccaacuaugggcuacuuuacuuagucuuacuuuuaucaagacuacccuuagccugcacuaugcauggaaaacgauggcaaugguacuuagcauagucagccuuuucccuuuaugccuaucuacaacuagccagaaaacaacauggcucccuguacuuuuaggaaguuuaggcugcaaaccacugaccauguuuuuaauagcagagaacaaaauauggggaaggaaaucauggccuuuaaacgaagguaucauggcaguugggguuguuuccauucugcugaguucgcuacucaaaaacgauguaccguuagccggacccuuaauagcaggcggcauguuaauugcaugcuaugugauuagcggaaguagugcagaucuaagccucgaaaaagcggccgaagugaguugggaagaggaagcagaacauuccggagcaucucauaauauacuuguagaaguucaagaugacggcacaaugaagauaaaagaugaggaaagggacgauacacugacaauuuuacuuaaagcaacuuuacuggccguuagcgggguuuauccauuaucuauuccagccacccuuuuuguuugguauuuuuggcagaagaagaaacaaagaucuggcguauugugggauacuccuucgccaccagagguugaaagagccgugcuugaugaugggauauaucgaauaaugcaaagaggacuucucggacgaucucaaguaggaguaggcguauuucaggagaacgucuuucauacaauguggcacguaacgagaggagccguucuuauguaccagggaaaacgauuagaaccgucaugggcguccgucaagaaagaucuaauuucauacggggguggguggcgucuacaaggcucauggaauacaggugaggagguucaagucauagcaguugaaccgggcaaaaaccccaaaaauguacagacagccccagguacauuuaaaacuccagaaggcgaaguuggcgcgauagcguuagauuucaaaccugggacuucaggcucgccuauagucaaucgcgaaggaaaaauuguaggccuuuacggaaauggggugguaacuacaucaggcaccuauguaagugcuaucgcgcaagcgaaagccagucaagaagggccauugccggaaauugaagaugaaguauucagaaaacgaaaucucacaaucauggacuuacaucccggaagugguaaaacucguagauaucuuccugcaauugugcgagaagcaauuaaaaggaaacuucgaacuuuaauauuggcaccgacaagaguuguugcaagcgagauggcagaagcucuaaaaggaaugcccauaagauaucaaacuacagcgguaaaaagcgaacauaccggaaaagaaauaguugaucucaugugccaugcaacguucacuaugcgacuucuguccccaguccgaguucccaacuacaauaugauaauaauggacgaagcccacuuuacugaucccaguagcauugccgcaaggggguauaucagcacaagaguuggaaugggagaagcagcugcaauauucaugacugcaaccccacccggcucgguugaagcauuuccgcaaaguaaugccgucauucaagacgaagaaagagauauuccagagcgaucuuggaacucugguuaugaauggaucacagacuuuccugguaaaacuguuugguucguuccaucaauaaaaagcggaaaugauauugcaaauugucuucggaagaaugguaaacgaguaauccaauuaucuaggaagacauucgauacagaguaucaaaagacuaaaaacaaugacugggacuacgugguaacuacugacauaagcgaaaugggagcgaauuuuagggcugacaggguuauagacccgagacguuguuuaaaaccgguaauucugaaggacgggccugaaagaguuauuuuagccggaccaaugccaguaacuguggcgucagcagcccagagaagggguagaauaggacgcaaucauaacaaagagggagaccaauacauuuauaugggucagccuuuaaacaaugacgaagaucacgcacacuggaccgaagcaaaaauguuacuagauaacauaaauacaccugaagguauaauaccugcacuuuuugagccggaaagagaaaaauccgcagcuauugacggugaguaucgguuaagaggagaggcaagaaagacguuuguagaauuaaugagacgaggcgaucuuccaguuuggcuuucauauaagguggccuccgaaggauuucaauauucagacagacgguggugcuucgauggagaacgcaauaaccaaguguuagaagaaaauauggacguugagauuuggaccaaagaaggggagaggaagaaacuaagaccacgaugguuggaugcgaggacguacuccgauccauuagccuuacgagaauuuaaggaauuugcagcuggucgcagaaguguaaguggagauuugauucucgaaauaggaaaacuaccucaacaucuuacucaacgagcccagaaugcgcuggauaaucucguuaugcuacauaacagugaacaaggaggacgcgcauaccgacacgcaauggaggaauuaccagauacuaucgagacacuaauguuacuugcucuaaucgcgguccuuaccgguggcguuacacucuucuuucuaucgggccgggggcuggguaagacaucgauaggauuacuuugcgugauggcaucgucaguguuacuauggauggcaagcguagagccacauuggaucgccgccuccauaauauuagaguucuuucuaauggugcuacuaaucccugaaccugacagacaaagaacuccacaggauaaucagcuagcauauguuguaaucgguuuacuauuuaugauuuuaacaguagcggcgaaugagauggguuuacuagaaacuacaaagaaagacuugggcaucgggcauguagcuguugagaaucaucaucacgcaacuaugcuggacguagauuuacauccugcgagcgcuuggacucuguaugccguugcaacuacaauuauuacaccaaugaugcgccauaccauugaaaauaccacagccaauaucaguuugacagccauugcgaaccaagccgcaauauuaaugggccuugacaaaggauggcccauuucaaagauggauauaggcguaccauuacucgcucuagguugcuacagccaaguuaauccacucacucuuacugcugccguauuaauguuaguugcccauuaugcgauaauaggaccuggccuacaagcuaaagcuacaagagaagcgcagaaaaggacugcagcagguaucaugaagaauccuacuguagacgguauaguugcuaucgaccuggauccaguaguuuacgaugcaaaauucgaaaaacaacuuggucaaauaaugcuccuaauccuaugcaccagucaaauauuacuaaugcgaacaacuugggcucuaugcgaauccauaacucuggcaacugguccacucacaacuuuaugggaagguucgccaggcaaauucuggaauacuacaauagcaguuucaauggcuaauauauucagaggaucuuaucucgccggugcgggacucgcuuuuucccuuaugaaaagccuuggcggagggaggagagguacaggagcucagggagagacguugggagaaaaauggaaacgucaauuaaaucaguuguccaaaucagaauuuaauauauacaagagaucugguauuauggaggucgaucgaucagaagcaaaggaagguuuaaaaagaggggaaacgacgcgacacgcaguaucucgagggacagccaaguuaagaugguuuguagaaagaaaccuaguuaagcccgaggguaaagucaucgacuuaggaugcggucguggugguuggucauauuauugugcagggcuaaagaaagucacagaagucaaaggguauacgaaagggggcccgggucacgaagaaccaauucccauggcuacauauggguggaaucuugucaaauugcacucgggcaaagacguguucuucaccccaccagaaaaaugcgauacucuguuaugugauauuggagaaucuucaccaaaccccacaauugaggaaggacguacauuacgcguuuugaagaugguggaaccuuggcuccgaggaaaccaauuuuguaucaaaauacucaauccguauaugcccagugugguugagacccuagaacaaaugcaaaggaagcacgguggcauguugguccgaaauccuuugagcaggaauagcacccacgaaauguauuggguuucguguggaacagguaauauugugagcgcaguaaacaugacaucaagaaugcucuuaaaucgauuuacaauggcgcaucgaaaaccuacuuacgaaagagacguugaucuaggggcggguacaaggcauguagcuguagagcccgaagucgcuaauuuagauauaaucggucaacgaauagagaauauuaaacaugaacauaaauccacguggcacuacgaugaggauaaucccuacaaaacuugggcauaucauggguccuacgaggugaaaccaucgggaucugcauccagcaugguaaauggagucguaaaauuacuaacgaaaccaugggauguaauaccgauggucacucaaauagccaugacugacacaacaccauucggccaacaacguguauuuaaggaaaagguggacaccagaacaccgaaggcaaaacgagggacagcacaaauaauggaaguaaccgcucggugguuaugggguuuucuaagucgcaacaagaaaccaaggauauguacuagggaagaauuuacucgcaaagucagaaguaaugcugccauuggggcagucuucguagaugagaaucaguggaacagugcaaaagaggcuguagaggacgaaagguuuugggauuuaguccaaaaggaaagggaacugcauaaacaagggaaaugugcuacuuguguuuauaacaugauggguaaacgagagaagaaacuuggagaauuugggaaagccaagggcucaagagcuauuugguauauguggcuaggggccagguucuuagaguucgaagcacuaggguucaugaaugaagaccacugguuuucuagagaaaacucucuaaguggaguugaaggagaaggacuacacaagcuaggcuauauacuucgagauauaucuaaaauuccagggggcaauauguacgcugaugauacggcuggcugggauacccgaauaacagaagaugauuuacagaacgaggcaaagauuaccgauauaauggaaccugaacaugccuugcuugcaacuucgauuuucaaacuuaccuaucaaaauaaaguuguucgagugcaacgcccagccaaaaacggcacggucauggacguaauaucaagaagagaccagcgagggucaggucaagucggaacuuauggcuugaauaccuuuacgaauauggaagcccaguugauacgucaaauggaaucagaaggaauuuuucuccccagcgaauuagaaacuccgaauuuagcagaacgcguuuuagauugguuggaaaaacauggaguggaacgucuaaaaagaauggccauuaguggggaugauugugucguuaagccuauugacgauagguuugccacagcucuaacugcacuaaacgacauggguaaagucagaaaagacauaccacaaugggaaccaagcaaggguuggaaugauuggcaacagguuccauuuugcucgcaucauuuucaucagcuaauaaugaaagauggacgugaaauaguggugccguguaggaaucaggaugaguuaguaggaagggcaaggguuucgcaaggugccgguuggucuuuaagagagacagcaugucuugguaaauccuaugcgcaaauguggcagcuaauguacuuucauagaagagaucucagacuagcugcuaacgcaauauguagcgccguaccugucgacuggguaccaacaagucgaacaaccuggucaauacacgcucaccaucaguggaugacaacagaagacaugcuaaguguauggaaccguguguggauagaggagaauccguggauggaagauaaaacacauguuagcucguggggagauguaccuuaccuagggaaacgcgaggaucaaugguguggauccuuaaucggucucacagcgagagcaacaugggcaaguaacauccagguagcgaucaaucaggugagaagauugauuggaaaugaaaacuaccuugauuacaugacaucuaugaagagauuuaaaaaugagggagacccugaaggugcacugugguga

SEQ ID NO: 21727 - RNA, 9879 nt, Artificial Sequence
  derived and/or modified CDS sequence (opt6) from DENV-1__FJ898391__SS-prME
uccguaacaauguuauuaaugcuaaugcccacagcauuagcauuucaccucacuacacgaggaggugaaccacauaugauugugaguaaacaagaaagagggaaaaguuuguuauuuaaaacaagcgccgguguuaauauguguacacuaauagcuauggaucuuggugaguucugcgaagacacaaugacuuauaaaugucccagaaucacagaagcugaaccagaugauguagauuguugguguaaugcuacagauacguggguaacauacggaacauguucccaaacgggcgaacauaggcgagauaaaagguccgucgcacuagcaccacauguaggacuuggucuugaaacacguacugaaacauggaugagcucugaaggugcuuggaagcagauucaaagaguggaaaccugggcguuaagacauccagguuuuacggucaucgcauuauuucuagcgcaugccaucggaacgucaaucacccaaaaaggaauuauauucauuuugcuaauguugguuaccccguccauggcaaugcgauguguuggaauaggaucccgcgacuuugucgaaggacuaucgggagcaacuuggguggauguugucuuagaacaugguagcugcguuacaacaauggccaaagauaaaccgacuuuggauauagaauuauuaaaaacagaaguaacaaacccagcuguauuacgaaaacucugcauagaagcgaaaauaaguaauacuacaaccgacagucguugucccacucaaggagaggcgacccugguagaagaacaagaugcaaauuuuguauguagaagaacguucguagauagaggauggggcaacggcugcggauuauuugguaaagggaguuugauaacaugcgcuaaauuuaaauguguuacuaaacuagaaggaaaaaccguacaauaugaaaaucucaaauacucuguuaucguaacgguucauacuggagaccaacaucaaguuggcaaugaaucaacagaacauggaacaacagcuaccauuaccccucaagcgccaaguacugaaauccaacuaaccgauuauggagcauugacuuuggauugcucaccuaggacaggacuugacuucaaugaaaugguucuauuaacgaugaaagagaaaaguugguuaguucacaaacaaugguuuuuagaccuaccauuaccauggacuagcggagcuucaacaagccaagaaacauggaauagaaaagaucuauuaguuacguucaaaacagcgcacgccaagaaacaagagguagugguucuugguucccaagaaggcgcaaugcacacugcacuaacaggugcaacagaaauacagaccucuggaacaacgacaauuuuugcuggucauuuaaaaugcagauugaaaauggauaaacuaacgcuaaaagguauguccuaugugauguguacggggucuuuuaaauuagaaaaagaaguagcggaaacccaacacggaacgguauuaguacaaauuaaauacgaagggacagacgcacccuguaaaaucccguucucuacacaagaugaaaaaggagugacacagaacggaagauuaauuacagcgaacccgauaguuacugauaaagaaaaaccagucaacaucgaggcugagccuccguuuggggaaagcuauauugugauuggagcuggugaaaaagcauugaaauuaagcugguucaagaaagguucgagcauuggcaagauguucgaagcaacggcacguggagcacgcaggauggcuauauugggugauacagcaugggacuucggaucuauagggggaguguucacaucuguuggaaaacuuguacaccaaauauuuggcacagcguauggaguguuauucucaggcguaaguuggacaaugaaaauugguauaggaguucuucuaacuuggcuagguuuaaauucaagaagcacaaguuugaguaugacauguauugcaguagggcuaguaaccuuguaucuuggaguuauggugcaagcagacuccgguugugugauaaauuggaagggaagagaacuuaaauguggcagugguauuuucgugaccaaugaaguucacacuuggaccgagcaguauaaauuucaggcugacucgccuaagagauugucugcugcaauugggaaggcaugggaggaaggaguaugcggcauacgauccgcgacaaggcuagaaaacaucauguggaaacaaauauccaaugaguuaaaccauauacuuuuagaaaaugacaugaaauuuacaguagugguaggagaugucgcaggaauacuagcccagggaaagaaaaugauaaggccgcagccaauggaauacaaguauucauggaaaucaugggguaaagcuaaaauaaucggagcggaugugcagaacacuacauuuauuaucgauggaccaaacacaccagaauguccugacgaucaaagagccuggaacauaugggaaguugaggacuauggauucggcaucuucaccaccaauauaugguuaaaacugagagacagcuacacacaaguaugcgaucacagauugaugagugcagcgaucaaggauucuaaggccgugcaugcagacaugggauauuggauugaguccgagaagaacgaaacuuggaaacucgcgcgugcgucauucauagaggugaaaacaugcauauggccaaaaucacacacucuguggaguaacggaguauuagaaucagagaugauuauaccuaaaauauacgguggaccgauaucacaacauaauuauagaccuggauacuuuacgcaaaccgcugguccguggcaccuaggcaaacucgaauuagacuuugaucuaugugaaggaacgacaguagugguagaugaacacuguggaaauagaggccccucauuacguacaacgacagugacagguaaaaucauucacgaguggugcuguaggaguuguacccuuccaccccucagguucaaaggagaagauggcugcugguacgguauggaaauucgcccgguaaaggaaaaggaagaaaauuugguaaaaucgauggucuccgcugguucuggcgaaguagauucauuuagcuuggggcuacugugcauaucaaucaugaucgaagaaguaaugcgaucuagauggucaaggaagaugcuuaugacuggaacgcuagcgguauucuuuuuacuaauaauggggcagcuaacuuggaaugacuugauucguuuaugcauaauggucggggcuaacgccucggacagaaugggaauggggacgacuuaucuagccuuaauggcaacauuuaagaugcguccuauguucgcaguagguuuacucuucaggcgauuaacaagccgagaaguucugcuucuaaccauaggucuaaguuugguugcaucagucgaacugccaaauucacuagaggagcuaggagauggauuagccauggggauaaugauacuuaaacuucuuacagacuuccaaucccaucaauuaugggcaacauuacuaaguuuaaccuuuauaaaaaccacauuuucucuacauuacgcauggaagacaauggcaaugguacuaagcauaguuucacuauucccacucugucuaagcacaacaagucaaaagacgacaugguuaccaguuuuacugggaucgcuagguugcaagcccuuaaccauguuuuugauugcggaaaacaagauuugggguaggaagaguuggccucugaaugaaggcauaauggcuguuggaauagucaguauacuucuuaguagccuccuuaaaaacgaugucccauuagcgggcccauugauagcaggcggaaugcuaauugcuugcuaugucauaucaggaaguagugcugacuuaagccuugaaaaagcagcggagguaucaugggaggaagaagcugaacauucaggcgcgagucauaacauuuuaguggaagugcaagaugaugguacaaugaagaucaaagaugaagaaagggaugauacguuaaccauacuauuaaaggcaacguuacuagcaguuucugguguguauccccugaguauuccagcaacacuuuuugucugguacuuuuggcagaagaagaaacagcguaguggaguacuaugggauacaccaaguccuccagagguugagagagcaguguuagaugacgguauauaccgaaucaugcaaagaggcuuacuaggaagaucacagguagguguagguguguuucaagaaaauguguuccauacgauguggcacguuacaaggggagccgugcucauguaucaggguaaacgcuuggagccgaguugggcaucagugaagaaagacuugauuucuuaugguggaggguggcgcuuacagggaucguggaacacaggggaagagguucaaguuauugcaguagaaccaggcaaaaauccgaaaaauguacaaacagccccagguacauucaaaacuucagagggugaaguaggagcaaucgcauuagacuuuaagccugggacaaguggauccccaaucgucaacagagaaggaaaaaucgucggacuauaugggaauggagucgucacuaccucagggacauauguaagcgcaauugcacaggcgaaagcuagccaggagggcccgcuuccugagaucgaagaugaagucuuuagaaaaagaaacuugacuaucauggaccuacaucccggaagugggaaaacacgccguuaucuucccgcuauuguucgagaggcaauaaaacguaaacuacguacgcuaauacuagcaccuacccgaguaguagccuccgaaauggcugaagcucuaaaaggaaugccaauaagauaucaaacaacagcgguuaaaucugaacacacuggaaaagaaauaguagaccucaugugccacgcuacguucacaaugcgacuuuuaucuccuguuagaguacccaauuauaauaugaucauaauggaugaagcccacuucaccgauccaaguagcauagccgcgaggggauauauauccacgcgcguggguaugggggaagcggccgcuaucuucaugaccgcgaccccgcccgggaguguagaagccuucccacaaucaaaugcugugauacaggaugaagaaagagacaucccggaacgaucauggaauaguggauaugaguggauaacugauuuuccagguaagacuguaugguucguucccagcauaaagucagguaaugacauagcaaacugcuugaggaaaaaugguaaaagaguaauucaauugucgagaaagacauucgauacagaauaccagaaaaccaaaaauaaugauugggauuacguagucacuacagacauaagcgaaaugggugccaauuucagagcugaccgcgugauagauccgagaagauguuuaaaaccaguaauacuuaaagauggcccggaaagaguuauauuagccggaccgaugccgguaacgguugcaucugcagcacagcggcgugguagaauagguaggaaucauaauaaggaaggagaucaauauauauacaugggucaaccucuaaauaacgaugaggaucacgcucacuggaccgaagcuaaaaugcucuuagauaauaucaacacaccagagggcauaauaccagcauuguuugaaccugaaagagagaaaagcgcagcaauagacggugaguacagguugaggggugaagcaagaaaaacuuucguugaauugaugcgaagaggggaucugcccguuuggcuuaguuauaaaguggcuagcgaagguuuccaauauucggaccgaagguggugcuucgauggagagagaaauaaucagguacuagaagaaaauauggauguugaaauauggacaaaagagggcgaaaggaaaaagcugcgaccacgaugguuggacgcacguaccuauagcgacccacuugcacucagagaauuuaaagaguuugcugcaggaagaagaucaguuucgggagauuugauacuugagauagguaaauuaccacagcaccuaacacagcgggcccaaaacgcacuagauaaccuaguaaugcugcauaacucugaacaggguggccgggcauauagacacgccauggaagaauugccggauacaauagagacgcugaugcuuuuagcucuuauagcuguguugacugguggaguuacauuguucuuuuuaucaggucggggauugggaaagaccuccauaggguuacuuuguguaauggccucuaguguuuuacuguggauggcuaguguagaaccacauuggauugcugcgucuauaauuuuagaauuuuuccuaaugguacuucuuaucccggaaccggaccgucaaaggacuccacaggauaaccagcuugcauauguaguaaucggacuguuauucaugauacucacaguagcagcaaaugaaaugggguuauuagaaacuaccaagaaagauuuaggaauuggacauguugcuguagaaaaucaccaucaugcggccauguuggauguugauuugcauccagccagugcguggacccuguacgccguggcaacaacaauaauaacaccuaugaugagacauacuauagaaaacacuacagcuaauauuucuuuaacagcgauugcaaaccaggcagcgauauuaaugggcuuagauaaaggguggccaauaucaaaaauggacauaggggucccauuacuugcauuaggaugcuauagucaggugaauccauuaacauuaacggcagcaguccuaauguuagucgcacauuacgcaauuauuggcccuggacuccaagccaaggcuacacgagaagcacaaaaacguacagcugcuggaauaaugaaaaauccaacaguugauggcauuguagcuauagaccuagaccccguagucuaugaugcaaaauuugagaaacaauuagggcagauaaugcuacugauauuaugcaccagucagauacuccuaaugcggacaacgugggcacuaugcgagucgauaacauuagcaacuggaccgcuuacuacauuaugggaaggaaguccagggaaauucuggaauaccacuaucgcagucucaauggcaaacauauuuagagguucuuauuuagcaggagcagguuuagcuuuuucucuuaugaaaucauuagggggugguagacgaggaacaggggcgcagggagaaacucuaggggagaaguggaagaggcaauuaaaucaacuaaguaaaagcgaguuuaauaccuacaaacgaagcggcaucauggaagucgaucguucagaggcuaaagagggguuaaaaaggggugaaacuacaaaacacgcggugagccgagguacagcaaaacugagaugguuuguagaaagaaaucuugugaaaccggaagggaagguaauagauuuaggcugcggucgaggugguuggaguuauuauugugcgggacucaaaaagguaacagaaguaaaaggguacacaaaaggagguccaggacaugaggaaccaauccccauggcuacuuacggguggaaccuaguaaaguugcauaguggaaaagacgucuucuucauuccgcccgagaaaugugauacauuauuaugcgauauuggggaaucgucaccuaauccuacuaucgaagaggggagaacuuuaagaguucugaaaaugguagagccaugguugcgaggaaaccaauucuguauuaaaauacuaaauccguauaugccaucggugguagagacucuagaacaaaugcaacggaaacacggaggaaugcuaguuaggaaccccuuaucuaggaauaguacacaugaaauguacuggguaucgugcgguacgggaaauauuguaagugcagucaacaugacuucacgaaugcuucuaaaccgauucacgauggcacacagaaaaccuacauacgagagagauguugaccuuggugcagguacccggcacguugccguagaaccugaaguugcuaauuuagauaucauagggcaacggauagagaacaucaaacacgaacacaagucaacuuggcacuacgaugaggacaaccccuauaaaacuugggcauaccacggcaguuacgaaguaaaaccaagugggagugcguccaguaugguaaauggaguaguuaaacuacuuacuaaaccaugggacgucauuccaauggugacgcaaauagcaaugacugacacaacaccauuuggacaacaaagaguguucaaagagaaaguugacacacguaccccgaaagcaaaacgggguacugcacagaucauggaaguuacugcaaaauggcuuugggguuuccuaucgcguaacaaaaagccgaggauauguacaagggaggaauuuacaaggaaaguucgaaguaaugcagcaauaggagccguuuuuguggacgaaaaccaauggaacucagcaaaagaagcagucgaagaugaacgauucugggacuuaguucacagggaacgggaguuacauaagcaagguaaaugcgcuacguguguuuacaauaugaugggcaaacgcgagaagaaauugggagaauuuggcaaagcuaagggcucaagggccauaugguacauguggcucggagcgagguucuuggaguucgaagcucuaggauuuaugaaugaagaccauugguuuucacgagaaaauagcuuauccggaguggaaggugaaggucuacauaagcugggauacauuuugcgagauauuucaaaaauaccugggggcaacauguacgcagaugauaccgcuggaugggauacucggauaacagaggaugaccuucaaaaugaagcuaaaaucacugacauaauggaacccgaacaugcuuuacuugcuaaaucaauuuuuaaauuaacauaucaaaauaaaguagugcgaguucaaagaccggccaaaaaugguacuguaauggacguaauaucaagacgggaccaacgugguaguggucaaguaggaacuuauggucuaaacaccuuuacgaauauggaagcgcaacugauuaggcagauggaaagcgaaggaauauuuagcccaucugaacuagaaacuccaaauuuggcgggucgugucuuggacugguuagaaaaacacgggguggaaagacucaaacgaauggcuauauccggagacgauugcgucgugaaaccaauagacgaccgauuugcgacagcauugaccgcgcucaaugacauggguaaaguucgaaaagacauaccacaaugggaacccucaaagggcuggaaugauuggcagcaagugcccuuuuguucgcaucacuuucaccaacuaauuaugaaagauggucgugaaauaguugugccuuguaggaaccaagacgaguuaguagggcgagcaagggugagccaaggugcaggcuggaguuuaagggagacagcaugucucggcaagagcuaugcacaaauguggcaacuaauguauuuucaucgcagagaccugcguuuagcagcuaacgcgauauguuccgcuguaccuguugauugggugccaacgaguagaacuacaugguccauccacgcgcaucaucaauggaugacaacagaagauauguuaagcguauggaauaggguguggaucgaagaaaauccauggauggaggacaaaacucauauaucaucguggggagauguuccguaccuugguaaaagagaagaccaauggugugguucuuuaauaggauuaacugcuagagccacaugggcaacgaauauacaaguagcuauaaaucaagucagacguuugauagggaacgagaauuauuuagacuauaugacgucgaugaaaagauuuaaaaaugaaagugacccagagggggccuugugguga

SEQ ID NO: 21728 - RNA, 9879 nt, Artificial Sequence
  derived and/or modified CDS sequence (opt6) from DENV-1__FJ898392__SS-prME
ucgguuaccaugcuauuaauguuaaugcccacugcguuagcauuccaucuaacuacaagaggaggugaaccacacaugaucgugacuaaacaggaacgaggaaaaucuuuacuuuuuaaaacaucugccgguguaaauauguguacucuaauugcuauggacuugggugaauuaugugaagauacuaugaccuauaaaugcccccgaauuacugaagcagaaccggacgauguagacuguugguguaaugcaacagauacgugggucacauacggaacuuguucccaaacaggagaacacagacgagacaaaagaucgguagcgcuagcaccccauguggguuuaggacucgaaacucggacagagacauggaugucaucagaaggugcguggaaacaaauccaacgaguagaaacaugggcguugagacauccuggguucacaguuauugcacuguuucuagcacacgcaauagguacuucaauaacacaaaaaggaauuaucuuuauucuacucaugcuuguuacgccauccauggcaaugagauguguagggauugggucucgagacuuuguugaaggucucucuggugcaaccuggguagacgugguucuagaacauggaagcuguguuacaacgauggcaaaagauaaaccuacguuagauauagaacuguuaaaaaccgaaguaacgaacccagcgguccugcguaaacuaugcaucgaagcaaaaauuucuaauaccacaacagacucucggugcccgacacagggagaagcgacucuaauggaagaacaagaugcaaauuucguuugucggcgaacuuuuguggauaggggauggggaaacgggugcggacuauucggcaaagggagcuugauaacuugugccaaauuuaaaugcguuacuaaacuggagggaaaaaucguccaauaugagaacuuaaaauacucaguaauaguaacuguccauaccggagaucaacaucaagucggaaacgaaucuacugaacacgggacgaccgcuacaauaacaccucaggcaccuaccucggaaauacaacuaacagacuacggugcacuaacguuagauuguuccccgagaacuggguuagauuucaaugagaugguacuacuaacaaugaaagagaaaaguugguuggugcauaaacagugguuuuuagaccuaccacugccuuggacuucaggagcgucaacaagucaagaaacuuggaaucgccaggaccugcuaguuacauucaaaacagcucacgcuaaaaagcaggaaguaguuguguuaggaucgcaagagggugcuaugcacacagcccuuacaggagccacagaaauacaaacgucaggaacuacaacaauuuucgcaggacacuuaaaaugucgucuuaagauggauaaauuaacguuaaagggaaugucuuacgucauguguacagguaguuucaaacuugaaaaagaagucgcagagacgcagcaugggacaguauuagugcaaauaaaauaugaaggaacugacgcgccgugcaaaaucccauucucgacacaagacgagaagggugugacccaaaacgguagauuaauaacagcaaacccaauaguaaccgauaaagaaaaaccaguaaauauagaagcagaaccuccauucggagaaaguuacaucguaauuggagcaggagaaaaggcauuaaaacugagcugguucaagaaaggaagcucaaucgguaaaauguuugaagcuacagcgcguggcgcucgcagaauggcuauccuaggggauacagccugggacuucggaagcauaggaggugucuucacgucaguugggaaauuaguccaucaaauauucggaacugccuacggggugcuauuuuccggugucuccuggacuaugaaaaucggaauagggguguugcuaaccugguuagggcucaauucucgaagcacaaguuuaaguaugacuuguauagcgguaggacugguaaccuuauaccuuggcguaaugguucaagcagauuccggguguguaauuaauuggaagggaagagagcuuaagugcggcucuggaauauuuguuacgaacgaaguacauaccuggacugagcaauacaaauuucaagccgauucacccaaaagguuaagcgcagcgauagguaaagcgugggaagaaggaguuugugggauucgaucggcuacuagguuagaaaauauuauguggaaacaaaucucuaacgaauugaaucacaucuuauuagaaaauggcaugaaauuuacggucguagucggugauguaguaggaauuuuggcacagggcaagaaaaugaucaggccacaaccuauggaacauaaauacucuuggaaaucauggggaaaagcuaaaaucauaggcgcagaugugcagaauacaaccuucauuauagacggaccgaauacacccgaauguccagacgaccaaagggcuuggaauauaugggagguagaagauuauggauucgggauuuuuaccacuaauauaugguugaaacugagagauucauauacgcaaguuugugaucauagacuaaugucugccgcaauuaaagacucaaaggccguccacgcggauaugggguacuggauugaauccgaaaagaaugaaaccuggaagcuagcuagagcauccuucauagaaguuaaaacuuguauuuggccuaaaucccauacauuauggucuaacggaguauuagaaagugaaaugauaauaccuaaaauauacggagggccgauaucccagcacaauuaucgaccaggauacuucacacaaacagcuggaccauggcacuuagguaaacuggagcuagauuuugauuuaugcgaaggaaccacagugguuguugaugagcauugugguaacagaggaccgagucugagaacuacaacaguuaccggaaaaauaauacaugaaugguguugucgcucguguacauuaccaccuuugagauucaaaggugaagaugggugcugguauggaauggagauaaggccagugaaagagaaggaagaaaacuugguuaaaaguauggucagugcgggaagcggagaaguggacucuuucagcuuagguuuacuuugcacuucaauuaugauagaagaaguuaugcggucgagauggagcagaaaaaugcugaugacgggcacauuggcugucuuccucuugcuaauaaugggacaauugacuuggaacgauuugauuagacuauguauaaugguaggagcuaaugcuucggauagaaugggaauggggacaacauaucuagcacuuauggcaaccuuuaaaaugagacccauguucgcaguuggcuuacuauuuagaagguuaacaucaagagaagucuugcuguugacuauaggguugucauuaguagcauccguagaacuaccuaacagccuggaagaacuuggugaugggcuagcaauggguauaaugauuuuaaaguugcucaccgacuuccaaucccaucaacuaugggcaacauuauuaucguuaacuuucauaaagacuacuuugagcuuacauuacgccuggaaaacuauggcgaugguacuauccauagucucgcuguucccccuuugcuuaucaacaaccucccagaaaaccacauggcuaccaguucuacuaggcagccuugggugcaagccguugacaauguuccuuauugcggagaacaagauuuggggccgaaaaucauggccacugaacgaagggauaauggccguaggagucguaucaauacuuuuaaguucuuuacucaaaaaugaugucccucuagcggguccguuaauagcuggcggcauguuaauugccugcuacguaauaucuggauccucagcugaucuuucucuagagaaagcggcugaaguuucuugggaagaagaagcagaacauucuggagcuucacauaauauauuaguagaagugcaagacgauggcacaaugaaaauaaaggaugaagagagagacgacacacuuacgauuuuacuaaaagcgaccuuacucgcagugucgggcguauaucccuuaagcauaccagcaacauuauucguuugguacuucuggcagaagaagaaacagagaucaggggugcuuugggauacuccaaguccgccugaaguagaacgagcuguuuuagaugacggaauuuacaggauaaugcaacgagggcuguugggaaggagucaaguuggcguaggaguauuucaagaaaaugucuuucacacaauguggcauguaacuagaggcgccguacucauguaccaaggaaaacgacuugaacccucuugggcaucgguaaagaaagaucuaauaucauauggggguggauggagauuacaaggaucauggaauacaggugaagagguccagguaauugcaguagaaccagggaaaaauccuaaaaauguacaaaccgcuccaggcaccuuuaagacuccagaaggagaaguaggggcaauagcuuuagacuucaagccagguacgucgggaaguccaauugucaaccgugaggggaaaauuguuggacuuuauggaaauggcguagugaccacaucaggcacguauguuagcgcaaucgcacaagcgaaggcaagccaagaagguccucuaccggaaauagaggaugaaguuuuuagaaaaagaaaucuaaccauuauggaccuacauccuggaucuggaaaaacacgacgauaucuaccagcgauaguuagagaagccauuaaaagaaaauuaagaacccugauauuagcgccgacgagagucgucgcuuccgaaauggcagaggcucuuaagggcaugccaauacgauaucaaacaacugcaguuaagucagagcauacggggaaagagauagucgaccuaaugugucacgcaacuuucaccaugagacuguuguccccagugagaguaccuaauuauaacaugauaauaauggaugaggcacacuuuacugauccuuccucaauugcggcgcgaggguacauaaguacaagggucggaaugggagaggcagcugcuauuuuuaugacagcaacaccacccggcaguguugaggcuuucccccaguccaaugcaguuauacaagaugaggaaagagacauaccugagaggucuuggaauagcgguuaugaauggauaacggauuucccaggcaaaaccguaugguuugucccauccaucaaaaguggcaacgauauugccaauugccuaagaaagaauggaaagcgaguuauacaauuaaguagaaaaacguucgauacagaauaccaaaagacgaaaaauaacgauugggacuaugucguuacgacugauauuucagaaaugggugcgaacuuucgugcugaucguguaauagauccaagaagauguuuaaagccaguuauauuaaaagaugguccugaaagagugauauuagcgggaccaaugccagucaccguagcaagcgcagcacaaagacgaggacgcauaggaaggaaucauaauaaggagggugaucaauacauauauaugggacaaccucucaacaaugaugaagaucacgcgcacuggacggaagcaaagaugcuucuagauaacauaaauaccccugaaggaauaauaccggcacuauucgagcccgagcgcgagaaaagugcagcuauagauggugaauaucgacuuagaggagaagcgcguaagacauucguagaacuuaugagacgaggagauuuacccguaugguuaagcuauaaaguagcuucagaaggauuucaguacucggauagaagauggugcuucgauggggaacguaauaaucaaguccuagaagagaacauggacguggaaauauggacaaaagagggagaaaggaagaaauugaggccaaggugguuggaugcgaggacguacucugauccacuagccuugcgcgaauuuaaagaguucgcugcuggacgacgcucaguaagcggagaucuaauacuugaaauugggaaauugccucaacauuuaacccaaagagcccaaaacgcauuagauaaccugguuauguuacacaauagcgaacagggagggcgagcuuaccgccacgccauggaagaacuaccagauacuauugaaacacuaauguuacuagcacuuaucgcaguccuuacaggagguguaacauuauucuuccuuagcggcagggguuuaggcaaaacuagcauaggcuuacuaugcguaauggcuucaucaguuuuguuauggauggcuaguguagaaccucacuggauugcagccuccauuauauuagaguucuuucuaauggucuuacuaaucccagaaccugaucgccaaagaacaccucaagacaaccaauuagccuauguaguuauaggacuuuuguuuaucauauugaccgucgcggcuaacgaaaugggauuguuagaaacaacuaagaaagauuuaggaauagggcauguggcaguugagaaccaccaccacgcuaccauguuagauguugauuugcacccugcuucugcauggacacucuacgccguugcgacaacgauaauuacuccuaugaugagacauacuauagaaaauacaacugccaacauuagcuugaccgcaauagcaaaucaggcggccauauuaaugggauuagacaaaggauggccuaucagcaaaauggacauagguguucccuuguuagcuuuaggauguuacagucaaguaaacccuuuaacauuaacggcggcgguacuaaugcuaguagcgcacuaugcuauuauaggaccaggacuacaagcaaaggcaacaagagaagcucaaaagcguacagcggcuggcauaaugaagaauccaacuguagacggaauagucgccauugauuuagacccagucguauacgacgcaaaauuugaaaaacaacuaggacaaauuaugcuacugauacuuugcacuucgcaaauuuuacuaaugaggacaaccugggcuuugugugaaaguauuacucuugcaacagguccacuaacaacguugugggaggguaguccgggcaaauuuuggaauacuacuauugcggucucaauggcaaauauauucaggggaucuuaucuugccggugcugggcuagcguuuucccuaaugaagucccuaggaggaggaagacgagggaccggggcccaaggagaaacucuaggugaaaaauggaaacgacaauuaaaucagcugucaaagucagaguucaauauauauaaaagaagcgguauaauggaaguugaccguuccgaagccaaagaagggcuaaaacgcggcgagaccacacgacacgcuguuucaagaggaacagcaaagcuccguugguuuguagaaagaaauuuaguaaaaccugaaggaaaagugauagauuuaggauguggccgugguggauggucauacuacugcgccggacucaagaaaguaaccgaaguuaaggguuauacaaaagguggccccggacacgaggagccuauaccaauggcuacuuacggauggaauuuaguuaaacuccauagcggaaaagauguguucuuuacgcccccggaaaaaugugauacucuuuuaugugauauuggcgagagcagcccuaauccgacaauugaagaagguagaacauugagaguguuaaaaaugguugaaccaugguuacgagguaaccaguuuugcauaaagauccugaacccauacaugccgucuguagucgagacucuagaacagaugcaaagaaaacaugguggaaugcuaguacgaaacccacuauccagaaacagcacgcacgaaauguauugggucagcugugguacaggaaauauaguuagugccguaaauaugacuucacgaauguuacugaacagauucacaauggcgcaccgaaaaccaacuuaugaacgagacguagaucuaggagccggaacaagacacguggcgguugagcccgaaguagcgaaucucgauauuauugggcaacgcauagaaaauauuaagcaugagcauaaaaguacguggcauuacgacgaagauaauccauacaaaacgugggcauaccacgggucuuaugaaguaaaaccuucaggaucggcuaguaguaugguaaauggaguuguaaagcuccuaacaaaaccgugggacguaaucccuaugguaacacagaucgcaaugacugacaccacuccauucggccaacaacgaguguucaaggaaaaaguagacaccagaacaccaaaagcuaagagaggaaccgcucaaauaauggaaguaacggcaaggugguuguggggauuuuuaagucgcaauaagaagcccagaauauguaccagggaggaguucacaagaaaaguacggucuaaugcugcaauuggagcugucuuugucgaugaaaaucaauggaacucggcuaaggaagcugucgaagaugaacgguuuugggaucuaguccagaaagaacgugaguuacacaagcaagguaaaugugcgacuuguguauauaauaugauggggaaaagagagaagaaacucggagaauuuggaaaagcgaagggaucaagagcaauuugguauauguggcucggggcucgauuucuggaguucgaagcacuagguuuuaugaacgaagaucauugguuuucgcgcgaaaauagccuaucuggaguagagggggaaggucuacauaaacuaggcuauauuuugagagacauaucaaaaaucccugggggcaauauguaugcggaugauaccgcgggcugggauacacguauuacagaagacgaucuacaaaaugaagcgaaaauaacagauauaauggaaccugaacaugcacuacuggcaacgaguauauuuaaacuaacauaccagaauaagguuguaaggguacaacgccccgcgaaaaauggaacagugauggauguaauaagccggagagaccaaaggggcagcggccagguggguacauauggauuaaauacauucaccaauauggaagcgcaacuuauuagacaaauggaaucagaagggauauuucuaccgucggaacuagaaacuccaaauuuagcagaaagagugcuggacugguuagaaaaauaugggguugaaagacuuaaacgcauggcuaucagcggagacgauugcguaguuaaaccuauagaugaucguuuugcuacagcauuaacagcacugaaugacauggggaaaguacgaaaggauaucccccaaugggaaccuagcaaaggauggaacgauuggcaacagguccccuucuguucgcaucauuuucaucagcuaaucaugaaagauggccgagaaauuguaguaccuugcagaaaccaagacgaacuuguaggccgcgccagaguaagccaaggggcagguuggucucuaagagaaacugcuugcuuagggaaaaguuaugcgcagauguggcaauugauguauuuccaucgccgagaucuucgucucgcugcuaacgcaauauguagcgcaguaccaguagacuggguuccaacuagccgcaccacauggagcauacaugcccaccaccaguggaugacaaccgaagauauguuaaguguguggaaccgaguuuggauugaggagaacccguggauggaagauaaaacucauguuucgucguggggagacgugccauaucucgguaaaagagaggaccagugguguggaucuuugauaggccuaacugcuagagccacgugggcaagcaacauacaaguagccauuaaucaagugagacgacugauaggcaaugagaauuacuuggacuacaugacuucuaugaaaagauuuaaaaaugaaggggauccagagggggcuuuaugguaa

SEQ ID NO: 21729 - RNA, 9879 nt, Artificial Sequence
  derived and/or modified CDS sequence (opt6) from DENV-1__FJ898393__SS-prME
agcguuacaaugcuccucauguuaaugccgaccgcuuuagcauuccacuuaaccacccgcggaggagagccccauaugauaguaacuaaacaagaaagagguaaaucucuuuuauuuaaaacaucggcagggguuaauauguguacguuaauagcaauggaucugggggaacuaugugaagacacaaugacuuauaaaugccccagaauaacugaggccgaacccgacgauguagacuguugguguaaugcgacagauacauggguaacauauggaacauguucucagaccggggaacaccgcagagacaaaagaucagucgcccucgcaccucacguuggacuaggucuugaaacccggacggaaacauggaugucuagcgagggagcauggaaacaaauccaaagaguugaaacuugggcgcuucgacauccaggauucacuguaauagcucuauucuuagcgcacgcuauaggaaccucaaucacacaaaaagguauaauauuuauucuucugauguuaguaacaccaucgauggcaaugagaugugucggaaucgggagcagagacuuuguagaaggcuugagcggagccacauggguagauguaguguuggaacauggcucuuguguaacgaccauggccaaagauaaaccaacucuagacaucgaauuauugaaaacggaagucacaaacccagcaguacuucguaaacuguguaucgaagcgaaaauaucuaacacuacaacagacagcagauguccgacucagggagaagcaacguuaauggaagaacaagaugcgaacuuuguauguagacgcaccuucgucgacagaggaugggguaauggaugcggauuauucggaaaagguagccucaucacaugcgcaaaauuuaaaugugugacaaaacuagaaggaaaaauuguacaauaugaaaacuuaaaauauucgguuaucgucacuguacauacaggugaccaacaucaaguaggcaaugaaucuacagaacaugguacaacugcaacuauaacgccacaagccccaacaagcgaaauacaguugacagauuacggcgcauuaacucuagauuguucuccucgaacaggguuggauuucaaugagaugguguuauuaacgaugaaagagaaaucaugguugguucauaaacaaugguuccucgaccuaccuuuaccguggacuucuggagcaucaacaucacaagaaacauggaacagacaagaccuuuuagucacguuuaaaaccgcccaugcaaagaagcaagaaguaguuguucuuggaucucaagaaggggcaaugcacacagcauuaacuggugcaaccgaaauacaaacaucagggaccacaacaauauuugcaggucauuuaaagugucgcuugaaaauggauaaauugacacuuaaaggcaugagcuaugugauguguaccggguccuuuaaguuggagaaagagguagcagaaacacaacacgguacuguauuaguccagauaaaguacgagggcacugacgcaccauguaaaaucccguuuucgacucaagacgagaaagggguaacacaaaauggacgguugauaacagcgaauccuauuguaacggauaaagaaaaaccaguaaacaucgaagcugaaccaccuuucggagaaucauauauagugauaggagcuggagagaaagcgcucaaacucaguugguuuaaaaagggguccaguauaggcaaaauguucgaagcaacagcccgaggagcgcgaagaauggcaauuuuaggggacacggcaugggacuucgguagugucgguggaguauuuacgucaguagggaaacuuguucaccaaauuuucggaacagccuacgguguauuauucucagggguuucauggaccaugaaaauagguauuggaguacuccuaacauggcucgguuuaaacagcaggagcaccagucuaaguaugaccugcaucgcaguagggcugguaacauuauacuuaggugucaugguccaggcagauagugguugcgucauaaacuggaaaggccgcgaauuaaaauguggaaguggaauuuuugucacgaacgaagugcauacuuggacugagcaauauaaauuccaggcagacucaccaaagcggcucagcgcagcaauaggacgagccugggaagaaggaguaugugguauuagaagugcaacacgucuugaaaacauuauguggaagcaaauuucgaacgaauugaaucauauacuucuugaaaacgauaugaaauuuaccguuguagugggugauguaguagggauauuagcgcaaggaaagaaaaugauccgaccacaacccauggaacauaaguauuccuggaaaaguuggggaaaggcgaagauaauuggagcagauguccaaaauacaacauucauuauugauggucccaauacccccgaaugucccgacgaucagcgcgcauggaacauuugggaaguugaagacuacggauuugggaucuucacuacuaacauaugguugaagcuacgagacucauauacucaaguaugcgaucauagacucauguccgcagcaauuaaagauaguaaagcgguacaugcagacaugggguacuggauugaaucggagaaaaaugaaacguggaaauuggccagagcaaguuuuauagaagucaaaacauguauauggccgaaaucacacacauuguggucaaauggaguucucgaaucagagaugauaauuccgaaaaucuauggagguccuauaucgcaacacaacuauagaccgggcuacuucacacaaacagcaggaccauggcauuuagguaaguuagagcuugauuucgacuuaugcgaaggaacuacagucguuguugacgaacauuguggaaauagggguccgaguuugagaacuaccacgguaacaggcaaaauaauacaugaauggugcuguagaucaugcacacuuccacccuuaagguuuaagggugaggacggaugcugguaugguauggagaucaggccagugaaagaaaaagaagaaaaucuaguaaaaucaaugguguccgcgggaucgggcgaaguggauuccuuuucucucgguuuauuauguauaucaauuaugaucgaggaagucaugagaucaagauggagucggaaaauguuaaugacggguacauuagcgguauuucuauuauuaauaaugggacaguugacguggaaugaccuaauaagauuauguauaaugguaggugcuaacgcaagugaccguaugggcauggguaccacauaucucgcauuaauggccacauuuaagaugcgaccaauguuugcaguuggauugcuguuuaggcgucugacuucaagagaaguauuauugcuaacgauaggacuaucauuaguggcaaguguagaacuaccgaauagucuagaggaacuuggugauggauuggcuaugggaauaaugauauuaaaguuguuaaccgacuuccaaucacaucaauuaugggccacauuacuguccuugacauuuauaaagacuacccucucauuacauuaugcguggaaaacuauggcaauggucuugucaauagcgaguuuauucccucuaugcuugucaaccaccucucagaaaacuacuugguuaccugugcuguuagggagucucggguguaagccgcugacgauguuuuugaucaccgagacaaaaauauggggaaggaaaucauggccguuaaaugaaggaaucauggcaguggguguuguaaguauuuuacuuucaucuuuauugaaaaaugacguaccccuagcggguccacuaauagccggcgggaugcuaauugcauguuauguaauuaguggaaguucugcugaccuuagucuugagaaagcagcagaaguaucgugggaggaagaagcggagcacucuggagcaagucauaauauucucguugugguucaagaugaugguacuaugaaaauaaaagaugaagaaagggaugauacauuaacaauauugcuaaaggcaacacuguuggcuguuucagggguauacccauugucuaucccagcuacauuauucgucugguacuucuggcagaaaaagaaacagagaucuggaguccuuugggauacgccaaguccuccagaagucgaaagagcgguccuagacgaugguauuuauaggaucaugcagaggggacuauuaggacguucucaaguagggguaggagucuuucaagaaaacguguuucauacgauguggcacgugacaaggggugcuguuuugauguaucagggcaaacgauuagaacccaguugggcauccgucaagaaagacuuaauaucauauggugguggguggcgauuacaagguucuuggaauaccggggaggaggugcaaguaaucgccguugaaccggggaaaaauccuaaaaauguccaaacagcaccaggaacuuucaaaacaccggaaggagaaguaggggccauagcauuagauuuuaaaccugggacuucaggcuccccaaucguaaacagagaagggaaaauagugggacucuaugguaaugggguaguuacuacaaguggaaccuauguuucagcuauugcacaagcuaaggcuagccaagaggguccuuugccagagauagaagacgaagucuuuagaaagaggaacuuaacgauuauggacuuacacccagggaguggcaaaacgaggcguuaucuaccagcgauuguuagagaggccaucaaacgcaaauuacgaacguuaauccuggcuccaacccggguaguugcuuccgaaauggcagaggcacuaaaaggaaugccaaucagauaucaaacuacggcgguaaagagcgaacauaccgguaaagaaauaguggaucuaaugugucaugcuacauuuacuaugaggcuauuaucuccugugagagugccuaauuacaacaugaucauaauggaugaagcacauuuuacugauccaagcaguauugcugcuagaggauauauaucaacacgaguaggaaugggagaagcagcagccauuuucaugacagcgacaccuccaggaucaguagaggcauucccgcaaagcaaugcagugauacaagacgaagaacgagacauaccagaacguucauggaauagcggauaugaauggauaacugacuucccagggaaaacgguaugguucgugcccucaauuaaaucuggaaacgauauagcgaauugcuuaaggaaaaaugggaagaggguaauccaauugaguaggaaaacauuugauacugaauaccagaaaacuaagaauaaugacugggauuacguugugacaacggauauaagcgaaaugggugcaaacuuuagagcagauagagucauugauccgcgaagaugccucaaaccggugauucuuaaagacggaccugaacgaguaauacuagccggaccaaugccugucacaguugcauccgcggcgcaacggcgaggacgaauaggccggaaucauaacaaagaaggagaccaauacauauacaugggacaaccgcuaaacaaugacgaagaucaugcucauuggacggaagcuaaaaugcuauuagauaauauuaacacacccgagggaauuaucccagcguuguucgaacccgagcgugagaaaucugcggcuauagauggggaauauagguugagaggugaagcacgcaaaacuuucgucgaguuaaugaggaggggcgauuugccaguauggcucucuuauaaaguugccagcgaaggcuuucaauacucagaucgaaggugguguuuugauggagaacgaaauaaccaagucuuagaagagaacauggacguagaaauauggacaaaagaaggagagaggaagaaacuaagaccaagauggcuagacgcaaggaccuauagcgauccgcuugcacucagggaguuuaaagaauuugcugcaggcaggagaucagugucuggcgaccuaauauuagaaauugggaaguuaccccagcaucuaacucagagagcucaaaacgcucuagauaauuuagugaugcuacauaacagugaacaaggugggcgugcguauagacaugcaauggaagaacuuccggauacaauugaaaccuugaugcuauuagcacugauagcgguucuaacugggggugucacacuauuuuuccugagcggccguggauuagguaaaacgucaauuggguugcucuguguaauggcaagcucgguacuacucuggauggcuucagucgaaccccacuggauugccgcaaguauuauacuggaguucuuucuuaugguacuauugauuccugaaccugauagacaaagaaccccgcaggauaaucaacuugcauacguaguaauugguuuauuguucaugauacuuacugucgcagcaaaugaaaugggucugcucgaaacaaccaagaaagaucuagguaucgggcauguggcuguagaaaaccaccaccacgcgacuaugcuugauguggaccuacauccggcguccgcauggacacuauaugcagucgccacaacuauaauaaccccuaugaugagacauacgaucgaaaacacgacagccaacauaucguuaacagcaauugcaaaucaagcggcaauuuuaaugggguuagauaaggguuggccaauuaguaagauggacauuggcguaccucuauuagcacucggcuguuacucacaaguaaacccauuaacacuuacggcugcgguuuuaaugcucgucgcccacuaugcaauuauaggcccaggccuucaagccaaggccacaagggaggcacagaagagaaccgcugcuggcauaaugaaaaauccuacagucgaugguauaguugcuauugacuuagacccugucguguaugaugcaaaauucgaaaaacaacuuggacagauuaugcuguuaauccuauguaccucucaaauucuucuaaugcgaaccacgugggcuuuaugugagagcauaacccuugccacgggaccgcucaccacacuaugggaaggaagcccuggaaaguucuggaacacaacaauugcaguaucuauggcgaauauauuccgugggagcuaccuggccggugcaggauuagcguucucgcuuaugaaauccuuagguggagggcggagggguacaggugcgcagggggaaacgcuaggugagaaguggaagagacaacucaaccaguugagcaaaagcgaauuuaacauauacaagagaucugguaucauggaaguagauaggagugaagccaaagagggauuaaaaagaggggagacuacuagacacgcagucagucgagguaccgcaaaauuacgaugguucguugagagaaauuuagucaaaccagaaggaaaaguaauagauuuagguugcgggcgugggggauggagcuauuauugcgcggggcuaaagaaaguuacggaaguaaaggguuauacaaaaggagggccuggacaugaggagccuauaccaauggccacuuaugguuggaaccucguuaaacuacacagugguaaagauguuuucuuuaccccuccugaaaaaugugauacacuucuuugugacauaggggagucaucacccaaucccacaauugaggaagguagaacauuacgaguccuaaaaaugguagagccauggcuccgugggaaccaauuuugcaucaaaauauuaaacccauauaugccguccguuguugaaacccucgaacaaaugcaacgcaagcaugguggaauguuaguaagaaacccacucucuaggaacagcacacacgaaauguacuggguauccugugguacagguaauaucgucucugcugugaauaugacaaguagaauguuacucaaucgguuuacgauggcgcaucgaaaaccaacauacgagagggauguagaucugggcgcugggacuaggcacguugcuguugaaccagagguagcaaacuuagauauaaucggucaaagaauugagaauauaaagcacgaacauaaaucuacuuggcauuaugaugaagacaaucccuacaagaccugggcuuaccacgguucauacgaggucaaaccuaguggaucugcaaguuccauggucaacggagucgugaaacuuuuaacuaaaccgugggaugucauuccaaugguaacacagauagcaaugaccgauaccacuccauuuggacaacaacgaguauuuaaggaaaaaguggauacucguacuccuaaagcuaaaagaggaacugcgcagauaauggaggugacugcccgaugguuguggggauucuuaucaagaaauaagaagccaagaaucuguacccgagaagaauuuacaaggaaaguacguaguaaugcugcuauaggugcuguuuuuguagacgaaaaucaauggaacucagccaaagaagcaguugaagaugaaagauuuugggauuugguucaaaaggaacgggaauugcauaagcaaggcaaaugcgcuacauguguauauaacaugaugggcaagagggagaagaaacugggagaauuuggaaaagcaaaggguagccgagcgauaugguacauguggcugggggccagauucuuggaguucgaagcauuaggauuuaugaacgaagaccauugguuuucuagagaaaacagccuuuccgguguagaaggugaaggauugcacaaacuaggauauauccuaagagacauuaguaaaauaccuggcgggaacauguaugcugaugacacugcggguugggacacgaggauaaccgaggaugaccuacaaaaugaggcaaaaauaacagauauaauggagccagaacacgccuuacuugcaacuucuauauuuaaacuaaccuaucagaacaaaguagugcggguucaaagacccgcgaaaaauggaacaguuauggauguuaucucucgucgagaucagagggggucuggucaagucggaacuuacgguuugaauacguuuacaaacauggaagcacaguuaauuagacaaauggaaucugaaggcauauuuuugccauccgaacucgagacgccuaauuuagcagagcgcguucuagacuggcuugagaaguacgggguagaaagauuaaagcggauggcaaucucaggagaugacuguguggucaaaccaauugaugauagauuugcgacagcacuaacagccuugaaugauauggguaagguucguaaagauauaccucaaugggaaccuaguaaaggauggaaugacuggcaacaaguuccguuuugcagucaccauuuccaccagcucaucaugaaagaugggcgagaaauuguugucccaugcagaaaccaggacgaacucguagggagagcgcgagugucucaaggugcgggcuggaguuuaagagaaacugcaugcuuagggaaaucuuacgcacagauguggcaacuuauguacuuucaucgccgagauuuacgacuugccgcaaacgccauuuguagcgcgguaccuguugauuggguaccaacaagucgcacaacuuggucuauacacgcucaccaucaauggaugacgacagaagauaugcuaucugucuggaauagaguguggauugaggaaaacccauggauggaggacaaaacacacguaaguucauggggagacgugccauaccucgggaaaagagaggaucagugguguggcucgcuuauaggcuugacggcacgcgcaacaugggcaagcaacauacagguugcaauaaaucaaguacguagauuaauaggaaacgaaaauuaucucgacuauaugacaucaaugaaacgauuuaagaaugagggugacccggaaggggcacuuugguag

SEQ ID NO: 21730 - RNA, 9879 nt, Artificial Sequence
  derived and/or modified CDS sequence (opt6) from DENV-1__FJ898394__SS-prME
ucaguaacgaugcuacuaauguuaaugccuacugcauuggccuuucaucucaccacgagagguggagaaccccauaugauuguaacaaaacaagaaaggggaaagagcuuacuauuuaaaacaucagcaggcguaaauauguguaccuuaauugccauggaccucggcgaguuaugugaagacacaaugacuuacaaaugcccuagaaucacggaagccgaacccgaugauguggacugcugguguaaugccacugauaccugggugacguacgggacuuguucgcaaacaggugaacauagaagagacaaacggaguguagcacuagcaccacaugugggacuuggccuugaaacgaggacagaaacauggaugucaagugaaggggcauggaaacaaauacaaagagucgaaacaugggcuuuaagacaucccggauuuaccgucauagcucuguuucuagcacacgcuauaggcacuucaauaacacaaaaaggaauaaucuucauacuccuaauguuggucacaccaaguauggcgaugagguguguugguauuggaucuagagacuucgucgagggccuuaguggggcaacuugggucgacguaguauuagagcaugguucauguguaacaacaauggcuaaagauaaaccuacauuagauaucgaauuauugaaaacagaaguaacaaauccagcagugcucagaaaauuguguaucgaagcaaaaauuucgaauacaacaacagacuccagauguccaacccaaggcgaggcgacucuaauggaagaacaggacgccaauuuuguauguaggaggacauucgucgaccgcggauggggcaaugguugcggauuauuuggaaaaggaucuuugauuacaugugcuaaauuuaaaugugugacaaaguuggagggcaaaaucguacaguaugaaaaccuaaaauacagcgugauaguaacaguacacacuggcgaccaacaccaaguaggaaaugaaaguacugaacacggaacaacugcgacaauaacuccgcaggcacccacgagugaaauacaacugacagauuauggagcauuaacacuagauugcaguccacgcacaggacuggacuuuaaugaaaugguacuucugacuaugaaggaaaaaucauggcuagugcauaagcaaugguuuuuagacuuaccgcuaccuuggaccaguggugcaaguacuccccaggagacauggaauagacaagauuugcuuguuacauuuaagacagcacacgcuaagaagcaggaaguuguaguacuaggaagccaagagggggcuaugcauacggcguuaacaggcgcgacagagauacaaacaagcggcacuacaacaauauuugcaggucacuuaaaauguaggcucaaaauggacaaacugacuuuaaaaggcaugagcuacguaauguguacuggaucauuuaaacuugaaaaagaaguggcggaaacacaacacgggacaguucuaguacagauaaaguaugagggaacagaugcaccgugcaaaauaccguuuucgacacaagaugagaaagggguaacacaaaauggaaggcuuauaacagccaacccgauaguaacagacaaagaaaaaccgguaaacauugaagcggaaccacccuucggggaaaguuauauuguaaucggugcaggagaaaaagcucuuaaguuaagcugguucaaaaaggguucgucaauaggaaaaauguuugaagcaaccgcacguggggcacgacgaauggcaauccuaggagauacagcaugggauuucgggaguauagguggaguuuuuacuuccgucggaaagcuagugcaucaaauauuuggcaccgcauauggaguauuauuuagcgggguuuccuggacaaugaagauagguauuggaguauuguuaacguggcuugguuuaaauaguagaagcacgagucucuccaugacguguauugcagucggccuugugaccuuauauuugggugugauggugcaggccgauuccggaugcgucauaaauuggaaaggaagagaacucaaaugugggucaggaauuuuuguaacuaaugaaguucacacauggacagagcaauacaaauuucaagccgauucaccaaaaagguuaagcgcagcuauugggaaagccugggaagaaggaguauguggaauacgaagugcaacaagauuagaaaauauuauguggaaacaaauuucuaacgaguuaaaccacauuuuacuagaaaaugauaugaaauuuaccgugguaguaggagaugugguuggaauuuuagcacagggcaaaaagaugauuaggccacagcccauggaacacaaauauucuuggaaaucaugggggaaagcuaagauuauuggagcagauguccaaaacacuacuuucauaauagacggacccaacacaccugaaugucccgacgaccaacgggcuuggaauauaugggagguagaagacuacggguucggaauuuuuaccaccaauauuugguuaaaacuucgcgacaguuauacacaggugugugaucaucgucuaaugagcgcggcuauaaaagacagcaaggcuguacaugcagacaugggguacuggauagaaagugagaaaaaugagaccuggaaauuagcucgagcgagcuucauagaaguaaaaacaugcaucuggccuaaaagccauacucuauggaguaacggaguacuugaaagugaaaugauaauuccuaagauuuaugguggaccaauaucucaacacaauuauagacccggauacuuuacacaaacagcuggaccuuggcauuugggaaagcuagagcuggacuuugaccugugugaagguacgacuguuguuguagaugaacauugcggaaaccgagggccaagccuacgaacuacgacuguuacggguaagauaauucacgaauggugcugcagaaguugcacccucccaccauuacgcuuuaagggagaagaugguugcugguacggaauggaaauacgaccgguaaaagaaaaggaagagaacuuaguaaaaucuaugguuucagccgggaguggggaaguugauaguuuuagccugggauuacuuuguauaucgauuaugauugaagaaguuaugcggaguagauggucgagaaaaauguugaugacggguacauuggccguauuccuacuucugaucauggggcaauugacauggaacgaucuaauccggcucuguauaaugguuggagcuaacgucuccgaucgaaugggaaugggaacaaccuaccucgcuuuaauggcgaccuucaaaaugcgaccgauguucgcugucggacuccuauuccgaagacuaacgagccgcgagguauuguuguuaacgauaggauugucacucguugcaucaguagaauuaccuaauucucuagaagaacuuggggauggauuagcaaugggaauuaugauucuuaaauuacuuacagauuuucagagccaucagcugugggcaacacuacuuaguuuaacauucaucaaaaccacucugucacuacauuacgcauggaaaaccauggccaugguccucucgaucguaucacuuuuuccauuauguuuaucaacuacaucacagaaaacgacuuggcuaccgguguuauuaggcucuuuaggaugcaaacccuuaacaauguuuuugauagcagaaaacaaaauauggggucgaaaaucauggccccuuaaugaaggaauuauggcuguuggcguagucucuauccuauuauccucauugcuaaagaaugacgucccuuuggcagguccacuuauagcuggaggaaugcuaauagcauguuaugugauuagcgguucaagugccgacuugaguuuggaaaaggcagcggaagucagcugggaagaggaagcugaacauaguggagcuagccauaacaucuuaguugaaguacaagacgacggaaccaugaagauaaaggaugaagagagggaugacacacuaacaauacuauuaaaggcaacuuuacuagcugucuccggaguguauccucuaaguauaccugcaacucuauucguuugguauuucuggcagaagaagaaacaaagaucaggaguauuaugggauacuccaagucccccggaaguugaaagggcaguuuuagaugacgguauauacagaaucaugcaaagaggacuuuuaggucgaucgcaaguaggaguggguguuuuucaagaaaacgucuuucacacuauguggcauguuacacgaggagcgguacuaauguaucaggggaaaagauuggaaccaaguugggcaucugucaagaaagaucucauaucauacgguggaggguggagacuccaagggucauggaauaccggggaagaaguucaaguaauagcggucgagccaggcaaaaaucccaaaaacguacaaaccgcaccgggaacauuuaaaaccccagaaggcgaaguuggggccauugcguuggauuuuaaaccuggcacaagcggaucaccuaucguuaacagagaaggaaaaaucgugggacuauauggcaauggaguuguaacuacaucugggacauacgucagugcuaucgcgcaagcaaaggcuucucaagaagguccacugccggaaauugaagaugaaguauuuagaaagaggaaccuuacaauuauggauuugcacccgggcuccggaaaaacacggcguuaccuaccagcaauaguuagagaagcuauuaagagaaaacuccgaaccuuaauacuagcuccaacucgcguaguagcuucugagauggcagaggcguugaaagguaugccaauacgguaucaaacaacggcaguaaaaucugagcauacaggaaaagagaucgucgauuugaugugccacgcuaccuucaccaugcgucuacucucgccgguuagagucccuaacuauaacaugaucauaauggacgaggcgcauuuuacagacccaagcuccauugcggcgagaggauacauaucgacucgaguugguaugggugaagcagcagcaauauucaugacugcaacgccaccaggaucaguggaggcauucccucaguccaacgcggugauacaggacgaagaacgcgacauaccugaaaggucguggaacucagguuaugaauggauuacugauuuuccaggaaagacuguaugguuuguaccaaguauuaaguccgguaaugauauugccaacuguuuaagaaagaacgguaagcgcgucauacaauuaucaagaaagacauuugacacagaguaucagaaaacuaagaauaaugauugggauuacguagugacuacggacaucuccgaaaugggagcgaacuuucgagcggaucgaguuauugacccaagacgcuguuuaaaaccaguaauccuuaaagauggaccggaaagagucauucuugccggacccaugcccguuacgguagcuagugcagcacaacgaagaggcagaauuggccgcaaucacaacaaagaaggagaucaauacauuuacaugggacagccauuaaauaacgacgaagaucacgcgcauuggaccgaggcuaagauguugcuugacaacauuaacacuccggaggguauaauaccagcucuauuugagccggaacgagagaaaucagcagcaauagacggagaauaucgauuaagaggggaagcaagaaagacauucgucgagcuaaugcgaagaggugaccuaccuguuuggcugucauauaaaguugcgagugaagguuuucaauauuccgauagaagguggugcuucgauggagaaagaaacaaccaaguacuagaggagaacauggacgucgagauauggacuaaggaaggugagcgaaagaaauugaggccccguuggcucgacgcuagaacguauucagauccuuuagcgcuaagagaauuuaaagaauuugcagcgggacgacgaucggucucuggggacuuaauacuugaaauuggaaaacugccacaacauuugacacaacgggcacaaaacgcuuuagauaauuuaguaauguuacauaauucugagcaaggugggagagcuuaccgacaugcgauggaagaacuaccugauacgauagaaacuuugauguugcuggcacuaauugcaguguuaacaggaggagugacgcucuuuuuccuaagcgggaggggcuuaggaaaaacaucuauaggacuucuaugugugauggcaucuucuguccuucuauggauggcuucugucgaaccccacuggauugccgcuucaaucauauuggaguucuuucuuaugguguuguugauaccugaaccagacaggcaacgaacaccacaagauaaucagcuagcuuauguaguuauagggcuucuauuuaugauacuaacaguggcagcuaaugaaaugggauugcuggaaaccacuaagaaagaucuuggaauuggccacguugcuguggaaaaucaucaucaugcuacuauguuagauguggaccuacauccagcaagugccuggacauuguacgccguggccacuacaaucauaacgccuaugaugagacauaccauugaaaauacgacagcaaauauaucuuuaacagccauagcgaaucaagcggcgauuuugauggguuuagauaaaggguggccuaucucgaaaauggauauaggagucccuuuauuagcccuaggcugcuacagucaaguuaauccauuaacauuaacugccgcgguacuaauguuagucgcacauuaugcuauaauuggucccggguuacaagcaaaggcuacacgagaagcccagaaaaggacagcagcagguauaaugaagaacccaacgguugauggaaucguggcuauugaucuagauccuguuguuuacgaugcaaaguuugaaaaacaacucgggcaaaucauguuauuaauauuguguacaucacaaauuuuacuaaugcgaaccaccugggcguuaugugagucaauaacgcucgcaacuggaccauugaccacacucugggaagguucaccagggaaauuuuggaacacaacuauagcugucucaauggcaaacauuuuuagggguaguuauuuagccggggccggccuggcuuuuagucuuaugaagagucucgguggagggagacgugguaccggugcacagggcgagacucuuggugagaaauggaaacgacaguuaaaccagcuaucgaagucagaauuuaauauauacaaaaggaguggcaucauggaaguugacagaucagaagcgaaagaagggcuaaagcguggagagacuacacgucaugcuguaaguagaggaaccgcgaaacuccgaugguuuguagagcgaaaucucguuaaacccgaaggaaaagucauagaccugggcugugguagaggcggcuggucauauuauugcgcuggccugaagaaaguaacagaaguuaaaggguauacaaaaggggguccuggucaugaagaaccgauuccuauggcaacauauggauggaaccuaguaaaacuccacagcggcaaggacgucuucuuuacaccacccgaaaagugugauacauuacucugugauauaggcgaaaguagucccaacccgaccaucgaagaaggaagaaccuuacgugucuuaaaaauggucgaaccaugguuaaggggaaaccaauuuuguauaaaaauacuaaaccccuauaugccgaguguuguagaaacauuagaacaaaugcagcgcaaacauggcgguauguuggugcgaaauccacucucacgaaauuccacgcacgaaauguauuggguuuccugcggaacaggcaacauaguaucugcagucaacaugacgagccgaaugcucuuaaacagauucacgaugacucacaggaaaccaacauaugaacgugauguggacuuaggagcugggacacgucacguugcgguagaaccugaaguugcuaauuuggauauaauaggucaaagaauagagaauauuaagcaugaacauaaaucaacauggcauuacgacgaagacaauccuuauaaaacgugggcuuaucaugguagcuacgaaguaaaaccuaguggaagcgcaaguaguauggugaacggugucguaaaauuacugacgaagccgugggacguaauuccaaugguaacccaaauugcuaugacagacacuacacccuuuggacaacaaaggguguucaaagagaaaguugacaccagaacaccaaaggcaaagaggggaacggcacaaauaauggaagucacugcucgguggcuauggggauucuuaucaagaaacaagaaaccacgcauuuguacuagagaagaguuuaccagaaaaguacgaagcaaugcagcaaucggagcggucuuugucgaugaaaaccaauggaacucggcaaaggaagcaguugaagaugaacgauuuugggacuuaguucagaaagaaagggaguuacauaaacaaggaaaaugugcgacgugugucuacaacaugauggggaaaagagagaagaaacucggugaauuuggaaaggcaaaggggucacgagcaaucugguacaugugguuaggugccagguuucuagaauuugaagcauugggauuuaugaaugaagaucacugguucagccgagagaacuccuuaagcggggucgaaggagaaggucugcacaaacuuggguacauucugagggauauuagcaaaauuccaggaggaaacauguacgcugaugauacagcagguugggacacaaggauaacagaagacgaucuccaaaaugaagcgaaaauaacagauauaauggaaccagaacaugcacugcucgcaaccucaauauuuaagcuaacguaucaaaacaaggucguaagaguacagaggcccgcgaaaaacgggaccguaauggauguaauaucgagacgugaucaaagagggagcggccaaguuggaacguauggauugaauacauuuacaaauauggaggcacaacuaauaagacaaauggagagugaaggaaucuuucuacccagugaauuagaaacucccaaccuugcagaacgagucuuagauuggcuagagaaacaugggguagagagauugaagcgaauggcaauuagcggugaugauugugugguuaagccaauugacgauagauucgccacggcgcucacugcauuaaaugauauggggaaagucaggaaggauauaccucaaugggaaccaucgaaaggguggaacgacuggcaacagguaccauuuugcagucaccacuuccaucagcuaaucaugaaagauggucgcgaaauugucgucccuugcagaaaccaggacgaacucgucgguagggcgagaguuucacaaggcgcaggcuggucacuaagggaaacggcaugccuuggaaaaucauaugcacaaauguggcagcuuauguacuuccauagaagagaccuuagacuugcugcgaaugcuaucuguagugccguaccaguagauugggucccgacuucuaggacuacauggucuauacaugcccaccaccaauggaugacaaccgaagacaugcucucaguauggaaccguguuuggauagaagaaaauccauggauggaagacaaaacgcauguaaguucauggggugacgucccauaucuggggaaaagagaagaucagugguguggcucauugauuggacucacugccagagcuacaugggccucaaauauacaaguagcgauuaaccaaguaaggcgacugauaggaaacgaaaacuaccuggauuauaugacgagcaugaaaagauuuaaaaaugaaggcgacccugaaggugcgcuaugguag

SEQ ID NO: 21731 - RNA, 9879 nt, Artificial Sequence
  derived and/or modified CDS sequence (opt6) from DENV-1__GQ199838__SS-prME
ucaguuacgauguugcucauguuaaugccaacugcauuagcauuucaucuuacaacacgcggcggugaaccucauaugauaguaaccaagcaagaacgggguaagucacuucuauuuaagacuucagcgggcguaaauaugugcacauuaauugcaauggaccuaggagaacuuugugaagauacgaugacauauaaaugucccagaauuacggaagcggagcccgacgacguggacuguugguguaacgcaacggauacgugggucacauacggcacaugcucccaaacuggugagcaccgaagagauaaacgcaguguugcuuuagcaccgcacgugggccuggggcuggagacgagaacugagaccuggauguccagugaaggcgcuuggaagcagauacaacguguagaaacgugggcgcuacgucauccaggguucacugugauagcguuauuuuuagcacaugcaauaggaacuucgauuacacaaaaggggauuauuuucauauuauuaauguuagugacacccucuauggcaaugcgauguguaggaaucggcagccgagacuuuguugaaggucugucaggggcaacaugggucgacgugguucuugaacacgguuccuguguuacaacuauggccaaggauaagccaacgcuagauauagaguuacuaaagacagaggugacaaaccccgccguucuaaggaaguuaugcauagaagccaaaauuucaaauacgaccacugauucuaggugcccuacccaaggugaagcaacucuaauggaagaacaagaugcgaauuucguaugcaggcgaacucuaguagaccgagggugggguaauggaugcggacucuuuggaaagggaaguuugauuacaugcgccaaauucaaauguguuaccaaacuggaaggaaaaauuguacaguacgaaaauuuaaaauauucaguuaucguaacaguacauacuggagaccaacaucaagugggaaaugagucgacggagcacggaaccacggcaacgauuacgccucaagcgccaaccucggaaauacaacuuaccgauuacggcgcccucacucuagauuguaguccccgaacuggacuagauuucaaugaaauggucuuauuaacuaugaaggagaagaguugguuaguacauaagcaaugguuccuggauuuaccacucccauggacgagcggugcaucuacuucacaggagacauggaauagacaagauuugcuaguuacauuuaagacggcucacgccaagaaacaagaaguaguuguacuaggaucucaagaaggggcaaugcauacugcgcuuacaggugcaacggaaauacaaacuucaggaacuacaacgauuuucgcaggacaccuuaagugcagauuaaaaauggauaaacuaacauuaaaaggaaugucauauguuauguguacaggaucauuuaagcuagaaaaagaaguggcggaaacgcagcaugggacgguccuuguccagauaaaauacgaagguacagaugcuccuuguaaaauaccuuucucaacucaagacgaaaagggugugacacaaaaugguagauuaauuacugcaaauccaaucgugacggauaaggaaaaacccguuaacauagaggcagagccaccauuuggggaaaguuacauuguaauaggugcuggagaaaaagcucuuaaguuaagcugguuuaagaaaggaucuucuauuggcaaaauguucgaagccacggcacgcggugcucgaaggauggcgauauuaggugacacggcgugggauuuuggaucaauagggggaguauuuacgucgguagguaaauuaguccaucagauauuuggaacagcguacggcguguuauuuuccgguguaucauggacaaugaaaauaggaauugggguauuacuaacuugguugggucuaaauagccgcagcaccucauugaguaugacuuguauagccguagguuuggucacuuuauauuugggcguuaugguacaagcggauucuggaugugucauaaauuggaagggaagggaacugaaguguggcagcgggauauuugugacaaaugagguucacacuuggacagaacaauacaaauuucaagcagauagcccuaaacgucuaucggccgcaauuggaaaagccugggaagaaggcguaugcggaauccgcagugccacuagacuugaaaacaucauguggaaacaaauuagcaacgagcuuaaucauauucuauuagaaaacgguaugaaauucacaguaguugugggggauguaguaggcauucuggcucaagggaagaaaaugauacggccacaaccgauggagcacaaauacagcuggaaaagcuggggaaaagcaaaaaucauaggagcagauguacaaaauacuacauuuauaaucgaugguccgaauacucccgaauguccagaugaucaaagagcguggaacauuugggaggucgaagauuacgguuuuggaauauucacaacgaacauaugguuaaaacuccgagacaguuacacccaaguuugugaccauaggcucaugagugcagcaauuaaagacucaaaagcgguucaugcugacaugggauacuggauagaaagugagaaaaacgaaaccuggaaacuugcacgagccaguuuuauagaaguaaaaacuugcauauggccgaaaagccauaccuuauggucaaaugguguucuugagucagaaaugauuaucccaaaaauuuauggugguccgauuucacaacauaauuauagacccggauauuucacacaaacagcuggaccauggcacuuaggcaaacuugaauuagauuuugaucucugcgaaggaacaacaguaguuguagacgaacacugcgggaaucgagggccgagucugagaacaaccacaguaaccgguaagauuauacacgaauggugcugccguucauguacguuaccgccccuacguuucaagggagaggacggcuguugguauggaauggaaaucagaccuguuaaggaaaaagaggagaaucuaguaaagucuauggugagcgcagggaguggugaaguagacagcuuuucgcuuggccugcuuugcacaucuauaaugauagaggaaguuaugagaaguagguggucgagaaaaauguuaaugacugggaccuuagcgguguucuuauuacuuauuaugggccaacuaacuuggaaugauuuaauacgacuguguaucaugguuggagccaaugcuuccgaccgcauggggaugggaaccacguacuuagcauuaauggcgacguuuaaaaugagacccauguuugccgucggccuauuguuuagacguuugacaucacgagagguauuacuacugaccauuggacucucucugguggcaucagucgaauugccuaacagucucgaggaacuuggagauggccuagcuauggguauaaugauauuaaaacuacuaacugauuuucagucgcaccaauugugggcgacauuacucucucucacguucauuaaaacaacacuuagucuccauuaugcauggaaaacgauggccauggucuugucaauaguaucccuuuuuccacugugucuaucuacgacaucgcagaaaacaacauggcuaccaguauuauuaggcucucuaggaugcaaaccccugacgauguuucuaauagccgaaaauaagaucuggggucguaagaguuggccucucaacgaaggaauaauggcaguuggcguuguaucaauacucuuaucuucauuacuuaaaaaugacgugccacucgcggguccgcugauugcugguggaauguuaauagcauguuacguaauuucaggcucaucagcggauuuauccuuggaaaaagcugccgaaguauccugggaggaggaagcugaacauucuggagcaagucacaacaucuuaguagagguccaagaugacggaacgaugaaaauuaaggacgaagaacgagacgauacucugacaauacuauugaaagccaccuuauuggcaguaucuggcguauacccauuaucaaucccggcgacacucuuuguaugguauuuuuggcagaaaaagaaacaaagaucaggagucuuaugggauacuccaucacccccagaaguagaaagagcaguauuagaugaugguauauaucgaaucaugcaaagaggucuccucggcagaagucaaguggggguuggcguuuuccaagaaaauguuuuccauacaauguggcauguaacucguggugcaguucuuauguaccaagguaaacgacuagaacccucgugggccucagucaaaaaggaucugauuaguuauggugggggauggcguuuacagggaucguggaacacaggggaagaaguucaaguaauugccguugagccugggaaaaauccaaagaacguacaaacugcaccaggaaccuucaagacgccugaaggggaagucggagcuauagcuuuagacuuuaaaccagguacgucgggcaguccaaucgucaaccgggaagggaagauugugggccuuuaugggaaugguguggugacuacgucuggaacguaugucucagcaauugcacaagcuaaagcaagucaagaggggccauuaccggaaauagaggaugaaguuuucaggaaaagaaaccuaacuauaauggaucuacauccagggaguggaaaaacaaggagauauuuaccggcaauaguacgugaagcaauaaaacguaaacuuagaacccuaauauuggcaccaacccgaguuguggcgagcgaaauggcagaagccuuaaaggggaugccaauaagauaccaaacgaccgcgguuaaaagugaacauaccgguaaagaaauaguggaucucaugugucaugcaacauucaccaugcggcuguugucucccguacgcguaccaaacuauaauaugauaauaauggacgaagcacacuuuacggauccaagcucgauugcggcacgaggauacauaucgaccagggucgggaugggggaagcggcugcuauauucaugacggcuacgccaccggguagcguggaggcuuuuccucagaguaaugcagugauacaagacgaagaaagagauauucccgaaagaagcuggaacucgggcuaugaauggauaacugacuucccagguaagacaguuugguucguaccaucaauaaaaaguggaaaugacaucgccaauugucuaaggaaaaaugguaaaagagugauacaacuaagcagaaaaacauuugauacagaauaucagaaaaccaaaaacaacgacugggacuauguaguuacgacagacauaucagaaaugggagcgaauuuccgagcggacagagugauugauccgagaagaugcuugaaaccgguaauacuaaaggaugguccugaaagaguaauucuagccggaccaaugcccguaacgguagcaucagcagcgcagagacguggacgcauagguagaaaucauaauaaagaaggcgaccaauauauuuacaugggacaaccccugaauaacgacgaggaccaugcacauuggaccgaagcuaaaaugcuuuuagauaauaucaacacgccggaaggaauaauaccugcuuuauuugaaccagaacgagagaaaucagcagcgauagacggcgaauauagguugcggggagaagcucggaaaacuuuuguugagcugaugaggagaggugaccuaccagucugguuaucuuauaaagucgcuucggaaggcuuucaauacagugacagaagaugguguuucgauggagagaggaacaaucaaguccuagaagagaacauggacguugaaauuuggacgaaagaaggagaacgcaaaaaguuacgaccgcgcuggcuagaugccagaacauacucagaucccuuggcgcuaagagaguucaaagaauuugcugcgggaagacgaagcgugucaggggacuuaauccuugaaauuggaaaauuaccacaacaucuaacacaaagggcucagaacgcuuuagauaauuuaguaaugcuucauaacagugaacagggagguagagcuuaccggcacgccauggaagaacuaccagauacaaucgaaacauuaauguuacuagcccugauugcaguacuaacaggagguguaacccuauuuuuccuaucaggcagagggcuaggaaagacaucgauaggauuguuauguguaauggcaucgucuguccuacuuuggauggcaucugucgaaccccauuggauugcggcuucuauaauacuugaguucuuucuaaugguauuauuaauuccagaaccggaccgacagagaacgccacaagauaaucaauuagcguaugucguuauaggcuuguuguuuauuauuuuaacaguagcagcaaacgaaaugggacuucuugaaacuaccaagaaagaccuaggaauuggacauguagcuguagagaaucaccaucaugcuacaaugcuagauguugauuugcaccccgcuagugcauggacccuguacgcaguugccacgacuauaauaaccccaaugaugcggcacacuauagaaaauacgacagccaauauuagcuuaacugcuauagcaaaccaagcugcaauucuaaugggauuagauaaaggauggccaauuaguaaaauggauauuggagugccgcuauuagcacucgguuguuacucucaaguaaauccccuuacacucacagcagcaguccuaaugcuaguugcacauuaugcuauuaucggaccuggucuccaagccaaggcuacacgugaagcacaaaaacggaccgcugcaggaauaaugaaaaauccgacagucgauggaauagucgcuauugaucuagauccugugguauaugacgcgaaguuugaaaaacaacuugggcaaauuaugcucuuaauauugugcacaagucaaauacugcuaaugcgcacgacgugggcccucugugaaaguaucacccuugcuacuggaccacuaacuacauugugggaaggauccccagguaaauuuuggaauaccacaauugcaguuaguauggcaaacauuuucagagggucauauuuagcaggagcaggacuugcauucucuuuaaugaaaucacuuggaggcgggagaagagggacaggugcacagggagaaacauugggugaaaaguggaaaagacaacugaaccaacuaagcaaaagcgaguucaacaucuauaagcgcagcggaauuauggaaguugaucggucagaagcgaaagaaggauuaaaacgaggugaaacuacgaggcacgcuguaucuagggguaccgcaaaauuaaggugguuuguugaaaggaacuuaguaaaaccugaaggcaaagugauugaccuaggauguggucgaggagguuggaguuacuauugugccggacuaaagaaaguaacggaggugaaggguuauacaaaagggggucccggucacgaagaaccaauuccuauggcaaccuacggauggaacuuagucaagcuacauuccggaaaggaugucuuuuucacaccaccugaaaagugugauacccuucuaugcgacauaggcgaaagcucuccaaacccuacuauagaagagggacggacauugcgaguacucaagaugguagagccaugguuacggggaaaucaauucuguauaaaaauucugaauccauauaugccaucugucguagaaacgcuagaacaaaugcagcgaaaacauggagggaugcugguaagaaaccccuuaucacggaauagcacacacgaaauguauugggugucuugugggaccggaaacauaguaucggcagugaauaugacaucaagaauguuguuaaaucguuucacaauggcucacagaaaacccaccuaugagagagauguggaccucggagcugguacuagacacguugccguggagcccgaggucgcuaauuuggauauaauaggacaacgaauagaaaacaucaaacacgaacacaaaucaacuuggcauuaugaugaagacaauccauauaaaacaugggccuaccacgggucuuaugaaguaaagccuucgggaagcgcaagcucuaugguuaacggcguuguaaaacuauuaacuaagcccugggauguaaucccuauggucacucaaauagccaugacagauacaacacccuuuggccagcagcgcguuuucaaagaaaaagucgauaccagaacuccaaaagccaaaaggggcaccgcucaaauuauggaaguaaccgcaagguggcuguggggauuucuaucgagaaacaagaagccacgaauuuguacccgugaagaauuuaccagaaaaguuagaucaaaugcugcuauaggugccguauuuguugacgaaaaccaauggaauagcgcgaaagaagcgguugaagaugaaagguucugggauuuaguacagaaagagcgggagcugcauaaacagggaaaaugcgcaacaugcguguacaauaugaugggcaagagagagaagaagcuaggggaguuuggcaaagcuaaaggaaguagagcuaucugguauaugugguugggugcaagguuuuuggaguucgaggcuuuaggcuuuaugaaugaagaucacugguucaguagagaaaauaguuugaguggaguagaaggugaagggcuccacaaauuggguuauauccuacgggacauaucgaaaauaccaggaggaaacauguacgcggacgauacagcaggaugggauacaaggauaacggaagacgacuuacaaaacgaagcuaaaauaacagauauaauggagcccgagcaugcuuugcucgcaacaucuauauuuaaauuaacuuaucaaaauaaaguggugcggguucagcgucccgccaaaaaugguacggucauggauguaauaucgagaagagaccaaagagguaguggacagguugguacauacggacuuaacaccuucacaaauauggaggcucaacuaauucgacagauggaaagugaagggauuuuucuuccaagugaacucgaaacaccaaacuuggcugaacguguauuagacuggcuggaaaaauacggcguugaacgccugaaaagaauggcuauuaguggggaugacuguguugugaaaccaauagaugacagauuugcuacagcacugacggcacucaaugauauggggaaaguuagaaaggauaucccccaaugggaaccaaguaaaggguggaaugauuggcaacaaguaccauuuugcucccaccauuuucaucagcuuauaaugaaagaugggcgagaaaucguagugccguguagaaaccaggaugaacugguagggagagcacgaguuucucagggagcggguuggucucugcgagaaaccgcaugucucggcaaaaguuacgcgcagauguggcaacuuauguauuuucauagaagagaucuaagauuagccgcaaaugccaucuguucagcggucccaguugacugggugccaacaaguagaacaacauggaguauucaugcgcaucaucaguggaugacgaccgaggacaugcuuaguguauggaauagaguauggauagaagaaaauccauggauggaggacaagacucauguuucuucauggggagauguaccauaucuaggcaaaagagaagaccaauggugugggagccugauugggcuuacagcacgugcaacgugggcgucuaacauacaaguagccauaaaucaaguccgacgacuaaucggcaacgaaaauuaucuagauuauaugaccaguaugaaacgauucaaaaacgagggugauccggaaggagcgcuaugguga

SEQ ID NO: 21732 - RNA, 9879 nt, Artificial Sequence
  derived and/or modified CDS sequence (opt6) from DENV-1__FJ898396__SS-prME
ucuguaacuaugcuguugauguuaaugccaacagcgcuugcauuucaucucacaacaaggggaggcgaaccacacaugauaguaacaaaacaagaacgaggcaagagcuuacuuuuuaaaacaucagcgggugugaacaugugcacacucaucgcaauggaucuaggagaacuaugugaagauacuaugacguauaaauguccuagaauuacagaagcggaacccgaugauguugacugcuggugcaaugcaaccgauacgugggucacauauggaacauguagucaaacaggagaacauagaagagacaaacguuccguggcuuuagcaccucauguuggauuaggauuggaaacaagaacugaaacauggaugaguucagaaggagccuggaaacaaauacagcgaguggaaacaugggcccuaagacauccuggauucacaguuauagcacuauuucuagcccacgccauaggaacuagcauaacucaaaaagguauaauauuuauuuugcucauguuaguaacuccaucaauggcaaugcgaugcguagggauuggaucaagagauuuugucgaaggccuuagcggcgcuacauggguagauguaguacuagaacauggcuccuguguaacaacuauggcgaaagacaaaccaacacuugacauagaauugcuaaaaacagaggugacaaacccagcuguuuugcggaaacucuguauagaagccaaaaucucaaacacaacaacggauuccagauguccaacucaaggggaagcaaccuugauggaagaacaagacgcaaauuuugugugucgcaggacauuuguugauagagguuggggcaaugguuguggcuuauucggaaaaggaagucucauaaccugcgcgaaauucaaauguguaacgaaacuagaagguaaaauuguucaauaugaaaauuuaaaauacaguguaauuguuacaguacauacaggcgaccaacaccaaguuggaaacgaauccacggaacauggaaccaccgcgacgauuacaccucaagcgccgacaucggagauacaacucaccgauuauggcgcguuaacguuggacugcucuccgagaaccggucucgauuuuaacgaaaugguacuacuaacgaugaaagagaaaagcugguugguucacaaacagugguuuuuagacuuaccuuugccauggacaaguggagcaaguacaucacaagaaacuuggaaucgacaggaucuccuaguaacauucaaaacugcgcaugccaagaaacaagaaguagucguucuaggaagucaagaaggggcuaugcacacagcuuuaacaggcgcuaccgagauccaaaccaguggaacuacuacuaucuuugcggggcaucugaaaugucgucuaaaaauggauaaauugacacuaaaagguaugaguuaugucauguguaccggaucauuuaaauuagaaaaagaaguagcagaaacacaacauggaacgguauuaguacaaauuaaauaugaaggaacugacgcuccuuguaaaauuccguuuuccacgcaagacgaaaaagggguaacacaaaacggacgauuaauuacagcaaacccaauaguaacugacaaagagaaacccguaaacauagaagcugagccuccauucggagaaaguuauauuguuauuggagccggugaaaaagccuuaaaacuaaguugguuuaagaaagguaguucgauugguaaaauguuugaagccacagcacgaggagcacguaggauggccauacugggcgacacugcuugggauuucggaagcguaggaggagucuuuacaaguguagguaaauuaguccaucaaauauucggaacggcuuacggcguacuauuuucaggagucucuuggaccaugaaaauaggcaucggagugcuccucacaugguugggccucaauagccgaucaacuuccuuauccaugacauguauagcuguugggcuaguaacuuuauaccucggagucaugguacaagcagauaguggauguguaauuaacuggaaaggaagagaauuaaaaugugggucuggaauauuuguaacaaaugaaguacacacuuggacggaacaguacaaauuccaagcagauaguccuaaaagacugagcgcugcaaucgguaaagccugggaagaaggaguuuguggcauacgcucugcaacaaggcuugaaaacaucauguggaaacagaucucaaacgaacuaaaccauauuuuacuagagaacgacaugaaauuuacagucguugucggagauguagucggaaucuuagcucaagggaagaaaaugauuagaccacaaccaauggaacauaaauauucuuggaagucuugggguaaagcaaagauaaucggcgcugauguccagaauacaacguuuauuaucgacggaccaaacacgccagaguguccugaugaucaaagggcuuggaauauaugggaaguagaagauuauggguuugggauuuuuacaacgaacauauggcuaaaacuaagagacucauauacucaaguaugugaucauaggcuuaugagugcagcgauuaaagauucuaaggcuguacaugcggacaugggauacuggauagaaucugagaaaaaugaaacauggaaacucgcucgugcaucguucaucgaggucaagaccuguauuuggccaaagucccauacccuauggucaaauggcguucuagaaucagagaugauaauaccaaagauauaugguggaccaauaucgcaacacaauuauagaccaggauacuucacucaaaccgcggggccuuggcaucuaggaaaacuugagcuugacuucgaccuaugcgaggggacaacaguagugguagaugaacauugugggaaccguggaccaagucuucggaccacaacgguaaccgggaagauuauccacgaguggugcugcagaaguugcacgcuaccgcccuugcgguucaaaggagaagacggauguugguauggcauggagauuagaccgguuaaggaaaaagaggaaaacuuagugaagaguaugguaucggcgggcaguggggaaguagauucauuuagccuggguuuauuguguauaaguaucaugauugaggaagugaugagaagcagauggucacgaaaaaugcuuaugacagguacacuggcuguuuuccuauuauuaauaaugggacaacuaacauggaacgaccucauucgguuaugcauaaugguaggggccaaugcaagugauagaaugggaauggguacaaccuaucucgcauugauggccacauuuaagaugagaccaauguucgcuguggggcuucuuuucagaagauuaacauccagggaagucuugcuauugacuauaggacuaucacuuguagcuagugucgagcuacccaauagucucgaagaacugggcgauggguuagcaaugggaauaaugauacucaaacuacuaacagauuuucaaucccaucaacuuugggcaacacuguugaguuuaacuuuuauaaaaacaacacugucacuacauuaugcauggaaaacgauggcaaugguguuaucaaucgccagucucuuuccauuaugcuuaagcacaacgagccagaagacuacauggcucccuguuuuacucgggucguuaggaugcaaaccguuaacaauguuucucauaaccgaaacgaaaaucuggggacgaaagaguuggccacugaaugaaggcauaauggcugugggagucguuaguauucuuuugucaucccuauuaaagaaugauguuccucuagcaggcccgcuaauugcaggagggaugcuuaucgcaugcuacguuauaagcggaucaagugcagaucugucauuggaaaaagcggcagaagucagcugggaggaagaagcggagcauucaggggcaucacauaauauuuugguaguuguacaagacgacgguacaaugaagauaaaagaugaagaacgagaugauaccuuaacuauacuacuaaaagcuacuuuacuugcaguuagugggguuuauccauuaucuauaccggcaacauuauucguaugguauuucuggcagaagaagaaacaacgaaguggcguacuuugggauacaccaagcccuccagagguugaacgugcaguuuuagacgauggaaucuaucgaauuaugcagagaggauuauuaggacguagucaaguaggaguagguguauuucaggaaaauguguuucauacaauguggcacgugacacgcggggcgguacuaauguaucaaggaaaaagauuagagccauccugggccagcguaaagaaggaucuaauuagcuauggagguggauggagacuacaggguucguggaauacuggugaagaaguacaaguaauagcagucgaacccgggaaaaacccgaaaaacguccaaaccgcaccggguacauucaaaacgccggagggugagguuggugcuauugcauuggauuucaagcccgguacaagugguaguccuauaguaaaucgggaaggaaagauaguuggauuguauggaaacggcguagugacuacaucagguacuuauguuucagcuauugcucaagcaaaagcaucccaagagggcccucuaccagaaauagaggacgaaguauuccguaagcgaaaccugacaauuauggaccuccacccggguucuggaaagacgagaagauacuugccugcuauagucagggaggcaaucaagaggaaacucaggacccucauccuagcaccaacacguguagucgcgucagagauggccgaggcacuuaaggggaugccgaucagauaucaaacaacagcggucaaaucugaacacacuggcaaagaaauaguugauuuaaugugccaugcaacuuuuaccaugcgccuucuuaguccaguccguguuccaaauuauaacaugauuauaauggaugaggcgcacuucacugauccuaguucuauugcagcacguggauauauaucuacucguguagguaugggagaggcugcugccauuuuuaugaccgcaacaccgccuggaagcguugaggcauuuccucaaucaaaugcagucauacaagaugaagaacgggauauaccugagcguucuuggaauaguggauaugaguggauaacagacuuuccaggaaagacuguaugguuugucccaucaauaaagaguggaaacgauaucgcaaauugcuuaaggaaaaauggaaaaagagugauacaacuauccagaaaaacuuuugacacagaauaccagaaaacuaaaaauaacgacugggacuacguaguaacuacugacauaagugaaaugggcgccaauuucagggcugaccgaguaauagauccaagaaggugccucaaaccugucauacuuaaagaugguccugagagaguaauacucgcugguccuaugccaguuaccguagcgucagccgcacaacgacggggacgcaucggaagaaaccauaacaaagaaggagaccaauacauuuacaugggccaaccucuaaacaacgacgaggaucaugcucauuggacugaagcgaaaauguugcuagauaauaucaacacuccagagggcauaaucccugcauuauuugaacccgaaagagaaaagagugcagcgauagacggggaauauagacuaagaggugaggcaagaaaaaccuuuguagaauuaaugagacgaggugaucuucccguauggcuaucauacaaaguagcgagugaaggcuuccaauauuccgauagaaggugguguuuugauggggaacguaacaaucaagugcucgaagaaaacauggauguagaaauauggaccaaagaaggugagaggaagaaauuacgaccacgauggcuggacgcacggaccuacucagauccucuggcuuugcgcgaauuuaaagaguucgcugcagguagacggucaguaucgggugaucuaauucucgagauuggcaaauuaccacagcaucuaacacagagagcccaaaacgcucuugauaauuugguaaugcuacacaauucagaacaagggggacgagcauacagacacgccauggaagaauuaccggauacuauagaaacgcuaauguuauuagcccucauagcugugcuuacaggcggcguuaccuuguucuuccugucaggucgaggacuaggcaaaacuucuauagggcuauuauguguuauggcaucuagcguccuucuauggauggcaucaguugagccacauuggauagcggcuucaaucacauuagaguucuuucuaaugguucuauugauuccagaacccgauagacaaagaacgccgcaagauaaccaguuagcuuacgugguuauuggcuuauuguuuaugauccuuaccguugccgcaaaugaaaugggccuguuagaaacaaccaagaaagacuuagggauaggucacguagccguggagaaucaucaucaugcuacaauguuagauguagacuuacauccagccucggcauggacccuguacgccguugcgacaacgauaaucacuccuaugaugagacacacaauugaaaauacuacugcaaacauaaguuugacugcaaucgcuaaucaagcugccauacuuaugggauuagacaagggauggccgauaucuaaaauggauauuggagugccguuacuagcucucgggugcuacucacaagucaacccacuuacccugaccgcagcuguauugauguugguagcacauuacgccaucaucggacccggcuugcaggcuaaagcaacaagggaagcacaaaaacgaaccgcagcaggaauuaugaaaaauccuacugucgacggaauaguagcaauugacuuagaucccguuguauacgacgcgaaauuugaaaagcaguuagggcaaaucaugcuuuuaauauugugcacaagucaaauccuucucaugagaacuacuugggcauugugugaaucuaucacgcuugcuacugguccacuuacuacuuuaugggaagggagcccaggcaaguuuuggaacacaacuaucgcggucuccauggccaacauuuuucguggaaguuacuuagccggggcugggcuagcguucucauuaaugaaaucauuagggggaggccgccgggguaccggugcgcaaggcgaaacacuaggcgaaaaauggaaacgacaacucaaccaguuaucaaaaucggaguucaauauuuacaagaggucagguauaauggaaguugaccgcucagaagcaaaggagggccugaagaggggagagacaacaagacacgcaguaaguagagggacugcgaagcuaagaugguuugucgaaaggaauuugguuaaaccggaagggaaagugauugacuuagggugcgguagagguggcuggucauauuauugcgccggucuuaagaaaguaacggaaguaaagggcuauacaaaaggagggcccggacaugaggaaccaauuccuauggcaacuuacggauggaaucucgucaaauuacauucgggaaaagacguuuucuuuacaccuccagaaaaaugcgauacacuucucugugauauuggagagagcucgccaaacccuacuauagaagaaggucgcacacugaggguguuaaagauggucgaaccuuggcuacgaggaaaucaguuuuguauaaaaauccuaaauccuuacaugccgucaguuguagaaacucuggaacaaaugcaacgcaaacacggugguaugcucguaagaaacccguugaguagaaauaguacucaugagauguauugggucucuuguggaacaggaaauaucguuagcgcuguuaauaugacuucacgaaugcuguuaaauagauucaccauggcgcacaggaaaccuaccuaugaacgagauguugaccuuggugcaggcaccagacaugucgcuguagaaccagaaguagcaaauuuagacauuauaggacagagaauagaaaauauaaagcaugaacacaaaucaacuuggcacuaugacgaagauaauccuuauaaaacuugggcauaucauggcucuuacgaagugaagccauccggaagcgcuaguucaaugguuaacgggguggugaaauuauuaaccaaaccuugggacgugauaccgaugguaacacaaaucgcuaugacugauacgaccccguuuggccaacaaagaguauuuaaggaaaaaguugauacgagaacaccuaaagcaaaacgugggacagcacagaucauggaaguaacagcacgcuggcuuuggggauuuuuaaguagaaauaagaaaccacguauauguacgagggaggaguucacucgcaaggugagaagcaacgcagcgauaggcgcagucuuuguagaugaaaaucaauggaauagcgcuaaagaagccguagaggaugagagguuuugggaccuuguacagaaagaacgcgaacuacacaaacaagguaaaugugccacuuguguauacaauaugauggggaaacgcgaaaagaaauuaggcgaauuuggaaaagcgaaaggaagucgagcuauaugguauauguggcuuggcgcacgcuuucuagaguucgaagcauuaggauuuaugaacgaggaccauugguucucaagagaaaauagucuaaguggagucgagggggaaggauugcacaaacuaggauacauacuucgagacauaaguaagauaccaggcggcaauauguacgcagaugacacggcagggugggauacuagaaucacagaagacgaucugcaaaacgaagcaaaaauuacggauauuauggaaccggaacacgcauuacuggcaacaucgauuuuuaagcucacguaccaaaacaaaguuguaaggguacaacggccugcuaaaaacggaacaguuauggacgucaucagucgaagagaucaacgaggaucuggucaagucgggacauacgguuuaaacaccuucacuaacauggaagcacaacuaauacgacaaauggaaucggaaggaauauuucuaccaucugaacuagaaacacccaaccuugccgaaagaguccuggauugguuagagaaauauggcguagaaagauuaaaacgcauggcuauaucaggugacgauugugugguaaaacccauagacgauagauucgcaacugccuuaacagcuuuaaacgauaugggaaagguaagaaaagacauuccgcaaugggaaccaaguaaaggauggaaugacuggcaacaaguaccguuuugcagucaccauuuucaucaauugauuaugaaagacggaagggaaauaguaguaccaugcaggaaucaggaugagcuuguuggucgagccagaguuagccagggcgcagggugguccuuaagagaaacagccugucuaggcaaaucuuacgcucaaauguggcaacucauguauuuucacagaagagaccuaagacuagcagcaaaugcuauuuguucagcuguaccaguugauuggguuccgacaucaaggaccacauggucaauacacgcucaucaucaauggaugacuacugaagacauguuaucuguauggaauaggguauggauagaagaaaaucccuggauggaagauaaaacacauguaucaucuuggggugaugucccuuauuuagggaaaagagaagaccaauggugcggcagcuugauuggacuuacagcacgagcaacaugggccucuaacauacaaguagccaucaaccaagugagaagacuaauuggaaacgagaauuacuuagacuacaugacgucaaugaaacgauucaaaaaugaaggagacccagagggagcguuaugguaa

SEQ ID NO: 21733 - RNA, 9879 nt, Artificial Sequence
  derived and/or modified CDS sequence (opt6) from DENV-1__GQ199839__SS-prME
agugugacaauguuauugaugcuuaugccaacagcacuugcguuccacuugacaacucgcgguggagaaccacauaugauuguaacaaaacaagaacguggcaaaucauuacuguucaaaacaagugcugggguaaacaugugcacguuaauagcuauggaucugggugagcuaugugaagacacaaugacuuauaaauguccgcgaauuacugaagcggaaccagaugauguugacugcugguguaaugcgacagauacauggguaaccuauggaacauguagcagaacaggagagcaccgacgcgauaaaagaucaguugcucuggcgccacacguaggguugggccuagaaacaagaacggaaaccuggaugucaagcgagggagcauggaaacaaauucaaagaguagagaccugggcguugagacacccuggcuuuacagucaucgcguuguucuuagcacaugcuauaggaacaaguauaacacaaaaagguaucauauucauacuucugauguuggucacgccaaguauggcgaugagaugcguaggcauaggaucacgggacuucguugaaggacuaucaggagcuacguggguagauguaguacuagagcacgguucuugcguuacuaccauggcaaaagacaaaccgacauuagauauugaauuacuaaaaaccgaagucaccaaucccgcgguacuaagaaaauuaugcauagaagcgaaaauuaguaauacuacuacagacucaagauguccgacucaaggagaagcaacauuaauggaggaacaagaugcaaacuuuguaugcagaaggacauuuguugacagaggauggggaaauggcuguggcuuguuugguaaagguagccuaauaacaugugcuaaauuuaaaugugugacaaaauuagaagggaaaaucguucaauacgaaaaccuuaaauauagcgugauaguaaccguccauacgggcgaucaacaucaagucgggaacgaaucaacagaacauggcaccacagccacuauaacuccucaagcgccgacuagcgaaauacaacuuacagacuacggcgccuuaacuuuggacugcagcccgagaacaggucuagauuucaaugaaaugguguugcuaacuaugaaagaaaaaucauggcuuguacauaaacaaugguuccuagacuuaccauugccguggacuucgggagcgucaacuucccaagaaacguggaaccgacaggaccuacucgugacuuucaaaacugcccacgccaagaaacaggagguaguaguucuugguucccaagagggcgcaaugcacacagcacuuaccggcgccaccgaaauucaaacaaguggaacgacuacgaucuuugcaggucaucugaaaugcagauuaaaaauggauaaauugacuuuaaaagguauguccuaugugauguguacggggucguuuaaacuugaaaaagaaguugcagaaacccaacauggaacuguauuggugcaaauuaaauaugagggaacagacgcaccauguaaaaucccuuucucaacgcaagaugaaaaaggugugacccaaaauggaaggcugauuacagcaaacccgauaguaaccgauaaagaaaaaccagucaacauagaagcugaaccaccuuuuggugagucuuauauagugauaggggccggagagaaggcuuugaaacuuucaugguucaagaaaggaucaucaauagggaagauguucgaagcgaccgcccgcggagcgcggagaauggcgauacuuggagacacagcgugggacuuuggaucgauagggggcguuuucaccagcgugggcaagcuaguacaucaaauuuucggaacugcuuauggaguucucuuuagcgguguaaguuggacgaugaagauaggaauaggagucuuauuaacaugguuaggccuaaauucccgcagcacaucauugucuaugacuugcaucgcuguugggcuagucacacuauaucugggcguaauggugcaggccgauuccggauguguaaucaauuggaaaggccgagagcuuaaaugugguagcgguaucuucguaacaaacgaaguucacacauggaccgaacaguauaaauuucaagcugauagcccgaaaaggcucucagcagcaaucggaaaagcgugggaagaggguguauguggaauuagaagcgcuacacgauuagaaaauaucauguggaaacaaauuaguaaugaacugaaucauauuuugcuugaaaacgggcuuaaauuuacuguugugguuggugauguuguuggaauccuggcacaaggaaagaaaaugauaagaccacaaccgauggagcacaaauauagcuggaaaucuuggggaaaagcgaaaaucauaggggccgacguccaaaacacaacuuuuauuauagacggaccuaacacacccgaaugccccgaugaucaacgagcauggaacauuugggagguggaggauuacgguuucggcaucuuuaccacuaacauauggcuuaaauuaagagacaguuauacccaagucugcgaucaucgacuaaugagugcagcuauuaaagauaguaaagcagugcaugcugacauggguuauuggauagaaucggagaaaaaugaaacauggaaacuagcaagagcuucauuuauagaaguuaaaacuugcauauggccaaagagucacacccuguggagcaacggaguauuagaaagcgaaaugauuauuccaaaaauauacggcgguccaaucagccaacacaauuauaggccaggcuauuucacucaaacagcaggcccguggcaucuugguaaacucgaauuagauuuugauuugugcgaagggacaacgguaguuguagacgaacacuguggaaaucgaggaccaucccucagaacaacgacuguaacggggaagauuauacacgagugguguuguagaucaugcacauugcccccauuaagauuuaaaggugaggauggaugcugguacggaauggaaauccgacccguaaaagaaaaagaagaaaaucuaguaaagaguauggucagcgccggaagcggggaaguagauuccuuuagucucggauuacuaugcaccagcaucaugaucgaagaggucaugagaucaagguggucgagaaaaauguuaaugacaggaacacuagcuguauuuuuacuacugauuaugggccaauuaacauggaaugaucucauuagguuaugcauaaugguaggugccaaugcauccgauaggaugggaaugggaacaacuuacuuggcacucauggcuaccuuuaagaugagaccaauguucgcuguaggacuuuuauuucguagauuaacgucuagagaagugcuccuucucacuauuggacucucgcuugucgcuaguguagaacuaccaaauucucucgaagaauuaggagacggacucgcaaugggcauaaugaucuuaaagcuacuuaccgauuuccagucacaucaacuuugggcgacgcucuuaagucuaacguucaucaagacaacuuuaagccuacacuaugcauggaaaacaauggcaauggugcuuaguauuguuagucuuuuuccacuuugcuugagcaccacuagccagaaaacaacgugguuacccguauuguuaggaagucucgguuguaaaccgcuuacaauguuucucauugcagagaauaaaauauggggccguaaguccuggccuuuaaaugaaggcauaauggccgucgguguggucagcauauuacucuccaguuuauuaaagaaugacguuccccucgcaggaccacuaauagcugggggaaugcugauugcuuguuaugucauuaguggcucaagcgccgaucucucgcuugaaaaagccgcagaaguuagcugggaggaggaagcagaacauaguggcgccagccacaauauauuuguugaaguacaagaugaugguacaaugaaaauuaaagaugaagaaagagacgacacacuaaccauccuacugaaagcgacucuacucgcggucagcggagucuacccccucucaauaccggcuacccuauucgucugguacuuuuggcaaaagaagaagcaacgcucagguguauugugggacacuccuucaccgccggagguggaacgggcagcccuagacgauggcaucuaccguaucaugcagagggggcuucuaggaagaagucaaguagggguaggaguauuucaggaaaacguauuucauaccauguggcacguaacacguggugcaguuuugauguaccaaggaaagcgacuggagccuuccugggcaucggucaagaaagaucuuauuuccuauggagguggcuggcgauuacaggguaguuggaacaccggugaagagguucaaguaauugcuguagagccgggaaagaauccuaaaaauguacaaacagcgccuggcacauucaagacaccagagggagaagugggggccauagcacuugauuucaaaccugggacuucaggcucgccaauaguaaaucgcgaagggaaaauuguaggucuuuacggaaacggaguuguuacuaccaguggaacguaugugagugcaauagcacaaaccaaagcaucucaagaggggccccuaccagaaauagaggaugaaguauuccgaaaaagaaaccuaacaauaauggauuugcacccagguaguggcaaaacacgcagauacuuaccagccauaguacgggaagcuaucaaaaggaagcuaagaacguuaauacuggcaccgacccgagucguugcaucagaaauggccgaagcacuuaaagggaugccaauaagguaucagacaacagcuguaaagagugaacauaccggaaaagaaauagucgaucucaugugucacgcuacauuuaccaugaggcuuuuaucgccagucagaguuccaaauuauaacaugauaauuauggaugaagcucauuucacugauccgagcaguauagcugcgcgcggguauauaucuacuagaguuggcaugggagaagcugcagccauauuuaugacagcgaccccuccaggaucaguugaagcauuuccucaaaguaaugcugucauacaggacgaagaacgagacauaccagaaaggucauggaacucgggauaugaauggauaacggacuuucccggcaagacuguaugguuuguaccguccauaaaaaguggcaaugauauugcgaauugucuaaggaaaaaugggaagagaguaauucaacucagucgcaaaaccuucgacacagaauaucaaaagaccaaaaauaaugauugggauuauguugucacaacugauauuagugagaugggagcaaacuuuagagcggaccgcguuauagauccuagaaggugccucaagccuguaauacuaaaagacggaccggaacgaguuaucuuagccgggccaaugccaguuaccguugcaagcgcggcucagcgucgagguagaauugggagaaaucacaauaaggagggcgaucaauauauauauaugggucagccauuaaacaaugacgaagaucaugcacauuggacggaagcgaagaugcuguuagacaacauaaacaccccagaaggcaucauuccggcucuguuugaaccagaaagagaaaaauccgccgcuauugauggagaauacagacuccguggagaagcacgaaaaacuuuuguagaauuaaugagacguggggaucugccuguguggcuaucguacaaaguagcgucagaaggguuccaauacucagauagacguuggugcuucgacggagagaggaauaaccaaguguuagaagagaauauggauguagaaaucuggacaaaagaaggagaaaggaagaaacuucgaccgagauggcuagacgcgcgaacauauucagauccacucgcucuacgugaauuuaaggaauuugcagcaggacgucgaucaguguccggagaucucauccuugagauuggaaagcucccucaacauuugacacagagggcgcagaacgcauuagacaacuugguaaugcuucacaauucagagcaaggaggcagagcguauagacaugcuauggaagaacucccugauacaauagaaacccuaauguuauuagcacucaucgcuguccuaacaggaggcgucaccuuauucuuucugaguggucgaggauuaggcaaaacaucaaucggacuccuauguguaauggcguccuccguuuuauuauggauggccucaguagaaccgcacuggauugcggcuaguauaauuuuggaauuuuuccuaauggugcuauuaauaccagagccagaucgucaaagaacuccgcaagauaaucaguuagcauacguagugauaggucuucuguuuauaauucucacugucgcugcuaacgaaaugggucuacuagagacuacuaagaaagauuuagguauuggacauguagccguugaaaaucaucaccacgcgacaauguuagacgucgaccugcauccugccucagccuggacacucuacgccguagcuacuacuauaauaacgccaaugaugagacauacaauugaaaacacaacggcgaauauuagcuugacugcgauagcgaaucaagcagcgauacuuaugggguuagauaaagguuggccaauaaguaaaauggacauaggaguaccccuacuugcgcuaggcugcuauucacaaguaaacccacuuacauugacugccgcgguguugaugcugguagcgcacuacgcgauaauaggcccaggcuuacaagcuaaagcaacuagagaagcucagaaaaggacugcggcaggaauuaugaagaaucccacagucgaugguauuguugcuauugaucuggacccgguuguauaugaugcgaaauuugagaaacaacucggucaaauaaugcuccuuauacuuugcacaagccaaaucuuguuaaugcgaacaaccugggcauuaugcgagucaauaacccuugcgacagggccacuaacuacuuuaugggaagguucaccggguaaguucuggaauaccacaauagcgguaucuauggcgaauaucuuuagggguagcuauuuagcaggcgccggauuagcuuucucacuuaugaagucgcuagggggaggaagaagggguacaggugcacaaggugaaacauugggugaaaaauggaaacgacaauuaaaccaacuaaguaaaagcgaguucaacauauacaaacgauccgggauaauggaaguggacagaagcgaggcuaaagaagguuuaaagcgaggagaaacuacaagacaugccguaaguagagguacugccaaauuacggugguuugucgagcgcaaucuagucaaaccagaaggaaaagucaucgaucucggauguggccgaggaggauggucuuacuacugugcuggacuaaagaaaguaacagaaguaaaggguuauacaaaaggagguccaggccaugaagaaccaauaccgauggcaacauauggcuggaaucucgucaaacuccacucugguaaagauguguucuuuacaccaccagagaaaugugacacacuauuaugcgauaucggugagaguucaccaaauccuacuauugaggaggguaggaccuuacgaguccuaaagaugguugagccauggcugcgugguaaucaauuuugcauaaaaauacuaaauccuuacaugccaucaguuguagaaacacuagaacagaugcagagaaagcauggcggaaugcuaguccguaauccacuuucacguaacaguacccacgaaauguauugggugaguuguggaacggguaacauaguaucagcuguaaauaugacgucucgaauguuauuaaaucgcuucacuauggcacauaggaagccaacauaugagagggacgucgauuuaggagcaggcacacgucacguagcaguagaaccggaagucgcaaauuuagacauaauuggccaaagaauagaaaacauuaaacacgagcauaaaucaacauggcacuaugaugaagauaacccuuacaagacaugggcauaucauggaucauaugagguaaagccaagcggcagugcaaguaguaugguuaaugguguaguaaaacuuuuaacaaaaccuugggacgugauuccgaugguaacucaaauugcuaugaccgauaccacaccuuucggacaacaacggguuuuuaaagaaaaagucgauacucgcacaccgaaggcaaagagaggaacugcgcaaaucauggaaguaacggcuagguggcucuggggauuucuuucaagaaauaagaaaccgaggauauguacgagagaagaauuuacaagaaaaguuagaucaaacgcagcaauaggagcaguuuucguugacgaaaaucaauggaauagugcgaaagaagcuguagaggaugagagguucugggaucuaguacaaaaagagagggaguuacauaaacaaggcaaaugugcgacuuguguguacaauaugaugggaaagcgagagaagaaacuaggugaguucgguaaagcaaaaggaagucgagcuauaugguacaugugguuaggagcaagauucuuagaguuugaagcauuaggcuuuaugaacgaagaucauugguuuucgagagaaaauucuuugucaggcguagaaggugaaggccuucacaaacuuggguacauauuacgugacauauccaaaauaccugguggaaauauguaugccgaugauacagcagguugggauaccaggauaacagaagaugaucuccaaaacgaagcaaaaauaacugacauaauggaaccagaacaugcauuguuagcgacuucgauauucaaauuaacauaccaaaacaaaguaguuaggguacaaagacccgccaaaaauggcaccgugauggacgugauaagccgaagagaucaacgggguucgggacagguugguacuuacggauuaaauaccuucacaaauauggaggcccaacugauaagacagauggagucagaagguauauuccugccguccgaacuugagacaccaaauuuggcugagcgaguauuagauuggcuagaaaaauaugggguggaaaggcuaaaaagaauggcaaucucgggggacgacugcgucgucaaaccuauagaugaucgauuugcuacugcacuaacggcgcucaaugauauggggaaaguaagaaaagauaucccccaaugggaaccgagcaaaggauggaacgauuggcaacaggucccauucuguucccaccauuuucaccaguuaauaaugaaggauggaagagagaucguaguuccgugucguaaccaagaugaacuggucggacgagcuaggguuucucagggugcugguuggagucuacgggaaacugcauguuuaggcaagagcuaugcgcaaauguggcaacuaauguacuuccauagaagggaccuuagacuggcggcaaacgcaauaugcagugcaguuccaguagauuggguaccuacaaguaggaccacauggucaauacacgcucaucaucaauggaugaccacagaagacauguuaaguguuuggaauagaguuuggauugaagaaaacccauggauggaagacaaaacccacguuuccagcuggggcgauguaccauaucuuggaaaaagagaagaccaauggugcggcagccuuauaggacuaacagcacgugcuacaugggcgagcaacauucaaguagcgauuaaccaaguacgaagacuaaucgguaacgagaauuaccuagauuacaugacguccaugaagagauuuaagaacgagggagauccugaaggugcucuaugguaa

SEQ ID NO: 21734 - RNA, 9879 nt, Artificial Sequence
  derived and/or modified CDS sequence (opt6) from DENV-1__FJ898397__SS-prME
ucuguaacaauguugcuaauguuaaugccaacagcccuggcauuccauuuaaccauaagaggaggagaaccacauaugauaguuucuaaacaagaaagagggaaaucuuuguuauuuaaaacaagugcaggagugaacauguguacuuuaauagcaauggaucuaggagaauuuugcgaagauacaaugacauauaaauguccaagaaucacugaagcugagcccgaugacgucgacuguugguguaaugcaacugauacaugggucaccuauggaacuugcagccaaacgggugaacauagaagagauaaacguucuguugcgcuggcaccacauguagguuuaggauuggaaaccagaacagaaacuuggaugagcucagaaggggcauggaaacaaauucaaagagucgagacuugggcucuaagacaucccggauuuacaguaaucgcacuauuucuagcacacgcuaucggaacaucaauuacacaaaaagguauuauuuucauacuauuaaugcuuguuacucccaguauggccaugcgaugcguagguauugguaguagagauuuugucgaaggacuaaguggugcgacauggguggacguaguacuugaacaugguaguugcgucaccacuauggcaaaagauaaaccgaccuuagacaucgaauuacuaaaaacugaagucacuaauccagccguacugagaaaauuaugcauagaagcgaaaauaaguaauacgacgacagauucaagauguccuacucaaggggaagccacauuaguggaagaacaagaugcaaacuuuguuugucguagaacauuuguggauagagguuggggaaaugguuguggacuuuucgguaaaggaucacuaauaacgugugcuaaauucaaaugcgucacgaaacuggaaggaaaaauaguacaauacgaaaaccuuaaauacagcguaaucguaacuguucauacaggggaccagcaucaaguagguaaugaaaguacugaacauggaacuacagccacaauuacaccacaggcaccaucuacggagauccaauuaaccgauuacggggcucuuacucuggauugcuccccacgaacaggguuagauuucaaugaaauggucuuauuaacaaugaaagagaaaaguuggcuaguucauaagcaaugguucuuagaccuaccacuccccuggacaucgggagcuagcaccagccaagaaacauggaaucguaaagaucuuuuagucacauuuaagacggcgcacgcgaagaaacaagaaguaguugucuuagggucacaagaaggagcuaugcacacggcucucacuggugcaacugaaauacaaacaaguggaacuacaacuaucuuugcaggucacuuaaaaugcagacuaaaaauggacaaauugacgcucaagggaaugucauauguaauguguacggggucauuuaaacuagagaaagaaguggcggagacacagcacggaacuguccuuguacaaauaaaauaugaggguacagaugcuccguguaaaauaccguucuccacacaggacgaaaagggcguuacacagaaugggcgacucauuacagcaaaucccauaguuacggacaaagaaaaaccuguuaacauagaagcagaaccgccguuuggggagucauauauagugauaggagccggagagaaagcccugaaacugucaugguuuaagaaaggaucaagcauuggaaaaauguucgaagcgacggcgagaggagcucgccgaauggcaauucuaggugauacugcaugggacuuuggcucaauugguggaguguuuacuagcguugguaaauuaguacaucaaauauucgguacagcuuacgguguccuauucucaggcguaaguuggacaaugaaaaucgggaucgguguuuuacuaacgugguugggacuaaauaguagaucaaccucacuauccaugacaugcauagccguaggacucguaacgcuuuauuuggggguaaugguucaagcagacucaggaugcguaauaaauuggaaaggacgugaguuaaaauguggaagugguauauucguaacuaaugaaguacacacauggacagaacaauacaaguuccaggcagauucaccaaaaaggcuuucagcagcuauagggaaggcuugggaggaaggugugugcggaauuaggagugcaacuagauuggagaauauaauguggaaacaaaucucaaacgaacucaaccacauccuacuagaaaacgacaugaaauuuacagucguuguaggggacguagccgggauuuuagcucagggcaagaaaaugauaagaccucaaccgauggaguauaaauauaguuggaaaucgugggguaaagcuaaaauaaucggagcggacguacagaacaccacguucaucauagacggaccuaauacgccagaaugcccagacgaccagagggcauggaacaucugggaagucgaagacuacgguuuuggaaucuuuacuacaaauauuugguuaaaacuuagagauucauacacgcaagugugcgaucaccgucucauguccgcugcuauaaaagauucgaaagcuguccacgcagacauggguuacuggauagaaucagagaaaaaugaaacauggaaacuugcaagagcgaguuucauagagguaaaaacgugcaucuggccaaagagucacacacuauggucaaauggcgugcuagaaucagaaaugauuaucccaaagauauauggugguccaauuucucaacacaauuaucgaccagguuauuucacgcaaacagcaggaccauggcauuuagggaagcucgaacuagauuuugaucuaugugaaggaacaacaguaguggucgacgaacauuguggaaauagagggcccagcuuacggacgacaacggucacaggcaagauuauucaugaaugguguugucgaaguuguacauuaccacccuuaagauuuaaaggagaggauggauguugguacgguauggaaaucagaccagucaaggaaaaagaagaaaaccuaguaaaaaguauggucagcgcuggaucaggcgagguggacaguuuuucuuuggggcuccuaugcauaucuauuaugaucgaagaggugaugagaucuagauggucaaggaagaugcuuaugacagggacuuuagcaguauuuuucuugcugauaaugggacaacuaacuuggaaugaucuuauaagacuuuguauaauggugggugcuaaugcgagcgauagaaugggaaugggaacuacuuauuuagcucuaauggcuacuuuuaagaugagaccaauguuugcuguaggucuucuauuccggcgauuaaccaguagggaaguccuacucuuaacaauagguuuaucacuuguggcaaguguagaguuaccaaauucccucgaggagcuaggagacggauuggccaugggaaucaugauacugaaacuauuaacagauuuccaaucccaucaacuuugggcgacuuuauuaagucuaacguucauaaaaaccacguuuucucuucacuacgcauggaaaaccauggcaaugguuuuaucaaucgugucacuuuuuccuuuaugucuaucuacgaccagucagaaaacaacauggcugccuguauugcucgguaguuuagguugcaaaccacucacgauguucuuaaucgcggagaauaaaauauggggccgaaaaucuuggccuuuaaacgaagggaucauggcggucggaauagugucuauauuauugucuagccuacucaaaaacgacgucccauuggcgggcccucugauugcugggggaauguuaauagccuguuauguaauaucugguagcucugcagaccuaucauuagaaaaagcagcagaagugucuugggaagaagaagcagaacauucuggugcuucgcauaauaucuugguugaaguucaagaugauggaacaaugaaaauaaaggacgaggagagagaugacacauuaacaauacuacucaaagcgacucuauuggccguaaguggcguauauccccuaucaauuccagcgacguuauuugugugguauuucuggcaaaagaagaaacaaagaagcggcguucuuugggauacuccaucgccgccagaaguugaaagggcaguacuggaugacggcaucuacaggaucaugcaaagaggucuauuggguaggucgcaagugggcgucggcguuuuucaggaaaauguuuuucacacuauguggcacguaacgcguggcgcaguuuuaauguaucaaggcaaaaggcuagagccaagcugggcaucaguaaagaaggaucuaauuucuuacgggggaggcuggcguuugcaaggaaguuggaauacuggugaagagguacaaguuauugcagucgaaccaggcaaaaauccgaaaaacguucaaacagccccggguacguuuaaaacgucggaaggagaggucggagcaauagcucuagacuuuaaaccagggacauccggaagcccgauuguaaacagagaggggaaaauaguagggcuauauggaaacgguguuguuacaacuagcggcacuuauguaagugcaauugcccaggcaaaagccucacaagaagguccacugccagaaaucgaggacgaaguauuucguaagcgaaauuugacgauaauggaccuacaucccggcucaggaaaaaccagaagauauuugcccgcaaucguuagggaagcgauaaaacgaaaacuaagaacgcuaauauuagcgccaacaagaguagucgccagcgaaauggccgaagcucuaaaagguaugccgauaagauaucagacaaccgcgguaaagagugaacauaccgguaaggaaauaguugaccuaaugugucaugcaacguuuacuaugagguuauuaucaccagugcgaguacccaacuacaacaugauuauuauggacgaggcacacuucaccgacccgucuucgauagcggccaggggcuacaucaguaccagaguuggcaugggcgaagcggcagcaauauuuaugacagcgaccccuccaggcuccguggaagcauucccucaauccaaugcaguaauccaagaugaagaaagggauauuccugaacguucuuggaauagcgguuaugaauggauaacugacuuuccaggaaaaacaguaugguuuguacccucaauaaagucugguaaugacaucgcaaauuguuugaggaaaaacggaaaaagaguaauacaacuaucgagaaaaaccuuugauacagaguaccagaaaacgaaaaacaaugauugggacuacgucguuacaacagauauuucagagaugggagccaauuuuagagcagaucgagucaucgauccgagacgcugucuaaaaccaguaauuuuaaaagacggucccgaaagagucaucuuggcgggaccaaugccaguaacuguugccucggcggcccaaaggagaggcaggauagguagaaaucauaauaaagagggagaccaauacauauauauggggcaaccuuugaauaaugacgaggaccaugcccacuggacagaagcuaaaaugcuucuugauaauauuaacacaccugagggaauuaucccagccuuauuugaacccgagagagagaaaagcgcugcaauagacggcgaauacagacuacguggcgaagcgagaaaaacuuucguugaacuaaugaggcgcggggaccuacccguuuggcuaucuuacaagguagcgagugagggcuuucaguacagugaucgaagguggugcuuugauggcgagaggaauaaccaagugcuggaagaaaacauggauguggagaucuggacgaaagaaggggaacgcaagaaacugagaccgagauggcuagaugcaagaacguauagugauccguuggccuuaagagaauuuaaagaguuugcagcggggcgaagaucuguuaguggugauuuaauucuagaaauaggaaaacuuccacaacacuuaacacaacgcgcucaaaaugcuuuagauaaucuaguaaugcuacauaauagugaacaggguggaagggccuaucgacaugccauggaagaacuucccgauacuauugaaacauuaauguuauuggcucuuauugcaguguuaacagguggaguuacgcuuuucuuuuugucuggaaggggguugggaaagacaucaauaggacuguuguguguuauggccagcucgguucuucuauggauggcgucuguugaaccacacuggauagcugcaucaauaauacucgaguucuuuuuaaugguguuacuuauuccggaaccggacagacaaagaacuccucaagauaaucaacucgcguauguaguaauuggacuuuuauuuaugauuuugacaguggccgcuaaugaaaugggguuacucgaaaccacaaagaaagauuuagggaucggacacguugcaguugagaaucaucaucaugcagcgaugcuagacguugaccuacacccugcaagugcauggacucuauaugcaguagcuacaacgaucauaacacccaugaugaggcauacuauugaaaauacuacagcaaauaucaguuuaacggcuauagcaaaucaagcagcaauucugaugggucuugacaaaggauggccuaucuccaaaauggauauaggaguaccgcucuuggcacuagguuguuauagccaagucaauccauuaacacucacugcugcgguucuaauguugguagcacacuacgccauaauaggacccggccuucaagcuaaagcuacucgugaagcacagaaaagaacugccgcugggauaaugaaaaauccaacuguagacggaauuguagcuauagaucuugaccccgugguauaugacgcgaaguuugagaaacaacuaggccaaauaaugcuuuuaauuuugugcaccucacagauacuucucaugaggacaacaugggcccuuugugaaucaauaacacuggcaacaggaccgcuuacuacccuaugggaagggucaccagguaaauuuuggaauacaacuauagcggucucaauggcaaauauauuccgggggucauauuuagcuggggcaggcuuagcauucucuuuaaugaaaagccucggagggggccgaagaggaacgggagcacaaggagaaacacuaggagaaaaauggaaaagacagcuaaaccaacuuucgaaaagugaauuuaauacauauaagcgaagcgggauuauggagguagacaggucagaagcgaaagaaggacuaaaacggggugaaacgaccaaacacgcagucaguagggggaccgcaaaacucagaugguuuguagagcgcaaucuagugaagccagaagggaagguaauagaucuagguugcggacgcggugguuggaguuacuauugcgcugggcucaagaaagugacugaaguaaaaggauauacaaaaggggguccgggucaugaagaaccaauucccauggccacguacggguggaaucuuguaaaacuucauucuggaaaggauguauucuucauaccgccagaaaaaugcgauacuuugcucugcgauauaggcgaaucaagcccaaauccuacaaucgaggaaggaagaaccuuacgugucuugaagaugguagaaccuuggcuacgagguaaucaauuuuguauaaaaauacuaaauccguauaugccuagcguaguagaaacacucgaacaaaugcaaagaaagcauggcggcaugcuuguucgaaauccguuaucuagaaacaguacccaugaaauguauugggucaguugcggcacagguaacauaguaucagccgugaauaugacaagcagaaugcucuuaaaucguuuuacuauggcacaccgcaaacccacuuaugaaagagauguugaccuuggggcggggacaagacacguagccguugaaccugaaguugcaaacuuagacauaaucggacaacguauagagaacauaaagcaugaacauaaaagcaccuggcauuaugacgaggacaacccauauaaaaccugggcauaucacgguagcuaugaaguuaaaccaagcgguucagcaucaaguaugguuaacggaguugucaaacuuuuaaccaagccgugggauguuauaccaaugguaacacaaauugcaaugacagauacaacuccauuuggacaacaaagaguauuuaaggaaaaaguggacaccaggacacccaaggcgaaacgcggcacugcccaaaucauggaaguuacagcaaaguggcuguggggauuucuaucacguaauaaaaagccacggauuuguacgcgggaggaguuuacaaggaaaguaaggucgaaugcagcgauuggggcuguuuucguagaugaaaaccaauggaauagugcgaaagaagcgguggaagaugaaagauucugggaucugguacaucgugaaagagaacuacacaagcaaggaaagugcgcaacguguguguacaacaugauggguaaacgagagaagaaacucggugaguuugggaaagcaaagggaucaagagccaucugguacaugugguuaggugccagguuucuugaguucgaagcucuuggauuuaugaacgaagaucacugguuuucccgggaaaacucuuuaucuggaguugagggugaaggacuacauaagcuaggauauauauuacgagacauuucuaaaauaccggguggaaacauguaugcagaugauacggcugggugggauacacgaauaaccgaagacgaccuacagaaugaagcgaaaauaacugauauuauggaaccagagcacgccuuauuggcuacaagcauuuuuaaacuuacauaucaaaauaaagugguaagaguacaacggccagcgaaaaaugguacagugauggacguaauuagccggcgagaccagagagguagugggcagguuggaacauacggguugaauacauucacuaacauggaagcgcaauuaauucgccaaauggagucagaggguauauuuagucccucagaacucgagacgcccaaccuugcaggaagaguuuuggauuggcuugaaaaacaugggguagagaggcucaaaagaauggcaauaucgggugacgauuguguagugaaaccaaucgacgaccgauuugcaaccgcacucaccgcacuaaacgacaugggcaaaguuaggaaggauauuccgcaaugggaaccgucaaaaggauggaaugacuggcagcaaguuccguucuguucccaucacuuucaccaacugauaaugaaggauggaagagaaauagucguaccaugccgaaaucaggaugaguuaguagguagagcaaggguaucccaaggagcagguuggagucugagagaaacugcuugccuagggaaaagcuaugcucaaauguggcaauuaauguauuuucauagacgcgaccucagacuugcugcaaacgccaucuguagugcggugccaguggauuggguuccaacgucacgaacgacguggaguauacaugcacaucaucaauggaugaccacugaagauauguugaguguauggaaccgaguuuggauugaagaaaauccauggauggaagacaaaacgcauauaaguaguuggggagauguaccguaccuggguaagcgugaagaccaauggugugguaguuugauaggacuaacggcgagagcgacaugggcaacaaauauccaaguggccauaaaccaaguacguagauuaauuggaaacgagaauuacuuagauuauaugacaaguaugaagagguuuaagaaugaaagcgacccugagggugcauugugguag

SEQ ID NO: 21735 - RNA, 9879 nt, Artificial Sequence
  derived and/or modified CDS sequence (opt6) from DENV-1__FJ898398__SS-prME
ucaguuacuaugcuacuuaugcuaaugcccacugcauuagcguuucaucuaacaacgagaggcggggagccacacaugauagucucaaaacaagaaaggggcaaaucccuauuauuuaaaacaagugcgggaguuaacaugugcacuuuaauagcuauggacuugggcgaauuuugcgaagacacaaugacauacaaauguccgaggauaacagaagcggaaccugacgacguagauuguuggugcaaugcaacugacacguggguuacauacggcacuugcagccaaacgggggagcaucgucgugacaaacguaguguugcauuagcuccacaugucggauugggauuagaaacaagaaccgaaacauggaugucuucagaaggugcauggaaacaaauacaaagaguagaaacaugggcucuuaggcauccaggauuuacuguaaucgcgcuauuccucgcacaugcaaucggaacaagcauuacgcaaaaggggauaauauuuauauuacuaaugcucguuacgccauccauggcuaugcguuguguuggcauuggaucacgugauuuugucgaaggucuuaguggagcaacauggguagauguaguguuggagcaugggagcugcguaacaacuauggcaaaagauaaaccaacgcuugacauugagcuauuaaaaacggaaguuaccaauccugcuguguugaggaaauuauguauagaagcaaaaauaaguaauacaaccacagauucacgaugccccacccagggagaagcuacauuaguugaagaacaagacgcuaauuuuguaugcagaaggacauucguugaccguggaugggguaacggauguggcuuauuugguaaggguaguuuaaucaccugugccaaauuuaaaugcgucacuaaacuagaaggaaaaauaguccaauaugaaaacuuaaaauacagcgucauugucacuguccacacuggcgaccaacaucagguggguaacgaaaguacagagcacgggacuacagcgaccauaacaccacaggcaccgagcacugaaauccaacuaacagauuauggugcccuaacacuugacugcaguccacgaacaggucuagauuucaacgaaaugguccucuuaacaaugaaagaaaaaucguggcuuguucacaaacaaugguuucuugacuuaccucuacccuggaccaguggggcaucaacaucacaagaaacguggaacagacaggacuuguugguuacauuuaaaaccgcacacgccaagaaacaggaagucguggucuuaggaucacaagaaggcgcaaugcacacugccuuaacaggagcaacugaaauccaaacuucagguacuacgaccaucuuugcgggacaccucaaauguagauuaaaaauggauaaauuaacauuaaaaggaaugucauauguaaugugcacugguagcuuuaaacuugaaaaagaaguagccgaaacgcagcauggcacaguauuaguccaaauuaaauacgaggggacggacgcgcccugcaaaauaccguuuaguacgcaagacgagaagggaguaacccaaaacgguagauuaauaacggccaauccaauuguaacggacaaagaaaaaccaguaaauauagaggcugaaccacccuuuggcgaaucauacauagugaucggcgcaggcgaaaaagcguugaaauuauccugguuuaagaaagguucaucuauuggaaaaauguuugaagcuacagcaaggggugcccgaaggauggccauucuaggagauacagcaugggacuuuggcuccauuggcggaguguucacaagcguugguaaauugguucaccaaaucuuugguacugccuauggcguacucuuuaguggcgucagcuggacaaugaagaucgguauuggcguucugcucaccugguugggacuaaauucacgaucuacauccuuaaguaugacuugcauagccguuggcuuagugacccucuacuugggggucauggugcaagcagauucgggaugcguaauuaacuggaaaggucgcgaauuaaagugcgggucaggaauauuugucacaaacgagguacacaccuggaccgaacaauauaaguuucaagcagauucaccuaaaagauuaagugcugcaauaggaaaagcaugggaagaaggaguauguggcauaagaagugcaacuaggcuagaaaauauuauguggaaacagaucucgaaugagcucaaucacaucuugcuugaaaaugauaugaaauuaacaguagucgucggagacguagccgguauccuagcacaagguaaaaagaugauucggccucagcccauggaauacaaguauagcuggaaaaucuggggaaaagccaaaauaauuggugcagacguucagaauacgacauuuauuauagauggaccuaauacaccugaguguccagacgaccaaagagcuuggaauauaugggaaguagaagauuauggauuuggaauuuucacaacaaacaucuggcuaaaguugcgagauucuuauacacagguuugcgaucaucgacugaugucugcugcgaucaaagauucuaaagcaguccaugccgauaugggcuauuggauagaauccgagaaaaaugaaaccuggaaauuggcuagagccucauuuauagaagucaagacgugcauuuggcccaaaagucauacacuuuggucaaauggaguauuagaaucggagaugauaauuccaaaaauauauggcggaccuaucagucagcacaauuaccguccuggauacuuuacucaaacugcuggaccuuggcaucuuggcaaauuagaauuagacuuugaucucugugaagguacuacaguagugguagaugaacauugugguaauagggggccaagucugagaacgacgaccguaacagggaaaauaauacacgaguggugcugccgaucauguacauuaccgccuuuaagauucaaaggagaagauggguguugguacgggauggaaauuaggccaguuaaagaaaaagaggaaaaccuagucaagucaauggucagugcgggcagcggggaagucgauucguucucacuuggguuacuaugcauaucaauuaugauagaagaaguuaugagaucaagauggucaagaaaaaugcucaugacuggcacguuggcagucuucuuucugcuuaucaugggacaacucacauggaaugaucuuauuagauuauguauaauggucggagccaaugcaucagaucgcaugggcauggggaccaccuaucuagcccuaauggcuaccuuuaaaaugagaccaauguucgcuguaggauuacuauuccgacgacucacaagccgugaaguguuacuguuaacaauaggacuuaguuuaguugcauccguugaacuuccuaacucucuagaagaacucggcgacggucuagcgauggguaucaugaucuuaaaauuauuaacagauuuccagucacaccaauugugggcaacguuauuaucuuugaccuuuaucaggacuacuuuuucauuacauuaugcauggaaaacaauggcuaugguacuaucgauagucucuuuauuucccuuaugucuuucuacaaccucccaaaagacaacuugguuaccagucuuauuaggauccuuagguugcaagccucuuacaauguucuuaauugcagagaacaagauauggggucguaaaucuuggccucucaaugaaggaauaauggcgguggguaucgugucuauucuuuuaucaagccuccucaaaaacgacguaccacuagccggaccccuaauagcggguggaaugcuaauagcuugcuauguaauaaguggauccagugcagaccuaucauuggaaaaagcagcugaagucaguugggaagaagaagcagaacacuccggcgcgagucauaacauucuaguagaaguacaagacgaugguaccaugaaaauuaaagacgaagaacgggaugauacucuaacaauucuauuaaaagcgacuuuacuugccgucucaggagucuauccuuuaucaaucccagccacgcuauucgugugguacuucuggcagaagaagaaacaacggagcggaguguuaugggauacuccaucuccaccggaaguugagagagcaguucuagacgacgguauauauagaauaaugcaacgaggauuauuagggagaucucaaguuggagucggaguuuuccaagagaauguauuucauacuauguggcauguaacucgcggagcaguacugauguaucaaggaaagcgacuagagccgucgugggcaaguguaaagaaagaccucaucucuuacggcggcggcuggcgacuucaagggucauggaauacgggugaagaaguacagguaauagcuguagaaccagggaaaaacccuaaaaacguucagacagcuccaggaacuuuuaaaacaagugagggugaggugggugcaaucgcuuuggauuuuaaaccaggcacaucuggcuccccaauaguaaaucgagaaggaaaaauaguaggacuauacgguaauggagugguaacaacaucaggaacuuauguauccgcaauugcacaggcuaaagcaucucaagaagggccgcuaccagagauagaagaugaagucuuccgaaaacggaaucuaacuauaauggacuuacauccaggaaguggaaagacacgacgauaucuuccugcaauaguuagagaagcaauaaaacgacgguugcggacucuuaucuuagccccaacgagaguaguugcuucugaaauggcugaggcauuaaaaggaaugccgauacguuaccagacaacagcaguuaaaucagaacauacuggaaaggagauaguggacuuaaugugccacgcuacauucacaaugcgacuauuaagucccgugagaguaccuaauuauaacaugauaauaauggaugaggcacacuucacggacccuucaaguauagcggcaagaggcuauauaaguacacgagucggaaugggugaggcggcggcaauauuuaugacggcaacaccgccaggaaguguggaagcguuuccacaaucaaacgcaguaauucaggacgaagagagagacauacccgaaagaucauggaacagugguuaugaauggauaaccgacuuuccggguaagacaguuugguucguuccuaguauuaaaaguggaaacgacauagcgaauugucuaagaaagaaugggaaaagaguuauacaauuaucaagaaaaacauuugauacagaauaccaaaagaccaagaauaacgacugggacuauguaguaacgacugauauaucagaaaugggugcaaacuuucgugcugauagagucauugauccgcgccgguguuuaaaaccuguuauacuaaaggacggaccagagagaguaaucuuggcaggccccaugccuguaacgguugcuucggcugcccaaagaagaggucguauagggaggaaccacaacaaagagggagaucaauacauauauaugggacaaccccuaaauaaugacgaggaccacgcgcacuggacagaagcaaagaugcuauuggauaauaucaacacaccugaagguauaauccccgcccuauucgaaccagaaagagaaaaaucagcggcuauagacggcgaguaccguuuaagaggagaggcaagaaaaacguuuguagaacuuaugcgaagaggggauuugccaguuugguuaagcuacaagguggcgucugaaggguuucaauacucugauaggagaugguguuuugauggcgaaagaaauaaucaaguucuagaagaaucaauggacguagaaaucuggacuaaagagggagaaaggaagaaauuaagaccacguuggcuagaugcacgaacguacagugauccguuagcacugagagaauuuaaagaauuugccgccggcagaagaucuguuucaggagauuuaauccuggaaauugguaaauuaccacaacauuugacccaaagagcacagaaugcguuggacaaccucguaauguuacacaacucggagcaaggagggagagcguauagacaugcuauggaagaacuccccgauacuauugaaacauuaauguuacuagcgcuaauugcuguauuaacggguggcguuacucuauucuuuuuaagcggccguggccuuggaaaaacaucgauagguuuacuaugugucauggccucauccguuuuacuauggauggccucaguugaaccacacuggauagccgcgagcauuauuuuagaguucuuuuuaaugguccuacucauaccggaaccggauaggcagagaacaccacaggauaaucagcuagcguauguggucauaggucuauuauucaugauucuaaccguugcagcaaacgagauggggcuacuggaaaccaccaaaaaggauuuagguaucgggcauguagcgguggagaaucaccaccacgcagcaaugcuugacgucgacuuacauccagccucagcguggacucuuuacgccguagcaacuacuauaauaacaccaaugaugcgccacacaauagaaaauacaacggcuaauauuagccuaacagcuauagcuaaccaggcagcgauacuuauggggcuagacaaaggauggccuauaaguaaaauggauaucggagucccuuuguuagcacuuggguguuacagucaggugaaccccuuaacauuaacagcagcaguucuuauguuaguagcacauuaugcuauuaucggaccaggauuacaagcuaaggcaacucgcgaagcccaaaagaggacggcggccggaauaaugaaaaacccaacaguggauggcauaguagccauagacuuagaucccguuguauaugaugcgaaauucgaaaagcagcugggccagauaauguugcuuauacuauguacgucacagauccugcuuaugagaacuacgugggcccucugugaauccauaacacuagcgaccggaccguuaacaacguugugggaaggcagcccaggaaaauuuuggaacacaacgauagcaguaucgauggcaaauauauuuagaggaucguaccuagcuggugcuggcuuggccuucagucuaaugaaaucacucggagguggaaggcgagguacaggcgcccaaggggaaacccugggugaaaaauggaaacggcagcuuaaucaacuaagcaaaagugaguucaauaccuacaaaagaucaggaauuauggaaguagaucguagugaagcaaaggaagguuuaaagaggggagaaaccacaaaacacgcugucucuagagguaccgcuaaacuaagaugguuuguagaaagaaaccuuguuaaaccugaaggaaaggucauagaccuaggaugcggacggggaggcuggucauauuauugugcgggacucaagaaaguuacagaagucaaagguuauacgaagggcggaccuggccaugaagaaccaauaccgauggcuaccuauggauggaacuuaguaaaauuacacucaggaaaagauguauucuuuauucccccagagaaaugugacacacuucuaugugauauaggagagucuucaccgaauccaaccauagaggaaggucggacgcuacgaguauugaaaaugguagaaccaugguugagagguaaucaauucuguauaaagauucuaaauccuuauaugccaucugugguggaaacauuggaacaaaugcaaaggaagcaugggggaauguuagucagaaauccacuuaguagaaauucaacccacgagauguacuggguaaguuguggaaccggaaauaucguuucagcagugaauaugacaucaagaauguuguugaaccgauucacaauggcacacaggaaaccaacauaugaacgcgauguugacuugggagccgguacuaggcacguugcuguagaaccggagguagccaaucucgauauaauaggucagaggauagaaaauaucaagcacgaacacaaaagcaccuggcacuaugaugaagauaauccuuauaaaaccugggcuuaucaugggaguuacgaaguuaaaccuucagggagcgcgucaagcaugguaaaugguguaguaaaacuauugacaaagccaugggauguuauucccaugguaacacagauagccaugacggauacuacuccauucggucaacaaaggguauucaaggagaaaguugacacgagaacucccaaagcaaagcgagggacggcucagauuauggaggucaccgcuaaaugguuauggggauuucucagucgaaacaagaaaccacguauaugcaccagagaggaguuuacaaggaaaguccguucgaacgcugcaaucggugccguauucguggaugaaaaccaauggaacucggccaaagaagcagucgaagaugaacgauuuugggaucuuguacaucgcgaacgagaguuacacaaacaaggaaaaugcgcgaccugcguuuauaacaugaugggaaaaagggagaaaaaguuaggugaauuugggaaagccaaagguucgagagcaauuugguauaugugguuaggugcgagauuucuagaguucgaggcccugggauuuaugaacgaggaccauugguuuucaagagaaaacagcuuaucagguguagaaggagaaggauugcauaaacuagguuauauucuacgagacauaucaaaaauuccgggagggaacauguaugcugaugauaccgcagggugggacacccgaaucacugaagaugaccugcagaacgaagccaaaaucacagacaucauggaaccagaacaugcacuucuggcgaaaucgauauucaaauugacauaccaaaauaagguaguacgaguacaaagaccugccaaaaauggaaccguaauggaugucauauccaggcgagaccaacggggaucaggucaggucgggacguacggucuaaauacauucacuaauauggaagcucaacucauaagacaaauggaaucagaggguaucuucuccccguccgaacucgaaacacccaauuuggcaggaagaguuuuaaacuggcuagaaaagcacggugucgaaagauuaaaaaggauggcaaucuccggugacgauugugugguaaaaccaauagaugaccguuuugcaacagcccucacagcguuaaaugauaugggaaaaguccgcaaggauauaccacaaugggaaccuucuaaaggauggaaugauuggcaacaggucccauuuuguucccaucauuuucaucaauuaauuaugaaagaugggagagaaauuguaguaccaugcagaaaccaagacgaguugguagguagggcacgaguaucucagggugccggauggucuuuaagagagacagcuugcuuaggaaaauccuacgcgcaaauguggcaauuaauguauuuucacagacgggaccuucgacuagcugcgaaugcaauuuguagcgcugugccuguugauugggucccaacaaguagaacuacguggucaauacaugcacaucaccaauggaugaccacugaagacauguuauccguuuggaaucggguauggaucgaagaaaacccuuggauggaagacaaaacucacguuucgaguuggggagacgucccauaucuuggaaagagagaagaccaaugguguggcucgcuuauuggccuaacggcacgggcaacuugggcgacgaauauacaaguagcgaucaaccaagugcggcgauuauuagggaaugagaacuaucuugacuacaugacaagcaugaaaagauuuaaaaaugaaagcgauccggaaggggcgcuaugguag

SEQ ID NO: 21736 - RNA, 9879 nt, Artificial Sequence
  derived and/or modified CDS sequence (opt6) from DENV-1__FJ898399__SS-prME
ucgguaacaauguuguugaugcuuaugccaacggcucuugcuuuucaucucaccaccagagggggugaaccucauaugaucguaucaaaacaagaacgagggaaaucauuacuguuuaaaaccuccgccgguguaaauaugugcacuuuaauugcaauggacuuaggcgaauuuugugaagacacaaugaccuauaaaugcccaagaauaacugaagcagagccagaugauguagauugcuggugcaacgcaacagauaccuggguaacauacgguacauguagucaaacaggagaacaucggagggauaaacguucgguagcgcucgcgccgcauguaggacucggacuggaaaccagaacagaaacuuggaugaguucugaaggagcuuggaaacaaauacaacgcguugaaacuugggcacuucgacacccugguuuuaccguuaucgcccuuuucuuagcacaugccauaggaacuucaaucacucaaaaaggaauuauuuucauauuguuaaugcuaguaacacccucaauggcaaugcguugcguaggaaucggaucaagagacuucguugaaggacuaucaggggcgacuuggguagauguaguacucgaacacggauccuguguuacaaccauggcaaaagauaaaccaacguuggacauugaauuguuaaaaacagaagugacuaacccagcaguacuaagaaaauuaugcauagaagcgaaaauuucuaauaccacaacagauucaaggugccccacucaaggugaagccacauuggucgaagaacaagacgccaauuucgucugccggagaaccuuugucgaucgaggguggggcaacggcuguggauuauucggaaaaggcucacuuauuacaugcgcuaaauucaaauguguaacaaaauuagaagguaaaauugugcaauaugaaaaucuaaaauacucaguaauaguaacgguacauacaggagaccaacaucaagugggcaaugaaucaacggaacacggcacaacggcgacuauuaccccacaagcaccuucuacugagauccaacuaacugacuauggugcauuaacuuuagauugcucgccgagaaccggcuuagauuuuaacgagauggucuuguuaacgaugaaggagaaaaguuggcucguacauaaacaaugguuuuuggaccugccgcuaccauggacgucaggagcgaguacaucacaggaaacuuggaaucgaaaggacuugcucgugacauuuaaaacugcacacgcgaagaaacaggagguaguaguccuaggcucacaggagggcgcuaugcauacugcgcucacaggugcaacagagauacaaacuagcgguacaaccacuaucuuugcaggccaccucaaauguagacucaaaauggauaaauuaacauuaaagggaaugucauacguaauguguaccgggucuuucaaauuagaaaaagaagucgccgagacucagcacgggaccguuuuaguacagauuaaguaugagggaacggaugcuccgugcaaaauaccuuuuucaacccaagacgagaaagguguaacacaaaauggacgucuaauaacugcuaaccccauuguaacagauaaagaaaagcccgugaauauagaggccgaacccccauucggcgaaucauauauuguuaucggcgccggggaaaaggcccuuaaauuaucgugguuuaagaaaggaucauccauagguaaaauguuugaagcaacagcgagaggcgcgcgaagaauggcgauuuuaggagacacagcgugggacuucggcaguauagggggaguauuuaccucagucggaaaacucgugcaccaaauuuucggaacugcauacggaguccuauuuucuggagugucauggacgaugaagaucgggauagguguguugcuaacauggcuaggguugaacucacgcaguacgagccuauccaugacauguauagcgguagguuugguaacucuauaucucgggguaaugguacaagccgauucuggaugugugauaaacuggaaaggaagagaacuuaaaugcggaagcggaauuuuugucacuaaugaaguacacacuuggacagagcaauacaaauuccaggcagacagucccaaacgcuugucugccgcuauagggaaggcuugggaggaagguguuugugggauacguagcgcgaccagauuggaaaauaucauguggaaacaaauuagcaaugaacucaaccauauucuacucgaaaaugacaugaaacuaaccgucguagucggggacgucgcagguauccuagggcaagguaagaaaaugauacggccacaaccuauggaguauaaauauagcuggaaaaguuggggcaaagcuaaaauaauaggagcugaugcucaaaacacaacuuuuauaauagauggaccaaauacacccgaauguccagaugaccagagagcuuggaacauaugggaggucgaagauuauggauuuggcaucuuuaccacaaauaucuggcuuaagcuaagagauaguuacacucaggucugcgaucacagacuuaugucugcagcaaucaaggauuccaaagcuguucaugccgauaugggauacuggauagagagugagaaaaacgagacauggaaauuggcuagagccagcuuuauugaaguaaaaaccuguaucuggccuaaaagccacacguuguggucuaauggagucuuggaaagcgaaaugauaauuccuaagauauacggaggaccaauaagccaacacaauuaucggccaggcuacuucacacaaacagcaggcccuuggcaucuuggaaaacuugaacuugauuuugaucucugugaaggaaccacaguagugguugaugaacacuguggaaaucgagguccaucacugcgaacaacuacgguaacagguaaaauaauacaugaguggugcugucgaucuuguacacugccgccacuaagauucaaaggugaagacggaugcugguacggaauggaaauacggcccguaaaagagaaagaagagaaucuaguaaagucaauggucucagcuggaagcggcgaaguagauucauuuucauuaggacuacuaugcauauccauuaugauagaggaaguaaugagaaguagauggucaaggaaaaugcucaugacuggaaccuuggcaguguucuuuuuacugaucaugggacaguuaacauggaacgaucucauucguuuguguaucaugguaggagcuaaugcuucggauagaauggguaugggcacuacguacuuagcacuaauggcgacauuuaagaugagaccaauguuugcuguaggauuacuauucagaaggcuaacgucgagagaaguguuacuucucacgauaggacuaucucuaguagcgucggucgagcugccaaauucgcuugaagaacugggugauggguuagcaaugggaauaaugauacugaaacuucucacagacuuucaaucccaccaauuaugggcgacauuguuaucauugacuuuuauaaaaaccacauuuucacugcauuacgccuggaaaacgauggcaaugguauuaucaauugucucauuauucccuuuaugucuaucaacaacuucacagaaaaccacuugguuacccguacuacucggaucgcuagguugcaaaccacucacgauguucuuaauagcagaaaauaagauauggggucgaaagucuuggccccuuaacgaggggaucauggcugucgguauugucucuauacuccuuucuucgcucuugaagaaugacguaccacuggccggcccuuugauagccggugguauguugauugcauguuauguuauuucuggaucgucugccgacuuaucuuuagagaaggcugcagaaguaucaugggaagaagaagcagaacauucaggagccucucacaauauacugguugaaguccaggacgaugggacaaugaaaaucaaagacgaagagagagacgacacauuaacaauauuauuaaaggcaacguuguuggcagugucgggcgucuauccauuaaguauuccugcgacacuuuucguaugguacuucuggcagaaaaagaaacaaaggucuggaguucucugggauacuccaucaccgccugaagucgaacgggcaguguuagaugaugggauauauaggauaaugcaaaggggucuacugggcagaucacaggugggaguggggguguuccaagaaaacgucuuucauaccauguggcacgucaccaggggugcaguucuuauguaccaaggcaaaagacucgagccaaguugggcaagcgucaagaaagaucucauuuccuauggugguggguggcgacugcaagggagcuggaauaccggagaggaaguucaaguaauagcaguagagccaggcaaaaaccccaaaaauguucaaacugcgccuggcacuuucaaaacaucggaaggagagguaggugcaauagcacuggauuuuaaaccuggaacaaguggaucaccaaucguuaaccgugaagguaaaaucgucgggcuuuacggaaauggaguuguuacaacaucagguacauacgugucagcaauugcucaggcaaaggcgucgcaagagggaccccuuccagaaauagaggaugaaguauuccgcaaaagaaaccuuaccauaauggauuuacacccagggagugguaagacccgcagauauuuaccugcgauagucagagaagcuauaaaacgaaaauuaagaacuuuaauucuagcuccaacaagaguaguggcaucggaaauggcugaggcuuugaaaggaaugccgauaagauaucagacuacagcuguaaaaucagagcauacagguaaagaaaucguagauuugaugugccaugcaacuuucaccaugcgacuccuaagcccaguacgcguaccaaauuacaauaugauaauaauggaugaggcucacuucacugacccauccucaauugcggcaaggggguacauaucuacgcguguugguaugggagaagcagcggccauuuuuaugacagcgacuccuccugggagcguagaggcauuuccacaaaguaacgcagugauacaagacgaggagcgcgacauaccagagcgcaguuggaauaguggcuacgaauggaucaccgauuuccccggaaaaacaguuugguucguuccuucuauuaagucuggcaacgauaucgcuaacugccucaggaaaaauggaaaaagagucauccaguuaagucggaaaacauuugauacagaauaucagaaaacaaagaauaaugauugggacuaugucguaacaacugauauaucagaaaugggugcgaauuuuagagcugauagggucauugaucccaggagaugccuuaaaccugucauauuaaaagauggaccagaaagaguaauacuggcaggacccaugccaguuacuguggcgagcgcagcucaacggagagggagaaucgggagaaaucauaauaaggagggcgaccaauauauuuauaugggucaaccguugaauaaugaugaagaccacgcgcacuggacugaagccaaaauguuacuugacaauauuaacacgccagaaggaauuauuccugcauuguucgaaccagaaagggaaaaaucagcugccauagacggugaauacagauuacgaggugaagcaaggaaaaccuuuguugaauuaaugagacggggagauuuaccaguaugguugagcuacaaagucgcgucagaaggguuccaauacuccgauagaagaugguguuucgacggagaaagaaacaaucagguucuggaagagaauauggauguagaaauuuggacaaaagaaggugaaaggaagaaacucagaccaagauggcuagacgcccggaccuacucggauccauuagcauuacgagaauuuaaagaguuugcugcaggaagacgaagugucucaggagauuuaauacucgaaauuggcaagcugccacaacacuuaacacagagagcucagaaugcacuugacaaccuugucauguugcauaacuccgaacaagguggucgugcuuauagacacgcuauggaagaacuaccagacacuauugagacauuaaugcuguuagcacuaauagcaguguuaaccgggggaguaaccuuauucuuuuuaagugggcguggacuuggaaaaacuucgauaggauuauuauguguaauggccucaucaguauuacuguggauggcaucgguagaaccgcacuggauugccgcuagcauuauucuugaguucuuucuuaugguccuccuuauaccagagcccgaccggcaacguacaccgcaagacaaucaacuugcuuacguugugaucggacuacuuuuuaugauacugacuguagcagcgaacgagauggggcuuuuagaaaccacaaagaaagaccucgggauuggucauguugcuguagagaaucaccaucaugcagcuauguuagacguagaucuacacccugcuucagcuuggacucuauaugcaguggcgacuacuauaauaacuccaaugaugagacacacuauugaaaauacaacugcaaacauaucacuuacugccauugccaaccaggcugcaauccuaaugggucuagauaagggguggccaauaucaaaaauggacauuggaguuccgcuacuagcccuugguuguuauagucaggugaauccccuaacguuaacagcugcaguacucaugcugguugcucacuacgcuauaauagguccagguuuacaagcgaaagcaacgcgagaagcacaaaaacguacggccgcuggaauuaugaaaaacccuacaguagacggcauuguagccauagaucuugacccggucguauacgacgcgaaauuugaaaaacagcucggacaaauuauguuauuaauacuaugcacaucccagauuuuguuaaugcggacaacgugggcguugugugaaucaauuacucucgcuacugguccuuugacuacguugugggaaggaucgccgggcaaauucuggaauacuaccaucgccguaaguauggcaaauauauucagaggguccuacuuggcaggagccggacuagcauuuaguuuaaugaagagucuaggcggagguagaagaggaacaggagcacaaggugaaacgcuaggggagaaauggaaacgucaacuuaaccaacuaaguaaaagugaauuuaauacauauaaaagaucuggaauuauggaaguggaccguuccgaggcaaaagaagggcuaaaaagaggcgaaacuacgaaacacgcaguuagccgaggaacagcuaaacuacgaugguucgucgagcgaaaccuuguaaaaccggaaggcaaaguuauugauuuaggauguggaaggggaggauggucauauuauugcgcaggucugaaaaagguaacggagguuaaaggcuacacuaaagggggacccgggcaugaagaaccaauuccuauggcaacauauggguggaauuugguuaaauuacauuccgggaaagauguguucuuuauaccuccugaaaagugcgacacucuuuugugcgauaucggggagaguagcccuaauccuacaauagaagagggaaggacacuaaggguauuaaaaaugguagaaccuugguuaagaggaaaucaauuuuguaucaaaauuuugaauccauauaugccuucaguaguugaaacuuuagagcaaaugcaaaggcgacauggaggaaugcuagugagaaacccauuaaguagaaauucuacacacgagauguauuggguuucaugcggaacaggaaauauagucagugcgguaaacaugacuucuagaauguuauuaaaucgauuuaccauggcgcauaggaaaccgaccuacgaaagagauguagaccuaggugcuggcacacgacaugucgcaguagaaccugaaguagcgaaucucgauauaauuggccagcgaauugaaaacaucaagcacgaacacaaaucuacuuggcauuaugacgaagauaauccguauaaaacgugggccuaucauggaucauaugagguaaaaccuagcggaucagcaaguaguaugguuaauggaguggugaaauuauuaacuaaaccaugggauguuaucccaaugguuacccaaauugcuaugacagauacuacuccuuuuggucagcaaagaguuuuuaaggagaaggucgacacuagaacgccuaaagcuaaacgaggaacggcucaaauaauggaagucacagcgaaauggcuauggggauuucucucaagaaauaagaaaccccgaauauguacgcgagaggaguuuacccgaaagguccggucaaacgcagcuauaggagcuguauuuguagacgaaaaucaauggaacucagcgaaggaagcgguagaagacgaaagauucugggauuuggugcacagagaaagagaacuucacaaacagggaaaaugcgccaccuguguguacaauaugaugggaaaacgugagaagaaauuaggggaauuugguaaggcaaaaggaagccgugccauuugguauauguggcucggcgcaagauuucuagaguucgaagcguuaggauucaugaacgaagaccauugguuuagucgagaaaacaguuugagcggcgucgagggagaaggauuacauaaguuaggauauauucugagggauauuucuaagauucccggugggaacauguaugcggaugauacagcuggaugggacacaaggauaacugaagaugaucuacaaaacgaagcaaaaaucacagacauaauggaaccagaacacgcacuauuggcaaaaucgauuuuuaaauuaacauaccaaaauaaagugguacgaguacaacguccggccaaaaaugguacaguaauggacgucaucagucggcgcgaucagagagguaguggucaagugggaaccuacggguuaaauacuuucacuaauauggaggcacaacuaauaaggcaaauggagucggaggguauuuucaguccuagugagcuggagacaccaaacuuagcaggcagaguacuagacuggcuagagaaacacgguguagaaaggcuaaagagaauggcgauuucaggggacgacugcguaguaaaaccaauugaugaucguuucgcaacagcacucacugcguuaaacgauaugggaaaaguaagaaaagauauuccacaaugggagccgucaaaaggguggaaugauuggcaacaaguaccauucuguucgcaccauuuccaucagcuaauaaugaaagacggacgggaaauaguagugccaugccgaaaucaggacgaacucguggguagagcaagggugagucaaggagcggguuggagucugcgcgaaacugcauguuuagguaaaagcuaugcacaaauguggcagcuaauguauuuccacagacgagaucuaagguuggcugccaaugcuauauguagcgccguacccgucgauuggguucccacaagcaggacuacauggucaauacacgcacaucaucaauggaugacuacagaagauaugcuaucuguguggaauagaguauggaucgaagaaaacccuuggauggaggauaaaacccacauauccucauggggagauguuccauaucuagggaaacgcgaagaucaauggugcggaagccuuauuggacugacagcuagagccacaugggcgacgaauauucagguggcaauuaaccaagugcggagacuaauaggaaacgagaacuacuuagacuauaugacaagcaugaaaagauucaaaaaugagagugauccagagggugcucuaugguaa

SEQ ID NO: 21737 - RNA, 9879 nt, Artificial Sequence
  derived and/or modified CDS sequence (opt6) from DENV-1__FJ898401__SS-prME
ucaguaacaaugcuccuaaugcuaaugccuacugcguuggcauuccacuuaacuacaagaggaggugaaccacauaugauagugagcaaacaggaaagagguaaaaguuuacuuuuuaaaacuucagccggaguaaauauguguacuuuaauugcaauggauuuaggugaguuuugcgaagacacuaugacguacaaauguccucgaaucacagaagcggagccggacgauguagacugcugguguaacgcgacagauacaugggucacuuacggcacuuguucacagacaggugaacacagaagggacaagagaagcguagcgcuugcaccucacguuggccuuggguuagagacacgcacugagaccuggaugucauccgaaggcgcuuggaagcagauucaacgcguagagacaugggcgcuaagacauccuggauucacgguaaucgccuuguuccucgcucacgcgauaggcaccuccaucacccagaaaggaauaauauuuauacuacuaaugcucguaaccccaucaauggcgaugcgaugcguggguauugguucuagagacuucguugaggggcucucuggcgcaacguggguggacguaguucuagaacauggaucauguguaacgaccauggcaaaggacaaaccgacacuagauauagaauuauuaaaaacggaaguaacaaaucccgcaguucucagaaaauuguguaucgaagcaaaaauaucuaauaccacgacagacagucgaugucccacacaaggcgaagcaacccuagucgaggagcaagacgcaaauuuuguaugucgaaggacguucgucgauagagguuggggaaauggcuguggucucuuugggaaaggaucacucauaacgugugcaaaauuuaaaugugucacgaagcuagaagguaaaauaguacaauaugaaaaucuuaaauacucagugauagugacgguacacacuggggaucaacaucaagugggaaaugagagcaccgaacauggaacuacagccacuauuacuccucaagcgccaucgaccgaaauucaauuaacagacuauggugcccuaacccuugacuguucaccucgaacaggacucgacuuuaacgaaaugguacuguuaaccaugaaagaaaaaucuuggcuaguacacaaacaaugguuucuagaccuaccgcugcccuggacgucaggagcaagcacaucacaagagacguggaaccguaaggaccuuuuaguuacauuuaaaacugcacacgcgaagaagcaagagguuguaguuuuaggaucccaggagggcgccaugcacacugcacuuaccggugcaacagagauucaaacaaguggaacuaccacaauuuuugcaggacacuuaaaauguagacucaagauggauaaacucacguuaaaaggaaugucguacguaauguguacuggaaguuucaaacuagaaaaagaggucgcugaaacgcaacacgggacaguauuaguacaaauaaaauacgaggggaccgacgcaccguguaagauaccuuuuaguacccaagaugaaaaaggcgugacacaaaauggcagacugauaacagcgaauccgaucguuacagacaaggagaaaccaguuaauauugaagcagaaccgccuuuuggugaaucuuauauaguuauuggugccggagagaaagcucuaaaacuaucuugguuuaaaaagggauccaguauagguaaaauguuugaagccacagcgagaggggcaaggcgaauggcaauauuaggagacacagccugggacuucgguagcauaggcggaguauuuaccucuguugguaaguugguccaucagauauucggaaccgcguacggaguccuguuuagcggcgugucauggacuaugaaaauaggcauaggaguacuccugacaugguuagggcuaaacucacgaucaaccagccucaguaugacauguauugcuguaggauuagugaccuuauacuuaggaguuaugguucaagcagauucaggaugugugauuaacuggaaaggcagggaguuaaaaugcggcucaggaauauuuguaacaaacgaaguacacacauggacugaacaguacaaauuccaggccgacucucccaaaagacuaucagcggcuauuggcaaggcaugggaagaaggagucugugggauucgaagugcaacacgcuuagagaacauuauguggaaacaaauaucuaaugaacuuaaucauauauuauuagaaaaugacaugaaauuuacaguuguaguuggagauguugccgguauucuagcucaaggaaagaaaaugauaaggccacaaccaauggaguauaaguacaguuggaagagcuggggaaaagcaaagaucauaggugcugauguacaaaauacaacguucauuauugauggaccgaacacuccugaaugcccagaugaccaaagggcauggaauauuugggaaguagaagacuauggauuuggcauuuuuaccaccaacauaugguugaaguugagagauagcuacacccaaguuugcgaucaccgccuaaugucugcagcuaucaaagauucgaaagcgguucaugcagauauggguuacuggauagaaagcgaaaaaaaugaaaccuggaaacuagcgcgcgcuucauucauugaagugaaaacauguauuuggccaaagucacauacccuguggagcaaugguguucuagagagcgaaaugauaauaccaaagauauacgguggccccauaucacaacauaacuauaggcccggcuauuuuacacaaaccgcaggaccauggcaccuagguaaauuagaacuugauuucgaccuuugcgaaggcacuacugugguuguagacggacacuguggaaaccgaggcccaucccuaagaaccacgacuguuaccggcaaaauaauacaugaauggugcugccguucgugcacacuaccgccauuaagauuuaaaggcgaagaugguugcugguauggaauggagaucagacccguaaaagaaaaagaggaaaauuuaguaaaaucgaugguuucagcgggaucaggagagguugacucguuuagccuagggcucuuaugcauaaguauaaugauagaagaaguaaugagaucaagguggucccgaaaaauguuaaugaccggaacauuagcagucuuuuuuuuguuaaucaugggucagcucacauggaaugauuugauaagacuaugcauuaugguaggagcaaacgcuagcgaucggaugggaauggggacuacuuaucuagcucucauggcuacuuucaaaaugagaccuauguucgccguaggguuauuauuccgaaggcuuaccucacgggaagugcuacuauuaacuaucggacuaucauuaguagccaguguagaauuaccuaauaguuuagaagaacuaggggauggucuagcaaugggaauaaugauuuugaaguuauugacagauuuucaaucgcaucaguuaugggccacgcuauuaagucuaacauucaucaaaacuacauuuaguuuacauuacgcauggaagacuauggcaaugguauugaguauuguaucacuauucccauuaugccuauccacuacaagccaaaaaacuacuugguuaccuguauuauuagguucacucggauguaaaccauuaacaauguuuuuaauagcagaaaauaaaauuugggguaggaagaguuggccauugaacgaaggaauaauggccguugguauaguuaguauucuacuuucuagcuuacuuaagaaugauguaccuuuagcagggccauuaauugcgggugguaugcuaauagcauguuauguaauuaguggaucaucggcggaucucagucucgagaaggcggcggaaguuucaugggagaaagaggcagaacauucaggcgcaucccauaauauauuaguagaaguccaagaugauggaaccaugaaaauaaaagaugaagaacgagaugacacauuaacuauauuauuaaaggcaacuuuguuagcagugaguggaguauauccuuuaucuaucccagccacacucuuuguguggcacuucuggcaaaaaaagaagcaacggucgggagugcugugggauacaccgagcccucccgagguggagcgugccguacuagaugauggcauauaccggaucaugcaaagagguuuguuaggacguagucagguaggugucggaguauuucaggaaaauguauuccauacgauguggcacguaacaaggggggccguauugauguaccaaggaaaaagauuagaaccgucaugggccucggugaagaaagauuuaauaucguaugggggcggguggcgucuacaaggaucauggaauacaggugaagaggugcaaguuauugccgucgaaccaggcaaaaacccgaaaaacguacaaacugccccaggaacauucaaaacaucugagggugaaguuggagcgauagcucucgacuucaagccgggaacaagcggcuccccgauaguuaacagagaaggaaaaauuguuggguuauaugguaauggaguaguaacaacuucuggcacguacguaucagcaauagcccaagcuaaagcgagucaggaagggccucucccagaaaucgaagacgaaguuuuucgaaaaaggaaucuaacgauuauggaucuacaccccggaucuggcaaaaccaggagauaucuaccggcaaucguacgugaagcaaucaaacgaaaauugcguacccugauacuggcaccaacucgcguaguagcgagcgaaauggcggaagcccugaaagggaugccgauccguuaucaaaccacagcuguaaaaagcgaacacacaggcaaagagauaguagaucuaaugugucacgcaacauuuacaaugagauuguuaucgccaguacgaguuccaaauuauaacaugaucauuauggaugaggcccauuucacagauccauccucaauugcagccaggggauauauaaguacaagagucgguaugggcgaagcagcagcaauuuuuaugacagcaacaccacccggaagcguugaggcuuucccgcaaucaaaugccguuauccaggaugaagaacgggacauaccagagagaucauggaacucaggauaugaauggauaacagauuucccgggaaaaacuguaugguucguaccguccauuaaaagugggaacgauauugcuaacuguuuacgaaaaaacggaaaaagaguaauacaacucagcagaaaaacuuucgacaccgaguaucaaaagacaaaaaacaacgacugggauuacguaguuacuacugacaucuccgaaaugggagcaaauuuuagagcugauagaguuauagacccucgaagaugcuugaaaccagugauccuaaaagauggcccagaaagaguuaucuuagccgguccaaugccuguaacugucgcaagugcugcacaaagacgugguagaauugguagaaaucacaauaaagaaggcgaccaauacauauauaugggucagccucuaaauaacgacgaggaccaugcgcauuggacagaggccaagaugcuacuugacaacaucaauacgccagaagggauuauuccugccuuauuugaaccagaaagggagaaaucagcagccauagauggagaauaucgcuugcguggugaggcaagaaaaacauucguugaguuaaugcgaaggggagaccugcccguauggcuuagcuauaagguagccagcgagggguuccaauacucugauagaaggugguguuuugauggggaaagaaauaaucaagucuuggaagagaauauggauguagagauuuggacaaaggaaggagagagaaaaaaacuaagaccaagauggcuggaugcgagaacuuauucagauccacuagcucucagagaauucaaagaauucgcagcuggucgaagaucagucucuggagaucuaauacuagagauaggaaagcuaccucagcauuugacucaacgugcucagaacgcauuagacaauuuaguaaugcuucauaacucagagcaaggaggaagggcguaucgccacgcgauggaagaauuaccagacaccauagaaacacugaugcuuuuggcucuaauagcgguuuuaacuggaggcgucacauuauucuucuuaucagggcgugguuuaggaaagacuucuauuggucuucugugcgucauggcaucgucaguccuacuauggauggccaguguugagccccauuggauagcagcaaguauaauauuagaauucuucuuaaugguacuacuaauaccagaaccggauaggcagaggacgccacaggacaaucaacuggcguacgugguaauuggguuauuauuuaugauauuaaccguagcggcaaaugaaaugggucuauuagaaacgacaaaaaaagacuuaggaauaggacacguugcuguugaaaaucaccaccaugcagccaugcuugacguggaucuccacccagcuagugcguggacacuauacgcaguagcgacaacaauaauuacuccaaugaugcgacauacgaucgaaaacacaacagcaaauaucagucuaacagcaauagcuaaccaagcugccauauuaaugggacuagacaaaggguggcccauaaguaaaauggacauuggcgucccacucuuagcucuagguuguuauagccagguaaacccuuugacauuaacagcugcgguucucauguuaguagcacauuaugccaucaucgggccaggcuugcaggccaaggccacucgagaagcacaaaaacgaacagcugcggguauaaugaaaaauccgacgguagauggcaucguggcaauagaccuagauccaguuguguaugaugcgaaguuugaaaagcaacuaggacaaauaaugcuguuaauauuauguacuucccaaauacuauugaugaggacgaccugggccuugugugaguccauaacguuagcgacaggaccccuaacgacacuuugggaagggucccccgguaaauuuuggaauacuaccauagcagucuccauggcaaauauuuucaggggaucauaucuagcuggagcgggucuagcguucucgcuuaugaagagucucggaggaggaaggagagggacaggagcucacggugagacacucggggaaaaauggaaaagacaauuaaaccaacuuaguaaaucagaauucaauaccuauaagaggucggggauaauggaaguugaucgauccgaagcaaaagaaggcuugaaaagaggugaaaccacuaaacacgcuguaaguagggggacggcaaagcucaggugguuuguggaacgaaaccugguaaaaccagagggaaaagugauagaucuugguuguggacgagguggauggucuuauuauugcgcuggucuaaaaaaagucacggaagugaaaggguauacuaaaggggguccaggacaugaagaaccaaucccaauggcuacuuacgguuggaacuuggugaaauuacacaguggcaaagaugucuuuuucaucccaccggaaaaaugcgauacgcuauuaugcgacauaggugagucuucaccgaauccaacgaucgaggaaggacgaacacuaaggguucuuaagaugguugagccgugguuacgaggcaaucaauuuugcauaaaaauacuaaaccccuauaugccaaguguaguugaaaccuuggaacaaaugcaaagaaaacauggaggcauguuaguccgaaauccuuuaucucgcaauucaacccacgagauguauugggucucaugcgggacaggaaauauugucagcgcugugaacaugaccagcagaauguuacugaauagguuuacgauggcacacagaaagccuacauacgagagagauguggacuuaggagcuggaacuagacauguggcaguggaaccagaagucgcaaaucuugauauuauaggacaacgcauagagaacauuaaacaugaacacaaguccacuuggcauuaugaugaagauaacccuuacaaaacaugggccuaccacggaucauaugaagugaaaccuucuggaucggcuucauccaugguuaacgguguaguuaaguuacuaacgaaaccgugggauguuauaccaaugguuacgcaaauagcaaugacugauacuaccccauucggccagcaaagaguauuuaaggaaaagguugacacuagaacgccuaaggcaaaaagaggaacagcgcagauaauggagguaacagcuaaguggcugugggguuuuuuaagccgaaacaaaaaaccgagaauuuguaccagggaggaguuuacucggaaaguuagaaguaaugcugcgauuggagcuguuuucgucgacgaaaaccaguggaauagugccaaagaagcgguugaagacgagagauuuugggaccuuguucauagagaacgcgaguugcauaagcaagguaaaugcgcgacgugcgucuacaauaugaugggaaaacgcgaaaaaaaacuaggagaauuugguaaagcaaaagguagcagagcaauaugguauauguggcuaggagcaagauuuuuagaguucgaggcgcuaggauuuaugaacgaagaucacugguuuuccagagaaaauagcuuauccggcguugagggagaaggauuacauaaacuuggguauauacuacgggauauuaguaaaauacccgggggaaacauguacgcagaugauaccgccggaugggacacgagaauaacagaggaugaccuucagaaugaagcgaagauaacugauauaauggaaccagaacacgcucuauuagcgaaaagcauuuucaaauugaccuaccaaaauaaggucguaagaguacaaagaccagcaaagaauggaacagugauggacgucauaaguagaagagaucaacgagguucuggccaaguuggaacguacggguuaaauacauucacaaacauggaggcacaauuaaucagacagauggaaucagaaggcauauuuucuccuucagaacucgaaacucccaaccucgcuggaagggugcuagacugguuggaaaagcaugggguagaacgauugaagcgaauggcaaucucgggagacgacugcgugguuaaacccauugacgacagauuugcgacagcauuaaccgcauugaaugacauggggaagguacguaaggacauuccucagugggaaccaucuaaaggauggaacgacuggcaacaaguaccauuuuguucacaucauuuucaucaacucauaaugaaagauggacgggaaauaguagugcccugccguaaucaagacgaauugguaggaagggcccgggucucacaaggggcaggauggucauuaagggaaacagccugcuuaggaaaaucauacgcgcaaauguggcaguuaauguauuuucauaggagagauuuacgauuagcugcaaacgccauuugcucagcuguuccgguagauuggguuccgacaucucguacgacuuggaguauacacgcccaucaucaauggaugaccacugaagacaugcucucgguauggaauaggguauggauagaggaaaacccauggauggaggauaaaacacauauaucgucguggggagaugucccuuauuuagguaaacgcgaagaccaaugguguggaaguuuaauaggccuuacugcgcgugcaacuugggccacuaauauacagguugcaaucaaucaaguaagaagacuuauaggaaaugaaaauuaucuggauuacaugacuucaaugaaaagguuuaaaaacgagagugacccagaaggugcuuuaugguaa

SEQ ID NO: 21738 - RNA, 9879 nt, Artificial Sequence
  derived and/or modified CDS sequence (opt6) from DENV-1__FJ898402__SS-prME
aguguaacuauguuauuaauguuaaugccaacagcucuugcauuucaucugacgaccagaggaggagaaccacacaugaucguaucgaaacaggaacgaggcaaaucacuucuauuuaaaaccucagcaggggucaacaugugcacgcuaauagcaauggaccuuggcgaauuuugugaagacaccaugacguacaaaugcccaagaaucacagaagcggaaccugaugauguagacuguugguguaaugcuacggacacguggguaacauacggcacuugcucccagacaggagaacauagaagggauaaacgauccguagcacuugcaccccauguaggccugggauuagaaacaagaacagaaaccuggaugucgucagaaggugcauggaaacaaauucaaaggguugaaacaugggcgcuacgccauccuggcuuuacaguaaucgcauuauuuuuagcucaugcaauuggaacaucaauuacacagaaaggaauaaucuuuauccuauugauguugguaacuccuagcauggcuaugagauguguggguauuggcucucgggauuucgucgaaggacuaucuggcgcaacauggguagacguaguuuuagaacacgguucauguguaacaaccauggcgaaagauaaacccacucucgauauugaauuacuaaaaaccgaaguuacgaauccagcuguuuuaaggaaacuguguauugaagcgaaaauaagcaacaccacaacugauucaagaugcccuacucagggagaagcuacucuaguggaagaacaagaugcaaauuuuguguguagacgaacguucguagaucggggaugggggaauggaugcggauuguucgguaaaggcucucucauaacaugcgcaaaauucaaaugcguaacaaaacuugaagguaaaauagugcaguaugaaaauuuaaaauacaguguuauaguaaccguacauacaggcgaccaacaucaagucggcaaugaaucuaccgaacaugguacgacagcuacuaucacaccgcaagcuccgucaacagaaauccaacugacagacuauggagcgcucacgcuagauugcagcccgcgaacaggacuagauuucaaugaaaugguucuucucacaaugaaagagaaaagcuggcucguacauaaacaaugguuucuugauuuaccccugccauggacguccggcgcaucgacuucacaggaaacauggaaucgaaaagaucuucuaguuaccuuuaaaacugcucaugccaagaaacaggaaguuguaguauuaggcucacaggaaggcgcgaugcauaccgcccuuaccggagccaccgagauccagacaaguggaacuacgacaauuuuugcaggccaccugaaaugcagauuaaaaauggacaaacuaacucuaaaaggaaugucuuacguaaugugcacagggaguuucaaguuggaaaaagagguagcugaaacucagcaugggaccguccuaguacaaaucaaauacgaaggaacggaugcuccuuguaaaaucccauucucuacucaggaugaaaaaggaguaacacaaaauggcagauuaauaacggcgaauccaaucguaacggauaaagaaaaacccguaaauauugaggcagaaccgccguucggagaauccuauauaguuauaggagcaggagaaaaagcucuaaaauugucgugguucaagaaaggcucauccauuggaaaaauguucgaggcaacggcaagaggugcaaggcgaauggcuaucuuaggggauacagcaugggacuuuggcucgauagggggugucuuuaccaguguugguaaacucguccaccaaauuuuuggcaccgcauaugguguacuuuucagcggcguaucauggacgaugaaaauugguauaggaguauuauugaccuggcuaggucuaaacucaaggucaacuucacuaaguaugacauguauagcaguagguuuaguaacauuauauuuaggaguaaugguacaagcggacaguggcugcguaaucaacuggaagggaagggaacuaaaauguggaagcgguauauuuguaaccaaugagguucacacauggacagaacaauauaaauuccaagcagauagcccaaagcgacuuucagcagcuauaggaaaggcuugggaagagggggugugcggaauccgaucagcuacaagacuagaaaacauuauguggaaacaaauuaguaacgaauuaaauuauauuuugcuggagaacgauaugaaauucaccguugucgucggagacguagccgggauccuugcgcaaggcaagaaaaugauaagaccacaaccuauggaauauaaauacucguggaagucauggggcaaagcaaaaauuaucggagccgacguucagaacaccacauuuauaauagaugggccuaauacaccugaauguccagaugaccaaagagcauggaacauuugggaagucgaagauuacgguuucgguauauuuacaacaaauauuugguuaaaauuaagagauuccuauacacaaguuugugaccaucggcuaaugucagcagcaauaaaagauaguaaagcuguacacgcggauauggguuacuggaucgaaucugaaaagaaugaaacauggaagcuagcuagagcaucauuuauagagguuaaaacuuguaucuggcccaagucucacacgcucuggucgaacggaguucuagaaagcgaaaugauuauaccaaaaauuuaugguggaccgauaagccaacauaacuaucgaccuggauauuuuacccagacagcaggucccuggcaccuaggaaaauuagagcucgacuucgaucuaugugaaggaacgacaguaguugucgacgagcauugcgguaaccgaggaccaucacuaagaacgaccacaguuacaggcaaaauaauacaugagugguguuguagaucuuguacacuaccgccuuuaagauucaagggugaagauggcuguugguacggaauggaaauucggccaguaaaagagaaagaagaaaauuuggugaaaagcaugguauccgcuggaucaggagaaguugacagcuucucccuaggcuuauuauguauaucaaucaugaucgaagaaguuaugagaagucguuggagccguaaaauguuaaugacuggaaccuuagcuguuuucuucuuacuuauuaugggacagcuuacuuggaacgaucuaauucgcuuaugcaucaugguaggagccaaugcuucagacagaaugggaaugggaaccacauaccuagcuuugauggcgacauuuaaaaugcgacccauguuugcagugggacuauuauuucggaggcugacuagccgagaaguacuucuuuuaacgauuggacuaucccucguugccagcguggaauuaccaaauuccuuggaagaacuuggggauggacuagcgaugggcauuaugauucuuaaguuguuaaccgauuuucagucucaucaauuaugggcuacacugcuaucauuaaccuuuauaaagacuacauucucauugcauuacgccuggaaaacgauggcaaugguacucucaauugucucacuauucccuuuauguuuaucuacgacuucccagaaaacgaccugguuaccgguuuuacuugguuccuuagguugcaagccucuuacaauguuucugauagcagaaaacaaaaucuggggccggaaaagcuggccgcuaaacgaagguaucauggccguaggaauaguaagcauauuacuuaguagccuacugaaaaaugacguuccacuagcuggucccuugauagcaggaggaaugcucauagcguguuacguaaucucaggaucaagugcugaucuuagccucgaaaaggcugcagaagucaguugggaagaagaagccgagcacaguggagcuagccauaacauuuuggucgaaguacaagacgacgguacuaugaaaauuaaagacgaagaacgggacgacaccuuaacaauacuacuaaaagcaacgcucuuagcgguaucaggcguauauccgcuuuccaucccagcaacguuauuuguaugguacuucuggcaaaagaagaaacaaagaaguggaguuuuaugggauaccccaucaccacccgagguggagcgagcaguucucgaugauggaauuuacagaauaaugcaaagaggccuacuuggaagaagucaaguagguguaggcguuuuccaagaaaacguuuuucauacuauguggcauguaacacggggcgcuguauuaauguaucaggguaagagacuagaaccuuccugggcgagcguuaagaaagauuuaaucagcuacggaggaggguggaggcuacaggguagcuggaacacgggagaggaagugcaaguaauugcuguagaaccuggcaagaauccuaaaaauguacaaacagcacccggaacuuucaaaacaagugaaggcgaggugggagcaauugcauuggauuucaaacccggaacuagcggcagcccaauaguuaauagggaaggcaaaauagucggacuauauggaaacggagucguuacuacaucagggacauaugugagugcgauugcacaggcaaaagcaucccaagaaggaccgcuaccagaaauagaggaugaaguauucagaaagcgaaaucuaacuaucauggaccugcauccaggaagcggaaaaaccagaagauauuugccagccauaguuagagaagcaauaaaacgaaaacuacgaacacucauauuagcaccaacaaggguuguagcaucugaaauggcugaagcgcuuaaagggaugccaauacgcuaucaaacgacggcaguuaaaucagagcauacagguaaggaaauuguggauuugaugugccacgcuaccuucacaaugcggcuucuaucuccaguacgcguacccaauuauaacaugaucauaauggaugaggcacauuuuacagauccuagcucaauagcugccaggggauacauaucaacucgagucggcaugggagaagccgcagccauauuuaugacggccaccccuccugggagcguagaagccuuuccccaaagcaaugccguaauacaggacgaagaacgggacauuccggaaagaucguggaacaguggauacgaauggauaaccgauuucccggguaaaaccguuugguuuguuccaucaauuaaauccggcaacgacauugccaauugucuuaggaaaaaugggaaaaggguaauccaauuaucccgcaaaacauucgacacggaauaccagaaaaccaagaauaaugauugggacuacguagugacuacugauauaucagaaaugggggccaacuuuagagcagaccgcguaaucgauccucgcagaugcuugaaaccagucauuuuaaaggacgggccagaaagaguaauccuagccggcccaaugccagugaccguagcaucggcggcgcaaagaagaggcagaauaggccggaaucacaauaaggagggugaucaauacauauacaugggacaacccuugaacaaugacgaggaucaugcacacuggacagaagcaaagaugcuauuagacaacauuaauacgccugagggcauuauaccagcguuguuugagccagagcgagaaaaaucugcugcaauugacggugaguaucgcuuaagaggcgaagcccguaaaacauuuguagaauuaaugagacgcggugacuuaccagucugguuaucauauaaaguugcgagugaaggcuuccaauauucggacagaagguggugcuuugacggcgaacgaaauaaucaaguuuuggaagaaaauauggauguagaaauuuggacaaaagagggugagagaaagaaauuaagaccuagauggcuagaugcacgaacauauagugacccauuggcguugagagaguucaaagaguucgccgcagguagaaggagcguaagcggugaucuuauuuuggaaauaggaaaacuuccccagcaccucacccagagagcacaaaacgcacuagauaaccuugugaugcuacacaacuccgagcagggugggcgagcguauaggcaugcuauggaagaacuccccgacacaauagaaacuuugauguuacuagcauuaauagcaguguuaacaggaggaguuacgcuauucuuucucaguggacgaggacucggaaaaacgagcauaggucugcucuguguaauggcaaguucaguacuccuauggacagcaucaguggagccacacuggauagcggcaucuauaauacucgaguuuuuccucaugguguuacugauaccagaaccagaucgacagaggacgccucaagauaaucagcuagcguaugucgucaucgguuuauuauuuaugauucugacaguagccgcgaaugagaugggcuugcuagaaacuacgaagaaagauuuaggaaucggucaugucgcaguggagaaucaucaccaugcagcuaugcuugauguggaucuucauccagcuagugcauggacuuuauacgcagucgcaacaacaauaauaacgccaaugaugagacacacgauagaaaauacaacugccaauauuucguuaacggcgauugcaaaucaagcagcuauauuaaugggucucgauaaaggcuggccuauaaguaaaauggauauuggggugccucuauuggccuugggauguuauucacaagugaauccacuuacucuaacggcagcuguacuaauguuaguagcacacuaugcaauaauuggcccaggcuuacaagcuaaagcaaccagagaggcacagaaacgaacugcagcuggcauaaugaaaaauccaaccgucgaugguauaguagcaaucgaucuagacccaguaguauacgaugcaaaauuugagaagcagcucggucagauuaugcuauuaauacuauguacaagucaaauccuauuaaugagaacuacaugggcauugugcgaaucaauuacccuugcuacugggccacugacaacguuaugggaggguagccccggcaaguuuuggaauacgacuauagcaguuuccauggcaaacauuuuuagagggaguuaccuagcaggggcaggccucgcauucucacuaaugaaaucacuagggggcgggagaaggggaacaggcgcccagggugagacauuaggagaaaaauggaaacgucaauuaaaccagcuaagcaaaagugaguucaauacauacaaaagaagcggcaucauggagguagauaggucagaagcuaaggagggguuaaaaaggggcgaaacuacaaaacaugcuguaucccgggguaccgcaaaguuaagaugguuuguagagcgaaauuugguaaaaccugaaggaaaaguaauagaucuaggcugcggcagagguggauggucuuauuauugugcugggcucaagaaaguaacagaggucaaaggauacaccaagggagguccgggucaugaagaaccaaucccuauggcaacuuacgguuggaauuuaguuaaacuacacucuggaaaagacguuuucuucauaccuccagaaaaaugcgauacuuuacuaugugauauuggugaaucgucccccaacccuacgauugaggaggguagaacauuacgaguuuuaaaaaugguagaaccguggcuaaggggcaaucaguucuguauaaaaauucucaauccuuauaugccaucaguaguugaaacacuggagcagaugcaacggaagcauggagggauguuaguaagaaauccgcucucacgcaauucuacgcaugagauguacugggugucaugugguaccgguaauaucguaagcgccgucaauaugaccagccgaaugcuccucaaccgcuuuacaauggcgcauagaaaaccaaccuaugagagagauguagacuuaggagcaggcacucgucacgucgcggucgaaccugagguggcgaaccuagacaucauugggcagagaaucgaaaacauaaaacacgaacauaaauccacuuggcacuacgacgaggacaauccauacaaaacgugggccuaccaugguagcuaugaaguaaaacccucugggagcgcaucuaguaugguaaauggggugguaaaacuacucacuaagcccugggauguuauuccuaugguuacacaaauagcaaugaccgacacuacaccauucggccagcaaaggguuuucaaagagaaaguagauacucgaacuccaaaggcgaaacgaggcaccgcgcaaauaauggagguuacugcaaaguggcucuggggauuccuguccaggaacaagaaaccaagaauuugcacacgagaagaguucacgagaaaaguacgaaguaacgccgcaauaggugcuguauuuguugacgagaaccaauggaauagcgccaaagaagccguugaggaugaaagguuuugggaucuaguucauagagaacgugaacuacacaaacagggaaaaugugcuacuugugucuauaauaugaugggaaaaagagagaagaaacugggugaguucgguaaagcuaagggcaguagggcgauaugguacauguggcugggagcacgguuuuuagaauuugaagcauuaggguuuaugaaugaggaucacugguuuucacgggagaacagucuaucaggaguugaaggcgaaggauuacacaagcugggauacauacugagagacauuaguaaaauaccaggugggaauauguacgcggacgauacugcgggaugggauacgaggauaacugaagaugaccuacagaacgaagcaaaaauaaccgacauuauggaaccugaacaugcuuuguuagcaaagucaaucuucaaauuaacuuaccaaaacaaaguaguaagagugcaacgaccagcuaaaaauggcacgguuauggauguuaucuccagaagagaucaaagaggaagcggacaaguuggcacuuacggacuaaauaccuucacuaauauggaagcgcaauuaauccggcaaauggagucagaagggauuuuuagucccucggaacuagaaacaccgaaucuagcagguagaguucuugauuggcucgaaaaacaugggguagaacgacuaaaacgcauggcuaucagcggcgaugacuguguaguuaaacccauugaugaccguuucgcaacugcguuaaccgcacuuaaugauauggggaaggucagaaaagauaucccgcagugggaaccuagcaaaggcuggaacgacuggcaacaagugcccuucuguucacaccauuuucaccaacuaaucaugaaagacggacgcgaaauuguugucccguguagaaaccaggacgaauuaguaggcagggcgagaguuucacaaggugcggguuggagucuucgugagacagcuugccucggcaagucauacgcgcagauguggcaacuaauguauuuucaucgccgagauuugagacuugcggcgaaugcuauuuguucagcagugccaguugacuggguaccgacuagccggacaaccuggucuauacaugcacaccaccaguggaugacuacggaggauauguugucaguauggaauagaguuuggauugaagaaaauccauggauggaagacaagacucacauuaguucauggggugauguuccguaucuagguaaacgggaagaccagugguguggaucauuaauaggcuuaacagcacgcgccaccugggccacaaacauccaagucgcuaucaaucaaguccgaaggcuaauaggaaacgaaaauuauuuagauuauaugacaucaaugaaaagauuuaaaaaugaaucagauccggaaggugcgcugugguaa

SEQ ID NO: 21739 - RNA, 9879 nt, Artificial Sequence
  derived and/or modified CDS sequence (opt6) from DENV-1__FJ898403__SS-prME
ucgguaacaauguuacugauguuaaugccaacagcacucgcguuccauuuaacaacucgagguggggaaccgcauaugauuguaucuaaacaggaacgagguaaauccuuguuauuuaaaacaagugcaggcguaaauauguguacauuaaucgcaauggauuuaggggaauuuugcgaagacacaaugacuuauaagugcccacguauuacagaagcggaaccugaugauguggacuguuggugcaaugcuacagacacguggguaacuuauggaacuugcucacaaacaggagaacacagacgugacaaaagaucgguugcguuagcuccacacguaggacugggacuugaaacacggaccgaaacguggaugucaagugaaggugccuggaagcaaauccaacguguugaaacuugggcguugcggcauccagguuucaccguuaucgcucucuuuuuagcccaugcgauugguaccucgauuacacaaaaaggaauuauuuuuauucuucucauguuggucacaccaucgauggcaaugagguguguaggaaucggaaguagagauuuuguagaaggccugucaggagcaacuuggguagaugugguuuuagaacaugggucguguguuaccacgauggcuaaagacaaaccaacauuagauauagaauuauugaaaacggaaguaacuaacccugcaguucugcguaaacuuuguauagaagcaaagauaucuaacacuaccacggacaguagaugcccaacgcaaggagaagcaacgcuaguagaagaacaagacgcaaauuuuguauguaggcgaacuuuuguugaucguggaugggguaacggcuguggauuguucggaaaagguagccuuaucacuugcgcgaaauuuaaaugugucacaaaguuagaaggaaagaucguccaguacgaaaauuugaaauacaguguaauaguuacaguucauacaggugaucaacaucaaguaggcaaugaaucaaccgagcacgguacuaccgcaacuauaacgccacaagcaccauccaccgaaauacagcuaacggacuacggagcauuaaccuuagauuguagcccgcgaacugggcuagacuucaacgaaaugguacuucuaacuaugaaagaaaaaucguggcuaguacacaaacaaugguucuuggaccuaccccuaccauggacuucgggagcguccaccucacaagagacauggaaucgcaaggaucuacuugugacauuuaaaacagcucaugccaagaaacaagaaguugugguacuugguucucaagagggagcuaugcacacagcguuaacuggugcgacugagauacaaacaagugguacuaccacaaucuucgcuggccacuugaaauguagacuaaagauggauaaacuuacgcuuaagggaaugaguuauguaauguguacaggaaguuucaaacuggagaaagaagucgcugagacacaacaugguacuguacugguucaaauaaaguacgagggaacugacgcuccuuguaagauaccuuucagcacacaagaugagaaaggaguaacacagaacggaagguugaucacugcaaauccaauuguaacggauaaagagaagccaguuaauaucgaagcagaaccaccuuucggagaaaguuacauaguaauaggagcuggugaaaaagccuugaaacuaagcugguucaagaaaggcucuagcauuggaaaaauguucgaagcaacagcaagaggugcacguaggauggcuauacuaggcgacacagcaugggauuuuggaucaauuggagguguguuuaccucgguagguaaacuggugcaucaaauuuucgguacugcguacgguguauuguuuucaggugugucauggacaaugaagauugggauaggcgucuuacuuaccugguuaggguugaacaguagauccacaucucuuucgaugacauguauagccguuggcuuaguuacccuauacuugggaguaaugguucaagcagauagcggauguguaauaaauuggaagggaagagaauugaaauguggcagcggaauauucgucacuaaugaaguccauacuuggacagaacaauacaaauuucaagcugauuccccaaaaagguugagugccgcuauagguaaggccugggaggaagguguauguggaauaagauccgccacacggcuagaaaacauaauguggaaacaaauuagcaacgaacuaaaccacauacuguuggaaaaugauaugaaauucacugucguagugggagauguagcggguauauuggcccaaggcaaaaagaugauuaggccccaaccaauggaauauaaguauagcuggaaaucauggggcaaagcuaagaucauuggcgccgauguucagaacacaaccuucaucauagacggaccuaauacaccggaauguccagaugaucaaagagcauggaacaucugggagguagaggauuaugguuuugguauauuuaccacaaauauaugguuaaaauuaagggacucauacacucaaguuugcgaccacagguugaugucagcagccaucaaagauaguaaggcuguucaugcugacaugggauauuggauagaaucagagaaaaaugagacauggaaacuagcuagggcaaguuucauagaaguaaaaaccugcauauggcccaaaucgcacacacucuggaguaauggcgucuuggaauccgagaugauuauaccgaaaauuuauggcgggccgauuucucaacacaauuacagaccgggauauuuuacucaaacagcuggcccauggcaucugggaaaguuagaacuagauuucgacuuaugugaaggcacaaccguagugguggaugagcacugugggaauagagggcccucacuucgaaccacuacgguaacugggaaaauuauacaugaaugguguugcagaagcuguacucuaccaccauuacgauucaaaggugaagacggauguugguacgguauggagauuagaccuguaaaagaaaaggaagaaaauuuaguuaaaucuaugguuucggcgggaagcggugaagucgauucuuucucacuaggacuauuaugcaucucaauaaugauagaagaagucaugcguagucgguggucaagaaagauguugaugacagguacauuggcuguauuuuucuugcugaucaugggucaauugacguggaacgaucugauacguuuauguauuaugguaggugcuaacgcaucagauaggaugggaauggguaccacuuaucuagcauuaauggcaacguucaaaaugcgaccgauguucgcaguaggccuccuuuucagaagacucacaucucgggaaguucuucuuuugacaauugguuuaagucucgucgccucuguagaacuuccaaacucccuagaagaauuaggugauggguuggccauggguaucaugauuuugaaauugcuaacggauuuucagagccaccaauugugggcgacuuuauugucauuaacuuuuauuaagaccacguuuagcuuacacuacgcuuggaaaacaauggcgaugguccuuucgauugugucgcuauucccacugugccugagcacgacaagucagaaaacaacauggcuaccgguccuauugggaucgcucgguuguaaaccacuaacgauguucuuaauagcagagaacaaaauauggggaagaaaaucauggcccuuaaaugaaggaaucauggcaguuggaauaguuaguauucuacuaaguagcuuacugaaaaacgauguuccauuggccgguccacuaaucgcaggaggcaugcuuauugcaugcuaugugauaucgggcagcucagcagaucuaucccucgagaaggcugcagaggugucuugggaggaagaagcugaacauucaggagccagccacaacauuuuaguugaaguacaagaugauggaacaaugaaaauuaaagacgaagagagagacgacacuuugacgauuuugcuaaaagcaacucuauuagcaguaagcgggguauauccucuauccaucccagcgacgcuguuugucugguauuuuuggcagaaaaagaaacaacgaagcggaguacuaugggacacaccaucgcccccagaaguagaacgugccguauuagacgauggcauuuauagaauaaugcagaggggccuguugggcaggucucaagugggugugggugucuuccaagaaaacguauuccauacaauguggcacguaacacgcggugcuguacuuauguaccagggaaaacgacuagaaccaaguugggccuccgugaaaaaggaccucauaucauauggaggaggauggagauuacaggguagcuggaauacaggagaagaaguacaagugauugcuguagagcccgguaagaaucccaaaaacguucaaacggcuccgggaacuuucaagaccagcgaaggggaaguuggagcaaucgcauuagauuucaaaccggguacaaguggcagcccuauaguaaacagagaaggaaaaauaguaggucucuaugguaaugguguaguuacgacgucagguacauacgucucugcaauagcacaagcgaaagccucucaagaaggaccccucccugaaauagaagaugaagucuuuaggaagcgaaauuuaacaauaauggaccuucacccgggcucgggaaaaacacggagauaucuuccagcaauaguaagagaggcgauaaaaagaaaacuucggacucuaauucuugccccuacaagagucgucgccucagagauggcugaagcucugaaaggcaugccuaucagguaccaaacuacggcgguaaaguccgaacacacggguaaagaaauuguugaccuaaugugucacgcuacuuuuaccaugagauuguugucuccgguacgcgugccuaacuauaacaugauaauaauggaugaagcucauuucacagauccuucaucaaucgcugcgagaggauacauauccacaagaguaggaaugggcgaagccgcugcgauauuuaugacggcaacacccccaggaaguguagaggcuuuuccucaaaguaacgcuguaauacaagaugaagaacgugauauccccgagagaaguuggaauaguggauaugaauggauuacggacuucccugguaaaacaguaugguuuguuccaucaauaaaaagcggaaacgacauugcaaacugucuaaggaaaaacgguaagagggucauccaauuaagucgaaagacauuugacacugaauaucagaaaaccaaaaauaacgacugggauuacguaguuacgacagacauaagcgaaaugggugcaaacuucagggcagauagagugaucgacccgagaaggugucuuaaaccuguaauacuaaaggaugguccagaaagagucauccuggcagggccaaugcccguaacaguugcaagugcagcccaacggagaggcaggauugguaggaaucauaauaaagaaggagaccaauauauuuauaugggucaaccguuaaauaaugacgaagaccacgcacauuggacggaggcgaaaauguugcuugauaacauaaauacaccugaaggaaucaucccagcucucuuugagccugagagggaaaaaucagcagcuauugauggagaauacagguugcggggagaagccaggaagacguucguagaguuaaugcgucgaggggauuuaccagucugguuauccuauaaaguagcaucagaaggcuuccaauacucagacagaagauggugcuucgacggggagaggaacaaucaagugcuggaagaaaauauggauguugagauauggacgaaagaaggagaacguaaaaagcugcguccgcgguggcucgaugccagaacuuauagcgauccauuagcuuuacgagaguucaaagaguucgcagcagggagacguucaguaaguggagauuuaaucuuagaaauaggcaagcuaccccaacaccuaacucaaagggcgcaaaaugcauuagacaacuugguuauguuacacaacagcgaacagggcggacgcgcauacagacaugccauggaagaacuaccagauacaauagaaacucuaauguuauuggcauuaauagcuguguuaacaggugguguaacuuuauucuuucuuucaggaagagguuuagguaaaacuagcauaggccugcucugcguuauggcaucaucaguacuguuauggauggcaucaguugaaccacacuggaucgcugcaagcaucauccuagaguucuucuuaaugguacuguugauaccagaaccagauaggcaacgaacuccacaagacaaucagcuugcauauguugucauagggcuacuguuuaugauucugacuguugcagcaaacgaaaugggauuacuugaaacuaccaagaaagacuuaggaauuggacacgucgcaguggaaaaucaucaucaugcggcaaugcuagauguugauuugcacccagcuucugcguggacauuguaugcaguagcgaccaccauaaucacaccuaugaugcgccauacaauagaaaacacgacagcaaauauaucgcuaacagcuaucgcuaaucaagcagcaauauugaugggucuagacaaaggauggccgaucagcaaaauggacauagggguaccacuccuugcgcuuggauguuauagccagguaaauccucugacguuaacugcagcaguccuaauguugguugcccauuaugcaaucaucggccccggacugcaggcaaaagccacacgcgaagcccaaaaacgaaccgccgcagguauuaugaagaauccuacuguggauggcauaguagccauagaccuagauccugucgucuacgaugccaaguuugagaagcaacuuggccaaauuauguuauuaauacuaugcacaagucaaauauuacugaugagaaccacaugggccuuaugugaaaguauaacauuagcgacggguccauuaaccacacuuugggaagguucgccugguaaauucuggaauacuacgaucgcaguaagcauggcaaauauuuuuagagguucguacuuagcgggagcgggauuagcuuuuucacuaaugaaaagccuaggaggaggacguagaggaacuggugcccagggggaaacuuugggcgaaaaguggaaacgucaacucaaucaacucuccaaaagcgaauuuaauaccuacaaacggaguggaauaauggaaguagaccgcagcgaagcaaaggagggauuaaaacgcggagaaacgacuaaacaugcaguaucaagggggacagccaaacuaaggugguuuguggaaaggaacuugguaaaaccugaaggcaagguaauagauuuagggugcggacgaggcgggugguccuauuacugcgcaggcuuaaagaaaguaacggaagugaaaggauacacgaaagguggaccaggacacgaagaaccgauuccaauggcgacuuacgguuggaaucucguuaaacuacacuccggcaaagacguauucuucauaccaccagagaaaugugauacauuacucugugauauuggggaaaguagcccgaacccaacgauagaggaagguagaacacuuagaguucuaaagauggucgaaccguggcuuaggggcaaccaauucuguauaaaaauccuaaacccauauaugccaagugucguagagacacuagagcagaugcaacgcaaacacggaggaaugcucgucagaaauccucuuaguagaaacucaacucaugagauguauugggucucaugcggaacagguaacauaguuucagccguaaauaugacuucgagaaugcuucuaaauagguucacaauggcucauagaaaaccaacuuacgagagagauguagaccuuggagcagguacuagacaugucgcagucgaaccagaaguggcuaaccuggauauuaucggucaacgcauagagaacauaaaacaugaacacaaaaguacauggcauuaugacgaggauaacccguauaaaacuugggccuaccacggaucguacgaaguuaaaccauccggcucagcaaguucuaugguaaacgguguagugaaacuccuaacaaagccgugggacguaauaccuaugguaacgcaaauagcaaugaccgauacuacccccuuuggccaacaaagaguuuuuaaagaaaaggucgacacaaggacgccaaaagcaaaacgaggcaccgcucaaauaauggaaguuacggcuaaaugguuauggggguuucuaaguaggaauaagaaacccagaauaugcacacgagaagaguucacgcggaaggugagaucgaaugcugcuauaggugccguauucguagaugagaaucaauggaacucagccaaagaggccguugaggaugaaagguuuugggaucucguacacagagaaagagaacuucauaagcagggaaaaugugcaaccugcguuuacaacaugaugggcaagcgagaaaagaaauuaggagaauuugguaaagcuaaaggaagucgugcuaucugguauauguggcugggugcccgcuuucuugaguucgaagcacuaggauucaugaacgaagaucauugguucucucgagaaaauucacuaucugguguugaaggugaggggcuccauaaauugggauauauauugcgcgacauaucaaaaauuccaggagggaauauguaugcggaugacacugcuggaugggauacucguaucacggaggaugaucuucaaaaugaggcgaaaaucacggauauuauggaaccagagcaugcucuuuuggcaaaaucuaucuucaaacuaacauaucaaaacaaaguuguacggguacagagaccagcgaaaaauggcacaguuauggacguuaucagcagacgugaucaacgggggagugggcaagugggcacauacggacuaaacaccuuuacaaauauggaagcacagcuuauuagacaaauggaaucagaaggaauauuuuccccuagcgaauuggagacucccaaucucgcagggagaguuuuagauugguuagaaaagcacggaguugagcgcuugaaacgcauggcaaucucgggggaugacugcgucguaaagcccauagacgacagguuugccacggcacugacagcucuuaacgauaugggaaaagugaggaaagaugugccucaaugggaaccaaguaaaggauggaaugauuggcaacaaguaccauucuguagccaucauuuccaucaacuuauaaugaaggauggucgugaaaucguaguuccgugccguaaccaagacgaguuagucggcagggcuagaguuagucaaggagcugguuggucacucagagaaacagcaugccuaggaaaauccuaugcucagauguggcaauuaauguauuuucacagaagagaucucaggcuggcugcaaacgcuauauguagcgcaguaccaguagauuggguaccuacaucucgaacaaccugguccauacacgcucaucaucaauggaugaccacagaagacaugcuuucaguuuggaauagaguguggaucgaagagaauccuuggauggaagauaaaacgcauauaaguucuuggggcgauguacccuauuuaggcaaacgggaagaucaauggugcggaaguuugauagggcuaacagcccgagcgacaugggccacgaauauacagguggcuaucaaucaaguaagaagacucauaggaaaugaaaauuaucuagacuacaugaccucuaugaaacguuucaaaaaugagucggauccugaaggagcuuugugguaa

SEQ ID NO: 21740 - RNA, 9879 nt, Artificial Sequence
  derived and/or modified CDS sequence (opt6) from DENV-1__FJ898404__SS-prME
ucggucacuauguugcuaaugcugaugccgaccgcucuagcguuucauuuaacuacuagaggaggggaaccucauaugauuguaacuaaacaagaaagagguaaaucccuuuuauucaaaacguccgcaggaguuaacauguguacucuaauugcaauggaucuaggggaauugugugaggauacuaugacauacaaauguccuagaaucacagaagcagagccggaugacgucgauuguugguguaaugcaacagauacuuggguuacuuaugguacgugcagucaaaccggcgaacauagacgagacaaacgaagcgucgcguuagcuccacauguagguuugggcuuggagacaagaacagaaacuuggaugucaagugaaggagcuuggaaacaaauccaacgugucgaaacaugggcucuuagacaucccgguuucacgguaauugcauuauuuuuagcacaugcaauugguacuucuaucacacaaaaagggauaauauuuauccuauuaauguuagucacaccaucuauggcuaugcgaugcgugggcauaggaagcagagauuucguagaaggcuuauccggagcaacuuggguagauguaguuuuagaacacgggagcuguguuacaacaauggcaaaagauaaaccuacccuugacauagaacucuugaaaacagaaguuacgaacccugcagucuuacgaaaacuauguauagaggcaaagauaagcaacacgaccacugauagccgaugccccacacaaggagaagcaacacuuauggaagaacaagacgcuaacuuugucugccgacggacauuuguggacagaggauggggaaauggaugugggcucuuuggaaaaggaucuuuaauaaccugcgcaaaauuuaagugugucacgaaguuagaaggcaaaauuguucaguacgaaaaccuaaaguacucagugauuguaacuguacauacaggggaucaacaucaagucgggaacgaaaguacagaacauggaaccacagcaacaauaacgccgcaagcaccuacaagcgagauacaauuaaccgacuacggagcacugacacuagacuguagcccccgaacuggcuuggauuucaaugagauggucuuacuuacaaugaaagagaaaucuugguuaguucacaaacaaugguuccuagaucucccauugcccuggaccucaggggcuucgacaagucaggaaacuuggaauagacaagaccuccuuguaacauucaagacagcgcacgcaaagaaacaagagguaguagucuuaggaagccaagaaggcgcuaugcacacggcauuaacuggggcuacugaaauacaaaccagcggaacuacaacaauauucgcaggacaccuuaagugccgauugaagauggauaaauuaacgcuuaaaggaaugagcuauguaaugugcacagguucuuuuaaauuggagaaggaggucgcugaaacacaacauggaacugugcuuguucagauaaaguacgaaggaaccgacgcaccuugcaaaauaccguuuaguacucaggacgaaaaaggaguaacccaaaauggucgacucaucacggcaaauccuauaguuaccgauaaagaaaaaccuguuaacauugaggcugaaccgccuuucggggagucuuauauagucauaggagccggugaaaaagccuuaaaacuuagcugguuuaagaaagggucuuccauaggaaagauguuugaagcaacggcuagaggugcucgaagaauggcaauauugggagacacugcaugggauuucgguucggugggagguguuuuuacuucgguaggaaagcuaguccaccaaauauucggcacagcguacggaguacuuuucucuggcguaucauggacgaugaaaauagguauaggaguacucuuaaccuggcucggucucaacagcagauccacgagucuaucgaugaccuguauagccguaggguuagucacuuuauaccuaggggugauggugcaagcagacuccggaugugucaucaacuggaagggcagagaauugaaguguggaagcgguauauucguuacgaacgaggugcacacuuggacggagcaauauaaguuucaggcugauaguccaaaaagacuaagugcggccaucgggaaagcgugggaagaaggcgugugcggaauuagaagcgccaccagauuagaaaauauaauguggaaacaaauaucaaacgaguuaaaucauauuuuauuagaaaaugacaugaaguucacaguuguugucggcgauguuguugguauccuugcucagggaaagaagaugauaagaccgcagccaauggaacauaaauauucguggaaaucauggggaaaagcaaaaauaauaggggcagauguacaaaacacuacauuuaucaucgacgguccgaacacaccagaauguccagacgaucaacgggcauggaauauaugggaaguugaggacuacggauucgguaucuuuacgaccaauauauggcucaaguuaagggauaguuauacccaaguaugcgaucacagguuaaugagcgcggccauaaaagauagcaaggcgguacaugcagauaugggauacuggaucgagucggagaaaaaugaaacauggaaauuggcuagagcaucauucauugaaguaaaaacuuguauauggccaaaaucucauacauuauggagcaacggaguauuagaaagcgaaaugauaauaccaaaaauuuaugguggaccuauaagucaacacaauuaucgaccaggauauuucacucaaacagcaggaccuuggcaccuagggaaauuggaacuagauuucgauuuaugugaagggacaacuguugucguugacgaacauugugggaaucgugggccaucucuacgaacgaccacagugacaggcaaaauaauacaugagugguguugucguagcuguacgcugccaccacuaagauucaagggugaagacgguuguugguauggaauggaaauucgaccaguaaaggaaaaagaagaaaaccuaguaaagucaaugguaagcgcugggaguggagaaguggauucauucagucuuggacuucuaugcaucucaauaaugauagaagaagucaugaggaguagauggaguagaaaaauguuaaugacugguacucuagccguauuccuacucuuaauuaugggccaauuaacuuggaaugacuuaauacgucuguguaucaugguaggggcaaacgcuucggaccguauggggaugggaacaacuuaccucgcgcucauggcaaccuuuaagaugaggccgauguuugcaguuggacuuuuguuuagaagacuuacuucaagggaagucuuacuauuaacaauaggccucucuuuagucgcaucggucgaacuuccaaacaguuuggaagaauugggugauggccuugcaaugggcauaaugauacuaaaauuauugacagacuuccagucucaccaauugugggcaaccuuacucaguuugacuuucauuaaaaccacguuaucucuacauuaugcguggaagacaauggccauggucuuaucuauagcuaguuuauucccccuaugcuuaucuaccacaucacagaaaacuacuuggcuucccguacuacuuggaucucugggauguaaaccccugacaauguuccuaauaacagaaacuaagauauggggacguaaaucuuggccucugaaugaaggaauaauggccguaggaguaguaucuauauuauuauccucauuacucaaaaacgaugucccccucgccgguccccuaauugcaggaggaaugcuaauagcaugcuauguaaucagugggucauccgccgaucucaguuuagaaaaagcagcugaagucaguugggaggaggaagcggaacacucuggcgccagccacaauauacuuguuguaguucaagaugauggaacaaugaagauaaaagaugaagaacgagaugacacucucacuauauugcuuaaagcgacgcuauuagccgugucaggcgucuauccucuaaguauuccagccacccuguuuguaugguauuuuuggcagaagaagaaacaacguagcgguguuuugugggacacgccuuccccaccggaaguugagagagcuguacuugaugauggcauuuauagaauaaugcagcguggcuuacuaggaaggagucaagucggcguaggugucuuucaagaaaaugucuuccauacuauguggcacguuacucgcggggcuguauuaauguaucaggguaaacgauuagagccuagcugggccagcguaaagaaagaccuuauaucauacggcgggggcuggagauuacaagguucauggaacaccggagaagagguucagguuauugcaguggaacccggcaaaaaucccaaaaauguucagacagcuccaggaacauuuaaaacuccagaaggugaaguaggagcaauagcccuagauuuuaaaccagguacgaguggaucacccaucguaaaucgugaagggaaaauuguuggcuuauacggcaacgguguaguuacgacaagugguacauauguaagugcuauagcacaggcgaaagcgucccaagagggaccguuaccugaaauagaagacgagguauuucgaaaaagaaauuuaacuaucauggaucugcaucccggaucagguaagacacgucgauaucugccugcgauaguuagagaggcaauuaagagaaaauuaagaacucuaauacucgcgcccacccgcgucgucgccagcgaaauggcagaggcccuuaaagguaugccaaucagauaccaaacuacggcuguaaaguccgaacacacggguaaagaaauaguagaccuuaugugucacgccacauucacgaugcgacugcucucgccaguaagaguucccaauuauaauaugauuauuauggaugaggcucacuucaccgauccgucuuccauagcagcaagaggguacaucucuaccagaguagguaugggggaagcggcugcgauuuuuaugacugcaacgcccccugggagcguugaggcuuuuccucaauccaacgcaguuauccaagacgaagaaagagauauacccgaaagaagcuggaacuccggauacgaauggauuacggauuuuccagguaaaaccguaugguuuguuccgucaaucaaaucaggaaaugauauagcaaauugucuucggaaaaaugguaaaagagugauacagcuuaguaggaaaacguucgauacugaauaccagaaaaccaaaaauaaugacugggauuacguaguaacaaccgauauaucggaaaugggcgccaauuuccgagcagaucgagucauugauccuagaaggugcuuaaaaccugucauucucaaggaugguccagagagaguuauacuagccgggccuaugccaguaacuguagcaagcgccgcacaaagaaggggaagaaucggaagaaaccauaacaaagagggagaccaauauaucuauaugggccaaccucuuaacaaugaugaagaucacgcacauuggacagaagccaaaauguuacuagauaacauuaauacacccgaaggaauaauuccugcucuguuugaaccagaaagggagaaauccgcugcaauugacggagaauaccggcuacgaggagaagcuaggaaaaccuuuguagaauuaaugagacgcggcgaucuacccguguggcuuuccuauaaaguugcgagcgaaggguuccaguauuccgacaggcggugguguuuugauggagaacgaaauaaucagguacuagaagaaaauauggauguggaaauauggacaaaagagggagaacgcaagaaacuacgaccacgauggcuagaugcacgaacuuacucugauccucuagccuuaagagaauuuaaggaauuugccgcagggcguaggaguguaucaggcgaccucaucuuagaaauagguaaauuaccgcaacauuuaacacaaagagcucaaaacgcacuugauaacuuaguaauguuacauaauagugaacaaggaggcagagcuuaucgucacgcaauggaggaauuaccagacacaauugaaacacuuauguuauuggcccuaauugcgguacucaccggaggaguuacauuauucuuucuaagcggaaggggucuuggaaaaacaucaauaggauugcucugugugauggcgucaaguguacuacuauggauggcaucuguugagccacauuggauagcagcaagcaucauuuuggaguucuuucuaaugguccuucuaauaccagaacccgaucggcaaaggacuccacaagauaaucaguuggcauauguuguaauuggacucuuauucaugauauuaacuguugccgcaaaugaaaugggccuacuggaaacaacuaagaaagaccuagggaucggucauguagccguugaaaaccaccaucacgcgacuauguuggauguggaucuccaccccgcguccgcguggacgcucuaugcaguagcuacuacaauaaucacgcccaugaugcgacacacaauagaaaacacaacagcuaacauuagccuuacugcgauagcaaaucaagcugcgauccuaauggguuuggauaaaggauggccaauaucaaagauggauauagguguaccucuguuggcauuaggcugcuauucccaaguuaauccucugacauuaacugcugcaguucuaauguuaguagcccauuaugcaauaauagggcccggguugcaagcuaaagcaacgcgcgaagcacaaaagagaacggcugcaggcauaaugaaaaauccuacaguugacggcauugucgcaaucgauuuagauccaguugucuaugacgcaaaauuugaaaaacaacucggacaaauaaugcuacuaauacuauguacgagucagauucuucuuaugcguacgaccugggcauuaugcgaaucaauaaccuuagcuacugggccacuaacgacuuugugggaggguucaccuggaaaguucuggaauacgacgaucgcaguuucaauggccaauauauucagagguuccuaccuagcaggagcgggacuagcguucagucuaaugaaaucuuuagguggaggaagacgcgguacaggugcacagggugaaacacucggcgaaaaauggaaacgacaacuaaaccaauugagcaaaagugaguucaauauauauaaacgcuccggaaucauggaaguugaucguagugaagccaaggaaggccuuaaacgaggggaaacuacaagacacgcgguuagucgaggaacagcuaagcuccgcugguuuguugaaagaaaucuagucaaaccagaaggaaaaguaaucgaccucggaugcgggagaggaggguggucauauuauugcgcgggguugaagaaagugacggaaguaaaagguuauaccaaaggugggccuggucaugaggaaccuauaccaauggcgaccuacggauggaaucucgucaagcuccacucggggaaggacgucuucuuuacaccacccgaaaaaugcgauacacuuuuaugcgacauaggcgaaucguccccaaacccaaccauagaagaaggcagaacauuaagaguauuaaagaugguagaaccaugguugagaggaaaucaguuuugcauuaagaucuuaaacccguacaugccuucaguaguagaaacacuagaacaaaugcaaagaaaacauggaggaauguugguaaggaacccgcucucacgcaauucaacacaugaaauguauuggguaaguuguggcacggguaacauugugagugccguuaauaugacaaguagaauguuauuaaauagauuuacaauggcucaucgaaaaccaacauacgaacgugacguugauuugggugcagguacaaggcacguggccguugagccugaggucgcuaaccuagacauuaucggucaaaggauagaaaauauuaaacaugaacauaagaguaccuggcacuacgacgaagauaauccguauaaaaccugggcuuaccaugguucauaugaaguaaaacccagcgggagcgcaaguaguaugguaaacggaguagucaaacugcuaacaaaaccuugggaugucauucccauggugacgcaaauugccaugacggacacaaccccuuucggccaacagagaguuuuuaaggaaaaaguagauacacggacgccgaaagcaaagagaggaacggcacaaauuauggaggugacggcccgaugguuauggggcuuuuuaucccgaaacaagaaacccaggauauguacucgagaagaguucacaagaaagguaaggucaaacgcugcuauaggagcaguauuuguugaugaaaaccaauggaacagugcaaaagaagcagucgaagacgaaagauuuugggauuuaguccaaaaagaacgggaauugcauaagcaagggaaaugcgcaacauguguuuauaacaugaugggcaaacgagagaagaaacugggggaauuuggaaaggcgaaaggaucuagagcgauaugguauauguggcuaggggcgagauuucucgaguuugaggcauuaggauucaugaacgaagaccacugguuuagccgugaaaauagcuuaucuggaguagaaggugagggucuccauaaauuaggauacauucuacgcgacauuucaaaaauuccaggaggaaauauguaugccgaugacacugcggggugggauacaagaauaacugaagacgacuuacaaaaugaagcaaaaauuaccgauauuauggagcccgaacacgcacugcuugcaacaaguauauuuaaacuaacuuaucaaaauaaggugguucgaguucaaaggccagccaaaaaugguacaguuauggaugugauaagcagacgggaccaaagaggaaguggccagguuggcacauaugguuuaaauacguuuacaaauauggaagcacaauuaauaagacaaauggaaucggaaggaauauuuuugccaucagagcuugaaaccccgaaccuagcagaaagaguuuuagacuggcuugaaaaauauggcguggaaaggcuaaaacgaauggcaaucaguggugacgauugcguuguuaaaccaauagacgauagauucgcuacagcucuuacagcacuaaaugacaugggaaaaguccguaaggauaucccacaaugggaaccaaguaaaggguggaaugacuggcaacaaguccccuuuugcagccaucauuuucaccaauuaauaaugaaagaugguagagagaucguaguccccugcagaaaucaagacgagcuagucggucgagcaagggugucccaaggugccggcuggagucucagagaaacagccuguuuaggaaagucguaugcucaaauguggcaauuaauguacuuucauaggagagauuuacgcuuagcagcaaacgcaauuuguagugccguuccuguagauuggguucccacaaguagaacuacauggucgauucacgcccaccaccaauggaugacuacugaagacauguuaaguguuuggaacagaguauggauagaggagaaucccuggauggaagacaagacccauguuucaaguuggggugacguaccuuaucuagguaaacgagaagaucaauggugcggcagcuuaauaggcuuaaccgcccgggcaacgugggccaguaauauucaaguggcuaucaaccaaguaaggaggcuaauagguaaugaaaauuaucuagauuauaugacaaguaugaaaagguuuaaaaacgaaggagauccugaaggagcuuuaugguga

SEQ ID NO: 21741 - RNA, 9879 nt, Artificial Sequence
  derived and/or modified CDS sequence (opt6) from DENV-1__GQ199840__SS-prME
ucaguuacgaugcugcuaauguuaaugccgacagccuuggcauuucauuuaaccacuagagggggugaaccacauaugauaguuucuaaacaagaaaggggaaagagcuuauuauucaaaacaucagcaggaguaaauaugugcacucucaucgcuauggaccugggggaauuuugugaagauacgaugacauauaaauguccgcggauaacagaggcggaaccugacgacguagauuguugguguaaugccacagauacuugggucaccuacggaacaugcagccaaacuggugaacacagacgcgauaaacguuccgucgcauuggcuccacacgucggacuaggauuagaaaccagaacagagacauggaugaguagcgaaggggcuuggaaacaaauccaaagaguugaaacaugggcauugcggcacccagguuuuacuguaauagcuuuauucuuagcucaugcgauuggaacgaguauaacucaaaaaggaauuaucuuuauacuacugauguugguaacaccgucuauggcaaugagaugcgucggcauagguucuagagauuucguagagggacucuccggagcgaccuggguagauguaguccuagaacacgguucaugugugaccacgauggcaaaagacaaaccaacuuuagauaucgagcuccucaaaacggagguaacgaauccugcgguacuaagaaaacuaugcaucgaagcgaaaaucucaaauacuacuacugauuccaggugucccacacaaggagaagcaacuuugguggaagaacaagaugcuaacuuugucuguagacgaaccuuuguagaccguggguggggcaauggauguggacuauuugggaaaggaucacucauuaccugugcgaaauucaaauguguaacaaaauuggaagguaaaauaguucaauaugaaaauuuaaaauacaguguaauugugacuguacacacuggggaucagcaccaaguaggaaacgaauccacugagcauggaacaacggcuaccauuacgccacaagccccauccacagaaauacaguugacagacuauggcgcauuaacuuuagacuguucaccgagaacuggccuagacuuuaaugaaauggucuuacuaacuaugaaagaaaaaucaugguuaguccacaaacaaugguuucuggaccuaccauuaccauggacuucuggggcgagcacuucucaagaaaccuggaaucgacaagaccucuuaguuaccuuuaaaacagcgcaugcaaagaaacaagaaguuguagugcuaggaucacaagagggcgcaaugcauacagcacuaaccggggcaacagaaauucaaacgucggggaccacaacaaucuuugcugggcaccuuaaaugucgauuaaaaauggacaaauuaacauuaaaagggaugucauauguuauguguacugguuccuuuaaauuggagaaagaaguagcggagacccaacaugguacagugcuaguccaaauuaaauacgaagggaccgacgcuccaugcaaaauaccuuuuaguacucaagaugaaaaaggaguaacucaaaauggucgacuaaucaccgcgaauccgauuguuacagauaaggaaaagccuguaaacauagaagcugaaccaccguuuggagagucuuacauaguaauuggugccggagaaaaggcuuuaaaacuaaguugguucaaaaagggaucaaguauuggaaaaauguuugaagcuacagcccgcggagcacgccgaauggccauucugggggauaccgcuugggauuuuggauccauaggagguguauucacuucggucggaaaacucguacaucaaauauuugggacugcauaugggguuuuauucucaggggucucuuggacuaugaaaauaggaauagguguucuacuuacguggcuggggcuaaacaguaggaguacgucacuaagcaugacauguauagcaguaggcuuaguuacccucuauuuaggaguuaugguacaggccgacucugguuguguaauaaauuggaaagggcgcgaauuaaaaugcggaaguggcauauuuguaacaaacgaaguccauacauggacagagcaauacaaauuccaggcggacagcccaaaacguuuaucggcggcaaucggaaaagcaugggaggagggaguuuguggaauaagauccgcgacgagacuagaaaacauuauguggaagcaaauuucaaaugagcugaaucacauauuauuagagaaugauaugaaauuuacaguugucgucggcgauguagcaggaauauuagcucaaggcaagaaaaugaucagaccccagcccauggaguauaaauacaguuggaaaucguggggcaaagcgaaaauaaucggagcagacgugcaaaauacaacuuuuauaauagauggucccaauacaccugaauguccugaugaucaacgugcguggaauauaugggaaguggaagauuaugguuuugggauauuuacaacaaauauaugguuaaaacuucgagacaguuauacccagguuugugaucauaggcucaugucugcagcgauaaaagacaguaaagccguucacgcugacaugggauacuggaucgaaucagagaagaaugaaaccuggaaauuagcacgagcuagcuuuauugaaguuaaaacuugcaucuggccaaaaagucauacacuuuggaguaauggagugcuggagagcgaaaugauuauaccaaaaaucuacggaggcccaauuucccaacacaauuacagaccaggauauuuuacucaaacggcagggccauggcacuuagggaaauuagaauuggauuucgaucuuugugaaggaaccacuguuguaguugacgagcauuguggaaauagagguccuagccuaagaacaacaaccgucacagguaaaauuauccaugaauggugcugucguucgugcacucuaccaccguuacgcuucaaaggugaagacgguuguugguacggaauggaaaucaggccaguaaaagagaaagaagaaaaucucguuaagucuauggugucagcuggaaguggagagguugauagcuuuucccuuggauuauuguguauuucuauuaugaucgaagaaguaaugcguagcagauggucaagaaaaauguugaugacagguacucuagcugucuuuuuccuacuaauuaccggacaacucacauggaaugaucuuauccgauuaugcauaaugguuggagcaaacgcuucugauagaaugggaaugggaacaacguauuuagcacuaauggcaacguuuaaaaugcgcccaauguucgcggugggacucuuauucaggagguugacuucuagagagguacuuuuauugacaauuggguuaagucuuguggcuucuguggaauuaccuaauagccuagaagaacuaggugauggccuagccauggguaucaugauuuuaaaacuccuaaccgauuuccaaucacaccaacucugggcaacacuucucucuuuaaccuuuauaaaaaccacauuuucuuuacacuaugcauggaagacaauggccaugguauuauccauuguaucauuauuuccacuuuguuuaucaaccacaagucagaaaacuaccuggcuaccugugcuauuaggaucgcuaggauguaaaccauuaacuauguuucuuaucgcugaaaauaaaauuuggggcagaaaauccuggccccuuaaugaagguaucauggcuguuggaauaguaucaauacuauuaucaucauuauugaaaaaugacguccccuuagcaggaccccuuauugcgggugggauguuaauugcauguuauguuauuucaggaagcucagcugauuuaucucuagaaaaagccgcagaaguaucaugggaagaagaggcagaacauaguggugccagucauaacauuuugguggaaguacaggacgauggaacaaugaaaauaaaggaugaggaacgggaugauacauuaaccauacuacuuaaagccacuuuacucgcaguuucuggggucuacccacuuucgauuccagcgacgcuauucguaugguacuuuuggcaaaagaagaaacaaagaucugggguauuaugggacauucccucacccccugagguagaaagagccguacuggacgaugggauauaucggauaaugcaaagaggguuacuuggaaggagucaaguggggguuggcguuuuccaagaaaacguuuuccacacaauguggcaugugacccguggggccguguuaauguaucagggaaaacgacuugagccaucaugggccuccguaaagaaagacuuaauuucauauggaggcggcuggcgacuacaaggaaguuggaauacgggcgaagaaguucaaguuaucgcagucgaaccaggcaaaaauccgaaaaauguucagacggcacccgggacuuuuaaaaccagcgaaggugagguaggggcuauagcgcucgauuuuaaaccuggaacaagcgguucccccauuguaaacagggagggaaaaaucgugggacucuaugguaacggugucgugacaacaucgggcacauaugucucagcuaucgcucaagcaaaggcuucgcaagaggguccacuucccgaaauagaagaugagguauuucggaaacgaaaccuaacaaucauggaccuucauccagguaguggaaaaacaagaagauauuuaccggcuauaguaagagaagccauaaaacgaaaacuucggacauuaauccuugcaccgacucggguggucgcaucugaaauggcugaagcacuaaaagggaugccaauucguuaucagaccacugccguuaaaagugaacacaccggcaaagaaauagucgacuuaaugugucaugccacuuuuacuaugcgacuuuuaucgcccgucagagugccaaauuauaauaugauaaucauggaugaggcucauuucacugauccuaguaguauugcugcacguggguauauaucaacgcguguuggaaugggcgaagcagcagcaauuuuuaugacagcuacacccccaggaucagucgaggcuuucccacaaagcaaugcagucauacaagacgaggaacgcgacauuccggaacgaagcuggaacucggguuacgaguggauuacggacuucccuggcaaaacuguaugguucgucccaucgauaaaaucgggcaacgauauagcaaacugucucaggaaaaauggcaaaaggguaauacaauuaucgcguaaaacauuugauacagaauaccagaaaaccaagaacaaugauugggauuauguaguuacuacagacauaucugagaugggagcuaauuucagagcggaucguguaauagacccuaggcgaugucuuaaacccguaauacuaaaggaugggccagaaaggguaauauuagcuggucccaugccugucaccgucgcgucagcagcgcaaagaagaggacgcauagggcgaaaucauaacaaagaaggcgaucaauacauuuauaugggucaaccguugaauaacgacgaagaccacgcgcacuggaccgaagcuaaaaugcuccuugacaacaucaacacgcccgaaggaauuaucccggcccuguucgaaccugaacgugaaaagucggcagcgauugacggagaguacagauuacgcggagaagcucggaagacauucguagaacuaaugaggaggggugauuuaccuguauggcuuucuuacaaagucgcaucagaggguuuccaauauuccgacagaagauggugcuucgacggugagcggaacaaccagguauuagaagagaacauggaugucgaaauuuggacaaaggaaggugagaggaagaaauuaaggccuagguggcucgaugcacgaacauauucagauccauuagcacuaagggaauuuaaggaauuugcagcagggaggagauccguaaguggagaucucauucuagaaauaggaaaauuaccccaacacuugacacaacgagcucagaacgccuuagauaaucuaguuaugcuccacaauucagagcaaggaggucgagcuuacaggcaugcaauggaagaacuccccgauacuauagaaacuuuaauguuauuagcgcuuauagccgucuugacaggaggagucacccucuuuuucuugucuggacguggauuaggcaagaccucaaucggcuuacuaugugugauggcaagcaguguauuauuauggauggcauccgucgaaccacauuggauagcugcuagcauaauuuuggaguucuuucugauggugcuacuaauuccagagcccgaccgucaaagaacgccgcaggauaaccaauuagcuuacguagugauaggacuuuuauuuaugauuuugacuguagcggcgaaugagauggggcuauuagagaccaccaaaaaggaccuaggaaucggacauguugcagcagaaaaucaucaucacgcugccaugcuugauguugaucuacaccccgcguccgcuuggacacuauacgcuguagcgaccacaauaauuacuccuaugaugcgacacacaauugaaaacacaacagcuaauauaucacuaacagcuauagccaaucaagcagcgauccuaauggggcuagauaagggauggccaaucucgaaaauggauaucgggguuccacucuuagcucuugguuguuacucacaggugaauccauuaacauugacugcagcgguacuaaugcuaguagcucauuacgcuaucauaggaccaggacuucaggccaaagcaacaagagaagcacaaaagcgaacugccgccgguauuaugaagaauccuacuguagauggaaucguugcaaucgaccuagauccuguugucuaugaugcaaaauucgagaaacaacucggccaaauuauguuacuaauacucugcacgucucaaauauuguuaaugcgaacgacgugggcacugugcgaaucaauuacccuugcaacggggccacuaacuacucugugggaagguucaccaggaaaguuuuggaacacaacgauagcggucaguauggcuaacauauuuaggggaagcuacuuagcaggggcaggccuagcauuuucgcucaugaaaucgcuagguggaggacguagaggaacuggggcacaaggggagacacucggugaaaaauggaaaaggcagcuaaaccaacucucaaagagcgaauuuaacacuuauaagcggaguggaauaauggaagucgaucggagugaagcaaaggaaggucucaaaaggggagagacaacaaaacaugccguuaguagaggcacagcgaaauuacgcugguucguugaacgcaauuuaguaaagccagaggggaagguuaucgaccuugggugcggucgcggagguuggaguuauuauugugccggucucaagaaaguaacagagguuaaaggauacacuaaaggagggcccggacaugaagaaccgauaccuauggcaacauacggauggaauuuaguaaaauuacacucaggaaaagauguauuuuucaucccucccgaaaaaugugauacauuauugugugauauaggugaaagcagccccaauccuacaauagaggaaggacguacauuacgcgugcugaagaugguagaaccaugguuacgcggcaaucaauucuguauuaagauuuugaacccuuacaugccgucagugguggagacacuagaacaaaugcaacgaaaacacggaggcauguuagugagaaauccgcucucucguaacucuacacacgagauguacugggucucauguggaacugguaacauugugucugcggucaauaugaccucaagaaugcuucugaauagauucacgauggcacaccgaaaaccaacguacgaaagagauguggauuuaggugcuggcacucgccaugucgccguggagcccgaagucgcgaauuuagacauaaucggccaacgcauagaaaauauuaaacacgaacauaaaucuacuuggcacuacgaugaagauaaucccuacaagacaugggcguaucauggaucauaugagguaaagccgaguggcagcgcaagcucuauggucaacggaguggucaaauuacugaccaaaccuugggauguaaucccaauggugacccagauugcaaugacugauacaacaccauucggccaacaaaggguauuuaaagaaaaaguagauacgcguacuccuaaagcgaaacggggcacagcacagauuauggaggugaccgcuaagugguuauggggauuuuuaaguagaaacaagaaaccaagaauauguacaagagaagaauuuacuagaaaaguaaggucaaacgccgcuaucggugcuguauuuguagaugaaaaucaauggaauagugccaaggaagcaguggaagaugagagauuuugggacuugguucaccgagaaagggaacuacacaagcaaggcaagugcgcaacguguguauacaacaugaugggcaaacgagagaagaaacugggggaguucgguaaggcgaaaggaagcagggcuauaugguauaugugguuaggagcccgauuuuuggaguucgaggcuuuaggguucaugaaugaagaucauugguuuagucgcgaaaacucauuaagcggaguagaaggagaaggccuccauaagcuaggauacauacuaagagauauaagcaaaauuccugguggaaauauguacgcagaugacacggccggaugggacaccaggauaacagaggaugacuuacagaacgaagcaaaaauaacagauauuauggagccggaacaugcuuuauuagcaaagucgauuuuuaaacuaaccuaccaaaauaagguagugcgaguccaaagaccagccaagaaugguacgguuauggaugugauaagcagacgugaucaaagaggcucaggacaagucgggacauauggauuaaacacuuucacuaacauggaggcacaauuaauuagacaaauggaaagugagggaauauucagcccaagcgaguuggaaacaccgaaucuagcagggcggguuuuagacugguuagaaaaauacgggguugagagauugaagaggauggcaauaaguggagacgauugcguagugaaaccaauagaugaccgcuucgcgacggcgcuuacagcacuaaaugauaugggcaaggugcgaaaagauauuccacaaugggaaccaucgaaaggguggaaugauuggcaacaaguucccuuuuguucacaucauuuccaccaacuaaucaugaaagacggaagagaaaucguaguaccuugcaggaaucaagacgagcuaguaggaagggcgagagucagccaaggagcaggauggucacuuagagaaacugcaugucuaggaaaaucauacgcacaaauguggcaauuaauguauuuucacagaagggaucuacguuuagcugcaaaugcaauauguagcgcaguccccguugauuggguaccuacaucacgaacaacaugguccauucacgcgcaucaucaauggaugacuacugaagauaugcuaucuguauggaaucgcguuuggauagaagagaacccuuggauggaagauaaaacacauaucucaucauggggagauguaccauauuuaggcaaacgggaagaccaaugguguggaucguuaauaggacuaacagcacgugcaacuugggcaacgaauauccaaguugcuauaaaccaaguaaggagacugauaggcaaugaaaauuaucuagauuauaugacgagcaugaagagguucaagaacgagucggauccugaaggggcacuaugguga

SEQ ID NO: 21742 - RNA, 9879 nt, Artificial Sequence
  derived and/or modified CDS sequence (opt6) from DENV-1__FJ898405__SS-prME
ucugugaccaugcuguugaugcucaugccaacugcgcuggcuuuccaucucacuacccgaggaggggaaccccauaugauaguuacgaaacaagaaagagggaaauccuuacuauuuaagacaagugcagggguuaauauguguaccuuaauagcaauggacuugggcgaacuaugugaagacacuaugacuuacaaauguccucggauaacugaagcagaaccugaugacguagacuguugguguaaugcuacugauacaugggugaccuacggaacauguagccaaacaggagaacaucgaagagauaaaagaaguguagcauuagccccgcauguaggccuuggacuugaaacgagaacagaaaccuggaugaguucagaaggagccuggaaacaaauacaacgcguagagacaugggcuuuaaggcauccgggauuuaccguaauagccuuauuucucgcacacgcaauagggacaucaauaacccaaaaaggaauuauauuuauacuacuuauguugguaacuccuuccauggcuaugagaugcguaggaaucggaucaagagauuuuguagaagggcuuuccggugcaacaugggucgacguagucuuggaacacggaagcugugugacaaccauggcaaaagauaaaccaacccuagacauagaguuguuaaaaacagaaguaacaaauccggcuguuuuacguaagcuaugcauugaagcgaaaaucaguaauacgaccacggauagcagauguccuacucaaggugaagcgacacuuauggaagaacaagaugcuaauuuugugugucgccggacguucguggacaggggguggggaaauggaugcggauuauuuggcaaggguucacuaauaacuugugcaaaauucaaauguguaacuaaacuugaaggaaagaucguucaauacgaaaaucuuaaguauucugucauagucaccguacacacgggcgaccaacaucaggucgguaacgaaaguacagaacaugguaccacggcaacgauuacuccucaggcaccgacauccgaaauccaauuaacagauuacggcgcauugacauuggacugcucacccaggacaggucuagauuucaacgagauggucuuauugaccaugaaagaaaaauccugguugguucauaaacaaugguucuuagauuuaccucuacccuggacaaguggggcuuccacaucucaggaaaccuggaacagacaggaucuauuaguaacuuuuaaaacagcccaugcuaagaaacaagaagucguuguacuaggaucacaagaaggcgccaugcauaccgcuuugacaggcgcaacagaaauucagacaucagggacaacaacgaucuuugccggucaccucaaaugccggcuuaaaauggauaaacuaacgcuaaaaggaauguccuauguuauguguacaggcuccuuuaaacuggaaaaagaaguggcggaaacccagcauggaacugucuuaguacagauuaaguacgaaggaaccgacgcuccuuguaaaaucccauuuucaacacaagaugaaaagggcgugacacaaaacggcagacuaaucacugcgaauccuauuguuacugacaaagaaaaacccguaaauauagaagcugaaccgcccuuuggagagucguauaucgugauaggagcaggagaaaaggcucuuaaauuaaguugguuuaagaaaggaaguaacauaggaaaaauguucgaagcuacggcaaggggugcaagaaggauggcaauauuaggggacaccgcuugggacuuuggaucaauaggaggcgucuucacaaguguaggaaaguugguucaucaaauauucgggacagcauauggcguccuauuuuccggagucucuuggacgaugaaaaucggaauaggcguucuauuaacuuggcucggacuaaauucaagaucuacgaguuuauccaugaccuguauugcgguaggccuaguaacccuguauuuaggagucaugguucaagcagauagcggguguguaauuaauuggaaaggacgagaacuaaaaugugguucggggaucuuugugacaaaugaagugcauacauggacagaacaauacaaauuucaagccgacucaccuaaaagacuuucagccgcuaucgguaaagcaugggaagaaggugugugcggcauaagaagugcuacgcgucuugaaaacauuauguggaagcagaucagcaaugaacuaaaucauauacuuuuagaaaaugauaugaaauucacuguagugguaggagauguaguggguauucuugcacaagggaaaaagaugauaagaccgcagcccauggaacauaaguauaguuggaaaaguuggggcaaagcaaaaauaauaggggcugacguacaaaauacaacuuucauaaucgacggaccaaauacaccagaauguccagacgaucaacgagcuuggaacauaugggaaguagaagauuacggauuugggaucuuuacuaccaacauauggcuaaaacuacgggacucauauacucaaguaugcgaucauagauuaaugagcgcagcaauuaaagacucuaaagcgguacacgccgacaugggauacuggauagaaagugagaaaaaugagacuuggaaauuagcacgagccagcuuuauagaaguuaaaacuuguauuuggccaaaaagucacacacuauggagcaacggaguauuggaaucugaaaugauaauaccgaagauauaugggggacccauaucgcaacacaauuauaggccggguuauuucacccaaacagcaggaccauggcacuuaggaaaguuggaauuggauuuugauuuaugcgaaggaaccaccgucguaguagacgaacauugcgggaacagaggcccgucucucagaacuaccacaguaacuggaaaaauaauccaugaaugguguugucguaguuguacucucccuccuuuaagauucaaaggagaagaugguuguugguauggaauggaaauuagaccugugaaagaaaaagaagaaaaccugguaaagucaaugguaucugcagguucaggagaggucgauuccuuuucauugggcuuacuaugcauaaguaucaugauugaagaggugaugcguucaagaugguccagaaaaaugcucaugacgggaacgcuugccgucuuccucuuauuaaucaugggacaauuaacuuggaacgaucuuauuaggcucuguauuaugguaggggcuaaugcaucugauagaaugggaauggguacgacauauuuggcguuaauggcuacauuuaaaaugcgaccgauguuugcagugggucuguuguuuagaagacucacgagccgugaaguuuuguuauuaacuauuggauugucauuaguugccucagucgagcuacccaauucauuagaagaauuaggggauggacucgcaaugggcauaaugauacucaaauuauuaacagauuuccagucacaccagcuaugggcaacacuccuaucacuaaccuucauuaaaaccacgcuaagucuacacuacgcauggaaaacuauggcaaugguucuaagcaucguaagccucuuucccuuaugucuuucaacgacaagccagaaaacgacaugguuaccuguauuauuaggaucgcuaggcugcaaaccacuuacuauguuccuaauagcagaaaauaaaauuuggggucgaaaaaguuggccccuaaaugaagggauaauggcuguggguguuguaagcaucuuacugucgagcuuacugaaaaaugaugucccacuagcaggcccucuaauagcugguggaaugcuuaucgcaugcuauguaauaagcggaucaagcgccgaucuaucuuuagaaaaagcugcugagguauccugggaagaagaagcagaacauucaggugcgagucauaacauauuaguggaaguccaggacgaugguacuaugaaaauaaaagaugaagaacgagaugacacgcuuacaauacuucugaaagcaacacucuuagcugucucagggguauacccuuuaaguaucccugcuacauuauucgugugguauuuuuggcaaaagaagaaacaacgguccggagugcuaugggacacaccuagcccaccugaaguagaaagagccguauuagaugacggcauuuaccgcauaaugcaacguggguuacuaggaagaagucaagugggugucggcgucuuccaggaaaauguguuccacacuauguggcauguuacgagaggggcaguccuaauguaucaaggaaaacgcuuagaaccaagcugggcuagcgucaagaaagauuuaauuagcuauggagguggguggcgccuacaaggaucuuggaauacuggagaagaaguccaaguuaucgcaguugaaccuggcaaaaaucccaaaaauguccaaacugcaccagguacuuucaaaacuccagaaggagaagucggugcuauugcguuagacuuuaaaccaggaaccucugguagcccaauugugaauagagagggaaagaucguuggccuguacggcaaugggguuguaacaacaucuggaacauacguaucugcaauagcacaagcaaaagcaucucaggaaggaccccuaccugaaauagaagaugaaguuuuuagaaaaaggaaucugacgauuauggaccuacauccaggaucaggaaagaccagaagguaccuuccggccaucguccgcgaagccaucaaaagaaaacuuagaacccuaauucuagcuccgaccagagucguugcaucagaaauggcggaggcucucaagggaaugccuauaagauaccaaacuacugccguaaaaucagagcacacaggaaaggagauaguggauuuaaugugccacgcaaccuuuacaaugcggcuacugucaccaguucgugucccgaacuauaacaugaucauaauggaugaggcucauuuuacagauccaaguagcauagcggcgagagguuauauaucaacgagaguaggcaugggagaagcugccgcaauauucaugacagcgaccccaccagguucaguagaagcguuuccccaaucaaaugcuguaauucaagaugaggaaagagauauuccagagcguucuuggaacagcggguaugaauggauuacagauuuucccgguaaaaccguaugguucguuccgucgaucaaguccggaaacgauauugcuaacuguuuacguaaaaaugggaaaagaguuauccaacucagcagaaaaacauucgauacugaauaccagaaaacgaaaaauaacgauugggauuaugucguaacaacagauauuagugaaaugggagcaaacuuucgcgcagaucguguaauagauccaagaagaugcuuaaaaccaguuauucugaaagauggcccggagagagucauccuugccggaccaaugccagugacaguagcgagugcagcucaacggagaggucgaauuggccggaaucacaacaaagaaggagaucaauacauauacaugggacaaccucuaaacaaugacgaagaucaugcucauuggacagaggcaaaaauguuacuagauaauauaaauacaccugaaggaauuauuccggcauuauuugagcccgagcgagaaaaaucagcugcaaucgauggcgaauaucgucuacgcggggaagcucgaaaaacuuucguugaguuaaugcgacgaggcgaucuaccagucugguuaaguuauaagguagcaucagaagguuuccaauacucugaucggcgauggugcuuugacggcgaaagaaauaaucagguuuuggaggaaaauauggauguagaaauuuggacuaaagagggggaaagaaagaaacuacggccgaggugguuagaugcaagaacauacagcgacccacuugcauuacgagaauuuaaagaguuugcagcgggcagacgaucaguguccggagauuuaauacucgagaucgguaaacuuccacaacaccucacucagagagcccaaaaugccuuggacaaccucguuauguuacauaauucagaacaaggcgguagggcuuauaggcaugcaauggaagaauuaccggacacuauugaaacacugaugcuauuggcacuaauagcaguacugacuggagguguaacgcucuuuuuccuuagcggucgugguuuaggaaagacgucaauaggccuacuauguguaauggcuucaucgguucuacuauggauggcuucaguugaaccacacuggauagcggcgaguauuauuuuggaguucuucuuaaugguccuacuuauuccagaaccagacagacaaagaaccccacaagacaaucaauuagcauacguugucauaggucuucuguucaugauucugacgguagccgcaaaugaaaugggacuauuggaaacaacuaagaaagacuuagggaucggucacguggcugucgagaaucaucaucaugcuacuaugcuagacguagaucuacauccugcuagugcauggacguuauaugcgguagcaaccacgaucauuacaccaaugaugagacauaccauagagaacacgacugcuaauaucucucuaacggcuauagcuaaucaagcagcuaucuugaugggauuagacaaagguuggccaauaucaaaaauggauauuggaguaccucuauuagcuuuagguugcuauagucaaguuaacccauugacauuaacagccgcgguacuuaugcuaguugcucacuaugcgauaauuggcccgggauuacaagcaaaggcgacacgcgaggcacaaaaacgaacugccgcuggaauaaugaaaaacccaacgguugauggcaucgucgccaucgaccuugaucccgucguuuaugacgcaaaguucgaaaaacagcuggggcaaauuaugcuacuaauauuauguacuucucaaauucuuuuaaugcggacgacaugggcguugugcgaaucaauuaccuuagcaacugguccucuaaccacauuaugggaggguucgccagguaaauucuggaauaccacaauagcuguaagcauggcaaacauuuucagaggaucuuaucuggcaggagcgggcuuagcuuuuuccuuaaugaagaguuuagguggagggcggagaggaacuggggcgcaaggagagacccuuggugaaaaauggaaacgucagcuaaaccaguuaucaaagucagaguucaacauuuacaagcggucuggaauaauggagguagacagaagcgaagcaaaagaagguuugaaaaggggugaaacgacuaggcacgcuguuucccguggaaccgcaaaguuaagaugguuuguugaaagaaaccuagugaaaccugaggggaaagugauagaucuuggaugcggaagaggaggauggaguuacuacugcgcuggacugaaaaagguuacggaaguuaaaggcuauacuaaaggugggccgggacacgaagaaccaauaccaauggcaacguacgguuggaaucucgucaaacuucauucggggaaggauguguucuuuacucccccagagaaaugugauacacuacuaugugauauaggggaaucaucgccaaauccaaccaucgaagaaggaaggaccuugagagucuuaaaaaugguugaaccaugguuaaggggaaaucaguucuguauaaaaauacucaauccauauaugcccuccguaguugagacacuggaacaaaugcaacguaagcauggaggcaugcuaguacggaacccccuuagccguaacagcacucaugaaauguacugggucucgugcgguacagguaauauagucagugcggucaacaugacuuccagaaugcuucuaaauagguuuacgauggcacauagaaaaccgacuuaugaaagagauguagaucuaggugcaggaaccagacacgucgccguagagccagagguagcaaauuuggacauaauaggacaaagaauagagaauauuaaacaugaacacaaaucuaccuggcauuaugacgaagacaacccguauaagacuugggcauaccauggaaguuacgaaguuaaaccauccggauccgcgaguaguauggugaacgguguaguaaaacuccugacuaaaccuugggauguaaucccuaugguuacucaaauugcuaugacggauacgacuccauuuggacagcaacgcguauuuaaagagaagguagauacaagaacacccaaagccaaacgaggaacugcucaaauuauggaggucacugcaagauggcuauggggauuucucuccagaaacaaaaagccaaggauauguacccgagaggaguucaccaggaaaguacgaucgaacgcagcaaucggggcaguauuuguagaugaaaaucaauggaacucugcaaaagaagcaguagaagacgaaagauucugggaucucguacaaaaggaacgagaacuccacaaacaaggaaaaugugcuacguguguguauaacaugaugggaaaaagagagaagaaauugggagaauuugguaaagcgaaagggucacgagcuauaugguauaugugguuaggugcucgguuuuuagaauuugaagcguuagguuucaugaaugaagaccacugguuuucacgugaaaauagucuuucugggguugaaggagaaggucuucacaaguugggcuacauauuaagagauaucucuaagauaccaggagguaacauguaugcagaugacacugcagggugggauacaaggauaaccgaagaugaccuccaaaaugaggcuaaaauuacggauauaauggagcccgaacacgcguuauuggcaacaucgauauucaaacugacauaucaaaauaaagucguuagaguucaaaggccagccaaaaauggcacaguaauggauguuaucucucguagagaucaaagggguaguggacaaguuggaacuuauggauuaaacacauuuacuaacauggaagcacaacuaauccgucaaauggaauccgaaggaauauucuccccuucagaacuugaaauacccaauuuagcagaacgcgugcucgacuggcuagaaaaauacgggguugagaggcuuaaacgaauggcaauaucgggugacgauugugucgugaagccaauagacgaucgguuugccaccgcauuaacggcccuuaacgauaugggaaaaguuagaaaggaugucccacaaugggaaccaucgaaagguuggaaugauuggcaacaagucccuuuuuguucucaucacuuccaccaacuaaucaugaaagauggacgugagaucguagucccuugucgcaaucaggaugaguugguuggacgggcccgagucucgcaaggcgcgggauggagccuuagggagacagcgugccuuggaaaauccuaugcacagauguggcaacuaauguacuuccacaggagagaccuuaggcuugcagcaaacgcaaucuguagugcaguuccuguagacuggguaccuacaucgaggacaacauggucgauacacgcacaucaucaauggaugacaacagaagacauguugaguguuuggaacagagucuggauagaagagaauccauggauggaggacaaaacucacguaucaucauggggcgauguaccuuacuuagguaaaagagaagaucaauggugcgguagccuaauagguuuaacagcaagggccacgugggcaucgaauauucagguagcgauuaaucaaguaaggcgacugauuggaaaugaaaacuacuuagacuacaugacguccaugaagagguucaaaaacgaaggagauccagaaggggcuuugugguaa

SEQ ID NO: 21743 - RNA, 9879 nt, Artificial Sequence
  derived and/or modified CDS sequence (opt6) from DENV-1__FJ898406__SS-prME
agcguuacaauguuacuuauguuaaugcccacggcauuagcauuucaucucacaacucggggaggagaaccgcauaugauagucacaaaacaagaaagagggaaaucauuacucuuuaaaaccucagccggaguuaauauguguaccuugauagcaauggacuugggugaauuaugcgaagauacaaugacguacaaaugcccaagaauuacggaagcagaaccagaugauguagauuguuggugcaaugcuaccgauacauggguaacauacgggacuuguucccaaacuggagagcacagacgagauaaacgcucaguggcgcuggcaccucaugucgggcuaggauuagaaacucguacggaaacauggaugagcucagaaggagcauggaaacaaauacaaagaguggaaacgugggcacucagacacccaggguuuacaguuauagcucuguuuuuagcucacgcuaucgggacgucuauaacgcaaaaagguaucaucuuuauacucuuaaugcuagucacccccucaauggcgaugagauguguagggaucggaucccgugacuucguggaggguuugucuggugcgacuuggguugauguagugcuggaacacggaucaugcguuacgacgauggccaaagauaaacccacuuuagauauagaacuuuuaaaaacagaaguaacuaauccggcuguucuacgcaaacuauguaucgaagcuaaaauaucgaacacaaccaccgacaguaggugcccaacgcaaggugaagccacccuuauggaagaacaagaugcuaauuuuguaugcagacgaacuuuuguagacagagguugggguaauggaugcggacuuuuuggaaaaggaucuuugauaacaugcgcuaaauucaaaugcguuaccaaauuggaggguaaaauuguacaauacgaaaaccugaaauacucuguuauuguaacagugcauaccggagaucagcaucaaguagguaaugaaucgacagaacaugguacaacggcaacuauuacaccccaagcuccaacgucggagauccaauuaaccgauuacggagccuugacucucgacuguucaccaaggacuggucuugauuucaaugagaugguucuguuaacaaugaaagagaaaagcugguuaguacacaagcaaugguuuuuagaccuuccacucccauggacgucaggugcaucaacaagccaagaaacuuggaauagacaggaccugcuuguuacuuuuaaaacggcucaugcgaagaaacaggagguaguaguauuagguagccaagagggugccaugcacacagccuugaccggggccacggaaauacagacgucagguaccacuaccauauuugcuggacauuuaaaauguagacuaaaaauggacaaacuaacacuaaaagguaugagcuauguuauguguacagguucguucaaauuagaaaaagaaguagcagaaacacaacauggaacugugcuaguacaaauuaaauaugagggaacggaugcaccaugcaaaaucccuuuuagcacccaagacgagaaaggaguaacucaaaauggucgcuugaucacagcaaaccccaucgucacggacaaggaaaaaccaguaaauauagaagccgaaccgccuuuuggggaaagcuacaucguaauaggugcuggugaaaaggcucuaaaacucucuugguuuaaaaagggaagcaauauagguaaaauguucgaagcaacagcgagaggugccaggcgcauggcaauucuaggugauacagcgugggauuuuggaaguaucggaggaguauucacgucaguggguaaguuaguucaccagauuuuuggaacugcuuacgggguuuuauucucuggaguaucuuggacaaugaaaauaggaauaggaguacuacuuacgugguuaggacucaauagcagaaguaccagccugucuaugacgugcauugcgguaggccuagucacguuauaccucggcguaaugguacaagcagauagugguugcguuauaaauuggaaaggcagagaauuaaaauguggcucgggaauuuuuguaacaaaugaaguacauacauggacugaacaauauaaauuucaggcugacaguccuaaaagauuaagugccgcaauugggaaagccugggaagagggggugugcggcauacgaucagcuacgagauuagaaaauaucauguggaagcaaauaucgaaugaacuuaaucauauauuauuagaaaaugauaugaaauucaccguaguuguaggugauguggucgggauucuagcccaaggaaagaaaaugauacgaccacagccuauggaacacaaguauaguuggaaauccuggggcaaggcaaaaauaauuggggcagacguccaaaacacuacuuuuauaauagauggucccaauacacccgagugcccagacgaccagcgagcauggaauaucugggaaguugaggauuacggauuuggaauauuuacgacuaauauuuggcucaaacuaagagacaguuacacgcagguaugcgaucaucgacugaugucggcggcuaucaaggacucaaaagcagugcaugcagauauggguuauuggauagagagugagaaaaaugaaaccuggaaacuagcuagggcaucauucauagaaguuaaaacauguaucuggcccaaaucucacacacuauggucaaauggaguauuggaaucugaaaugaucauaccgaagaucuauggaggaccuauuagccagcacaauuauaggccagguuauuucacucaaacugcagggcccuggcacuuaggaaaguuagagcuagauuuugacuuaugugagggaacgacuguaguaguggacgaacauuguggaaaucgcggcccaucccugcgaacaacuacagucaccgguaagauaauucaugaaugguguugcagaucaugcacacuuccaccacuacguuucaagggugaagacggcuguugguauggcauggagaucaggccugucaaagagaaagaggaaaaucucgucaaaucgaugguaagugcaggaaguggcgagguagacucauuuagcuuaggacuccuauguauaaguauaaugauugaagaaguaaugagaucaagauggagcaggaagauguuaaugaccggcacccuggcuguauuucuccuacuuauaaugggacaauuaacguggaaugaucuuauucgacugugcaucauggucggagcgaaugcuucugacagaauggguaugggaacaacguaucuagccuuaauggcaacguucaagaugcgaccaauguucgcgguaggcuuacuuuuucggcgccuaacaucccgagagguccuauuguuaacuaucggauuaucgcuaguagcgucagucgagcucccaaacucauuagaagaacuuggugacggauuagcuaugggaauuaugauacuuaaauuacuaaccgacuuucagucacaccaguuaugggcgacacuucugucacuaacauuuauuaaaacaacguuaagccuacauuaugccuggaaaacaauggccaugguacugaguauaguuucacucuuuccuuuaugcuuaucaacuacgucacagaaaacuacgugguugccaguauuguuagggucauuagguugcaagccacuuacuauguuucugauagcagagaauaaaauauggggaagaaaaagcuggcccuugaaugaagggaucauggccguugggguaguaagcauauuauugucaucauuacuuaaaaaugaugugccuuuagcggguccguugaucgcuggcggaaugcuuaucgccuguuaugucauuucgggaagcuccgcagauuuaucacuagaaaaagccgcagaaguuucaugggaagaggaagcggagcacagcggagcgagccauaauauacucguagagguacaagaugacgguacaaugaaaauuaaagacgaagaacgugacgauacuuuaaccauauuauuaaaagccacucuacuugcgguuucuggcgucuacccucuaucaaucccagcuacucuguuuguaugguauuuuuggcagaagaagaaacagcggagcgggguucugugggauaccccaagucccccagagguggagagagccguuuuagacgaugggauauacagaauaaugcagagaggacuucuugggagaagucaaguaggaguaggcgucuuccaagaaaacguauuucauacaauguggcacguuaccaggggugcuguccugauguaucagggcaaacgcuuggaacccagcugggcaagugugaagaaagauuuaaucucuuacggagguggguggcggcuucaaggaucuuggaauacaggugaagaaguccaagucaucgccguagaaccagguaaaaaccccaaaaacguucaaacagcccccggaacuuuuaaaaccccagaaggugaagugggcgcaauagcccuagauuuuaaaccuggcacgucaggaucuccaauuguuaauagggaggguaagauagugggcuuauaugggaauggcgugguuaccacaucaggaacauauguaagcgcgaucgcucaggccaaagccucgcaagagggaccacucccagagaucgaggacgaaguauucagaaaaaggaaucugaccauuauggaucuacauccaggauccgguaagacccgaagauaucuucccgcaauuguacgagaagcuauuaaacguaaauuaagaacauuaauuuuagcgccgacucgggugguagcgagcgagauggcggaggcacuuaaggggaugccaauacgguaccagacaacggcagucaaaucagaacauaccgguaaagaaauugucgacuuaaugugucacgcuaccuuuacuaugagguuguuaucaccuguaagagugcccaacuacaacaugauaauaauggaugaagcacauuuuacugauccuagcucuauagcagcgcgggguuauauaaguacgagaguuggaaugggagaggcggcugcaauauuuaugacagcgacaccucccgggucagucgaagcauuuccacaaaguaaugccguaauccaagacgaggaacgagauauaccugaacgaucauggaauagcgguuaugaguggauuacagacuuuccuggcaagacaguuugguucgucccaagcaucaaaucaggcaaugauaucgccaauugcuugaggaaaaacgggaagcguguuauucaguuaucaagaaaaacauuugauaccgaauaucagaaaacaaagaacaacgauugggauuauguagucacaacugauauuagugaaaugggcgccaacuuucgcgccgacaggguaaucgaccccaggcgauguuuaaaacccguaauauuaaaagauggaccggagagaguaauccuugcagguccuaugccaguaacaguagcaucggcagcacagcgacgaggaagaauaggucguaaccacaauaaagaaggcgaccaauauauauauaugggacaaccccuaaauaaugaugaagaucaugcccacuggacagaagcuaagaugcuauuagacaacauuaauacaccggaagggauaauaccugcauuguuugagccagaaagagaaaaauccgcugcuauagacggugaguacagacuaaggggugaagcacggaaaaccuuuguagagcucaugagaagaggggauuugccgguauggcuaagcuacaaaguagcaagugagggguuucaauauucggacaggagauggugcuucgacggagaacguaauaaucaaguauuagaagagaacauggauguagaaauauggacuaaagaaggugaaagaaagaaacuacgaccucgcugguuagacgcgcgcacauauagugacccacuggcauugcgagaguucaaagaauuugcagccggucgcagaaguguaucaggggaccuuauauuagaaauuggaaaacuaccgcaacaucuaacacaaagagcacaaaaugcacuugauaauuuagucauguugcauaauuccgaacaaggagggagagcauauagacaugcaauggaagaacugcccgauacaauugagacauugaugcuguuagcuuuaauagcugucuuaacaggagggguuaccuuguucuuucucucggggcguggucuaggaaaaacuucuauaggcuuacucuguguuauggcuagcuccguuuuauuauggauggcuagugucgaaccucacuggauugcagcaaguauuauuuuagaguucuuucuaauggugcuguuaaucccagaacccgauagacagaggacuccgcaggauaaucaacucgcauacguaguaauuggguuacuuuuuaugauuuuaacugucgccgcuaaugaaaugggacuucuagaaaccaccaagaaagaucuuggcauaggucauguagcaguagaaaaccaucaucaugcaacaauguuagacguggauuugcacccggcaucagcuuggacacuauaugcaguagcuaccacaauuauaacaccaaugaugagacacacuauagaaaauacgacggcuaauaucagcuuaacugccaucgccaaucaagcggcgauauuaaugggucuagacaaaggguggccgaucuccaaaauggacauuggcguuccucuguuagcacucgguuguuauucccaaguaaaccccuugacgcucacagcagcaguauuaauguuaguggcacauuaugcgauaauugguccuggucuccaggcaaaagcaacuagagaagcacagaaaaggacggcagcgggaauaaugaaaaauccgaccguagauggaaucguagcuaucgauuuggauccaguuguauacgaugccaaauuugaaaaacaacuuggccaaauaauguugcuaauucuauguaccucacaaauacugcuaaugcguacaacaugggcacuuugugaauccaucacauuggcaacuggaccauugacaaccuuaugggaaggaucaccagguaaauucuggaauacuacaaucgcuguuuccauggcaaacauuuuuaggggaucauaucuagcgggagccggacuugcuuucucccuuaugaaaagccucgggggagguaggcgugguacuggugcccagggugagaccuugggggagaaguggaagcgccaguugaaucaacuaucaaaaagcgaguucaacauuuacaaacgaucagggauaauggaaguugaccguuccgaagccaaagaaggucuaaaacgcggcgaaacgaccagacacgcaguuagccgaggaaccgccaaacuacgaugguucguagaacgcaaccucguaaagcccgagggaaaaguuauugaucuggggugugggagaggggguugguccuauuacugugccggccuuaagaaagucaccgaggugaaaggauacacaaaaggcgguccaggccaugaagaaccgauucccauggccaccuauggguggaaccuaguaaaacuacauagugggaaggauguauuuuucacaccaccagaaaaaugugauacauuauugugcgacauaggggaauccagcccgaauccaaccauagaagaaggucgcacacugagaguccuuaaaaugguagaaccaugguugagaggaaaccaguuuuguauaaaaauacuuaacccuuauaugccuuccguuguugaaacauuagaacagaugcagagaaagcacggaggaauguuaguacguaauccucuuucccgaaauucaacccaugaaauguacuggguaagcugugggacagguaacauaguaagcgcagugaacaugacuucaagaauguugcuaaaccgguuuacuauggcucacagaaagccaacuuaugaaagagacguagauuuaggagcuggaacuagacauguagcaguggaaccagagguagcuaaccuagacaucauuggacagcggauagaaaauauuaaacaugagcacaagucuacauggcauuacgaugaagauaauccuuacaaaacuugggcguaccaugguaguuacgaagucaaaccgaguggaagcgcaucaagcauggugaaugguguugucaagcugcuuacaaaaccuugggaugugauccccaugguaacacaaauagcuaugacagacacaacgccauuuggacaacaacgggucuuuaaagaaaaaguagacacccguacuccuaaagcgaaacgaggcacugcucaaauaauggaaguaaccgcuagaugguuauggggauucuuaucgagaaacaaaaagccacgaauauguacaagagaagaauuuaccagaaaagucagaucaaaugcugcgauaggcgcgguauuuguugaugaaaaucaguggaauagcgcuaaagaagccguugaagaugaaagguuuugggauuuaguccaaaaggagagggagcuacauaagcaagguaaaugugcgacguguguguacaauaugauggguaaaagggagaagaaacuuggugaguuuggaaaagcaaaaggcucgcgggcuauaugguauauguggcuuggagcccgguuuuuagaauuugaagcucuaggauuuaugaaugaggaucauugguuuucaagagaaaacucccuaaguggagucgaaggagaaggccuacauaaacuaggauauaucuuaagagauauauccaaaauaccuggagggaauauguaugcugaugacacugccggaugggauacaagaauaaccgaagaugaccuucaaaacgaagcaaaaaucacugauauuauggaaccagaacaugcacugcuggcuacaagcauauucaaacuuacauaucagaauaaaguuguaaggguacagagaccagccaaaaaugguacaguaauggacgucauaucaaggcgcgaccagcgaggcucgggacaagugggaaccuauggccucaacaccuuuacaaauauggaagcgcaguuaauacgacaaauggaaucagaaggcauuuuuaguccaucugagcuagaaauuccaaauuuagcagagagggugcucgacuggcuagaaaaauauggcguugagagacuaaaacgcauggcaauauccggagaugauugcguugucaaaccuauugaugaucgauuugcaacagcauugacugcuuuaaaugauaugggcaaagugcguaaagacguuccccaaugggaaccauccaaaggcuggaaugacuggcaacagguuccuuucugcucacaucauuuucaucaacuaauuaugaaagacggacgagaaaucguagugccaugucguaaccaagacgagcuaguaggcagagcgagaguaagucagggagcaggauggucauuacgcgaaacagcauguuuggguaaauccuacgcucaaauguggcaauuaauguauuuucauaggcgagaccuuagacucgccgcuaaugcaauauguucagcaguucccguugauugggugccaacuucaagaacgacgugguccauacaugcgcaccaccaauggaugacuacugaggauauguuaaguguuuggaaccgaguuuggauagaagaaaacccuuggauggaagauaaaacgcacguauccagcuggggagacguuccuuaucucgguaaaagagaagaccaauggugcgguagccuaauagguuugacagcaagggcaaccugggcaucaaacauacaaguagccauuaaccagguaagacgauuaauagguaaugaaaacuacuuggauuacauggccucgaugaagagauucaagaacgaaggggauccugaaggcgcccuuugguaa

SEQ ID NO: 21744 - RNA, 9879 nt, Artificial Sequence
  derived and/or modified CDS sequence (opt6) from DENV-1__GQ199841__SS-prME
agugugacgauguuacugaugcugaugccgaccgcguuagcauuucaucuaacgacucgaggaggagaaccacacaugauaguuucaaaacaggaacguggaaagagcuuguuauuuaaaacuucagcuggaguuaauaugugcacacuaauagcuauggacuugggagaauuuugugaagacacgaugacuuacaaauguccaagaauaacugaggcagagcccgaugauguagacuguuggugcaacgccacagauacuuggguuaccuacggaacuugcucacaaacaggagaacaccgucgggauaaaaggagcguggcccuagcgccccacguuggucucgggcuagaaacaaggacugaaacauggaugaguucggaaggagcguggaaacaaauacaaagggucgagacuugggcccuacgacauccggguuuuacaguuauagcguuguuucuagcacaugcgaucgggaccucuauaacgcaaaagggaauuauauucaucuuacugaugcuggucacaccuaguauggcuaugagaugugucggaauugguagucgugacuuuguugaaggauuaagcggugcuacguggguugauguaguacuggaacauggauccuguguuacaacaauggcuaaagacaaaccgacacuugauauugaacugcuaaaaacagaaguuacgaacccagcaguccucaggaaacuauguauagaagcuaaaauuagcaauacuacaacagacucgaggugcccaacgcaaggagaagccacguugguagaagaacaagacgcgaacuuuguaugucggaggacauuuguugaccgaggauggggaaacggaugcggacucuuugggaaaggaagccuuaucacgugcgcaaaauucaaaugugugaccaaauuagaagguaaaacggugcaguaugaaaaucuaaaauacagugucaucguaacagugcacacuggagaucaacaucagguagguaacgaaucgacugaacaugguacgaccgccacuauaacaccucaagcaccuagcacugagauacaacugacggauuacggagcccuaacauuggacugcagcccucggacaggacuagauuuuaaugaaauggugcuccuaacaaugaaagagaaaaguuggcuaguacacaaacaaugguuucuugaucuaccacuaccguggacaaguggagcuuccaccagccaggaaacuuggaauagaaaagacuuacuugucaccuuuaaaacagcgcacgcuaagaaacaagaaguuguggucuugggaucucaagaaggagcaaugcacacagcacuuaccggugcuacugaaauacagaccagcggaacaacuacaauuuuugcaggacauuuaaaaugcaggcugaaaauggauaaacuaacauuaaaagggaugagcuacguuauguguacuggaucauuuaaacuugaaaaagagguggcggaaacucaacacggcacuguucuuguccaaaucaaauaugaaggcacugaugcgcccuguaaaauaccuuuuucaacacaggacgaaaaaggggucacacaaaaugggcggcuaauaaccgcgaaucccauagucacagauaaagaaaaaccuguuaauauugaagcagaaccgccauuuggagagucauacauaguaaucggggccggagaaaaagcacuaaaauuaucaugguucaagaaagggucaucaauugguaaaauguuugaagccacggccaggggagcacgcagaauggcuauccuuggcgauacagccugggacuucggaaguauaggcggaguauuuacaucuguaggaaaauugguucaucaaauauuugguacagcuuacggaguacuauuuucgggugucuccuggacuaugaaaauaggaaucggaguauuguuaacuugguuagggcuaaauucccgaaguacaucauugaguaugacgugcauagccguaggcuuagucacccuuuaucucggaguaauggugcaagcagacagcgguugcguaauaaauuggaaaggacgagaacuaaaaugcgggucagguaucuuuguaacgaaugagguccacacauggacggagcaauauaaauuccaagccgacaguccaaaaagacugucagcagcuauuggaaaggcuugggaagaaggagugugcggaauacgaucagcuacaagacuugaaaauauaauguggaaacagauaucuaaugaguuaaaccauauuuuauuagaaaaugauaugaaauucacgguaguuguaggugacguagcugguauauuagcccaagguaagaaaaugaucaggccucaaccgauggaauauaaguauagcuggaaaucuugggggaaagccaaaaucauaggugcugacguacaaaacaccacauuuaucauagacggaccgaacaccccggaauguccugacgaucagagagcauggaacauaugggaaguugaagauuacgguuuuggcauuuuuacgacgaauauauggcucaaguuacgagauucuuauacucaaguaugugaucacagacucaugagugccgcgauuaaggauucgaaagcaguacaugccgauaugggauauuggauugaaagugaaaagaaugaaacauggaaacuugcuagggccagcuuuauugaaguuaaaacaugcauauggccaaagagucacacacuauggaguaacggaguuuuagaauccgaaaugauaauaccgaaaauuuauggaggcccgaucagccaacauaauuauaggccugguuauuuuacgcagacagcugggccuuggcaucuaggcaaacuagaacuagauuucgaucucugugaagggacaacaguagucguggaugaacauugugguaauagagguccaaguuuacgaaccacuacagucacagguaaaauuauacacgagugguguugcagaaguugcacguuaccaccccuuagauucaaaggagaggauggcugcugguaugggauggaaauaaggccaguuaaagaaaaagaggaaaacuuaguaaaaagcauggucagcgcugggucgggugagguagacucuuuuucucuaggccugcuaugcaucuccaucaugauagaagaagugaugcgaucaagauggucgcgaaaaauguugaugacaggaacccuugcaguauucuuucuucucauaaugggacaguuaacauggaacgaucuuauuagacuaugcauaaugguaggagcaaacgcuagcgacaggaugggaaugggcacuacauaccuggcccugauggcuacguuuaaaaugcgcccaauguuugcagucggccuccuauucaggcguuuaaccucuagggaaguucuauuguuaacuaucgguuuaucucugguagcaucaguagaguuaccaaauucauuagaagaacuaggagacgguuuagcaaugggcauaaugauacugaaacuacucacagacuuucaaucucaccaauugugggcaacacucuugagcuuaacauuuauuaagacuacauucaguuuacauuacgcuuggaaaacaauggccaugguacucagcauaguuagcuuauuuccuuuguguuuaucuacaacaagucagaaaacaacauggcuaccaguguuacuagguucccuaggaugcaagccuuuaacgauguuucucauagcagaaaauaagauauggggucguaagucuuggccacucaacgaaggaauuauggcggucgguauaguaagcauacuauuaaguagccucuuaaagaaugauguaccccuagcuggcccauuaaucgcuggcggaaugcugauugccuguuacgucauaaguggcucauccgcggauuugucauuagaaaaggcugcggaaguaagcugggaggaggaagcagaacacaguggcgcaucucauaauauucuuguagagguacaagaugauggaacaaugaaaaucaaggacgaagaaagagaugauacgcugacgauuuuauugaaagcaacauuauuagccguuagcggaguauauccccucucaauacccgcaacucuauucguaugguacuuuuggcagaagaagaaacaaagaucaggaguacuuugggacacuccaaguccacccgaaguagaacgagcaguuuuagaugacggaauauaccgcauuaugcagcggggucuacuaggucguucucaagugggagugggaguuuuucaagagaacguuuuucacacaauguggcacgucacucgaggggcaguucucauguaccaaggaaaacgucuagaacccucaugggcgucuguuaagaaagauuuaauaagcuacgguggagguuggcgacuccagggaagcuggaauaccggagaagaaguacaggugauagcuguagagccaggcaaaaaucccaaaaacguacaaacggccccaggaacuuuuaagacaagcgagggagaaguaggggcuauagcccuagacuucaagccuggaacaagcgggagucccauagugaacagagaaggaaaaauuguagguuuauaugguaauggaguaguaacuacauccgguacauaugucagcgcaaucgcccaggcgaaggcuucgcaagaagguccucuuccagaaaucgaagaugaaguguuuagaaaacgaaaucuuacaauaauggacuuacacccagguucugguaaaacacgacgauacuugccugcuauuguacgagaagccauuaaacguaaauugcgcacguuaauauuagcuccuacuagaguaguagcgagcgaaauggcagaagccuuaaaaggaaugccuauacgauaccaaaccacugcagucaaaagcgagcauacagggaaagaaauaguugaucuaaugugucaugccacguuuacaaugagguugcuaucuccaguaaggguucccaacuauaauaugauaaucauggaugaagcgcacuuuacagacccaaguagcaucgcagcaagaggauauauaucgaccagaguuggaaugggggaagcggcagcaauauuuaugacugccacuccaccggggucaguagaagcauucccccaaagcaaugcagugauucaagacgaagaacgagauauaccagaacguucguggaacucggguuacgaauggauaacagacuucccagguaagacaguuugguuuguaccaucaauaaaaucaggaaaugauauagcaaauuguuuacguaaaaauggaaaaaggguuauacagcucucuagaaaaacauuugacaccgaauaccagaaaacuaaaaauaaugauugggauuauguaguaacuacagauauuucagagaugggcgcuaacuuuagagcugaccguguuauugauccuagacgaugucuuaaaccaguaauccugaaggauggacccgagcgagugauacuagcugggccgaugccgguaacuguagcaucagcggcgcaaagacgcggcagaauuggacgaaaucauaacaaagagggagaucaguacauauacaugggucaaccucuaaacaacgaugaagaccaugcacacuggacagaagcuaagaugcuccuagauaacauaaauacaccugaagggauaauacccgcucuauuugaacccgaaagagaaaagucagcggcaaucgauggcgaauauagacuaagaggugaagcuaggaagaccuucguagaacugaugaggagaggagaccugccaguuuggcuuucauauaaggucgcaucagaagguuuucaguacucagacagaagauggugcuucgauggcgaaagaaauaaucaaguuuuggaagaaaacauggauguagaaauauggacgaaagagggcgaaagaaagaaauuacgaccgagauggcuggacgcacgaaccuacagcgauccauuagcucugagagaauuuaaggaguuugcugcaggaagaagauccguaucaggagacuuaauauuagagauagguaaacuaccucaacaccucacacaacgcgcucaaaaugcucuagauaaccuagugaugcuacauaacucggaacaagguggccgagcauauagacacgcgauggaggaacuuccagauaccauagaaacucuaaugcuauuagcguuaauagcaguuuugacagguggcguaacacuuuucuuucuauccggacggggguuaggaaagacaaguauagguuuacucugcguaauggcuucgucagcacuucuguggauggcaagugucgaaccucacuggauugcugcaaguaucauauuggaguucuuuuugaugguauuauuaaucccagaacccgaccgacagagaacaccacaagauaaucaacuugcauacguaguaaucgguuuauuauuuaugauacucacaguagcagcaaaugaaaugggcuuauuagaaacuaccaagaaagaucuaggaaucggucacguagcgguugaaaaccaccaucaugcggcuaugcuagauguugaucuacauccagcauccgcuuggacccuuuaugccguggccacgacaauaauaacuccuaugaugcgacacaccauagagaacacgacugcgaauauuaguuuaacugcuaucgcaaaucaagcagcuauucucaugggcuuggacaaagguuggccuauauccaaaauggacauagggguaccauuacuugcauugggaugcuacagccagguaaaccccuuaacucuaacagcagcuguucuuaugcugguggcucauuacgcgauuauaggaccgggcuuacaggcgaaagcaacucgggaggcacaaaagagaacagcugcagggaucaugaaaaauccgacagucgauggaauaguagcaauagaccuagacccaguaguguaugacgcaaaguucgagaaacaguugggacagauuauguuguuaauucuuuguaccucacaaauucuacuuaugagaacgacgugggcacuaugugagucuauaacucuggcaacugguccgcuuacuacauugugggaagguagucccggaaaauucuggaauacuacuauagcagugucgauggcaaauauuuuuagaggaucguaccucgcaggagcgggucuugcuuucucacuaaugaaaucacuagguggugggcgcagaggaacaggagcacaaggagaaacacuaggagaaaaguggaaaagacaacuuaaccaacuaaguaaaucugaguucaauaccuauaaaagaucgggcauaauggaaguagaucgcucugaagcaaaagaaggacuaaagagaggagagacaacgaaacaugcugucucucgaggaaccgccaaauuacguugguucguugaacgaaaucuggucaagccugagggcaaaguuaucgacuuagguugcggcagaggugguuggucguacuauugugcaggucuuaagaaaguaacggaagugaaaggcuacacuaaaggaggacccggccaugaagaaccgauaccaauggcaacauacgguuggaacuuagugaaauuacacaguggaaaggauguauucuuuauucccccugaaaaaugugauacacugcucugcgacauaggcgaaagcuccccaaauccuaccauagaagaggguaggaccuuacguguauuaaaaaugguagaaccgugguugaggggcaaccaauucuguaucaaaauacuaaaccccuacaugccaucuguaguggaaacgcuugagcaaaugcaacgcaaacauggaggcauguugguaagaaacccacuuuccaggaacucuacgcaugaaauguacugggugagcuguggaacaggcaacaucguuucagccguaaacaugacaaguaggauguuauuaaauagauuuacuauggcacacagaaaacccacauacgaacgagaugucgacuuaggugcagggacacgccacguagcaguugaaccagagguugcaaaucucgauauuauaggucaaagaauagaaaauauaaagcacgaacauaaaucgacauggcacuaugaugaagauaauccauacaaaacaugggcauaccacggaucguaugagguuaaaccgucugggucggcgaguagcaugguaaauggaguuguuaaauuguugacaaaaccuugggacgucauccccaugguaacccagaucgcaaugacagacacaacaccuuuuggucaacagcgcgucuuuaaagagaaaguagauacaaggacacccaaagcuaaacgaggaacugcccagaucauggaaguuacagcaaaaugguuauggggguucuuaaguagaaauaagaaaccccgcauaugcacacgggaagaauuuaccagaaaaguaagaagcaaugccgcgauuggggcaguuuuuguugacgagaaucaauggaacucugcgaaagaagcggucgaagaugaacgguuuugggaucuaguacauagagagagagaacuacauaaacaaggaaaaugugcgacgugcguuuauaacaugauggguaaacgugagaagaaauuaggggaauuuggaaaagcaaaagggucucgagccauaugguauauguggcuaggugcaagguuucuggaauuugaagcucuaggauuuaugaaugaggaccauugguucucccgggaaaauucacuuucgggugucgagggggaaggacuucacaaauuagguuacauuuuacgagauauaucaaaaauaccaggaggaaauauguaugcugaugacaccgcagguugggacacaaggauaacggaagaugaccuucaaaaugaggccaaaauuacagauauaauggagccggaacaugcauuacuggcgaaaucaaucuuuaaacuuacguaucagaauaaaguugucaggguccagaggcccgcuaaaaacggaacuguuauggacguaaucucacgacgcgaucagcguggguccggccagguagggacguaugguuuaaacaccuucaccaauauggaagcucaauuaauacgucaaauggaguccgaagguauuuucucacccucagaauuagaaacuccgaaccuugccgggagaguuuuggauugguuagaaaaacacgguguagaaaggcucaaaaggauggcaauaucaggcgaugauugugugguaaaaccgauagacgacagguuugcaaccgcucuaacugcgcuuaacgacaugggaaaaguuagaaaagacauuccgcagugggaaccuaguaaagguuggaaugauuggcaacaagucccauuuugcucucaucauuuccaucagcucauaaugaaagauggaagggaaauaguaguaccaugcagaaaccaagacgaauugguagggagggcgagaguuagucaaggagccggcuggaguuuacgggagacagcaugucuaggcaagagcuaugcacaaauguggcaacucauguacuuccauaggcgagauuugagguuagcagccaaugcaauaugcucagcuguaccagucgauuggguuccgacuucaagaacaacauggaguauacacgcgcaucaccaguggaugacaacagaggauaugcucucaguuuggaaccggguuuggauagaggaaaauccauggauggaggauaaaacucauauaucuaguuggggcgacguaccauacuuggguaagcgcgaagaucaguggugugggagccuaauaggauuaacagcaagagcgaccugggcuacaaacauacaaguagcuauaaaucaaguccgucguuugaucgguaacgaaaauuaccuugauuauaugacaaguaugaaaagguucaaaaaugaaucagaccccgaaggagcucuaugguaa

SEQ ID NO: 21745 - RNA, 9879 nt, Artificial Sequence
  derived and/or modified CDS sequence (opt6) from DENV-1__FJ898407__SS-prME
aguguaacuauguuauugaugcuaaugccaacugccuuagccuuucaccuaacaacucggggaggggaaccacauaugauugugucuaaacaagaaagaggaaaaucgcuacucuuuaaaacuucggcaggggucaauauguguacccuaauagccauggaccuuggagaauugugugaagauacuaugacuuauaaauguccacgcauaacagaaguagaaccugaugauguagauuguugguguaauacgacagauacaugggugacuuauggaacauguucacaaacuggagaacauagacgagauaaacgaaguguggccuuagcgccgcauguggguuuaggauuggaaacacgcgcugaaacguggaugucaagugaaggagcauggaaacaaauccaaaaaguagaaaccugggcacuaaggcauccagguuuuacaguaauagcgcuguucuuagcucacgcaauaggaacaaguauaacucaaaaagguauaauuuucauauuauuaaugcuggugaccccuaguauggcaaugcguugcguugguauaggcucucgagauuucguagaaggucuuuccggcgcaacguggguugauguuguauuggaacauggaaguuguguaacaacaauggcaaaagacaaaccaacacucgauaucgaacuauuaaaaacagaaguuacuaaucccgccguacugagaaaacuuuguaucgaagccaaaauuucuaauacaacaacugacagccgauguccuacacaaggugaagcuacacuuguagaagaacaagaugcaaauuuuguauguagacgaacauucgucgaccgaggguggggcaacggauguggucucuucggaaaagguucacucauaacuugcgcaaaauuuaaauguguaaccaaacucgaagguaaaauuguccaauaugagaacuugaaauauagugugauugucaccguacacaccggagaucaacaucaaguagggaaugaaucuacugaacauggaacuacagcgacuauuacuccacaagccccaacuuccgaaauucagcuaacugacuacggagcacuaacauuagauugcucaccuaggaccggccuggacuucaaugaaaugguccuuuuaacuaugaaagaaaaaucaugguuaguacauaaacagugguuucuggaccuuccuuuaccauggacaucgggagcuucgacaucacaagagacauggaauaggcaagaccuauuagucacauucaaaacugcacacgcgaagaaacaggaaguaguuguucuaggaucgcaagaaggugccaugcauacagcguuaacgggugcuacggaaauacagacgagcggaaccacgacgauauuugcggggcaccucaaaugccgacuaaaaauggauaagcucacccucaaaggaaugagcuauguuauguguacaggcucauuuaaacuagaaaaagaaguggcggaaacccaacacggcacuguuuuaguucaaauaaaauacgagggcacagaugcaccauguaaaauaccauuuucuacgcaggacgaaaaaggaguuacccaaaacgggaggcuuauaacagccaacccaauagucacagauaaagaaaaaccagugaauauugaagcugaaccucccuucggagagucuuauauaguaaucggagcaggcgaaaaagcacuaaaacucuccugguuuaagaaagguaguagcauaggcaaaauguucgaggccaccgcaagaggggcucguaggauggcuauucuaggugauacagcuugggauuuuggaaguauagggggagucuucacgaguguagguaaacuuguacaucaaauauucgguacagcuuacggcgucuuauuuaguggagugaguuggaccaugaaaaucggaaucggugucuuauugacguggcuuggguuaaauagucguagcacuuccuuauccaugacauguauagcuguugguuuggucacauuauaucuaggcguuaugguucaggcagacucaggcugugucauaaacuggaaagggagagaacuuaaaugcgggagcggcauuuuuguaacuaacgaggugcauacuuggaccgaacaguauaaauuucaagcggacaguccaaagagauuaagugcggcgauuggaaaagcaugggaagagggaguauguggaauacgaagugcaaccagacuagaaaauaucauguggagacagauaagcaaugaauugaaccauauacuauuagagaaugauaugaaauuuacuguuguuguaggcgaugucguggguauuuuggcccaaggcaagaaaaugaucagaccccaaccaauggaacauaaauauucuuggaaaucuuggggaaaggcaaaaauuauuggggcagacguacaaaacacuacuuuuauuaucgaugguccuaauacaccagaaugcccggaugaccaaagagcguggaacaucugggaagucgaagacuaugguuuuggcauauuuacgaccaacauaugguugaaauuacgagacucauauacacaaguaugugaccaccguuugauguccgcagcaauuaaggauaguaaggccguacaugccgauaugggauacuggaucgaaucggagaaaaaugaaacuuggaaguuagcacgugccaguuucauugaaguaaaaaccuguauauggccaaaaucacauacucuauggucaaacgguguacucgaauccgaaaugaucauaccaaaaauauacggagguccaauuucgcaacauaauuaucgaccaggauacuuuacgcaaaccgccggcccguggcacuuaggaaaacuagaauuagauuucgaucucugcgaaggaacaacagucguagucgaugagcauuguggaaaucggggucccaguuugcggacaacaacuguaacaggaaaaauaauacacgaguggugcugccggucauguaccuugcccccacuacgauuuaaaggggaagaugguugcugguacggaauggaaauaaggccuguuaaagaaaaagaagagaauuuaguaaaauccaugguguccgcuggaaguggagagguagacucauucaguuugggucuacucuguauuucgauaaugauugaagaaguaaugcgaucccgguggagcagaaaaauguuaaugacaggaacauuagcggucuuuuuccuacuaauuaugggucaacuuacauggaaugauuuaauaaggucaugcauuaugguaggagcuaacgcuucagaccguaugggaaugggaacgacuuaccucgcgcucauggcaaccuuuaaaaugagaccaauguuugcaguagguuuacuuuuuaggagacucacaaguagagaaguguuguuauuaacuauaggucuaaguuugguagcuuccgucgagcugccuaauagucuagaggaacugggcgauggacuugccaugggcauaaugauauuaaaacuuuuaacagacuuccaaaguuaccagcugugggcaaccuuauuaagucuaaccuuuauuaaaaccacguucagucuacacuacgcauggaaaacuauggcgauggucuugagcauagucucacugcugccacuaugccuuuccacuaccagccagaaaacuacuugguuaccagugcuacucggaucacuagggugcaagccucuuacaauguuuuugauagccgaaaauaagauauggggacgaaaaagcuggccucuuaacgaaggaauuauggcaguaggaauaguuaguauucuccuaagcaguuuguuaaagaaugauguaccauuagcaggaccacuuauagcaggcgggaugcuaauugcuugcuacguuauauccgguagcucugcugaucucagcuuagagaaagcagccgaaguaucgugggaagaggaagccgagcauaguggugcaagucauaauauucuaguugaagugcaagaugauggaaccaugaaaaucaaagacgaagaaagagaugacacucuuacuauuuuauugaaggcuaccuuacucgcuguaagcggaguguacccuuugucaauucccgccacacuauucguuugguacuuuuggcaaaagaagaaacaaagaagcggcguucuaugggacacacccucgccaccugaaguugaacgugcuguauuagaugauggcauauacagaaucaugcaaaggggccuacuuggacgaagccaagucggaguuggaguuuuucaggaaaauguguuccauacuauguggcauguaacuaggggcgcaguauugauguaucaaggcaaacgacuagaaccaucuugggcgagugucaagaaagauuuaauaucuuauggaggaggauggcgacuacaggggucuuggaauacuggagaggaaguacagguaauagcaguagaaccaggcaaaaauccuaaaaauguacaaacagcgccagggacauucaaaacaccagagggcgaagucggcgccaucgcucuagacuucaaaccggguacaaguggguccccuauuguaaauagagaaggaaaaaucguaggauuauauggcaacggggugguaacuacauccggaacuuaugugucggccauagcacaaacaaaagcuagucaggaagguccacugccugagauagaggaugaaguauuucguaaaaggaacuugaccaucauggaccuacauccgggcucugggaaaacucgacgauaccuccccgcaauagucagggaggcuauuaaacgaaaauuaaggacucuaauccuagcaccaacgcgaguuguagcguccgaaauggcagaggcccuuaaaggcaugccgauaagauaccaaacaacugcagucaaaagcgagcauacaggacgugaaauuguagaccuuaugugucacgcaacauuuacuaugagauuauuaaguccaguacgaguacccaauuauaauaugauaauaauggaugaggcacauuuuaccgauccauccuccauagcugcucgugguuauauuucaacucgaguagggaugggugaagcagcagcaaucuuuaugacagcaaccccgccugggucaguugaagcguuuccacaaucaaacgcugugauacaagaugaggaacgugacauaccugaaagaucuuggaacucuggcuacgaauggaucacugauuuuccaggaaaaacgguaugguuuguuccaagcauuaaaagugggaaugacauagcaaauuguuugagaaagaacggcaaaagaguaauccaacucagcagaaaaacguuugauacugaauaccagaaaaccaaaaauaaugauugggacuaugucgugacgaccgacauaucugagaugggagcaaacuuuagggcagauagaguaauugacccacgaagaugcuuaaagccaguaaucuuaaaagacggaccagaacgggugauucuggcuggcccaaugccaguaaccguugcuucagccgcgcaaagaagaggacguauugguagaaaccauaauaaggagggugaccaauacaucuacaugggccaacccuugaacaacgaugaagaccaugcucacuggaccgaagccaaaaugcuauuagauaauauaaauacgcccgaaggaauaauuccagcuuuguuugaaccugaacgugaaaaauccgcugccaucgauggugaauauagauuacgcggagaagcccguaaaacauuuguagagcuaaugagaagaggggacuugcccgucugguuguccuauaaaguugcgucagaaggcuuucaauauucagacagacgauggugcuucgacggcgaaagaaauaaucaaguguuagaagaaaacauggacguugagauuuggacaaaagagggggaaagaaagaaauuacgaccacgauggcuggaugccagaacauauucugacccuuuagcucuccgugaauuuaaagaguucgcugcugguagaagaagcgugagcggagauuugauucuggagauuggaaaauugccacaacaccugacucagagagcccaaaacgcacuagacaacuugguaaugcuacacaacucagaacaagguggacgagcauaucgucacgcaauggaagaacuuccagauacuauugaaacccuuauguuauuggcccugaucgcugucuuaacaggaggaguaacucuauucuucuugucuggaaggggcuuaggaaaaacgucaauagguuuauuaugugucauggcuucaucagcauuacucuggauggcgaguguggagccucacuggauagcggcuagcauaaucuuagaguuuuuccuaaugguucuacugauuccagaacccgauagacagcggacuccucaagauaaucaauuggcguauguuguuauaggauuguuauuuaugauucuuacuguugcugcaaacgaaaugggacuauuagagacuacgaagaaagaucuugguauaggacacguugcaguagaaaaccaccaccacgcuaccaugcucgauguagauuuacaucccgcgagcgcguggacacuguacgcgguagcuacaacgauaauaacuccuaugaugcgacauacaauugagaauacuacggcuaauaucucauuaaccgcaauagcuaaccaggccgcaauacuaaugggccucgacaagggcuggccuauauccaaaauggauauuggaguaccacuacuugcuuuaggauguuacucgcaaguuaacccauugacacuaacugcagccguguugaugcugguugcacauuacgcuauaauuggaccuggauuacaagccaaggcuacccgugaggcucaaaagagaacugcagcgggcauaaugaaaaauccaacgguugauggaaucgucgcaauagaucuugaccccguuguguacgacgcaaaguucgaaaaacaauuaggacaaaucaugcugcucauacuauguaccucucaaauacuguugaugcgaacaacgugggcucuaugcgaauccauuacccuugcuacagguccauuaacuaccuuaugggaagguucucccggaaaauuuuggaauacaacuauagcgguguccauggcaaauauauucagggggagcuaucuggcaggagccggacucgccuuuucuuuaaugaaaagucuaggugguggcaggagggguacuggcgcacaaggggaaacacuuggagaaaaauggaaaaggcaacugaaucaacuaucaaagagugaguucaauaccuauaagagguccggcauaauggaaguagacagaagugaagccaaggagggcuugagaagaggagaaacuacaaaacaugcuguuucaagggggacugccaaauuaaggugguucguggagcgaaaccugguuaagccagaaggaaaggucauagaccucgguuguggucgaggaggguggaguuauuauugugcagggcuuaagaaagugacagaagucaaaggauauacuaaaggagggccgggccaugaagaaccaaucccuauggcaacuuacggauggaacuuaguaaagcugcauaguggcaaagauguauucuucauaccaccagagaagugugauacucuuuuaugugauauuggagaaucuucaccaaauccuacaaucgaagaaggaagaacgcucagaguucucaaaaugguagaaccauggcucagagguaaucaauucuguaucaagauucucaacccuuauaugccaucuguagucgaaacauuggaacaaaugcaaagaaagcaugguggcaugcuaguaaggaauccacucucuagaaauucuacucacgaaauguacuggguuucguguggaacagggaacauagugucggcuguuaauaugacaaguaggauguuauuaaaucguuucacaauggcacaucguaagccgacuuaugaacgcgauguugaucuuggcgcggggacccgacauguagccguagaaccagaaguagcuaaucuugacauaaucggacaacgaauugaaaacauuaaacaugaacacaagucuacauggcacuaugaugaagauaauccauauaaaacaugggcuuaccacggcucauacgaagugaaaccgaguggaucugcaaguaguaugguaaacgguguuguuaaguuacucacaaaacccugggauguaauaccuauggugacucagauagcaaugacugauacuacuccauuugggcagcagagaguuuucaaagaaaagguugauacaaggacaccgaaggcuaaaagaggaacagcacaaauuauggagguaacugcucgauggcuuuggggauuuuuaucucgcaacaagaaaccaaggauauguacacgggaagaguucacccgaaaaguucgcucgaaugccgcgauuggagcaguuuucguggaugaaaaccaauggaacuccgcaaaagaggcgguagaggacgaacgcuuuugggacuugguacacagagaacgagagcuacacaaacaggguaaaugugccacguguguguauaauaugauggggaaacgcgagaagaaacuaggggaauuugguaaagcuaaaggaucccgagcgauuugguauaugugguuaggagcuagauuccuggaauuugaagccuuaggauucaugaacgaagaucacugguucucaagagagaauagucuaaguggcguugaaggagaagggcuacauaaauuagguuacauccucagagacauuucaaagauacccgguggaaauauguacgcugacgauacugcgggaugggacacgcgaauaaccgaagacgacuuacaaaaugaagccaagaucacugauauaauggaaccagaacacgcucuacucgccacgucgaucuuuaaauugaccuaucaaaauaaaguaguuaggguccaaagacccgcccgaaacggcacgguaauggacguaaucuccaggagagaccaaaggggcucgggacagguuggcacauauggucuaaacacuuuuacaaacauggaagcacaacuaauacgacagauggaaucagaagggauauucagcccuagcgagcucgaaacgccaaaucuugcugaaagaguucuugauuggcuagaaaagcaugguguagaaagacuuaaaagaauggcuaucaguggugaugauugcguugucaaacccauagaugauagauuugccacggcucuauccgcgcuaaaugauauggguaagguuagaaaagauauuccgcaaugggagccaucgaaaggauggaaugauuggcaacaggucccauuuuguucccaucauuuccaucaacuaaucaugaaagauggacgagaaauaguuguuccaugucggaaucaagacgagcuaguuggacgggcgagggucagccagggagcuggauggucacuaagagaaacugcgugucuuggaaaaaguuaugcgcaaauguggcagcuaauguauuuucauagacgugaccugaggcuugcugcuaacgcaaucuguagcgcuguucccguggacugggucccaacaucacggacaacuuggucuauccacgcacaccaucaauggaugacuacagaagauauguuauccguauggaauaggguauggaucgaagaaaaccccuggauggaggauaaaacgcacauaaguucauggggagacguaccuuacuuaggaaaaagagaggaccaaugguguggcagccuuauuggucucacggcaagagcaacuugggcaacaaauauacagguagcaauaaaucaaguaaggagacuaauagggaacgagaauuaucuugacuauaugacaaguaugaaaagauucaaaaacgaaucggauccugaaggagcauuaugguga

SEQ ID NO: 21746 - RNA, 9879 nt, Artificial Sequence
  derived and/or modified CDS sequence (opt6) from DENV-1__FJ898408__SS-prME
ucaguaacaauguuacuuauguuaaugccaacugcacucgcauuucauuuaacaacaagaggaggagaaccgcauaugauaguaacuaaacaagaacguggaaagagcuuacuuuucaaaacgucggcaggagucaauaugugcaccuuaauagcaauggauuugggagaacuaugcgaagacaccaugacauauaaaugcccacgcauaaccgaagcugaaccggacgacguugauuguuggugcaacgcuacggauacaugggucacuuauggaacguguagccaaacgggggaacaucgcagggauaaacgauccguggcauuagcaccacaugucggauuaggguuggagacaagaaccgaaaccuggaugucuucagaaggcgcauggaaacaaauucaacgaguagaaacaugggcucuacgucacccagguuuuacugucauagcacuauucuuagcacacgcaauaggaacaagcauaacacagaaagggauuauauucauccuauugaugcucguaaccccuuccauggcgaugagauguguuggaaucgggucacgagauuuugucgaaggacuuucaggggcaacauggguagauguuguucuugaacauggcaguuguguaacaacuauggcuaaagauaaaccaacauuggauauagaauuauuaaaaacagaagucacaaacccugcgguacugagaaaauuauguaucgaagcaaaaauaucaaacacaaccacagacucaagguguccuacacaaggggaagcgacguugauggaagaacaagaugcaaacuuuguaugucgaagaacauuuguagauagaggcugggguaauggguguggucuguucggaaaaggaaguuuaauuacaugcgccaaauucaaaugcguaacaaaauuagaagguaaaauaguccaguaugaaaaucuuaaauacaguguuauagugacaguccacacuggagaccaacaucaaguuggaaacgaauccaccgaacaugggacaaccgcaacgauaacgccccaagcuccaacaucggagauacaguuaacagauuacggcgccuuaacgcucgacuguucgccccgcacuggacucgauuuuaaugaaaugguauuguuaacuaugaaagaaaaaucgugguuagugcauaaacaaugguuuuuagacuugcccuugcccuggacaucaggcgccucuacaucccaagaaacguggaaucgacaagaucuauuaguuacauuuaaaacagcacaugccaagaaacaagaagucguaguucuagguagucaagaaggggcgaugcauaccgcccuuaccggggccacugaaauccagaccucgggaacgacaacaaucuuugcuggucaucugaaauguagguuaaaaauggacaaacucacauugaaaggaaugucauacgugauguguacaggaucguucaaacuggagaaagaaguagccgaaacucaacacggcacuguccuaguccagauuaaauacgaggguacagacgcaccaugcaaaauaccguuuucuacucaagacgaaaaagguguuacacaaaauggucgacugaucacagcaaauccgauagugaccgacaaggagaaaccuguaaacauagaagcagagcccccguuuggagaaaguuauauugugauuggagcaggagagaaggcuuuaaaguuaucuugguuuaagaaaggauccaguauuggcaaaauguucgaagcaacggcuagaggcgcuagacgcauggcuauauugggggacacagcaugggacuucgguagcauaggcggaguguuuacaagcguagggaaacuuguccaccaaauauucggaaccgcauacggaguauuauucucagggguaagcuggacaaugaaaauuggaauuggaguucuacuuacguggcugggccuaaauucaagaucaacaucucuauccaugacauguauagcggugggguuagugacacuguauuuggguguaaugguucaagcugacaguggcuguguaauuaauuggaagggacgagaacuuaaguguggcagcggaauuuuuguaacaaaugagguucauacuuggacagagcaauacaaauuccaagcugauucaccuaagcgauuaucugcagccauaggaaaggcuugggaagagggagucuguggcauucggucagcuacucgucuugaaaauauaauguggaaacaaauaucuaacgaauuaaaucauauacuccucgagaauggaaugaaauuuacagugguagucggagauguuguuggaauacucgcgcaaggcaagaaaaugauccguccccaaccuauggagcauaaauacaguuggaaaucuugggguaaagcaaaaauuaucggagcugacguucagaauacaacauuuauaauugaugguccaaauacaccagaauguccagacgaucaaagagccuggaauauuugggagguagaggacuaugguuuugguauauuuacaacgaauaucuggcuaaaacuccgugauucuuauacgcaagugugugaucaucgacuuauguccgcagcgauuaaggauucaaaagcuguacacgcugauaugggguauuggaucgagagcgagaagaacgaaacuuggaaauuagcccgugccuccuucauagagguuaaaacauguaucuggccaaagucgcacacauuauggagcaacggcguauuagagagcgaaaugaucauaccuaaaauuuauggaggaccuauaagucagcacaacuacaggcccgguuauuuuacucagacagccggccccuggcacuugggaaaacuagaauuagauuucgaucuaugugaagguacaaccgucguaguugacgagcauugcggaaauagaggcccgucauugcgaacaacaaccguaaccggaaaaauaauacaugaauggugcugcagaucgugcacauuaccaccuuugcgauuuaaaggagaagauggcugcugguaugguauggagauuaggccaguaaaagaaaaagaagagaaccuaguuaaaucgaugguaagcgcgggaucuggagaaguugacuccuuuucguugggacuauugugcacaaguauaaugauugaagaaguaaugaggucuagguggagucguaaaauguugaugacaggaacccuggccguuuuucuccucuuaauaaugggccaacucaccuggaacgacuugauucgacuauguauuaugguaggcgcgaaugcaagugacagaaugggcauggggacaaccuaccuugcauuaauggccacauuuaaaaugaggcccauguuugcaguugguuuacuauuuagaagacuuacaagucgugagguuuuacuacuaacaauaggauugucccuuguugcuaguguugaacuaccuaacagucuugaggaacuaggagacggccuagcuauggguauaaugaucuuaaaacuauuaacagacuuucaaucgcaucaauuaugggcuacauugcuuucucuuacuuucauaaaaacgacacuauccuuacauuaugcuuggaagacaauggccauggugcuaagcauaguuucuuuauucccauuauguuuaucaacgaccucacagaaaacuaccugguugccaguacuccuuggcucauuagguuguaaaccgcuaacaauguuucuaauagccgagaacaagauuugggguagaaaauccuggccuuuaaacgaagguauaauggcuguagggguaguuagcauauugcucaguaguuuacuuaaaaaugacguaccauuagcggguccucuaauugccggugguaugcuaauugcuuguuauguaauuucaggcucauccgcagacuugagccuagagaaagcagcggaagugucaugggaggaggaagcugaacacagcggcgcuagucauaauaucuuaguagaggugcaggacgaugguaccaugaaaauuaaagacgaggagagagaugauacacuaacaauacuucuaaaggcuacuuuacuugcaguaucuggaguguauccacuaaguauacccgcuaccuuguuuguuugguauuuuuggcagaaaaagaaacaacguaguggaguguuaugggacacaccaagucccccagaaguagagagggcaguauuagaugaugguauauauagaauaaugcaacgugggcuacuagggcgaucacagguuggaguuggcguauuucaagaaaacgucuuucauaccauguggcacguaacaagaggcgcaguacuaauguaucaaggaaaaaggcuagaaccguccugggcaucggucaagaaagaccuuauuucuuauggaggaggauggagacuacaaggaagcuggaacacgggagaagaaguucaaguaauugcagucgagccagggaaaaauccuaaaaauguacagaccgccccggggacauuuaaaaccccagagggagaaguaggagcaauagccuuggacuucaaaccggguacgagcggauccccuauaguaaaccgggaagguaaaauaguagguuuauauggaaauggugucguaacuacaagugguacauaugucagugcgauugcccaagcaaaggcgucucaagagggaccguuacccgaaaucgaagacgaaguauucagaaaaagaaaccucacgauuauggauuuacauccggguucuggcaaaacaagaagauaucuuccugcgauagugcgagaagcuauaaaacgaaagcuacgaacuuuaauauuggcaccuacuagaguagucgcaagcgaaauggccgaggcacuaaaagguaugccgauaagauaccaaaccacugccgucaaaagcgaacacacggggaaagaaauaguugaucuaaugugccacgcuacauucacaaugcgauugcuuucaccagugagaguaccuaauuauaauaugauaaucauggaugaggcccauuucaccgauccuucaagcauagcugcgcggggguauauaagcaccagagucggcaugggcgaagcugccgcaaucuucaugaccgcgacaccaccaggaaguguagaagcauuuccucaaagcaacgcaguuauucaagaugaagaacgugauauuccagaacgaagcuggaacucaggauaugaauggauaacggauuuuccuggaaagacugucugguucgucccaucaauaaagagugggaacgauauagcuaauugcuuacgcaaaaacggaaaaaggguaauucaguuaucaaggaagacauucgauacggaauaucagaagacuaaaaauaacgacugggauuauguaguaacaacugauauaagcgaaaugggggcuaacuuucgagcagauagaguaaucgacccacgaagauguuuaaaaccuguuauucuaaaagauggaccagagcgaguuauacuugccggcccaaugccagucacgguggcaagugcagcgcagaggagaggaaggauagguagaaaccauaauaaagaaggagaucaauauauauauaugggucaaccacucaauaaugaugaagaccaugcccauuggacggaagcuaaaauguuguuagacaacauaaauacgcccgaaggaauuauuccggcuuuguuugagccagaaagagagaaaagugcugcaauagacggggaguaucgcuuacggggagaggccagaaaaacguuugucgaauuaaugagaaggggagaucuacccguuuggcuuagcuauaaaguagcaagcgagggguuccaguauucugaucgaagguggugcuucgauggagaaaggaacaaccaaguccucgaggaaaauauggacguagaaauauggacaaaggaaggggaaaggaagaaacugagaccaagaugguuggaugcgaggacauauucagauccacuagccuuaagagaauuuaaagaauuugcagcugggcgcaggucuguaagcggggauuuaauauuggagauaggaaaacuuccccaacauuuaacucaacgagcacaaaaugcauuagacaacuuaguuauguuacauaauagcgaacaagguggcagagcguaccgccaugccauggaagaacucccggauacuauagaaacuuuaaugcuucuagcacucaucgccguacuaacagguggcguaacucucuuuuuccuaucaggaaggggacugggaaaaacuucaaucggcuuauuguguguaauggccaguucaguauuauuauggauggcaucgguggaaccacacuggauagccgcaucgauuauacuagaguuuuuccuaaugguccuacugauaccggaacccgaccgacaaagaacaccacaagauaaucaauuagcauacguagucauaggacuacuuuucaucauacuuaccguugcugcgaacgaaaugggucuucuagagacaacaaagaaagaucucgggauaggccauguagcgguagaaaaucaucaucaugcgacaaugcuagacgucgacuuacauccugcuagcgcuuggacauuguacgccgucgcgacuacaauuauaacaccaaugaugcggcacacgauagaaaacacuacagcuaacauaaguuuaacagcuauagcaaaucaagcggcaauccuuaugggucuggauaaaggcuggccuauuagcaaaauggauauaggaguuccucucuuagcacuaggaugcuauucucagguuaacccacuuacauuaacggcugcagucuuaauguugguugcacacuacgcuauuauaggaccuggacuucaagcuaaagcuacccgagaggcacaaaaacgaaccgcagccggcauuaugaaaaacccaacgguagaugguauuguggcgauugauuuagauccaguuguguacgaugcuaaguuugagaaacagcucggacagauuaugcuauuaauauuauguacaucacagauacuucucaugcguacuacaugggcacuuugugaaucaaucacguuagcaacgggucccuuaaccacgcuaugggaggguucaccagguaaauuuuggaauacuacuauagccguaucaauggcuaauauauuccgaggaagcuaccuugccggugcgggacuagcguuuucccugaugaagucgcuaggcggagggcgaagaggcaccggagcucaaggggaaacauuaggagagaaguggaagaggcaacuuaaucagcugaguaagagcgaauuuaauauauauaaaagaucaggaauuauggagguugaucgcuccgaggcaaaagaaggccuuaaaagaggggagacuaccagacaugccgugagcagaggaacugcaaaacugcggugguuuguugagagaaauuuaguaaaacccgaagguaaggugauagaccuaggcugcggucguggaggauggaguuauuauugugcaggccuaaagaaaguaaccgaaguaaaaggauauacuaaaggcgggccaggacacgaagaaccaauaccuauggccacguacggauggaaucuuguaaaacuucacucagguaaagacguauucuuuacgccuccagaaaaaugcgacacucugcugugugauauaggugagaguucacccaacccgacaauagaggaaggaaggacucuacgugugcuuaaaauggucgaaccuuggcuccgagguaaucaguuuuguaucaagauuuuaaacccauauaugcccaguguuguagaaacauuagaacaaaugcagaggaaacacgguggaaugcuuguccgaaauccucucucucgcaauagcacccaugaaauguauuggguaucaugcgguacagguaacaucgugagugcugucaacaugacaucucgaaugcuguuaaaccgguucacaauggcacaucguaaaccaaccuacgagagggaugucgauuugggggcuggaacaagacaugucgcaguagaaccagagguugccaaccuugacaucauuggacagaggaucgaaaacauaaaacacgagcauaagucuaccuggcacuaugaugaagacaacccuuacaaaacuugggcguaucacggaaguuacgaaguaaagccaaguggaagugcgucaucaaugguuaauggaguagugaaguuacugacaaaaccaugggacgucauaccaaugguaacccagauagcgaugacagauacaacccccuuuggucaacagagaguuuucaaagagaaaguggacacaaggacaccaaaagcgaaaagaggcacugcacaaaucauggaagucacggcacguuggcuauggggcuucuuauccagaaauaagaaaccucguaucuguacaagagaggaauuuacucgaaaaguaagaucuaacgccgcaauaggcgcaguguucguugacgagaaucaauggaacagugcaaaagaggcaguggaagacgagagauuuugggauuuaguucaaaaggaaagggaacugcacaaacagggaaaaugcgcuacauguguauauaauaugauggggaaaagagagaagaaauuaggagaauuugguaaagcgaaaggaagccgagccauaugguacaugugguuaggagcaagauucuuagaguuugaggcacuuggguucaugaaugaagaucauugguuuucaagggaaaauagccuaucaggaguggagggugaaggccugcauaaauuaggauauauccuuagagacauaucgaaaauccccggagggaauauguaugcugacgacacagcgggaugggauacucgcaucacugaagaugaucuacaaaaugaagcaaagauaacagacauaauggaaccugaacaugcgcuauuggcgacaucaauuuucaaguuaacuuaucagaacaaaguuguuagaguacaaagaccagcaaagaauggcacaguaauggauguaauaucccggcgagaccagagaggaaguggccaaguaggcacauacggucugaauacauuuacaaauauggaagcacaacuaauaagacagauggaaagcgaagguauuuuucuacccucggaauuggaaacuccaaaucuggcggagagaguucuggacuggcuugaaaaguauggagucgaaagacuaaaaagaauggcaaucucaggcgacgacugcguagugaaacccauagacgaucgcuuugcaacagcuuuaacagcucuuaacgauaugggaaaaguacgaaaagauauaccgcagugggaaccauccaaaggauggaaugauuggcaacagguaccauuuuguagccaucauuuucaucaacuuauaaugaaagaugguagagaaauaguaguaccuugucggaaucaagacgaauuaguagguagagcgagggucagucagggcgcaggguggucacuacgugaaacagcaugccuaggcaaaucauacgcucaaauguggcaacuaauguauuuucacagaagagaucuuagacuugcggcaaaugcuauauguagcgccgaucccggagacugggugccaacgucgagaacgacauggucaauccacgcacaccaccaauggaugacgacagaggauauguugucaguauggaacaggguguggaucgaagagaaccccuggauggaggauaaaacucacgucuccaguuggggcgacgucccuuauuuaggaaagagagaggaucaauggugugguucauugauaggguugacugcuagagcaacuugggcaagcaauauacaaguugcaaucaaucaaguucgaagacuuauaggcaaugaaaauuaucucgauuacaugacgagcaugaaaagguuuaagaaugaaggagauccagaaggggcccuaugguag

SEQ ID NO: 21747 - RNA, 9879 nt, Artificial Sequence
  derived and/or modified CDS sequence (opt6) from DENV-1__GQ199843__SS-prME
ucugugacaauguuacuuauguuaaugcccacagcucuugccuuccacuuaacgacacguggaggagagccacacaugaucguuucaaaacaagaaaggggaaaaucuuuguuauucaaaacaucugcggggguaaauauguguacguuaauagcuauggaucuuggagaauuaugugaagauacaaugacauauaaauguccgcguauaacggagguugaaccugacgauguggauuguugguguaauaccacugauacaugggugacuuaugguacaugcucgcagacaggggaacauaggcgcgauaaacgaaguguagcauuagcaccacauguagguuuagguuuagaaacaagggcagagacguggaugaguucggagggugcauggaaacagauacaaaaagucgaaacaugggcauugcgucauccaggauuuacgguaauagcauuauucuuagcacaugcuaucggaacuuccauaacccaaaaagguauaauauuuauacuuuuaauguuaguuacacccucgauggcaaugagaugugugggaaucggcucuagagacuucgucgagggccuuucaggagcgacuuggguagaugugguacuugaacaugggaguuguguaaccaccauggcgaaagauaaaccuaccuuagacauagaacuacuuaaaacagaaguuacuaacccugcuguucugaggaaacuuuguauagaagcaaagauaaguaacacuacaacggauucuagaugcccgacacaaggagaagccacucuuguagaagaacaagacgcuaauuucgugugcagacgcaccuuuguugaucgcggaugggggaacgguuguggccuauucggaaaaggcagucucauaacaugcgccaaauuuaagugugugacaaaauuagaagguaaaauaguacaauacgagaauuuaaaauauaguguuauuguuaccguccauacaggagaucaacaucaaguaggaaacgaaaguacagaacacggaacaacggcaacaauuacgccacaggcacccacuucagaaauucagcuuacagacuauggagcccuaacauuagauugcuccccucggacgggcuuggauuuuaaugagaugguacuucuuacaaugaaagagaaaaguuggcuaguacauaaacaaugguucuuagaccuucccuuaccuuggacaucuggugccucuacuagccaggagacauggaaucggcaagaccucuuaguaacauucaagacugcacaugcuaagaagcaggaagugguuguucuuggaucgcaggaaggagccaugcauacagcgcucacaggugccacagaaauucagacauccggaacaacuacgaucuuugcuggacauuugaaguguagauuaaagauggauaaacuaacuuuaaagggaaugaguuauguuauguguaccggaaguuucaaacuagaaaaagaaguagcagaaacacaacauggcacuguuuuaguucaaauaaaauacgaagguacagacgcacccuguaaaauccccuuuaguacacaagacgagaaaggcgugacgcaaaaugggaggcuaauuaccgcuaaucccaucguaacugauaaggaaaaaccggucaauauugaggcugaaccgcccuuuggggaaucauauauuguaaucggugcaggagaaaaagcauuaaaacuuucaugguucaagaaaggcuccucuaucggaaagauguuugaggcuacagcaagaggcgcaagacggauggcaauacuuggcgauacagcuugggauuuugguucaaucggaggagucuuuaccucuguaggaaaguuaguccaucagauauuuggcacggccuauggcguucuauuuucagggguuagcuggacuaugaaaauugggaucggaguacuucuaacauggcugggauugaacucaagaaguacaucccuaaguaugacuugcauugccguugggcuuguuacuuuguaucucgguguuaugguucaggcugauucaggcugcgugauaaauuggaagggacgugaacuaaaaugugguucugguauauucgugacuaaugaaguucauacauggacggaacaauacaaauuccaagcagacucaccuaaaagguugucagcugcuauugguaaagcgugggaagaaggaguaugcgggauucgaagugccacgagacuagagaauauaauguggagacaaauaucuaacgaauugaaucacauucuacuggaaaacgacaugaaauuuaccguuguggucggcgaugucguagguauuuuagcacagggcaagaaaaugauuagaccacaaccuauggaacauaaauacuccuggaaaucguggggcaaggcaaaaaucauaggagccgauguccaaaacacaacauucaucauugacgguccuaauacacccgaguguccagacgaucaaagagcuuggaauauuugggaagucgaagacuacggguucggaauuuuuacaacgaacauauggcucaagcuaagggauagcuacacacagguaugcgaccaucggcuuaugucugccgcgauuaaagacucuaaggcaguacacgcggauaugggauacuggauagagucagagaaaaaugaaaccuggaaauuggcucgugcaaguuuuauagaaguaaagacuugcauauggccuaaaucacauacauuauggucgaacggcguuuuagaaagcgaaaugauaauaccaaagauauauggaggaccaauuucacaacauaacuacagaccagguuauuuuacucagacugccggaccguggcaccuaggaaaauuagaacuagauuuugaucuaugugaagguacaacaguugucguagacgaacacugcggcaaucgaggaccuaguuuaagaacaacuacaguaacuggaaaaauuauccaugaaugguguuguaggucguguacacucccuccuuugagguuuaaaggugaagaugggugcugguaugggauggaaauaagaccaguaaaagaaaaggaggagaaccuaguaaagagcauggugucugcugguuccggagaaguagauucuuucucacucggacuccuauguauuucaauuaugauugaagaaguuaugagauccaggugguccagaaagauguuaaugaccgggaccuuggcuguguucuuucugcuaauuauggggcaauuaacauggaacgaucugaucagaaguuguauaaugguaggugcaaaugcaagugaccguaugggcaugggaacaacauacuuagcauugauggcuacuuuuaaaaugagaccaauguucgcuguugggcuguuauuuagaaggcugacguccagagagguauugcuacuuacuauagguuuaagccucguggccagcguugagcuaccaaacucguuggaggagcuaggugauggucuagccauggggaucaugauauuaaagcuguuaacagacuuucagucuuaucaauuaugggccacucuauuaucacuaacguucauuaaaacgacguuuagucuacacuaugccuggaaaacuauggcuaugguuuugucaaucgugagucugcucccguuaugucucaguacgacaagucagaaaaccacauggcuaccaguucuauuaggcaguuuggguugcaaaccauuaaccauguuccuaaucgcagaaaacaagauauggggacggaaauccuggccauuaaaugaaggaauuauggcgguaggaauagucucuauuuuacuaucaucauuacuaaagaaugacguuccuuuagcagggcccuuaauagcaggcggaaugcucauugcgugcuacguaaucagcggcuccucugccgaccugucuuuagaaaaagcugcagagguaagcugggaagaggaagcagaacauucgggugcuagucacaauauucucguagaaguacaagaugaugggacaaugaaaauuaaagacgaggagcgcgaugacacccuuacaauauuacuaaaagcaacacuccuagcaguaucuggcguauauccccuaucgauaccugcaacacuuuuuguuugguauuuuuggcagaagaagaaacaacgaucaggaguacuuugggauacuccaagucccccugaaguugaacgugccguacuugaugacggcauuuauaggauaaugcagcgcggauuauuaggccgaagccaaguaggaguaggcguuuuucaagaaaauguauuucacacgauguggcacgucacgagaggagcuguacuaauguaucagggaaagagauuggaaccaucaugggcaagugucaagaaagaucuuauaucauacgggggaggcuggagauugcaagggaguuggaauacuggcgaagaaguacaagugaucgcagucgaaccaggcaaaaaucccaaaaacguucaaacagccccaggaacauuuaaaacgccggaaggagaagucggagccauagcccuggacuuuaaaccagguacuagcggaaguccgauaguaaacagagagggaaagauuguaggauuauauggaaauggaguugucacgacaagugguacuuaugucagugcaauagcacaggcuaaggcuagccaagaggguccauugccugaaauagaggacgaaguguucagaaaaagaaaccugaccauaauggaucuucauccaggcaguggaaaaacaagaagauaccuuccggcaauaguacgugaagccauuaaaaggaagcuaagaacauugauucucgcuccuaccagggucguggcauccgaaauggcagaagcauuaaaagguaugccaauacgauaucagacaaccgcgguaaaaucagaacauacaggacgagaaauuguagauuuaaugugccacgcaaccuuuacaaugagacugcuaucgccagugagaguaccgaacuauaacaugauaaucauggaugaagcacacuuuacagauccaucuagcaucgcagcaagaggcuacauaucuacccgugugggcaugggagaggcagcagcuauuuuuaugacagccaccccacccggaagcguugaagcguucccacagucaaacgcagugauacaagaugaagaaagggauauacccgaacgaagcuggaacucaggauaugaauggauaacugauuuuccuggaaagacugucugguuuguaccaucuauaaagucaggaaacgauauagcuaauugucuccguaaaaacggcaaacggguuauucaguuaaguaggaaaacauucgauacugaguaucagaaaaccaaaaauaaugacugggauuauguagugacaacagauauuucagaaaugggugcaaauuuucgugcugaucgcgugaucgacccuagaaggugucugaaacccgucauucuaaaagauggaccggaacguguuauauuggcaggaccgaugcccgugacaguagcaucugcagcacaacgacgaggcaggaucgguagaaaucauaauaaagaaggugaucaguauauauauaugggacaaccucuuaacaaugaugaagaucaugcgcacuggacagaagcaaaaauguuacuagauaauauaaacacacccgaaggcauaauuccagcauuauucgagccagaaagggagaaaagugcggccauagauggcgaguaccgccuacguggagaagccagaaaaacuuucguugaacugaugaggcgcggagaucugccaguauggcuauccuacaagguugccagugaaggguuccaauauagugacagacggugguguuuugacggugaacguaacaaccaaguacucgaagagaauauggauguagaaauauggaccaaagaaggcgaaagaaagaaacuccgaccucgcuggcuagacgcacgaacuuauagcgacccccuugcuuuacgugaauuuaaagaauuugcugcuggccgaagaaguguuucgggugauuugauauuggaaauaggcaaauuaccucaacacuuaacccaaagggcacagaaugcucuagacaaccuaguaaugcuacacaacagugaacaaggaggacgagcuuacagacaugcuauggaggaacucccugauacuauagagacgcuaauguuguuggcguuaauagcuguccuaacaggaggcguuacacuauucuuuuuauccggccgaggauugggcaagacgucaauuggcuugcuuugugucauggcuucaucagcucuacuauggauggcaucagucgaaccacauuggauugcagcaagcauaauccucgaguucuuuuugaugguacuauuaauuccugaaccugacagacaaagaacaccacaagacaaucaacuugcuuacguagucauaggauugcuauucaugauucuuaccguagcagcaaaugaaaugggguuacuagagacaacuaagaaagauuugggaauaggacaugcagcaguagaaaaccaucaccacgcuacaaugcuagauguugauuuacacccagcaucagcauggaccuuauacgcaguagcaacuacuauuauaacuccaaugaugagacauacuauugaaaauacuacagcaaauauuagcuuaaccgcaaucgcuaaucaagcagcaauauuaaugggauuggauaaggguuggcccauauccaaaauggacaucggaguaccauuacuagcacuaggguguuauagccaaguuaauccucucacuuuaacggcagcaguacugaugcucgucgcacauuacgcaauaauaggacccggguuacaagcuaaagccacccgugaagcacagaaacgaacugcagccgguauaaugaagaaucccacugucgaugguaucguugcaauugaccuugaccccguaguauacgacgcuaaguucgagaaacaauugggucaaauaaugcuccucauccuuugcacaucucaaauacuacuaaugaggacuacgugggcacuaugugaauccauaaccuuagcaacaggcccacuaacaacucugugggaaggaagcccuggaaaauucuggaauaccacgauagcaguaucgauggcuaauauuuuccgaggaucauauuuagcaggggcgggauuagcuuuuucgcucaugaaaucucuugguggagggagacgcgggacaggugcccagggugaaacccuuggggaaaaauggaaaagacagcuaaaucaacuaucaaaaagugaauuuaacacuuacaaaagaucugguauaauggaagucgacagaagugaggcaaaagaaggauugcgacggggugaaacgacaaaacacgcaguaucaagggggacggcaaaacuuagaugguuuguagaaaggaauuuaguuaaaccugaggguaaagucauugaccugggauguggcaggggaggauggaguuauuauugugcuggacucaagaaagugacagaagugaagggauauacuaaaggggguccaggucacgaagaacccauaccaauggcuacauacggcuggaacuuaguaaaacuacacucaggaaaggacguuuucuuuauuccaccggaaaaaugugacacccugcuaugugauaucggcgaaucgucucccaacccgacaauagaagaagguagaacgcuucguguauuaaaaaugguagaacccuggcugcgagggaaccaauuuugcaucaaaauucugaacccauacaugccaucgguagucgaaacauuagaacagaugcaaagaaaacacggcgguaugcuaguucgaaacccacuaaguaggaauaguacacacgaaauguauuggguaucguguggaacgggcaauauuguuuccgcggucaauaugacaucacgaauguuguuaaaucgauuuacgauggcucacagaaaaccaacauacgaacgcgaugucgaucuaggcgcaggaacaagacacguagccguagagccugaagucgccaauuuagauauaauuggacagcgaauagaaaacauaaagcaugaacauaaaucuacauggcauuacgacgaagacaauccauauaagacaugggcuuaccaugguaguuaugagguuaaaccuagugguagcgcuucuagcaugguaaauggaguuguuaaacuucuaacuaagccaugggauguuauaccaaugguaacucaaaucgcuaugacagauacuaccccguuuggacaacagagaguauucaaagaaaaggucgauacuagaacccccaaggcaaagagaggaacugcccagauuauggaagucacggcacguugguuauggggcuuuuugucccggaauaagaaaccucgcauauguacaagagaagaguucacccgaaaagucagaaguaaugcagcuauuggagcaguguuugucgaugaaaaucaguggaacucugcaaaagaagcagucgaagaugagagauuuugggauuuaguacaucgggagcgcgagcuacacaagcaaggcaagugugccacauguguguacaacaugauggguaaacgcgagaagaaacuuggagaguuuggcaaggccaaaggaagucgagcaauuugguauauguggcuuggcgcuagauuucuugaguuugaagcguuggguuuuaugaaugaggaccauugguucucuagggagaacaguuugucagguguugaaggugaggguuuacauaaauuagguuacaucuuaagggauauaucuaaaauaccuggcggaaauauguaugcagacgauacagcagguugggacacccgaauaacugaagacgaucugcagaaugaagccaaaaucacugauaucauggagccagaacacgcucuacuagcaacaaguaucuucaaauugacuuaccaaaauaagguugugaggguacaaagaccagcacguaauggcaccgucauggaugucauauccagaagggaucaaaggggcucaggccagguagguaccuauggauuaaauacauuuacgaacauggaagcacaacuaauaagacaaauggaaagcgagggcauauuuaguccgagugaauuagaaaccccaaaucuagccgaaagaguguuggacuggcucgaaaagcacggaguagaaagauuaaaaagaauggcaauuuccggcgaugauugugucgugaaaccaauugaugaucgguucgcaacugcguugucagcauuaaacgauaugggaaaaguccguaaagauauuccccaaugggaaccaucaaaagguuggaaugacuggcaacaaguccccuuuuguucacaucauuuccaucaacuaauaaugaaagauggcagagaaaucguaguuccuugccguaaccaggacgaauuaguaggcagagcaaggguuucucaaggagccggauggaguuuaagagaaacagcaugcuuaggaaaauccuaugcgcaaauguggcagcucauguauuuccauagaagagaccuacgucuggcagcaaaugccauauguucggcgguuccugucgacuggguccccacuucaagaacuacgugguccauacaugcacaucaccaguggaugacuacagaggacaugcucaguguuuggaauagaguguggauagaagaaaaucccuggauggaagacaaaacucauauaucuucuuggggagacguaccguauuuaggcaaaagagaagaucaauggugcggcucacugauaggacuaacugcacgggccacaugggcuaccaauauacagguagccauuaaucagguucgaagacuaauaggaaacgagaacuaucuagauuauaugacuucuaugaagagauucaaaaaugaaucagacccggagggcgcuuuaugguag

SEQ ID NO: 21748 - RNA, 9879 nt, Artificial Sequence
  derived and/or modified CDS sequence (opt6) from DENV-1__GQ199844__SS-prME
agcguaacuauguugcuuaugcuaaugccgacggcgcuagcuuuccacuuaacaacaaggggcggagaaccacauaugauugucacgaaacaagaacgaggcaaaucauuacucuucaaaaccagugcgggaguaaauauguguacucucauugcgauggauuuaggagaacuuugugaagauacaaugacauauaaaugucccaggauaacagaagcagaacccgacgacguagauuguuggugcaaugcaacagacacuugggugacuuauggcacauguucucagacaggugaacaccggcgggauaaacgcagcguagcacuugcaccucauguaggucuaggucuugaaacaagaaccgaaacauggaugucuucagaaggggcauggaaacaaauucaacggguagaaacgugggcauuaaggcacccuggauuuacaguuauugcuuuguucuuagcccaugccauaggaaccaguaucacacaaaaagggauaauauucauacuacuaauguuggucacgccgagcauggcaaugagauguguagguauaggaucaagggacuucguggagggguugucaggagcaacauggguggacguagugcucgaacacggaaguugcguuacuacgauggcuaaagauaaaccgacacuagauauagaacuacucaaaaccgaagucacaaauccagcaguauuacgaaaauugugcauagaggcgaaaauaucaaauacgacaacugauucaagaugcccaacacagggagaggccacauugauggaagaacaggaugcuaauuucguaugccgaagaacguucguagaucgaggauggggcaauggauguggguuauucggcaaaggaucccucauuacgugugcgaaauuuaaauguguaacgaaacuagagggcaagauuguacaauaugaaaaccuaaaauauucaguaauuguuacuguucauacaggugaucaacaccaaguagguaaugaaagcaccgaacacggaacgauagcaacaaucacaccacaagcgcccacauccgaaauacaauuaacggacuauggugcucucacauuagauuguucaccaagaaccggacuagauuucaacgaaaugguguugcuaacgaugaaagaaaagucuuggcuuguacacaagcagugguuccuugaccucccacuuccguggacgucaggagccucuaccucccaagaaacuuggaauagacaagaucugcucguuacuuucaagaccgcucaugccaaaaagcaggaggugguuguacuaggcucacaagagggugcgaugcauacugcacucacaggugcaacagaaauacaaacaucuggaacuacuaccauauuugcgggacauuuaaaaugucguuuaaaaauggacaaacugaccuugaaagggaugucguaugugauguguacaggaaguuuuaaguuagaaaaagagguagcugagacucaacacggaacaguauuaguacagauaaaguacgaagguacugaugcuccuugcaaaauacccuuuucaacccaggaugaaaaaggaguaacucagaacggaagacugauaaccgcaaauccgauaguuacagacaaagaaaagccagucaauauagaggcagaaccgccguucggagagucauauauuguaauaggagcgggugagaaggcauugaaguuaucaugguuuaagaagggaaguuccauuggaaaaauguucgaagcaacugccagaggagcuagaagaauggcaauucucggugauacagcuugggauuuuggaaguguaggcggaguuuucacaucuguuggaaaauuaguucaucagaucuucggaacagcguauggcguacuauuuucaggcguuaguuggacaaugaaaauagggaucgguguacuacuaacauggcuaggauuaaauucacguagcacaaguuuaaguaugacauguauagccguuggauuaguuacccuauaucugggagugauggugcaagcagacuccggaugcgucauuaauuggaaagggagggaacucaaauguggcagcggaauuuucguaacgaaugaaguucauacauggacagaacaauacaaauuucaagcagauagucccaaacgcuuaucugcagcgauuggaaaagccugggaggagggaguuuguggcaucaggucggcuacucgacuugagaacauuauguggaaacaaauaucuaacgaacuuaaccauauauuacuugaaaaugacaugaaauuuacaguagugguuggagauguaguuggaauacuagcacaaggcaagaaaaugauaagaccacagccaauggaacacaaauauucuuggaagaguuggggaaaagcaaaaaucauaggagcagauguucaaaacacaacguucauaauugauggaccgaauacgccagagugccccgaugaucaaagagcauggaauauaugggaaguugaggauuacggcuucgguauauucaccacuaauauaugguuaaaacuacgagacuccuauacgcaggucugugaucauagacugaugucggcugcgauaaaagacucuaaagccguacaugcagauaugggguacuggaucgaaucugagaaaaacgagacuuggaagcuagcucgagcgaguuucauugaggucaaaacuuguauuuggccuaagagccacacuuuauggucaaauggaguauuagagagcgaaaugaucaucccaaaaaucuaugggggaccaaucucccaacacaauuaucguccaggguacuuuacacaaacagcagguccguggcauuuagggaaguuagaauuagacuucgaucugugugaaggaacuacaguaguaguugaugaacauuguggaaaucgaggaccaucucucagaacuacuacugucacagggaaaaucauacaugaaugguguugcagaaguuguacauuaccgccccuaagauuuaaaggugaagauggauguugguaugguauggaaauacgaccaguaaaagaaaaagaagagaacuuagucaaaaguauggucucugcugguucuggagaagucgauucauuuucucugggccuacuuuguauaucaaucaugauagaagagguuaugcggucuagguggucgaggaagaugcuuaugacugggacuuuggcuguauuuuugcuauuaauaaugggucaacugaccuggaaugaucuuauucgauuaugcauaauggugggugcuaacgcgucugaccggaugggcaugggcaccaccuauuuagcccuaauggcuacuuuuaaaaugagaccuauguuugcuguaggacuucuuuucaggcgccuuacuucaagggagguacuauuacuaaccauugguuuaucuuugguagcuaguguagagcuuccuaauucauuagaagaacuuggcgauggccuagcgaugggaauuaugauauuaaaacuucuuacggauuuucaaagucaucaacuaugggcuacacuauugagccugacauuuauaaagacuacacuuucgcuacacuaugcuuggaaaacaauggcaaugguauugucaauugcuucacuuuuuccccuaugcuugagcacaaccucccaaaagaccaccuggcuaccaguacuucuaggaucacugggguguaagccgcuaacaauguucuuaauaacagaaacgaaaauauggggccgaaaaucauggccacuaaaugaaggaauuauggcgguaggcguagucucaauuuuacuuuccagccugcugaaaaacgaugucccauuagcagggccgcuuauagcaggaggaaugcuuauugcguguuaugugaucucaggaucgagugcagaccuaucauuggagaaagcggcagaagugucgugggaagaagaagccgaacauucaggagcgagccauaauauucuagugguugugcaagaugaugguacgaugaaaauuaaggacgaggaaagggaugauacauugacgauucuacuaaaagcuacacuauuggcgguuaguggaguguaucccuugucuauacccgcaacccuguucguuugguauuucuggcaaaagaagaaacaacguaguggaguccugugggacacuccaaguccaccggaaguugagagagcaguccuggaugacggaauauaccgaauuaugcagcgugguuuguuaggccgaagccaaguagggguugguguguuucaagaaaaugucuuccauacuauguggcacguaacuagaggggcaguuuuaauguaccaaggcaaaagacucgaaccuuccugggcuagugucaagaaagaucuuauaaguuaugguggcggauggaggcuacaaggauccuggaauacaggagaagaggugcagguaauagcgguugaacccggaaagaaucccaaaaauguacaaacggcaccgggcacuuuuaaaacuccagaaggggaagugggugcaaucgcgcuggacuuuaaacccggaacaaguggaucuccgauaguaaauagggaaggaaaaauugucggguuauacgguaaugggguaguaaccacaagugguacauacguaucagcgauugcacaggcaaaagcaucucaagaaggaccacuacccgaaauugaagacgaaguauuucgaaagagaaauuuaaccaucauggaccugcauccaggaagugguaaaacaagacguuaccucccugcaauaguccgcgaggcaauuaaacgaaaacuccgcacgcucauacucgcaccuacaagaguaguagcaucugaaauggcugaagcucuuaaagguaugccaauuagauaucaaaccacagcgguaaaaagcgagcacacagguaaagagaucgucgauuugaugugucaugcaacguucacuaugagacucuuaagccccguucgaguuccuaauuauaauaugauuaucauggaugaagcacauuucacagacccauccagcauagccgcaagaggcuacauaaguacacgcguugggaugggggaagcugcugcaauauuuaugaccgcuacaccuccggguucuguagaagcauuuccucaaaguaacgccgugauacaggacgaagagagagacaucccugaacgaagcuggaauagugguuaugaauggauaacugacuuucccggaaaaaccguaugguucguaccgucaauaaaauccggcaaugauauagcaaauugucugcguaaaaacgggaaaagaguaauacaauuaucacgcaaaacauuugacaccgaauaccagaaaacaaagaauaaugacugggauuacguagucacaacugacauaucugagaugggugcaaacuucagagcugauagaguaauugauccucgccguugucuaaagccaguuauacuaaaagacgggccugaaagaguaauacuagcagggccaaugccaguaacaguugcuucagcagcacaacgucgagggcggauuggccguaaucauaacaaagaaggugaucaauacaucuauauggggcaaccacuaaauaacgacgaagaccaugcucacuggacagaggcaaaaauguuauuagacaacauaaacacaccagaaggaaucauacccgcgcuguucgagccagagcgagaaaaauccgcggcaauugauggagaauauagauuaagaggugaagcaagaaagacuuuuguugaauuaaugagaaggggugaccuaccgguauggcuaaguuauaagguagcaucagaaggauuccaauauucugaucgaagauggugcuuugauggagaaaggaacaaucaggucuuggaggaaaauauggacgucgaaaucuggacgaaagaaggggagaggaagaaauuacgcccucguugguuagaugcucggacguacucagacccauuggcccuaagggaguuuaaagaguucgccgcaggaagaagguccguuucaggagaucuaauacuagagauaggaaaacugccucaacaucuuacccaaagagcacaaaaugcauuagacaauuuaguaauguugcacaauucugaacaaggcgguagagcuuauaggcacgcuauggaggaacugccggauacaauagagacauugaugcuucuggcucuaaucgcaguacuaacaggcggugugacauuauuuuuccuaagcggaaggggacuuggaaaaacaucuauaggccuccuauguguuauggcaucaucuguuuuauuauggauggcaagcguggaaccccauuggauagccgcaucgauaauuuuagaguuuuucuugaugguauuacuuauuccugagccugaucgacagagaacaccacaagacaaccaauuagccuacgucguaauaggacuauuauucaugauccucacaguagcagccaacgagaugggauuguuggaaaccacuaagaaagaucucggaauugggcacgucgcaguggaaaaucaucaucaugcaacuauguuggauguggaccuucacccagcuucagccuggacucuguaugcaguagcaacaacaaucaucaccccaaugaugcgacacaccauagaaaauacaacagcaaacauaucucuaaccgccaucgcaaaucaggcugccauccuuaugggucuugacaaaggcuggccaauaucgaaaauggacauaggcgucccucuacuggcccuaggaugcuacagccaaguaaauccauuaacguugacggcggcagugcuaaugcuaguugcgcauuaugcuauuaucggaccuggauuacaggcuaaagcuacccgagaagcucagaaaagaacggcagcugggaucaugaaaaauccaacaguagacgggauugucgcuaucgauuuggaucccguuguguacgacgcuaaauuugaaaagcaacucggucaaauuaugcuauuaauuuuaugcacgucucagauccuucugaugcgaaccacaugggcuuuaugcgaaucaauuacuuuagcaacuggaccguugaccacacuaugggagggaagccccggaaaauucuggaacacgacaauagcuguaucaauggcuaauauuuuuagaggaaguuaucuagcaggagcagggcuugcauuuucacugaugaagucauuaggaggcggacgcagaggcacaggcgcccaaggcgaaacucucggagagaaauggaaacggcaacuaaaucaacugagcaaaucagaguucaauaucuauaaaagaucggguaucauggagguggaucgaagugaggccaaggaagggcugaaaagaggagagacaacgagacacgcuguuagucgaggaacugcuaaauuacguugguuuguggaaaggaaccuggucaaaccagaaggaaaagucauugacuuaggaugcgggagaggcgguuggagcuacuacugcgcgggucucaaaaagguuacagaaguaaagggcuauaccaaagggggccccggacacgaggaaccaaucccaauggcuacauacggcuggaaucuaguaaagcuacauuccgguaaagacguuuucuuuacaccaccagagaaaugugauacccucuuaugcgauauaggcgagucuuccccaaauccuacaauagaggaaggacguacucuaagaguacuaaaaaugguugaaccguggcuacgagguaaccaauucugcaucaaaauauugaaccccuacaugccaaguguagucgaaaccuuggaacaaaugcaaagaaaacacgguggaaugcuuguccgaaaccccuuaucucguaacaguacacacgaaauguauuggguaagcuguggaaccggaaacauaguuucugccguaaacaugacaucgcgaauguuauuaaaccgcuucacaauggcacaccguaaaccaacuuaugaaagagaugucgaccugggagcagguacgagacacguagcuguagaaccggaagucgcaaacuuggauauaauuggucagcgcauagagaauauaaaacacgaacauaaaaguacuuggcacuaugacgaagacaauccuuacaaaacuugggcauaucacggauccuaugaaguaaaaccuaguggcucggcaaguucuauggugaauggugugguaaaauuauugacaaaaccgugggacguaauuccaaugguaacacaaauagcuaugaccgauacaacaccauuugggcaacaacguguauuuaaagaaaaaguugacacgagaacuccgaaagcuaaacgaggaacugcacaaauaauggaaguaacagcuagauggcuuuggggauuccuaucacgcaacaaaaagccaagaauaugcacccgugaagaguucacucgaaaaguaagaagcaaugcugcaauaggugcgguauuuguagacgaaaaccaguggaauagugccaaagaagccguugaagaugagagguucugggaucucguacaaaaagaaagagaguuacauaaacaaggaaaaugugcaacguguguauacaauaugauggguaagagagagaagaaacuuggugaguucgguaaagcaaagggaucaagagcuauuugguacaugugguuaggagcaagguuccuugaauuugaagcccuuggauuuaugaacgaagaccacugguuuucacgugaaaauucguugucaggcguggaaggagaagggcuucacaaacuuggauacauauuaagagauauaaguaaaauuccaggugggaauauguaugccgacgauacugcaggaugggauacccgaauaaccgaagacgaucugcaaaaugaagcaaaaauaacugauaucauggaaccggagcaugccuuacucgcaacaagcaucuucaaguugacauaccaaaauaagguuguaagaguccaacgaccggcuaaaaacggcacgguaauggacgucaucucaagaagggaucaacgggguucuggucaaguagguacauauggacugaacacuuuuaccaauauggaggcccaauuaauucgacaaauggagucagaagguauauuuuugccgucagaacucgaaaccccuaaucuagcagaacguguacuagauugguuagaaaaauacggaguagaaagacuaaaaaggauggcgauuaguggcgacgauugcgucguuaaacccaucgacgacagauuugcaacagcacuuacagcuuuaaacgauaugggcaaagucagaaaggacauuccucaaugggaaccaucaaaaggauggaacgacuggcaacaaguaccuuucuguagucaucacuuccaucaauuaauaaugaaagaugggcgugaaauaguaguuccgugucguaaucaagaugaauuagucgggcgagcacgagugucacagggggcuggguggucacugcgagaaacagccugcuuggguaagaguuacgcacagauguggcagcucauguacuuucaucgucgcgauuuaagacuugcggcaaaugcaauauguagcgcuguuccaguagauuggguaccaacaaguaggaccacuuggaguauucacgcacaccaccaauggaugaccaccgaagauauguuaaguguguggaauagaguauggauagaggaaaaucccuggauggaagauaaaacacacgucucaucauggggagauguucccuauuugggcaagagagaggaucaauggugcgguagucuaauaggguuaaccgcccgagcaaccugggcuucgaacauacaggucgcaaucaaccagguaaggagauugauaggaaaugagaacuaucuggauuauaugacuucuaugaaaagauuuaaaaaugagggagacccugaaggugcacuaugguga

SEQ ID NO: 21749 - RNA, 9879 nt, Artificial Sequence
  derived and/or modified CDS sequence (opt6) from DENV-1__GQ199845__SS-prME
agcgucacuauguuauugauguuaaugccuacugcucuagcuuuucauuuaacuacccguggaggagaaccacauaugauaguuaguaaacaagaacgagguaaaucacugcuguuuaaaacuucugccggaguaaauauguguacccuuauugcuauggaucuuggggaauuuugcgaagauacuaugacauacaaauguccgagaauaacagaggcggaacccgaugauguagauugcugguguaacgcaacugauacuuggguaacuuacggaacauguucgcaaacaggagaacaccgaagagacaaaagaucuguggcccuggcgccucacguaggauuaggacuagagacaagaacagaaacauggaugaguagcgaaggagcuuggaaacagauccaacgaguagaaacgugggccuuaaggcauccaggguucacggucauugcgcuuuuucuugcacaugcuaucgggacgagcauaacacaaaaaggaauuauauucauucuuuuaauguuaguaacaccgaguauggccaugcgaugcgucggcauagggagucgcgauuuuguagaaggacuaucuggagcuaccuggguagauguaguucuagaacaugggucuuguguaaccacuauggcgaaagauaaaccgacauuagauauagaacuguuaaaaacggaggucacuaauccagcuguauuaagaaaauuauguaucgaggcuaaaauaucuaauacuacuacggauagccgauguccuacucaaggugaagcgacccuaguagaagaacaagacgccaacuucguauguagaagaacguuuguagaucgcggaugggguaauggaugcggguuauucgggaagggcagccuaauuacaugcgcgaaauuuaaguguguaacaaaacuugaaggaaagauaguucaguaugaaaacuuaaaguauuccguaaucgucacgguucacacuggagaccaacaccagguuggaaacgaaucaacugaacacggaaccacugcuacuauuacgccucaagcacccucuacagaaauacaauuaacagacuauggagcacuuacuuuggauuguucuccuagaacaggguuagacuucaaugaaaugguauuacuaacaaugaaagagaaaaguuggcuuguacauaagcagugguuccucgaccuaccacuaccauggacaucgggcgcuucaacuucacaagagacauggaacagacaggacuuauuaguaacauuuaaaacagcacaugcgaagaaacaggaagugguagugcuaggaucccaggaaggggcaaugcauaccgcguuaacaggagcgacugaaauacagacauccgggacaacgacaaucuucgcuggccacuugaagugucgauuaaagauggauaaacuaacuuuaaaaggaaugaguuauguuaugugcacugggucauuuaagcuagaaaaagaagucgcugaaacccaacacggaacuguuuuagugcaaauaaaauacgaaggaacugaugcaccguguaagauuccauuuucgacacaagaugagaaggguguaacucaaaacggaagauuaauaacggcaaauccgauagugacugauaaagaaaaacccguuaauaucgaggcagaaccgcccuucggugaaucuuauauaguuauuggugcuggugaaaaggcacuaaaguuaaguugguucaagaaaggaucaucaauaggaaagauguuugaagcgacagcacguggagcucggcguauggcaauauuaggagauacugcgugggauuucggcucuauuggagguauguucacaagcguggggaaauugguccaucaaauuuucggaacggcauaugggguauuguuuagcggagucagcuggacgaugaaaaucggaauagguguuuuacuuaccuggcuuggacucaauagucguaguacuuccuugaguaugacaugcauugcgguaggccuuguaacucuuuacuugggaguuaugguacaagcagauagcgguugugucauuaauuggaaaggaagagaacucaaauguggauccgguauuuucguaacgaaugagguacauacguggaccgaacaguauaaauuccaggcggacagcccaaaaagauuaucugcagcaaucgggaaggcuugggaagaagguguaugcgguauaagaucugcaacacgacucgaaaacauaauguggaaacaaaucagcaaugagcuaaaccacauacucuuagaaaacgauaugaagcuaacagugguaguaggcgacguggccgguauuuuggcacaaggcaagaaaaugauuaggccacagccaauggaauauaaauauagcuggaaaauaugggggaaggcuaagauaauaggugcugacguacagaauacgacauuuauuaucgaugguccgaacacuccagagugccccgaugaucagagagcuuggaauauuugggaaguagaagacuaugguuucggaauauucacuacuaauaucuggcuuaaauuaagagacucauacacccaaguaugcgaucauagacucaugucugcugccaucaaagauaguaaagccguacaugcagauaugggauauuggaucgaaucagagaaaaaugaaacauggaaauuggcaagggccagcuucaucgagguaaaaacgugcauuuggccgaaaagccauacucugugguccaauggaguucucgaaagugaaaugauaauuccaaaaauauauggagguccuauuagccaacauaauuaucggccaggauacuuuacucaaacagcugggccauggcaucuuggaaaacuugaauuagacuuugaucuaugugaagguacaacagugguuguagacgagcauugcggcaaccgaggacccuccuuacgaacaacuacaguaacggguaaaauuauacaugaguggugcugcagaucaugcacacuaccuccacuaagauuuaagggcgaagauggaugcugguacgguauggagaucaggccgguaaaagagaaggaagagaacuuaguaaagucuaugguaucagccggaucuggggaaguagauaguuuuucacuagguuuauuauguauaucaauaaugauagaagaagugaugcgaagucgguggucaaggaagauguuaaugacgggaacauuggccguuuucuuucuccuuauaauggggcagcucacauggaaugacuuaauucgacuauguauuaugguuggagcaaacgcgucagaucggaugggaaugggaacaacuuaccuggcgcuaauggccacuuuuaaaaugcguccaauguuugcaguugguuuguuauuuagacgucucacaucaagggaaguauuacuauuaacaauuggucuaucucugguagccucgguggaacuaccaaauucucuggaggaguuaggggauggauuagcaauggguauaaugauucuaaaauuacuuacagauuuucaaagucaucaauuaugggcaacauuacucagcuuaacuuuuauccgaacaacuuucucccugcacuaugcguggaagacaauggccaugguauuaaguaucguaucauuauuccccuuaugccuaagcaccacaucucaaaagacuacauggcuaccgguguuauuagggucacucggauguaaaccccugacuauguuucucauugcugagaauaaaauauggggucgcaaaucuuggccauuaaaugagggaaucauggcagugggaauaguuuccauuuuauugaguucguuacucaaaaaugacguuccuuuggcaggcccccugauagcuggagggaugcuaauugcauguuauguuauuuccggaucuucggcagaccucagcuuggaaaaagccgccgaagugucaugggaggaagaggcggaacacagcggcgcaagucacaacaucuuaguugaaguccaggacgacggaacuaugaaaaucaaagaugaagaaagagaugacacgcucacaauauuauuaaaagcaacuuuacucgcagucucaggagucuaccccuuaucaaucccagccacauuauuugugugguauuucuggcagaagaagaaacaacgaagugggguuuuaugggauacuccaagcccuccggaaguagaacgugcagugcuggaugauggcauauauaggauaaugcaacguggacuucuaggucggucucaaguuggggucgguguuuuccaagagaacguuuuccacaccauguggcaugugacacguggagcuguucugauguaucaagguaaaagauuagaaccaucaugggcuucagucaagaaggauuuaaucucauauggagggggauggagguugcaaggaagcuggaauaccggggaagaggugcaagugauugcuguugagccuggcaaaaacccgaaaaauguacaaacagcaccugguacauucaagacaagugaaggugaaguaggugcaauagcccuugauuucaagccaggaacaagcggcaguccaauaguaaacagagaagggaaaauaguaggguuauauggaaauggaguuguuaccacuucaggcacuuauguuagcgcgaucgcccaagcuaaggcuucacaagagggaccuuuaccggaaauagaggaugaaguauucagaaaaaggaauuuaacaauaauggaccuucacccagggucuggaaaaacacgucgauauuuaccggcaauaguucgagaggcaacaaaaagacguuuaagaacuuugauauuggcaccaacaagaguaguugcaagugagauggcagaggccuugaagggaaugccgauacguuaucagacuacagcgguaaaaucugagcauacagggaaagagaucguugaccuuaugugucaugcuacauuuacgaugagauuacugucaccaguccgaguaccaaauuauaacaugaucauaauggaugaagcacauuuuacagauccaucuagcauagcggcacgaggcuacauaucaacccggguagguaugggcgaagcugccgcaauauuuaugacggcgacgcccccggguucagucgaagccuucccccaaucaaacgcugucauucaagaugaagagagagauaucccugaaagaaguuggaacucggguuaugaauggauaacagacuucccgggaaaaacuguaugguuuguaccaucaaucaagaguggaaaugauauugcaaacugccuccgcaaaaaugguaaaagaguaauacaacuuagcaggaagacauuugauacugaguaucagaaaaccaaaaauaaugacugggauuacguuguaaccaccgacaucucugagaugggcgcgaacuuucgggcggaucguguuauugauccaaggagauguuuaaaaccugucauacuuaaggacggcccggaacgcguaauacucgcaggucccaugccaguuacgguagcuagugcggcucaaagacgggggagaauagguagaaaucacaacaaagaaggugaucaauauaucuauaugggucaaccacuaaacaacgacgaagaucaugcgcacuggacagaagcuaaaauguuauuagauaacauaaauacaccagaaggcaucauuccugcuuuguucgagccagagagagaaaaaucagcagcaauagacggagaauaucgauuaaggggugaagcgagaaagacuuuuguagagcuaaugagacguggggacuugccaguaugguuauccuauaaaguagcgucagaaggauuucaauauucagaccgaaggugguguuucgauggagagaggaauaaucaaguuuuagaagaaaacauggauguagaaauuuggacaaaggagggagagagaaagaaauuacgccccagguggcuagacgcgaggacuuauagcgauccauuagcgcugcgggaauuuaaggaauuugcugccgguagaaggucaguaaguggagaccuaauacuagaaauaggaaaacuuccucaacacuugacccaacgagcacagaacgcccuugacaaccuaguaaugcuccauaauucagagcaggguggacgagccuacagacaugcuauggaagaacuuccugacacuauagaaaccuuaaugcugcuggcguuaauagcaguacuaacgggaggaguuacucuguuuuucuugucgggucggggcuuagggaaaacauccaucggccuacuaugcguuauggccuccucuguauuacuauggauggcaagcguagaaccccauuggauagcggcgaguauaauccuggaguucuuuuuaaugguauuacuaauacccgaaccugauagacaaagaaccccacaagacaaccaauuggccuacguuguaauaggccuguuguucaugauacucaccguggcagcuaaugaaaugggucuucuagaaacaaccaaaaaggauuuagggauaggucauguugcaguagagaaucaucaucacgcagcaauguuggauguagauuuacacccggcaagcgcuuggacauuauaugcuguugccacaacuauaaucacaccaaugaugagacacacaaucgaaaauacaaccgcaaauauaucauugacagcgauagcaaaucaagcugcuauauuaaugggguuagacaaggguuggccaauaucaaaaauggacaucggcguuccauuacuagcuuugggaugcuauagucaagucaauccauuaacacugacugcugcuguauugaugcucguagcgcauuaugcuauuauagguccaggucuccaagcaaaagcuacgagagaagcccaaaagaggacugcggcgggcaucaugaaaaacccaacaguugacgguauagucgcaauugaccuugacccaguagucuacgaugcuaaauucgaaaagcagcuaggacaaaucauguuacugauacucuguacgucacagauucuauuaaugaggaccaccugggcauugugugagucaaucacgcuggccacggguccacucacaacgcuuugggaagguucuccaggaaaguucuggaacacuacaaucgcagugucaauggcgaauauauucagagguucguauuuggcuggggcuggauuggccuuuagucuaaugaaaucauuaggagggggccguagggguacgggcgcacaaggggagacucucggagaaaaauggaaacgacaacucaaccaauugaguaagucugaauuuaauacauauaaaaggagcggaauuauggaaguggaccggagcgaagcuaaagagggucuaaaaagaggugaaacgacgaaacaugcagucagccggggaacggcgaaacuccggugguucgucgaaagaaaucugguaaaaccggaaggcaaaguaauagaucuuggcuguggaaggggaggauggagcuauuauugcgcaggccucaagaaagugacggaaguuaaaggauauacgaaaggagggccggggcaugaagaaccgauaccuauggcuacauauggauggaaucucguuaaauugcauucagggaaagauguauuuuucauaccacccgaaaagugugacacacuauuaugugauaucggggaauccucuccgaacccuacaauugaagaagggcgaacuuugcgaguacuaaaaaugguugaaccuuggcuaagaggcaaccaguucuguaucaaaauauuaaaucccuacaugccaaguguagucgaaacgcuggagcaaaugcaacguaaacauggaggaaugcuuguaagaaaccccuuaucacgcaacucaacacaugaaauguauugggugaguugcggaaccgguaacauagucucagccgugaacaugacaagucguauguuauuaaaucgcuuuacuauggcgcaucgaaaaccuacuuaugagcgagacguagauuuaggagcuggaacaagacacgucgcgguggaaccggaaguagcgaacuuagacauaauaggacaacgaauugaaaacauuaaacaugaacauaaaucuacauggcauuaugacgaggauaacccguauaaaacuugggcguaccaugggucauaugaagugaagccgucaggauccgcuucuagcaugguuaauggcgucguuaaauuauugacuaagccuugggauguaaucccaauggugacacaaauagccaugacggauacuacaccauucggacaacaacggguauuuaaagagaaaguagauacuagaacgccaaaggcaaaacguggcaccgcucagauaauggagguaacugcaaaauggcuuuggggauuucuuagccggaauaagaagcccagaauauguacgcgggaagaguucacuagaaaaguucgcucuaacgcagcuauuggugcuguuuuugucgaugaaaaucaauggaacucugcgaaagaagcaguagaggaugagagauuuugggaucugguacauagggagcgcgaacuucauaaacaggggaagugcgcaacauguguguauaacaugaugggaaagagagagaagaaacuaggcgaguucgggaaagccaaaggaucccgggcuauaugguauaugugguuaggugccagauuucuugaauuugaggcuuuaggcuuuaugaaugaagaccauugguuuagccgagaaaacucgcuaucaggaguagaaggugaagguuuacacaaauuagguuauauacugcgcgauauaucaaaaaucccaggagggaauauguacgcagaugacacggcgggaugggauaccagaauuacagaggaugaucuacaaaaugaagcaaagaucacugacaucauggaaccagaacacgcguuguuagcaaaaucaauauucaaauuaacauaccaaaauaaaguuguuagaguacaacgacccgcuaaaaauggaacggugauggacguaaucucaaggagagaucagcgagguaguggucaggucggaaccuauggucuaaacacauuuacgaacauggaagcacaacuuauacgccaaauggaaucggagggaauuuucucaccgucagaacuugagacgccaaauuuagcaggacgugugcuggacugguuagagaaacacgguguggaacgucuaaaacgaauggcuauuucaggugaugauuguguuguaaaaccaauagaugauagauuugccacagcauuaacggcacuuaaugacaugggaaaaguccggaaagauauaccccagugggaaccgucgaaaggauggaaugauuggcaacaaguuccauucuguucacaccacuuucaccaguuaaucaugaaagauggacgugagauagucguaccguguagaaaucaagaugaguuggucggacgagcgcgcgucucacagggagcaggauggaguuuacgggaaacagccugcuuagguaaaaguuaugcucaaauguggcaacucauguacuuucacaggagggacuuaagguuagcagcaaacgcgauauguuccgcggucccugucgacuggguaccaacgucaagaaccacuuggucgauucaugcgcaccaucaguggaugacuacggaagauaugcugagcguguggaaucggguguggauugaagaaaacccauggauggaagacaagacgcauguaucgaguuggggagacguaccguacuuggggaagagggaggaucaauggugugguagcuuaaucggauuaacugcucgagcaacgugggcaacgaacauacaaguagcaauaaaccaagugcgacguuuauuaggcaaugaaaacuaucuagacuacaugacaagcaugaagcgguuuaagaacgaaucagaccccgagggagcacuaugguaa

SEQ ID NO: 21750 - RNA, 9879 nt, Artificial Sequence
  derived and/or modified CDS sequence (opt6) from DENV-1__GQ199846__SS-prME
ucaguaaccaugcuguuaauguuaaugccgacugcuuuggcguuucaucuuaccacucgaggaggagaaccgcacaugauuguaacuaaacaagaaagagggaaaagucuacuauucaaaacgucugcaggagucaauauguguacucuuauagccauggaucuaggcgaacucugugaagauacuaugacuuauaaaugcccaagaaucacugaagcagaaccggacgacguagacuguugguguaaugcaaccgacacuugggugacauauggaacuugcagucaaaccggagaacaccggcgcgauaaaagauccguagcauuagcaccacauguuggccuaggacucgaaacucgaacugaaacuuggaugaguucagaaggagcauggaaacaaauucaaagaguagaaacaugggcucuaagacauccaggguuuaccguaaucgcacucuucuuagcacacgcaaucggaacgagcauuacucagaaaggaauuauauuuaucuuacucauguugguaacaccuuccauggcgaugagaugcguagggauagguucaagagacuuuguagaaggucugucuggugccacauggguggauguagucuuagaacacggaucguguguuacaauuauggcacgcgauaaacccacacuagauauugaacuacuaaaaacugaagucacaaauccugcugucuuacgaaaauuauguauagaagccaaaauuucaaauacuacuacugacucaagaugcccuacgcaaggagaagcaacucuuauggaagaacaagacgccaauuucguuugcaggagaacauuuguugacagaggcuggggaaacggcugcgggcucuuuggcaaaggaucucuaauaacaugugcaaaauuuaaaugugucacuaaacuugaaggaaaaauugugcaauaugaaaaccugaaauauucgguaauaguaaccguucacacaggagaccaacaucagguagguaaugaaucaacggaacacgguacaacagcuaccaucacaccccaagcuccuaccucagaaauccaauuaacggacuauggugcacuaacacucgacugcagcccaagaaccggucuugauuuuaacgaaaugguauuauugacaaugaaagaaaaauccuggcuaguccauaaacagugguuuuuagauuugccccuacccuggacuuccggggccucgacaagccaggaaacguggaauagacaagaucugcuagucaccuucaagacugcacaugccaagaaacaggaaguuguuguacuugggucgcaagaaggggcgaugcacaccgcccuaaccggagccaccgaaauacaaaccagugguaccacuaccauauuugcaggccacuuaaaauguaggcucaaaauggacaaacugaccuuaaaaggaaugaguuacguaaugugcacagggagcuuuaaguuagaaaaggaaguugccgaaacgcaacacggaacaguauugguccaaaucaaauaugaagguacugaugcucccugcaaaauaccuuuuucuacacaggaugaaaaggggguuacucaaaauggaagauuaauaacugcaaacccuauaguuacagacaaggagaaaccaguaaacauagaagcagaaccuccauuuggugaaaguuauauaguuauaggagcgggugaaaaagccuuaaaguuaucuugguuuaaaaagggaaguuccauaggaaagauguuugaagcuacagcacguggagcacgaaggauggccauuuuaggugauacugcuugggauuucgguagcguaggaggaguuuuuacaucuguagguaaguugguacaucaaaucuucgguacggcauauggcguacuuuuuaguggcguuaguuggacuaugaaaauagguauuggaguauuauuaacguggcuaggguugaauagcagaagcacuucgcucucaaugacauguauagcuguaggguuaguaaccuuauauuuaggaguaauggugcaggccgacaguggcugcgucauuaauuggaaaggucgcgaguuaaaaugcggaucagguauauuugucacuaaugagguccacacauggacagaacaauauaaauuccaggcagauucuccgaaaagauuaagugccgcuaucgguaaagccugggaagaaggcguauguggcaucagaagugcaacacgauuagagaacauuauguggaagcaaauaagcaacgaacuuaaucacauucuuuuggaaaacgauaugaaauucacgguagucgugggugauguuguaggaauacuagcucaaggaaagaaaaugauucgcccacagccgauggaacauaaguauagcuggaagucauggggaaaagcaaaaauaauuggcgcagaugugcaaaauacgacuuuuaucauagauggcccaaauacaccagaaugccccgacgaccaaagggccuggaacauaugggaagucgaggacuauggguucggcauuuuuacuacuaauauaugguuaaaauuaagggacucauauacgcaaguuugugaccacagacucaugucggcggcuaucaaagauucaaaagcagugcaugcagacaugggcuacuggauugaaagugagaaaaaugaaaccuggaaacuugccagagcaucauuuauagaaguaaaaacaugcauauggcccaaaucacacacucuauggucgaauggagugcuugaaagugaaaugauaauuccaaaaauauauggagguccuauaucacagcacaauuauagaccagguuauuuuacgcagacugcggggcccuggcaccuagggaaauuggaauuggacuuugaucucugcgaaggaacgacgguaguuguagacgaacacuguggaaacaggggaccuucccuaaggacaaccacaguaacugguaaaauaauacaugaauggugcugucgcucauguacguuacccccacuacgauucaaaggugaagaugguugcugguaugguauggagaucagaccgguuaaagaaaaagaagagaauuuaguaaagucuauggucucagccggaaguggcgaaguagacucguucucuuuaggacuguuauguauaaguauaaugaucgaagagguaaugcgcaguagauggucaaggaaaaugcuuaugacuggaacacuugcaguauuucucuuacuuaucaugggacaacuaacuuggaacgacuuaauccgguuguguauaauggucggugcaaaugcgagugaucgcaugggcaugggcacaacguauuuagcauuaauggcaaccuuuaaaaugagaccaauguucgcuguaggacuccuuuucagaaggcuaaccaguagggaaguucuguuguuaacuaucggccuuucucuagucgcaagcguagaauugccuaauagcuuagaggaauugggugauggccuggcuauggguauaaugauacuaaaauuacuaacagauuuccaaucucaucaauuaugggccacucugcucucacuuacguucaucaaaacgacucuaucgcuccauuaugcuuggaaaacaauggccaugguacuuagcauugccucacuauucccguuauguuugucuacuaccucacagaagacuacuugguuacccguacuucuaggcagucuuggauguaagccucucacaauguuucuaauaacagaaacuaaaauauggggaagaaaaaguuggccauugaaugaggggauuauggcgguggguguaguuagcauucuauuaagcagcuuauugaagaaugacgugccgcucgcuggaccuuugauagcgggagguaugcucaucgcauguuacguuauaucggggagcuccgcggaccuaucauuagaaaaagcagcggagguuucaugggaagaggaagccgaacauagcggugcuucucauaauauuuugguaguaguacaggacgaugggaccaugaaaauaaaggacgaagaacgagacgacacauuaacgauauuacuaaaagcaacccuacuugcaguaucaggcguguauccgcucagcauaccagccacguuauuuguaugguauuuuuggcaaaagaagaaacagagauccgggguauuaugggacacaccuagcccuccagaaguggaaagagccguucucgaugacggaauuuauagaauuaugcaacggggacuauuagggcgaagucagguaggaguggguguuuuucaggaaaaugucuuucauacaauguggcauguaacaagaggugcuguccugauguaucaaggaaaaagacuugaaccuaguugggcguccgucaagaaagaucucauaagcuauggaggaggauggcgacuccaggguuccuggaacacaggggaagaaguccaagugauagcuguggaaccugguaaaaaccccaaaaauguacaaaccgccccggguacuuuuaaaaccccagagggggaaguuggggcaaucgcauuagauuuuaaaccaggaacaucaggcucaccuauagugaauagggaagggaaaauagugggucuauauggcaauggaguaguaacaacaagcgggacauacgucagugcaauugcacaagcaaaagccucacaagagggaccauuaccagaaaucgaggaugaaguguuuagaaaaagaaaccuaacuaucauggacuuacacccuggaagcggaaaaacuagacgguaucucccugcgauuguuagagaagcgauaaaacgaaaguugcguacacuaauuuuagcaccaacgcgaguagucgcgagcgagauggcagaggcgcuaaaagggaugcccauuagguaucaaacuacagcuguaaagucagaacauacuggaaaagagauaguugaccuuaugugucaugccacuuucacaaugcgucuucucucaccaguccgaguaccgaauuacaauaugauuauaauggacgaggcccauuuuacggaucccucgucaauagcagcaagaggguacauaucgacuagaguaggaaugggggaagcugcugccauauucaugacggccacuccaccaggaaguguugaggcuuucccucaaucaaaugccgucauacaggaugaagagagggacauucccgaacgaagcuggaacucaggauacgaguggauaacugacuucccgggaaaaacagugugguucgucccgaguauaaaaaguggcaaugacauugcgaauugucuacggaaaaacgguaaaagaguuauacaacuuucgcgaaagaccuucgauacugaguaucagaaaacuaaaaauaacgauugggacuauguugugacaacugauauaagcgaaaugggagcuaauuucagggcagauagagucaucgauccuagaagauguuuaaagccagugauucuaaaagauggaccugagcgaguuauucuugcaggcccgaugccgguaacaguggcaucagcagcacagaggcgagguaggauagggaggaaccauaauaaagaaggagaccaauauauuuauaugggucaaccacuaaacaaugacgaagaccacgcacacuggacagaggcaaaaauguuguuagacaacauaaauacacccgaaggcauuauuccagcauuguuugaaccagagagagagaaaagugccgcaauugauggugaauaucgcuuacgcggagaggcaaggaaaacauuugucgaacucaugaggagaggcgaucucccgguauggcuuaguuauaaagucgcaucagagggauuucaauacagugauagacgaugguguuuugauggggaacgcaauaaucaaguauuagaggaaaauauggauguagagauuuggacaaaggaaggugaaaggaagaaauuacguccaagauggcuagacgccagaacguacagugauccacuugcccuuagagaguucaaggaauuugcugccggccgucgaaguguaaguggagaucugauauuagaaauugguaaauugccgcaacaucuaacccaacgugcacagaacgcucuggacaaccuagugaugcugcauaauucggaacagggagggagagcauauagacaugccauggaggaguuaccggacacaauagaaacuuugaugcuauuagcuuugauagccguccuaaccggagguguuacucuuuucuuucuuagcggaagaggucucggcaaaacuucgauuggccuucuaugugucauggccaguucuguauuauuguggauggcaucgguugaaccccacuggauugcugcgaguauuauucuagaguucuuccugaugguacucuuaauucccgaaccggauagacaacgaaccccacaagauaaccaacuagcguaugugguuaucggauuacuauucaugauccuaacgguagcagcaaaugaaauggguuuacuagaaaccaccaagaaagacuuagguauuggucauguagcaguagaaaaucaucaucacgcgacuaugcuagacguugacuuacaccccgccucagcauggacuuuauaugcaguugcgacaaccauuauaacuccuaugaugagacauacaaucgaaaauaccacagcaaauauuucacuaacagccauagcaaaccaagcagcuauauugaugggucuagacaaaggcuggccgaucucaaaaauggacauagguguaccgcuuuuggccuuagguuguuauucccaagugaaucccuugacuuuaacagcggccguacuaaugcuugucgcacacuacgcaaucauaggaccuggucugcaagcaaaagcaacacgugaagcacagaaaagaacugcugcuggaauaaugaagaaucccaccgucgaugggauaguagccaucgacuuagacccgguggucuaugaugcaaaauuugaaaaacaauuaggucaaauaaugcuacuuauucugugcacaucgcaaaucuuguugaugagaacuacaugggcacugugugaaucgaucacacuagccacaggaccucugacgacacugugggaaggaucaccuggaaaguuuuggaauacuacuauagcaguuaguauggcuaacauauuuagagggucuuaucuggccggcgcgggacucgcauuuagucugaugaaaucacuaggaggaggacguagggguacgggcgcccaaggagagacucugggcgaaaaauggaaacgccaauuaaaucaacucucaaaaucagaauuuaacaucuauaaaagaucaggaaucauggagguagauagauccgaggcaaaagagggauuaaaacgcggggaaaccacacgucacgcaguaucaaggggcacagcaaaacugcggugguuuguagaacggaauuuaguaaaaccugaaggaaaaguaaucgacuuggggugugggcgugggggauggucuuauuauugugcaggucuaaagaaaguaacagaagugaaaggauauaccaaagguggucccgggcacgaagaaccuaucccuauggcgacauacggauggaaccuagucaaacugcacagcggcaaagacgucuuuuucacacccccggagaaaugugacacuuuacuuugugauauuggagaaagcuccccgaacccaacaaucgaagaaggaaggacucugcgcguucuuaagauggucgaaccuugguuaaggggaaaucaauuuuguauaaagauauuaaauccguacaugccuagcguaguggagacauuagaacaaaugcaaaggaaacacgguggcauguuaguccguaauccccuuaguaggaauagcacacacgaaauguauugggugucgugugguaccgguaauauaguaagcgcugugaauaugacaagucgaaugcuauugaacagauucacaauggcccacaggaaaccuacuuaugaacgcgaugucgauuugggcgcagggacaagacaugucgcaguagaaccagaaguagcaaaccuggacauuauaggacaaagaauagagaacauuaagcacgagcauaaaucaacuuggcauuaugacgaagacaauccauauaagacuugggcauaucacggcagcuaugaagugaagccaagugguagcgcauccucgaugguuaaugguguaguaaaguuacuaaccaaaccuugggauguaauaccaauggucacucagauagcgaugacugauacuacaccguuuggccagcagaggguguuuaaagaaaagguugauacaagaacaccaaaggcgaaacgugguacggcacaaaucauggaaguuacggcuaggugguuauggggauuucuuaguaggaauaagaaaccaagaauaugcacacgagaagaguucacgaggaaaguucgcucaaaugcagccauaggcgcagucuuuguagaugaaaaucaauggaacucggcuaaagaggcaguugaagacgagcgauucugggauuuagugcaaaaagagcgugaauuacauaaacaaggaaaaugcgcuacauguguauacaacaugaugggaaaaagggagaagaaacuuggcgaguucggaaaagcuaaagguuccagagccauaugguacaugugguugggagcccgcuuuuuagaguucgaagcacuugguuucaugaacgaagaucacugguuuucgagagaaaacucuuugucagguguugagggugaaggucuucauaagcucggauacauacuaagagauauaagcaagauuccaggagggaacauguaugcagaugauacagcuggaugggauacgcggauuaccgaagaugaucuucaaaacgaagcaaaaauaacugacauaauggagccagaacaugcguuacuagcgacaaguauauuuaaauugaccuaucaaaauaaaguagucaggguacagcggccugccaaaaacggaacgguuauggauguaauaucuagacgggaccaacgagggaguggucaagucgguacguacggucuaaacacuuuuacuaacauggaagcacaauuaauacgacagauggaaucugaaggaauauuucuucccagugaauuagagacacccaaucucgcggaaagaguacucgacuggcuggaaaaguacgggguagaaagguuaaagcggauggcaauuucuggugaugauugugucguaaaaccuaucgaugauagguucgcuacugcauuaacugcauuaaaugauaugggaaaagugaggaaggacauaccacaaugggaaccgaguaaggguuggaaugacuggcaacaagucccauuuugcucacaucauuuucaccaacuuauuaugaaagacggacgugaaauaguaguaccaugcagaaaucaagaugaacuuguaggacgagcgagagugucccagggcgccggauggucccuucgagagacagcgugucuagguaagucuuaugcucaaauguggcaacucauguauuuucauaggcgagaucuacgacuugccgcgaaugcgauuuguucagcuguaccaguggauugggugccgacaagucguacaacuuggagcauucaugcacaucaucaguggaugacaaccgaagauauguugucuguuuggaaucgaguguggauagaggaaaaccccuggauggaagacaagacucauguaucauccuggggagauguaccuuaccuggguaaaagagaagaucaauggugugggagccugauaggauuaacggccagagcaacuugggccagcaacauucaaguagcaauaaaucaagugcguagacuaauaggaaaugagaauuaccuagauuauaugacaucaaugaagagguuuaaaaaugaaggggauccagaaggggccuuaugguaa

SEQ ID NO: 21751 - RNA, 9879 nt, Artificial Sequence
  derived and/or modified CDS sequence (opt6) from DENV-1__GQ199847__SS-prME
agugucacaauguugcuuauguuaaugccaacagcacuugcuuuucaccuaacaaccagagguggggaaccacauaugauuguuaguaaacaagaacgagggaaaucacugcuguuuaaaaccucugcgggggugaacaugugcacacuaauugcuauggaccugggggaauuuugcgaagauaccaugacguauaaauguccucgaauaaccgaagcagaaccagacgaugucgauugcugguguaaugcgacagauacauggguaacuuacggaacuugcucucaaacuggagaacauagaagagauaaaagaucuguagcacuggcuccccaugugggguuggggcuagaaacacgaacugaaacauggaugucuagugaaggagcuuggaaacaaauacagcgcguagaaacuugggcauuaagacauccuggauuuaccgugaucgcucuuuuucuagcacaugcgauaggaacauccauaacgcaaaaagguauuauauuuauauugcuaaugcugguaacaccaucaauggcuaugcgguguguaggcauaggcucuagagauuucguugagggcuugaguggugcaacauggguagauguuguucuagagcauggaaguugugugacaacaauggcuaaagauaaaccgacucuagacauugaacuuuuaaaaacggaggucaccaacccagcuguauuacgaaaacuaugcaucgaagcuaaaauaucaaauaccacaaccgauagucgauguccaacacagggugaggcgacgcuaguagaggagcaggaugcuaauuucguaugccgcaggacauucgucgaucguggauggggcaaugguugugguuuauuuggcaagggaucacucauaacuugcgcuaaguuuaaaugcguaacaaaacuugaagguaagauaguacaauacgaaaauuugaaauacaguguaaucgucacgguacauacaggggaucaacaccaaguagggaaugaaucaacugaacaugguacaacagcaaccaucacgccucaggcaccgaguaccgaaauacaacucacagacuauggagccuuaacucuggauuguucgccgcguacgggacuagacuucaaugaaaugguacuuuuaaccaugaaggagaaaaguuggcucguacacaagcagugguuucuagauuugccgcuuccauggacuucaggagcaagcacaagucaagagaccuggaauagaaaagaucuauuaguaaccuucaaaacugcucaugcgaaaaagcaagaaguaguaguacuugguucgcaagaaggugcaaugcacaccgcucuaaccggugcuacagagauacaaacaagcggcaccacuacaauuuuugccggucauuuaaaauguagguuaaaaauggauaaacugacgcuaaaggguaugucauacgugauguguacagggaguuucaaacucgaaaaagaaguagcugaaacgcaacaugguaccguauugguacaaauaaaauaugaggguacagaugcaccuugcaaaauaccguuuaguacacaggacgaaaagggugucacucagaaugguagacucauuacugcaaauccuauaguuacagauaaggaaaaaccuguuaacaucgaagcagaaccuccguucggugaaucauauauugucauaggggcaggagaaaaagcucuuaagcuaagcugguucaagaaaggaucaucuauuggaaaaauguuugaagccacugcacgaggugcucggcgaauggcaauauuaggcgauacugcaugggacuucggauccaucggcggcguauuuacuucaguaggaaaacuggugcaucaaauuuucgguacggcguacggaguauuauuuucgggcgugucguggacgaugaaaauagguauuggugucuuacuuacaugguuaggacuaaauucccgaaguacaucucucucaaugacauguaucgcaguaggacugguaaccuuauauuuaggaguaaugguccaggccgacucuggaugcguaaucaauuggaaaggccgugaauuaaagugugguagcgguauauucguaacuaacgagguacauacauggaccgaacaguacaaauuucaggcagacuccccuaaacguuugagcgcugccauugggaaggccugggaagaaggaguuuguggaauacggagcgcuacuagacuagagaauauuauguggaaacaaauaucgaaugaguuaaaucacauauugcuugagaaugauaugaaauuuacugugguaguuggagacguugcaggaauauuagcacaagggaagaagaugauacgaccccagccuauggaauacaaauacaguuggaaaucuugggguaaggcaaaaauuauaggagcugaugugcagaauacaaccuuuauuauagaugguccgaauacaccugagugcccagaugaucaaagggcuuggaacauaugggagguugaagauuauggguucggaaucuucaccacaaauauauggcuaaaacuaagagauaguuauacacagguaugcgaucauagacuuauguccgccgccauuaaagauucaaaagccguacaugcugauaugggcuauuggauagaaucagagaagaacgaaaccuggaagcuagcaagagcuucauucauagaaguaaagacgugcauauggcccaaaucccacacuuuauggucgaaugguguuuuggaaucggaaaugauaauuccuaagauuuacggaggaccaaucagccaacauaacuaucguccuggcuacuucacgcagacagcaggucccuggcaccuaggcaaacuugaauuagauuucgauuuaugcgaaggaaccacgguaguaguagacgaacauugcggaaaccgcggcccgucgcuacgcacgacgacaguaacaggaaaaauaauacaugagugguguugcagauccugcaccuugccgccuuuaagauucaaaggggaagauggcugcugguauggaauggagauaagaccggugaaagaaaaagaagaaaaucucguuaaaucaaugguuucggcagggucaggagagguagauaguuucagucuaggcuugcuauguauaucaaucaugaucgaagagguaaugcggaguagauggucaaggaaaaugcuaaugacuggcacgcuagcggucuucuuuuuacucauaaugggucaacuuacguggaacgauuuaauucgguuaugcauuauggucggagcaaacgcaucagaccguaugggaaugggaacuacauaccuugcuuuaauggcuacuuuuaaaaugcgaccuauguucgcgguuggucuucuuuuuagaagauuaaccucuagagaaguauuacuccugacuauuggucuuagccuagucgcaucaguagaauuaccuaacucacuagaagaauuaggggacggccuagccauggggauaaugauucucaagcucuuaacugacuuucaaucacaucaauuaugggcaacucugcuuucccucacuuucauaaaaaccacguucucccuucauuaugccuggaagacgauggccaugguauuaaguauaguaucuuuauuuccucuuuguuuaucaacuacaucacagaaaacuacaugguuacccguuuuacuaggcucccugggauguaaaccccuuacaauguuuuuaauagcagaaaauaaaauauggggcagaaagucuuggcccuuaaaugaaggaauuauggcuguggggauuguuucuauucuguuaucagcuuugcucaaaaacgaugugccauuagcuggcccacuaauagcaggaggaauguugauugcauguuacguaauuucuggaaguagcgccgaccuaagucuggaaaaagcugccgaaguaucaugggaagaggaggcugaacauucaggggccagccacaauauauuaguugagguacaagacgaugguacaaugaaaauaaaagaugaagaaagagacgauacuuuaaccauccuacuaaaggcaacccuacucgcgguuagcgggguguaccccuuaucaaucccagcgacauuauuuguaugguacuuuuggcaaaagaagaaacagagaaguggcgucuugugggacacgccgaguccacccgaaguugagcgugcaguauuagacgaugggauauacagaauuaugcaaaggggucuauuagguagaagucaagugggcgucggaguuuuccaagagaauguauuccacaccauguggcacguaacaaggggagcaguccugauguaccagggaaaaagguuagaaccgagcugggcaucaguaaagaaagacuugauuucguacgguggaggcuggagauugcaaggaucauggaauaccggcgaagaaguccaaguuaucgcaguagagccgggcaaaaaucccaaaaauguacaaaccgcacccggaacauucaaaacaagugagggcgaaguaggcgcaauagcacucgacuucaaaccaggaacaucagguucgccgauuguaaauagagaaggaaaaauuguuggucuauauggcaacgguguaguaaccaccucaggcacguauguaagugcuaucgcccaggcaaaagcaucgcaagaagguccuuuaccggaaauugaggaugaggucuucagaaaaagaaaucuuacgaucauggauuugcauccgggauccggaaaaacaagaagauaucugccagccauaguucgugaagccauaaaaaggaagcuacgaacuuugauauuagcucccacacgaguaguggccagugaaauggccgaagcucuuaaaggaaugccuauaagauaucagacuacagccguuaaaagcgaacacacaggaaaagaaauaguagaucuaaugugccacgccaccuucaccaugagauuacugaguccgguacguguuccaaauuacaacaugauuauuauggaugaagcacauuucacagacccuucauccauugcagcucggggauauauaucaacaagagucggaaugggggaagcagcugcuauauuuaugacagcaaccccaccgggaagcguugaggcauuuccacagucaaaugccgugauucaagaugaagaacgggauauaccggaaaggucuuggaacagcggauaugaauggaucacugauuucccuggaaaaacugucugguucguuccgaguauuaaauccgguaacgacauugccaauugucucaggaaaaaugguaaaagagugauccaauuaagucgcaaaacuuuugauacugaauaucagaaaacuaaaaauaacgacugggauuacguuguaacaacagauaucagugaaaugggagccaacuucagggcagaucgagugauagauccuagaagaugccuaaagccggugauacuuaaagacgggccggaacgagucaucuuggccgggcccaugccaguaacuguggccagugcugcucaaagaaggggacgaauaggaagaaaucacaacaaagaaggcgaucaauacaucuauaugggucaaccuuugaacaaugaugaggaccaugcacauuggacagaggcgaaaaugcuucuagauaauaucaauacuccggagggcauaauccccgcauuauuugaaccagaaagagagaaaucugcagcaauagauggcgaguacagacuaagaggagaggcacgaaaaaccuuuguggaauuaaugagaagaggagaucuaccaguaugguuauccuauaaaguagcuagugagggauuccaauauucagauaggagauggugcuuugauggugaacgaaauaaucaaguuuuggaagaaaauauggauguggaaaucuggacuaaagagggggagcguaagaaacuucgaccuaggugguuggacgcucguaccuauuccgauccacuggcauuacgugaauuuaaagaauuugcugcggguagacggucgguuucaggagaucuaaucuuggaaauuggaaaauugccacaacacuugacacaaagagcucaaaacgccuuagacaauuugguuaugcuacacaacucagagcaagguggccgagcauacagacaugccauggaggaacuuccugauacaauagaaacgcucaugcuauuagcauuaauugcgguacugacgggugguguuacucuauucuuucuuagcgggcgugguuuaggaaagacaagcauaggacuauugugcguaauggcgucaucgguucuacuauggauggcuagcguggaaccccauuggauagcugcuuccauaaucuuagaguucuuuuuaaugguauuguuaauuccggaaccugauaggcagagaacuccucaagauaaucaacuagccuauguaguaauuggauugcuuuuuaugauuuuaacgguagcugccaacgaaaugggacuuuuggaaaccacuaagaaagacuugggaauaggacacguggccguggaaaaccaucaccacgccgcaaugcuggauguugauuugcauccagcuucagcuuggacuuuauaugcaguggcuacuacaaucauaacaccuaugaugcgucauaccauagagaacacuaccgcgaauauuucucucacagcgauagccaaccaagcugccauccugaugggucuggacaaaggauggccaauuaguaagauggauauuggcguuccgcuacuugcgcuaggauguuauucucaaguaaauccuuuaacccucacagcagcgguguuaaugcuaguggcccauuacgcaauaauaggaccgggucuccaagcuaaagcuacuagagaagcgcagaaacgaacagccgcggguaucaugaagaauccuacaguugacggaauaguugccauagacuuagacccggucgucuacgacgcgaaauuugaaaaacaauuaggacaaauaaugcuacucauacuuuguacaucacaaauccuguuaaugcguacgacgugggcgcuaugcgaaagcauaacgcuggcgacaggaccgcugacuaccuuaugggaaggauccccaggaaaauuuuggaacacaacuauugcaguaucuauggcaaacauuuuuagaggaagcuaccuagcgggcgcaggauuagcauucucucuaaugaaaucgcuggguggagggagacgagguacgggugcacaaggagagacucugggggaaaaauggaaacgacaauuaaaccaacuaucaaagagugaauuuaacacuuauaaacguucuggaaucauggaaguugauaggucugaggcaaaggaagguuuaaaaagaggagaaaccacaaaacacgcaguaucacgagggacagcuaagcucagaugguucguagaaagaaauuuggugaaaccagaagguaaagucaucgaucuaggguguggacgugguggguggucauacuauugugcuggguuaaagaaaguaacagaaguuaaaggguacaccaaaggagggccaggacaugaagaaccgauacccauggcaaccuauggcuggaauuugguaaaauugcauucuggaaaagauguauucuuuauuccgccggaaaagugugacacuuuacuaugcgacauaggagaaucaucaccuaauccaacuauugaagagggacggacuuuacgcguauugaagaugguagaaccguggcuuagaggcaaucaauucugcauuaaaauucucaacccauauaugccaucuguaguagagaccuuggaacaaaugcagaggaaacauggagggaugcuaguacggaauccauugucaagaaacucgacccaugagauguauuggguuucauguggaacugguaauauaguuucggccguaaacaugacaaguaggauguuguugaauagguuuaccauggcucaccgaaaaccgacuuacgaaagagacgucgaucuaggggcuggcacgagacauguagccguugaaccugaaguugcgaaccuggacaucauaggucagcgaaucgagaauauaaagcaugaacacaaaucgacuuggcauuacgacgaggauaauccguauaaaacaugggcauaccacgguucuuacgagguaaaaccaagcggcagcgcauccaguaugguaaacggugugguaaaacuucuuacaaaaccaugggauguuauacccaugguaacucagaucgcaaugacagauacuacaccuuuuggacaacagaggguuuuuaaagagaaaguugauacccguacaccaaaagcuaaacggggaacugcgcaaauuauggaaguaacugcuaaauggcuauggggauuucuuucaagaaacaagaaacccagaauauguacccgagaagaguuuacacggaaggugcgaagcaacgccgcgaucggugcuguauucguugaugaaaaucaauggaauagcgcuaaggaagcaguagaagaugagagguuuugggaccuaguccauagggagcgugaauuacacaaacaaggcaaaugugcgacuugcguuuauaauaugaugggaaaaagagagaagaaacucggugaguuuggaaaagcaaaaggaucacgugcaaucugguacauguggcucggggcucguuucuuagaguuugaagcacuagguuuuaugaacgaggaucauugguuuucacgggaaaauucauuaagugguguagaaggagaaggacuacauaaguuagguuacauacuacgggauauaucaaaaauaccggguggaaacauguacgccgaugacacggcugguugggacacacgcauaacagaagaugaccugcaaaacgaagccaaaauaacggacauaauggagccagagcacgcccuauuagccaaguccauauuuaaauuaacauaucagaauaagguaguucggguacaaagaccagccaaaaaugguacagugauggauguuauuucacggagggaucagcggggcucgggccaaguuggaacauauggacuaaauacuuucacaaauauggaagcucaacuaaucagacaaauggagucggaaggaauauuuucucccuccgaacucgaaacuccuaaucuagcuggaagaguuuuggauuggcuggagaaacauggaguugaaagauuaaaacgaauggcaauauccggagaugacugcguagugaagccaauagaugacagauuugcaacagcacuaacugcauuaaaugauaugggaaaaguuagaaaagauauaccccaaugggaaccuagcaagggauggaacgacuggcagcaaguaccauucugcucacaccacuuccaucaguuaauaaugaaggauggcagggaaaucgucguuccuuguagaaaucaagaugaauuaguugggcgggcacguguuagccaaggcgcuggauggucacucagggaaaccgcaugucucgguaaaagcuaugcccaaauguggcagcuaauguauuuccaccgaagagauuuaaggcuggcugcuaaugcuaucuguucggcugaucccgaugacuggguuccaacaaguaggacaacguggucaauacaugcacaucaucaauggaugacgaccgaggacaugcuuucgguuuggaaucggguauggauugaagagaaccccuggauggaagacaagacucacaucucuuccuggggagaugucccauaucuaggaaagcgagaagaccaauggugugguucucuaaucgggcuaacagcuagggcuaccugggccacuaacauacagguugcaauuaaucaaguaagacgacuaauuggaaacgaaaauuacuuggauuacaugacaagcaugaagcgauucaaaaacgaaucugauccagaaggcgcgcucugguga

SEQ ID NO: 21752 - RNA, 9879 nt, Artificial Sequence
  derived and/or modified CDS sequence (opt6) from DENV-1__GQ199849__SS-prME
ucuguaacuaugcugcuuaugcuuaugccgacugcauuagcauuucauuuaacaacucgcggaggugaaccccauaugauaguaacaaagcaagaaagaggaaaaucacuucuuuuuaagacaucugccgguguaaauaugugcacuuugauagcuauggauuugggagaacucugugaagacacaaugacauauaagugcccgagaauuacagaagcagaaccagaugaugucgacuguugguguaacgcuacugauacaugggucacauauggaaccugcucacgcacaggagaacauaggagagacaagcguuccguggcauuagcuccccacgugggauugggacucgaaacaaggacggaaacauggaugagcucagaaggugcauggaaacagauacaaagagucgaaacgugggcuuuacgucacccagguuuuacaguuauagcguuauuuuuagcucaugcuauuggaaccucuauuacgcaaaagggaaucauuuuuauccuauuaaugcuuguaacaccauccauggcuaugagaugcgucgggauaggaucaagagacuucguggaaggacuaaguggggcgaccuggguugaugucguauuagaacacgggucguguguuacuaccauggccaaagauaagccuacgcuagacauugaacuacugaagacagaagugacgaacccugcaguacuuagaaaauugugcauugaagccaaaauauccaacacuacuacagacucaagauguccgacacagggagaagcgacacuuauggaagaacaagaugcaaauuuugucugccggagaaccuucguugaucgagguugggggaauggaugcgguuuauuugguaaagguucccuuaucacgugugcuaaguuuaaaugcguaacgaaauuagagggaaagauuguucaauaugagaauuuaaaauauagcgugauaguaacgguacacacaggugaucaacaucaaguugguaaugaaagcacugaacacggaacaacugcaaccaucacgccacaagccccgacuucugagauacaacuaacagauuauggugcccuuacacucgacuguucaccaaggacaggacuagauuucaaugaaaugguacuccuaacaaugaaagagaagucgugguuaguccacaaacaaugguuccucgaucuuccgcuaccuuggacaucaggugcuucuacgagucaagaaaccuggaacaggcaagaccuauuaguaaccuuuaaaacugcucaugcgaagaaacaagaagucguuguccuagguucacaagaaggagcgaugcauacugcguuaacaggugcaacagagauucagaccucugguacaaccacaauauuugcugggcaccuuaaaugcagauuaaaaauggacaagcucgcccuaaagggaaugucguacguaaugugcaccgguaguuuuaaacuagaaaaagaaguggcggagacacaacacggaaccguacucguccaaauaaaauaugaagguaccgaugcuccaugcaaaauaccuuuuuccacucaggacgaaaagggaguaacacaaaauggacgacuuauaacggccaauccgauuguuacagauaaagaaaaacccguaaacauagaagcagaaccacccuuuggagagaguuauauagucauuggugcaggagaaaaagcgcuuaaguugucuugguucaagaaaggguccaguauaggaaaaauguucgaagcaacugccagaggggcacgacguauggcaaucuuaggugauacugcaugggauuuuggcuccauuggcggcguuuucacgucuguuggaaaguuaguucaucagaucuucggaacugcauauggagugcuauucucaggagucaguuggacaaugaaaauagguauugggguccucuugacgugguugggauugaacucacggaguacaaguuuaaguaugacauguauugcaguugggcuaguuacguuauauuuaggagugaugguccaagcagacagcggaugcguaaucaacuggaagggaagagagcugaaaugcggaucaggaauuuucgucacaaaugaaguccacacauggacugaacaguacaaauuucaagccgacagcccaaaaagacucagugcagcuauugguaaagcgugggaggaggguguaugugggauuagaagugcaacuagauuggaaaacauaauguggaaacaaauaucuaacgaguugaaucauaucuuacucgaaaauggucuuaaauucacagugguagucggugauguagucggaauauuagcacagggcaagaaaaugauacgcccacaaccgauggaacacaaauacaguuggaagucuugggguaaagccaagauaauaggugcugacguacagaauaccaccuuuaucaucgacggaccaaauacgccagaauguccagaugaucaaagagcguggaacauaugggaagucgaggacuauggguuugggauauuuacuacaaacauauggcugaaauuacgcgauucauauacgcaggucugugaucaccgguuaaugucugcggcuaucaaagauucaaaagcaguacacgcugauaugggauacuggauugagagugaaagaaacgaaacuuggaaacuugccagggcgucuuucauugaggucaaaacguguauauggccuaaaagccauacgcuuuggucaaauggcguuuuggagucagaaaugaucauucccaaaauuuacgggggaccgauuagucaacauaacuauaggccaggauauuucacgcaaaccgcgggacccuggcauuuaggcaaacuugaacuagauuucgauuugugcgaaggaacaacugugguaguagaugaacacuguggcaauagaggaccaucgcuacggacgacgacgguuacagguaaaauaauucaugaaugguguugcagaucguguacacuacccccauuaagauuuaaaggagaggaugggugcugguaugguauggagauccgucccgucaaggaaaaagaagaaaauuugguaaaaucgaugguaucagcaggaucgggagaaguagacucauucucacuuggacuccuaugcacgucaaucaugauugaagagguuaugcggaguagauggaguagaaaaaugcuuaugacuggaacauuagcaguauuucuauuacuaauaaugggacaguugacauggaacgaucugauacgccucuguauuauggugggugcgaacgcuagugauagaauggguaugggcaccaccuauuuagccuuaauggcuacauuuaagaugagaccaauguucgcaguagguuugcuauuuagaagacuaaccaguagagagguccuauuacuuacgaucggucuaucccuaguagcaucaguagaacucccaaauucccuagaagaacuuggggauggacuugcaaugggaauaaugauacuaaaauuacuaacagacuuccaaucccaccaguuaugggcgacguuacugagucuaacuuucauaaaaaccacacuaagccuucacuacgcauggaaaaccauggcuauggucuuaucuauaguaagccuguucccauuaugccuaucgacaacaucgcagaaaacuacuuggcugcccguucuauuaggcucauugggaugcaaaccccuaacuauguuccugauugcggaaaauaagauaugggggagaaaauccuggccccuaaaugaagguauaauggccguggguguagugaguauacuacuaucuagucugcuaaagaacgacgugccguuagcugggccauuaauugcaggcggcauguuaauagccuguuacguaauuuccgguagcagugcagacuuaucacucgaaaaagcugcugaaguaagcugggaagaagaagcugagcauaguggugcaucacauaauauauuuguugagguucaagaugaugguacuaugaaaauaaaagaugaagaacgagaugacacauuaacaauacuguuaaaagccacauuacucgcaguuaguggaguauauccacuuucaauucccgcgacauuauucgugugguacuuuuggcaaaagaagaagcagagaaguggcguauuaugggauacuccaagcccaccggaaguugaacgagccgcgcuagacgaugggaucuauagaaucaugcaaagagguuuauugggacgaucucaaguugggguuggaguauuccaggaaaauguguuucacacgauguggcauguaacucguggagcagugcuaauguaucaggguaaacgacuagagccauccugggcauccguaaagaaagaucugaucaguuauggaggugguuggagacuacaagguagcuggaauaccggggaggaaguacaaguuaucgccgucgaaccagggaaaaauccgaaaaacguucagacggcaccaggaacauucaaaacaccagaaggugaaguuggcgcgauagcauuggacuucaaaccgggaacaagugggagcccaauuguuaauagagaagguaaaauaguagguuuauaugguaauggaguaguuacaacaagcgggacuuacguauccgcgauagcccaaacaaaagccucacaggaaggaccacuaccagaaauugaagacgaaguauuuaggaaaagaaauuuaacuauuauggauuuacauccaggcucuggaaaaacgagaagguaccuaccugcuauaguaagggaggcuauuaaacgaaaacuccgaacacucauacuagcuccuacaagagugguagcaagugagauggcagaagcgcuaaaaggaaugccuauccgguaucaaacaacagcugugaaaucugaacauacaggaaaagaaauuguggaucugaugugucacgcuacauucaccaugcgauuacuaagcccagugcgugucccaaacuacaacaugauaaucauggaugaagcacauuuuacagaccccaguaguaucgcagcacgaggauauauuucuacucgugucggaaugggcgaagccgcagccauuuuuaugacugcaacgccaccggguucaguugaggcuuuuccgcaauccaaugcuguuauacaagaugaagaacgagauauucccgagcguagcuggaacuccggauacgaauggaucacugacuucccagggaagacagugugguucguuccgaguauaaaaaguggaaacgauauagcaaauuguuuaagaaagaaugguaaacgcguaauacaacuuucaagaaaaacauuugauacggaauaucaaaagacuaaaaauaacgauugggacuacgucguuacaacagacauauccgaaaugggggcaaacuuuagggccgauagaguuauagauccccgccgcugcuugaaaccgguaauuuuaaaagacgguccugaaagagugauccuggcuggaccaaugccuguaacaguugcaagcgcugcacagcguagaggccgaauagguaggaaucauaauaaagagggggaucaauauauauacaugggccagccuuuaaauaacgaugaagaucaugcacacuggacugaagcuaagaugcuucuggacaauauaaauacuccugaagguauaauaccagcccuauucgaaccagaaagagagaaaagugcagcaauugauggagaguauagauuaagaggggaagcacgaaaaacauuuguggaacuuaugaggagaggagauuugccggugugguugaguuacaagguagcguccgagggauuucaguauuccgauagacgaugguguuucgauggugaacgaaauaaucaaguguuggaagagaauauggauguugaaauauggacuaaagaaggagaaagaaagaaauugcgcccccgguggcucgacgcucgaacauauagcgauccguuagcucuccgagaguucaaagaauuugcggcgggucgaagaucaguguccggggaccucauuuuagaaaucggaaaguugccacaacaucuuacgcaacgagcccaaaacgcacucgacaaucuuguuaugcuacacaacuccgagcaagggggacgagcauacagacaugcuauggaagaguugcccgacaccauagagacacucauguuacucgcauugauagcaguauuaacgggaggaguuacacuuuucuuccugucaggucgcggacuaggaaaaacaaguauaggauugcuaugcgucauggcuuccucagugcuucuuuggauggccaguguugaaccacauuggauagcggcuaguauuauccuugaguucuuuuuaaugguccucuuaauuccugaaccggauagacagagaaccccucaggacaaucaacuagcauacgucgucaucggacuacuauuuauuauacuuacuguagcagcuaaugaaauggguuugcucgaaaccaccaagaaagaccuuggaauuggacacgucgcaguggaaaaucaucaccaugcuacgaugcuagauguagauuuacauccggcaagcgccuggacccuauacgcaguggcuacaacuauaauuacgccuaugaugcgucauacaauagagaauacuacggccaauaucucauuaacugcgaucgcgaaucaagcggcgauuuuaaugggacuagacaaaggcuggccgauaucgaaaauggauauagggguaccucuguuggcacuaggaugcuauucccaaguuaauccgcugacguuaaccgccgcaguccuaauguuaguggcucacuaugcuauuaucggacccggucuacaggcaaaagcgacgagagaggcucaaaaacguacagcugcaggaauaaugaaaaauccuacaguugacggaauuguagccauagacuuagauccuguagucuaugacgcuaaauuugagaaacaauuaggccaaaucaugcuauugauuuuauguacuucucaaauauuacuuaugcggacuacaugggcauuaugcgaaucuauaacauuggcaacuggucccuuaaccacccuuugggaagguaguccaggaaaauuuuggaacacaacgauagcgguaucaauggcuaacaucuuuagaggcucauaccuggcuggugcuggacuagcguucagucuaaugaaaucauuaggaggaggaagaagaggcacgggagcacaaggcgagaccuugggggaaaaguggaaaagacaacuuaaucaacuaucuaaaucggaauuuaauauauauaaaagaucugguauaauggagguugaucguagugaagcaaaagaaggauuaaagcguggagaaacaaccagacaugcaguaucgcgcgguaccgcaaaauuaagaugguuuguagaaaggaaccucguuaaaccagaaggaaaaguaauagaccugggcuguggucgaggaggcuggucuuauuauugugcaggguuaaagaaagugaccgaaguaaaaggauauacgaaaggaggacccggacacgaagaaccuauaccaauggcaaccuacggguggaacuuagucaaacugcacucaggcaaagauguauucuuuacgccgccagaaaaaugugauacuuuauuaugcgauauaggggaauccucaccuaauccaacaauagaagaaggucggacccuacggguacuuaaaaugguagagccauggcuccgugguaaucaauucuguauaaaaauuuuaaaccccuacaugccgucaguaguggaaacguuagagcaaaugcaacggaaacauggaggaaugcucguuagaaacccacuaagucgaaauaguacccaugaaauguauugggugucaugcgguacuggaaauauuguaucagcagucaauaugacauccaggaugcugcugaaccgauuuacuauggcccauagaaaacccacauaugaacgggauguagaucucggugcugggaccagacacgucgcagucgaacccgaaguagcaaaucuagauaucaucggacagaggauagagaauauaaaacaugaacacaaaucgacauggcacuacgacgaagauaauccguauaaaacgugggccuaucacgguucuuaugagguuaaaccgaguggcucagcuaguucuauggucaauggggucguuaaacuacugacaaagccaugggauguaauaccgaugguuacacaaauugcaaugacugauacaacgcccuuuggccaacagcgaguguuuaaagaaaaaguagauacaagaaccccuaaggcuaaaagaggcaccgcucaaaucauggaaguaacggcaagauggcucuggggauuccuaucgagaaacaagaaaccuagaauaugcacuagagaagaguuuacccguaaagugagguccaaugcagcuaucggcgcuguauuugucgaugagaaucaguggaauagugcaaaggaggcuguagaggaugaacguuucugggauuuaguacaaaaagagagagaacuacacaagcagggaaagugugcaaccugugucuauaauaugaugggaaaaagagaaaagaaauugggagaguucggcaaggcaaagggaagcagagcaauuugguauauguggcuuggagcacgauuucuggaguucgaagcccuaggcuucaugaaugaagaucauugguucagucgagaaaacagucuaucuggaguagaaggagagggacuccacaaguuaggauacaucuugagggacauaucaaaaauuccaggcgggaauauguaugcugaugacacagcaggaugggacacaagaauaacagaagaugauuugcagaaugaggcaaaaauaacagacauuauggaaccagaacacgcacuacuugcaacaaguauauuuaaacuuacguaccaaaauaaaguaguaagaguccaaaggcccgcgaaaaauggaacggucauggauguuauaucuagaagagaucaacgggguucagggcaaguaggaaccuacgguuuaaauaccuuuacaaauauggaagcacaauuaaucaggcagauggaaucugaaggaauauuucucccuucugaguuagaaacaccuaaucuggcugagagaguacuagauugguuagaaaaguacggaguagaaagacuuaagcgcauggcuauuuccggagaugauuguguaguaaagccuaucgaugauagauucgcaacagcgcuuacagcguuaaacgacaugggaaaaguuagaaaggacauaccgcaaugggaaccaucaaagggguggaacgacuggcaacaggucccauuuugcucccaccauuuucaccaacuaaucaugaaagauggacgugaaauaguagucccaugucguaaucaggacgaauuaguuggacgggcacgaguuucacagggggccggguggucucuacgagaaacagcaugucucgguaaaaguuacgcacagauguggcaauuaauguacuuucacagacgugaccuccgguuagcugcgaacgcuauauguagcgccguaccgguugauuggguccccacaucacguacaacauggagcauucaugcccaccaucaauggaugacaacagaagacaugcuaagcguauggaacagaguauggauugaagaaaaccccuggauggaagacaaaacccacgugaguuccuggggagacgugccauauuuggggaagcgagaggaucaguggugcggaagucuaauaggacuaacagcaagggcuacaugggcaucaaauauucaaguagcuauaaaucaaguccgacgacuaauugguaaugaaaacuaccuugauuacaugacaagcaugaaaagauucaaaaaugaaggagauccugaaggugcucucugguag

SEQ ID NO: 21753 - RNA, 9879 nt, Artificial Sequence
  derived and/or modified CDS sequence (opt6) from DENV-1__FJ898410__SS-prME
uccguuaccaugcuacucaugcugaccccaacugcccuugcauuucauuuaacgacgagaggaggagaaccucacaugauuguaaguaaacaagaaagaggcaaaucgcuucuauuuaaaaccuccgcuggaguaaauauguguacacuaauagccauggaucuaggagaauuuugcgaagacacuaugacguauaaauguccgagaaucacggaagcagaaccagacgauguagauuguuggugcaaugcuacugauaccuggguaacguaugguacguguucucaaacuggugaacaucgacgggauaaaagaucaguugcucucgcuccacacgucggcuuaggauuagaaacuagaacugaaaccuggaugucgucugaaggugcauggaaacaaauacaaagaguugagacuugggcgcuacgucaucccggauuuacuguuauagcucuauuucuagcacaugcuauugggacaucuaucacacagaaagguaucauuuuuauacuauuaaugcucguaacucccaguauggccaugagguguguagguauuggaagcagggauuucguggaaggucuuaguggugcuacguggguagacguuguacuugaacacggcaguuguguaacaacuauggcaaaagauaaaccaacacuagauauugaauuauuaaaaacagaaguaacaaauccagcuguccuaagaaaacuaugcauagaggcgaaaauaagcaacacgacgacagacagccgauguccuacccagggagaggcaacauugguagaagaacaagaugcaaacuucgucuguagaagaacauuuguagacaggggcugggggaauggauguggauuauuuggaaagggaucucucaucacuugcgcaaaauucaaauguguaacaaaacucgaaggcaaaauaguacaguacgagaaccugaaauauagcguuauaguuacaguccauacaggugaucagcaccaaguagguaaugaaagcacggagcacggaaccacugcgacaauuacgccacaggcaccaucaacagaaauacaguuaacggacuacggcgcacuaacacuagacuguagcccacguacgggccuagauuucaaugaaaugguauuacucaccaugaaagagaagaguugguuagugcacaaacaaugguuccuugaucuuccgcuacccuggaccucuggggcaaguacaagucaagaaacuuggaacaggcaagaccuauuaguaacguuuaaaacugcgcacgcuaagaaacaagaaguugucguuuuggguagucaggaaggagcuaugcacacugcauugacaggcgcaacugaaauacaaacaagcggaacaacaacuauauucgcaggacaccuaaaaugcaggcucaagauggauaaacugacgcuuaaagguaugucguauguaaugugcacuggcucauucaaauuagaaaaagaaguagcugagacacagcaugggacugugcucgugcaaauuaaguacgaaggaacugacgccccuugcaaaauacccuuuuccacacaggaugaaaagggcguaacucagaacggacgguugauaacugcaaacccuaucgucacagauaaagaaaaacccguaaacauagaagcugagccaccguuuggcgaaucuuauauagucaucggagcaggagaaaaggccuuaaaacuaaguugguuuaagaaaggcuccaguauagguaagauguuugaggcuacugcuaggggagcuagaagaauggcgauacuaggagauacugcuugggauuuuggcucaauaggaggagucuuuacuucagugggaaaacuuguacaucaaauuuuuggaacagcguauggaguauuguuuucuggaguuagcuggaccaugaaaauugggauuggaguauugcugacauggcugggauuaaauucacgaaguacaucacucucaaugacauguaucgcugucggucugguaacccuauaucuaggcguaaugguucaagcagacuccggcugcguaauuaacuggaaaggaagagaguuaaagugugguucuggaauuuuugucacgaaugaagugcauacauggaccgaacaguauaaauuucaagcagauucaccgaagagauuaagugcggccauagggaaggcuugggaagaaggaguguguggaauacgaucagcaacucgcuuagaaaauauuauguggaaacaaaucagcaaugaacuaaaccauauacuacucgagaaugacaugaaacugacagugguuguaggcgauguugcgggcauccuugcucaaggaaagaaaaugauccgcccucagccgauggaauauaaauauucauggaaaauaugggggaaagcuaaaauaaucggcgcugauguccaaaacaccaccuucaucauagauggaccaaauacacccgaaugucccgaugaccaaagagcauggaacauaugggaggucgaggauuacggcuucgggauuuuuacaacuaauauaugguuaaaacuaagagauucauauacccaagucugugaucacagauuaaugucagcggcaauaaaagauaguaaagcaguacaugcggauaugggguauuggaucgagucggagaaaaaugagacauggaagcucgcucgggcaucauucauugaagugaaaacauguauauggcccaagagccauacgcuaugguccaacggggucuuggaaucagaaaugaucaucccaaagauauauggcgguccaauaagucaacauaacuaccguccaggauacuuuacgcaaaccgcagguccauggcauuuagguaagcuggaacuagacuucgaucuaugugaaggaaccacugucguaguugacgaacacugcggaaaccgcgggccaucuuuaagaacuacgacugucaccgggaaaauaauacaugagugguguugcagaucgugcacacuuccuccacuucgguucaagggggaagacggaugcugguaugguauggaaauuagaccuguuaaggaaaaggaagagaaucuuguaaaaucuauggucagugcggguucaggagaaguagauuccuucucgcuuggguuacuaugcauuagcauaaugauagaagaaguuaugagaucucguuggucacguaaaauguuaaugacuggaaccuuagccguauucuucuuacuaauaaugggacaacucacuuggaaugaucuaauaagacuuuguauuauggugggagcgaaugccucagaucggauggguaugggaacaacauaucuagcuuugauggcuacguuuaaaaugagaccaauguucgcuguaggccuacucuuucguagguuaaccuccagagaaguuuugcuguugaccaucggacuaucauuaguugccucuguagagcuucccaacucacuugaagaacugggagaugguuuagccaugggcauuaugauuuuaaaacuacuaacagauuuucaaucccaccagcuuugggcaacccuucuuucuuuaacuuucauaaggacgaccuucagccuucacuaugccuggaagaccauggcuaugguucuaaguauagucucauuguuuccauuaugucucaguacaacaucacaaaagacaacguggcuuccgguacuauuggguuccuuaggauguaaacccuuaaccauguuucuaaucgcggagaacaaaauauggggcagaaagucauggccccuaaacgaaggaaucauggcuguugguauaguaagcauauugcuaagcagucuacucaaaaacgacguaccucuugcgggaccauuaauagcugguggcaugcuaauagcaugcuauguuauaucaggcaguucagcggaccuauccuuagagaaagcugccgaaguuuccugggaggaagaagccgagcauucgggugcaucacauaauauccuaguagagguacaagaugacgguaccaugaagauuaaagaugaagaacgcgaugauacacucacaauacucuugaaggccacacuacuagcaguuucuggcguauauccauuaaguauuccggcaacacuauuuguaugguauuuuuggcagaaaaagaaacaaagaagcggaguguuaugggauacacccagcccgcccgaaguagagcgggcuguuuuggaugacgguauauauaggauaaugcagcgcggccuccucgguagaagccaaguaggugugggcguguuccaggaaaaugucuuucacacgauguggcaugucacaagaggggcaguauuaauguaucaaggcaaaagauuggaaccaaguugggcuucggucaagaaagacuuaauaucguacggaggagguuggagauugcaaggaagcuggaacacaggagaagagguacaaguaaucgcagucgaaccuggcaaaaaucccaaaaacguucaaacagcaccgggcacauucaaaacuuccgaaggagaggugggagcgaucgcucuggacuuuaaaccaggcacaaguggaucgccuauuguuaaucgggaaggaaaaaucguaggauuguauggcaauggagucguuaccacaucagguacauacguaucagccauagcacaagcaaaagcgagucaggaaggcccacugccggagauagaagaugaaguauuccggaaacgaaaccuaacaauaauggauuuacauccugggagugggaaaaccagacgauaucuaccggcuauaguacgagaagcgaucaaaagacgacuuaggacuuugauucuugcaccaacuagaguaguggcgagcgaaauggccgaagcucuaaaaggcaugccuauucgcuaucaaacuacugcaguuaaauccgaacauaccggaaaagaaauaguugauuuaaugugccacgcaacauuuacuaugagacuacucucgccuguacgcguaccaaauuauaauaugaucaucauggaugaagcucauuuuacagauccuucuaguaucgcugcacgggguuacauuaguacuagggucgguaugggcgaagcagcagcuauauuuaugacugcaacgccaccaggcagugucgaggcauuuccacaaucaaaugcaguaauucaggacgaagaaagagacauuccagaaagaucuuggaauaguggguacgaguggauuacugacuuuccaggcaaaacgguaugguuugucccuucaaucaagucgggaaacgacaucgcuaauugucucaggaaaaaugggaaaagaguaauccaauugagucguaaaacuuuugauacagaauaucaaaagacgaaaaauaacgacugggacuauguuguaacgaccgauauuucggaaaugggagcaaauuuuagagcagauagagucaucgauccacggcgauguuuaaaaccagucauucuuaaagaugguccugaaagagucauucucgccgguccuaugccagucacaguugcaucugcggcacagcgucgcgguagaauaggaaggaaccacaacaaagaaggagaucaauacauuuacaugggccaaccacugaacaaugacgaagaccacgcacacuggaccgaagcgaaaaugcuuuuggacaauauuaauacgcccgaaggcauaauaccugcacucuuugaacccgaaagagaaaagucagcugcaauugauggcgaguauaggcuuagaggagaagcacguaaaacuuuugucgaacuaaugagacguggugaccuuccagucuggcuguccuauaaagucgcaagcgaaggcuuccaauauagugaucguagaugguguuuugacggugaaaggaacaaucaaguguuagaagaaaauauggauguagagaucuggacgaaggagggugaaagaaagaaacuucgaccacguugguuagaugcacguacuuacucagacccucuugcauuaagggaauuuaaggaguuugccgccggcaggagaagcgucagcggggaucuaaucuuagaaauagguaaauuaccacaacauuugacccagcgagcacaaaacgcacuagauaaccuaguuauguuacauaacagcgaacaaggcgggagagcauaccgacacgcuauggaggaguugccugacacaauagaaacguuaaugcuguuagcgcuaauagcuguauuaacuggagggguaacacucuucuuucuuucaggaaggggucuugguaaaacaucgauuggacuccuauguguaauggcaucaucuguacuuuuguggauggcgaguguagaaccucauuggauagcggccagcauaaucuuagaguucuuuuugaugguguuacucauaccagaacccgauaggcagaggaccccucaagacaaccaauuagccuacguagucaucggacuacucuuuaugauauuaaccguagcagcaaaugaaaugggccuccuugaaacaacuaagaaagaccuugguauaggacauguugccgucgaaaaucaccaucacgccgccaugcuugacguugaucuacacccggccucagcauggaccuuguaugccguugcuacuacaauaauuacaccaaugaugaggcacacuauugaaaacacaacugcaaauauaagccuaaccgccauagccaaucaggcggccauauuaauggggcuagacaaaggcuggcccauauccaaaauggauauaggaguuccccuauuagcacuuggcuguuacucgcaaguaaauccucuuacacugacggcugccgugcucauguugguggcacauuaugccauuauuggaccaggacuucaggcuaaggcgacacgggaggcucaaaagcgaacugcggcuggcauaaugaaaaacccgacuguagacgguauaguagcgauugacuuggacccgguagucuacgaugccaaauucgaaaaacaacuaggacaaauaaugcuauuaauacucuguaccagucaaauucuauuaaugagaaccacaugggcucuaugcgaaucaaucacacuagcgacuggcccacuuaccacgcuaugggaaggaaguccagggaaauuuuggaauacuacuaucgcaguaaguauggccaauauuuuccgugguaguuacuuagcgggagcggguuuagcguucucauuaaugaagucuuuggguggaggacgcagagggacuggagcccagggagaaacguuaggcgaaaaauggaaaagacaacuuaaccaacugagcaagccugaguuuaacaccuacaaacguagcggaauaauggaaguagaucguagcgaagccaaggaaggacuaaaacgaggcgaaacuaccaaacaugcaguuagcaggggaaccgcaaaauuacgcugguuuguagaaaggaaccugguuaagccugaagguaaaguuaucgaccuaggauguggucgaggaggguggagcuauuacugugccggauugaagaaaguaacugaaguuaaaggcuauacuaaaggagguccaggacacgaagaaccaauaccaauggcaacuuacggcuggaaucuuguuaaacuccauagugggaaggaugucuucuucauucccccagaaaaaugugauacacucuuaugcgauauaggugaaucgucuccaaaucccacuaucgaggaaggaaggacacuucgaguacuaaaaaugguagagccuuggcucagggguaaucaauuuugcauaaaaauuuuaaauccuuauaugccaucagucguagaaacguuagaacaaaugcaacguaagcacggugggaugcuagugcguaauccacuuucgcgcaauaguacacaugaaauguauuggguaagcuguggaacagguaacauaguaucagcuguuaauaugacuagcaggaugcuguuaaauagauucacuauggcgcaucgaaagccaaccuaugaacgagacgucgaccuaggggcuggaacgagacauguagcuguagaaccagaaguagcaaaucucgacauuauuggucaaaggaucgaaaauauaaaacaugagcacaagagcacauggcauuacgacgaagacaacccauacaagacgugggcauaccauggaagcuaugaaguaaaaccaucuggauccgcuaguucaaugguaaauggaguagucaaauuauuaacaaaacccugggaugugauuccaauggucacccagauagcuaugaccgacacaacccccuuuggucaacaaaggguuuuuaaagaaaaagucgauacuagaacuccaaaagccaaaagaggcacagcacaaauaauggaaguaacagccaaauggcuuuggggcuuccuuucgagaaacaagaaaccccgcauaugcacgagggaggaauuuacaagaaaaguccgaucgaaugccgcuauaggggcaguuuucguagaugaaaaccaauggaacagugcaaaagaagcuguggaagacgaaagauuuugggaucuaguacauagggagcgugagcuacauaaacaagguaagugugcaacauguguuuacaauaugauggggaaaagggagaagaaauuaggagaguuugggaaagccaagggcucccgcgcaauuugguauaugugguuaggcgcucgauuuuuggaauuugaagcacuaggauuuaugaaugaagaccauugguucucgcgagaaaauucccuaagcggugucgaaggcgaaggucuacauaaauuaggauauaucuuaagagauaucaguaaaauaccaggaggaaacauguacgcggacgacacugccggaugggacacucgcauaaccgaagaugaucuacaaaaugaagccaaaauuacugacauuauggaacccgaacacgcucuguuagcaaagucuauauuuaaacuuacuuaucagaauaaaguuguacgaguacaacguccugcuaaaaaugguacaguuauggacguaauuuccagaagagaucaacgaggcucagggcaagugggaacguacgguuuaaauacguucacaaauauggaggcacaguuaaucagacaaauggaaagugaaggaaucuuuagccccucggaauuggagacgccuaacuuagcugguaggguucucgacugguuagaaaagcauggagucgaaagacuaaaaagaauggcuaucuccggugaugacuguguugugaagccaaucgaugaucguuuugcuacugcuuugacagcguuaaaugauauggguaaaguuagaaaagauauaccgcaaugggaaccaagcaagggauggaaugauuggcagcaaguaccuuuuuguagccaucacuuccaucaguuaauuaugaaggacggaagagaaauagugguaccauguagaaaucaagaugaauuaguuggccgagcgaggguuucacaaggugcgggauggaguuugagagagacugcaugccuaggaaaauccuaugcacaaauguggcaacuuauguacuuucaucgacgugaccuacgacuugcugcaaacgcuauaugcagugcgguaccaguagacugggucccgaccuccaggacaacauggucuauacaugcacaccaccaguggaugacaacagaggauaugcuuaguguauggaacagaguguggauagaagaaaauccauggauggaagauaagacucacgugaguucauggggagacgucccguacuuaggaaagcgcgaagaucaguggugugguucacucauuggauugacagcacgagccaccugggcaacaaauauacagguugcaaucaaucaaguucgacgacuucucggcaaugaaaacuaucuagauuauaugacaaguaugaagcgauucaaaaacgaauccgaucccgaaggugcauuaugguaa

SEQ ID NO: 21754 - RNA, 9879 nt, Artificial Sequence
  derived and/or modified CDS sequence (opt6) from DENV-1__FJ898411__SS-prME
ucaguaacaauguuacuuaugcuuaugcccacagcacuagcauuccaccuaacaacuagaggaggugaaccacauaugauugugucaaaacaagaaagaggaaagagcuuacucuuuaaaacaagugccgguguuaauaugugcacuuugauagcuauggaccuuggagaauuuugcgaagauacgaugaccuauaaauguccaaggaucacagaagcagaaccagaugacgucgauuguuggugcaacgcaacugacaccuggguaacauacggaacauguagccaaacaggugaacauagaagggauaaacguucaguggcccuugcaccacacguagguuuaggauuagaaaccagaacagagacuuggaugaguucugaaggggcuuggaaacaaauucaaagaguugaaacgugggcucuacgacacccuggguuuaccguuauagcacuauuuuuagcacaugcaauaggaacaucaauuacgcaaaaagggaucauauucauacuauuaaugcucguaacuccuuccauggcuaugcgguguguugguauagggagcagagauuuuguggagggucuaucuggugcuacauggguagauguaguguuagaacacggcucaugugugacaacgauggcgaaagacaaaccgacucuugauauagaauuauugaaaacagaagucacgaaucccgcuguacuaagaaaacuaugcauugaggcaaaaauuucaaacacaacuacagauagcagaugcccaacucaaggggaagcuacacuuguggaagaacaggaugccaacuuuguauguagaaggacguucguagacagaggauggggcaacggguguggacuuuucggaaaaggaucucugauuacaugcgcgaaauucaaaugugugacuaaacuagaaggcaaaauugugcaauacgaaaaccucaaauauagugucauaguuaccguacauacaggugaccaacaccaaguaggcaacgagucuacggaacacggcacaacagcaacaauaacaccacaggccccaucaacugaaauacaguuaacggauuauggagcauugacgcuugacugcuccccaagaacaggucuagauuuuaacgaaaugguuuuauuaacuaugaaagagaaaaguuggcuaguccauaaacagugguucuuggauuugccguugccguggacuucgggugcaucgacaagccaagagaccuggaaucgaaaagaccuacugguaacauuuaaaacggcccaugcgaagaaacaagaaguaguaguacugggaucucaagaaggagcaaugcacacugcauuaaccggggccacagaaauucaaacaaguggcaccacuacaaucuucgcuggccauuuaaaaugucgucuuaaaauggacaaacucacacuuaaagguaugucguaugucaugugcacuggcucauucaaauuggagaaagaaguagcugaaacacaacacgggacuguauuagugcaaaucaaauacgaaggaacagaugcaccuuguaaaauaccuuucucaacgcaagacgaaaaaggagucacgcaaaaugggcgauugauuacagcaaauccuaucguaacugacaaggaaaaaccaguaaauaucgaagcggaaccacccuuuggcgaaucauauauugucauaggcgcaggggaaaaagcacugaaguugucgugguucaagaagggauccucgauaggaaagauguuugaagcaacugccaggggagccagacguauggcgauacuuggagauacagcaugggauuuuggcucaauuggcgguguauucacuucaguagguaaacucgugcaccagaucuuuggcaccgccuaugguguuuuauucucgggagugucauggacaaugaagauaggaaucggaguacuauuaacauggcuaggacucaauucaagaucuacgagucucucaaugacguguaucgcaguaggauuagugacacuguauuuaggaguuauggugcaagcagauucugguuguguaauaaauuggaaaggaagagaacuaaaaugugggucuggaaucuucguaaccaaugaaguccacacuuggacggaacaguacaaguuucaagcugauucaccaaagagacuuagcgcagcaauaggcaaggcaugggaagaaggaguuugugggauucgaucagcgacgcgucuggaaaacauuauguggaaacaaauaaguaaugaguugaaucacauacuucuggagaaugauaugaaauucacagucguaguaggcgaugucgcaggaauacuggcacagggaaagaaaaugauacgcccucagcccauggaauauaaauauucauggaaaucuugggguaaagcuaaaauaauaggugcagauguucaaaauacuacauucauuaucgacgggccaaauacaccagaauguccggaugaucaaagagcauggaacauaugggaagucgaagacuacggguuuggcauauuuacuacuaacauuuggcuaaagcuccgugacaguuauacacaaguaugugaucaucgacuuaugagugcggcgaucaaagauuccaaagcuguucaugcugauaugggauacuggauagaaagugagaaaaaugagacuuggaaguuagcucgugccagcuucauagaagugaaaacuugcauuuggccgaaaagucauacguuguggaguaacgguguauuggaaucugaaaugauuaucccaaaaauuuacggagguccaaucucacaacauaauuaucgaccagguuacuucacacaaacugcuggaccauggcacuuggggaaauuggaauuagauuucgaccucugugaagguacgaccgucguuguugaugaacacugcggaaauaggggaccaagucuacguacgacgacaguuacggguaagauaauacacgaauggugcugucgcucauguacgcugcccccauuaagauuuaaaggcgaagauggcuguugguacgguauggaaauaagaccuguuaaggagaaggaagagaaccucgugaaaagcaugguaucugcaggaucuggggaaguagacucuuuuagcuuaggucuauuguguaucucaaucaugauagaagaaguaaugagaagcagauggagcagaaaaaugcuuaugacugguacgcuagcuguauucuuucuacucauuauggggcagcuaacauggaacgaccucaucagacuaugcauaaugguaggagcaaacgcaucagauagaauggggauggguaccacguaucuagcgcucauggcuacuuuuaagaugagaccaauguuugcaguuggauugcuguuuagaagacuuacaucuagagagguucuuuuacugaccauaggacuuucucugguugcaaguguggaauuaccaaauuccuuggaagaacuuggugauggguuagcgaugggaauaaugauuuuaaagcuguuaacugacuuccagagucaccagcugugggcuacguuauuaucuuuaaccuuuauaaaaacaacauucucucuacauuaugcauggaaaacuauggccaugguuuuaucaauagucagucucuuuccgcuauguuugucuacaacgagucaaaagacuaccuggcuuccuguccuccuaggcucccugggauguaagccauuaacaauguuuuuaauugcggagaauaaaaucuggggaaggaaaagcuggccccuuaacgaaggcauaauggcaguggguauaguaaguauacuacuaucugcauuguugaagaaugaugucccuuuagcgggaccacuaauugcaggcggaaugcuuauugcuuguuacguuauuucaggaucuucagcggauuuaaguuuagaaaaggccgcggaaguuucuugggaagaggaagccgaacacucuggugcaagccauaauauacuuguugagguccaagaugauggaacaaugaagauaaaggacgaagaacgagaugacacucuaacuauuuuguugaaagcaacacuacuagcuguauccggaguauauccauuaucaauaccagcuacguuguucgucugguauuuuuggcagaagaagaaacagcgaucuggaguuuuaugggacacaccaucgccaccagaagucgaaagggcagugcuagaugaugguauauauaggaucaugcagagaggacucuuagggcgaagucaagucgggguggguguauuucaagaaaauguuuuucacacaauguggcacgugacaagaggagcugugcucauguaucaagguaagcgauuagaaccaaguugggcgucggucaagaaagacuuaauaucuuacggcggggguuggaggcuucaaggaucuuggaauacaggagaagagguccaaguaauagcaguugagcccgggaaaaauccuaagaacguacagacugcaccaggcacauuuaaaacgucugagggugaaguaggggcuauagcauuagauuuuaaacccggaaccuccggcucgccuaucguaaauagagaggguaaaauaguuggacuuuauggaaacggaguaguuacaacaucagguacuuaugucucagcuaucgcacaagcuaaagcaucucaagagggaccauuaccggagauugaagaugaagucuucagaaaacgcaaucugacaauaauggaccuacacccugggagcggaaagaccagaagauacuuaccugcgauuguucgagaagcuauaaaaagaaaacuucgcacacuuauacucgccccuacuagagugguagcuagcgaaauggcggaagcucugaaaggaaugccuauacgcuaucaaacaacagcugucaaaucugaacauacuggaaaagaaauuguagauuuaaugugucaugcuacuuuuacaaugagauuauuaaguccaguuagaguaccuaauuauaacaugauaaucauggaugaagcacauuucacugaucccagcucuaucgcagcaagagguuauauuucuacacggguuggaaugggagaggccgcggcaaucuucaugaccgccacuccuccaggcagcguggaagccuuuccacaaagcaacgcaguaauucaagaugaggaacgugauauaccugagaggagcuggaacaguggguaugaguggauaacugacuuuccggguaaaacuguaugguucguaccuagcaucaaaucgggcaacgacaucgcaaauuguuuaaggaaaaacgguaaaagaguaauccaacuaucaagaaaaacuuuugauacugaauaccagaaaaccaaaaauaaugauugggauuaugucguaacaacagacauaagcgaaaugggagcuaacuuuagggcugaucgcgugaucgauccccgacgcuguuuaaagcccguuauacuaaaagacggaccggagagaguuauauuggcuggccccaugccaguaacaguugcuagcgcagcacaaagaaggggacggauaggaaggaaucauaacaaggaaggagaccaguauauuuauaugggacaaccucugaauaacgaugaggaucaugcucacuggacagaagcaaaaauguuacuagauaauauuaauacgccggaagggauaaucccagcgcuuuuugaacccgaacgagaaaaaucagccgcaauugacggcgaguauagguuacgaggugaggcuaggaagacguuuguugaacuuaugaggcggggugaucugccagucuggcugagcuacaaagucgccucagaaggauuucaauauucggaucgacggugguguuuugacggggagcgaaauaaccaagucuuggaagaaaacauggacguugagauauggaccaaagaaggagaaaggaagaaacuuaggcccagauggcuugaugcccgaaccuauucagacccauuggcucuuagggaauuuaaagaauuugcagcaggaagacgcucggucuccggcgaucugauauuggagauuggaaaguuaccccaacacuugacccaacgcgcccagaacgcguuagauaaucuugugauguugcauaacucagaacaaggggguagggcguaccgacaugcuauggaagaguugccggauacaauagagaccuugaugcugcucgcguugauugcaguccucacuggaggaguaacuuuguucuuucuaucagggcgaggcuuaggaaaaacgagcauaggacuguuaugcguaauggcuucuucaguucuuuuauggauggccagcgucgagccacauuggaucgcagcgucaaucauauuagaauuuuuccucaugguucuacuuauaccugaacccgauagacagaggaccccacaagacaaucaacuugcauaugucgugaucggucuacuauuuaugauacuuacuguggcagcaaaugagaugggacuauuagagacaacaaagaaagaucuuggcauaggacauguagcgguugaaaaucaccaucaugcagcgauguuggauguugauuuacauccugcuucagcauggacacuuuaugcuguggcaaccacaauuauaacaccgaugaugcgccacaccauagaaaauacaacagcuaacauaucacucacagccauagccaaucaagcagccauauuaaugggguuagacaagggcuggcccauaucaaaaauggacaucggcguuccauuacuugcauuaggaugcuacagucaaguuaauccacucacauugacagcugcaguauuaaugcuuguggcacacuaugcaauuauaggccccggcuuacaggccaaagccacacgagaggcgcagaagagaacugcggcagguaucaugaaaaacccaacuguggacggaauaguugcaauugauuuagauccagugguauaugaugcuaaguuugaaaagcaacuaggucaaauaauguuauuaauauuauguacuucccaaauauuacuuaugaggacuacuugggcauuaugugagucuauuacauuagcaacaggcccuuuaacuacccuaugggaagggagcccggguaaauucuggaauacaacgauagccguaucgauggccaacauauuuagagguaguuaucuagcgggugcgggacuugcguucagucucaugaagucauuaggggguggacgaaggggaacaggcgcccaaggagaaacacugggcgaaaaauggaaaagacaacucaaucaacucuccaaaucagaguucaauacauacaaaaggucaggcauaauggaaguagaucguuccgaagccaaagaagggcugaaacgaggagaaacaacgaagcaugcuguuucgagaggcaccgccaaguugcguugguucguggagcggaacuugguuaaaccugagggcaaaguuauagacuuaggauguggcagaggugguuggucuuacuauugugcuggucuuaagaaaguaacagaagugaaaggauauacaaaagggggacccggacaugaagaaccuauuccaauggcgacguacggauggaauuuagugaaguuacacuccggcaaagauguauuuuucauuccacccgaaaaaugcgacacuuuacucugcgacaucggagaaucaucacccaauccuaccauagaagaaggacgaacacuuaggguucuaaaaaugguagaaccuuggcuuagaggcaaucaguucuguauaaagauucuuaauccuuauaugccgucugucguggagacauuggaacagaugcagaggaaacacggaggaauguuaguuagaaauccccuaaguagaaacagcacucacgaaauguauugggugucuugcgguacagguaauaucgucucagcgguuaauaugacaaguaggauguugcuaaaccgauuuaccauggcccacagaaaaccaacauaugagcgggacguagacuuaggugccgguacucgacauguugccguagaaccagaaguugcuaaucuagacauaauaggacagaggauugaaaauauuaaacaugaacauaagucgacguggcauuaugaugaagacaauccuuacaaaacaugggcguaucacggaaguuacgaggucaaacccagugguucagccucuaguauggucaacggggugguuaaauuauugacaaaaccuugggacguaauaccaauggugacccagauugcgaugacagauacgacacccuuuggacaacaacgcguauucaaagaaaaaguugauacacgaacacccaaagcaaagagaggaaccgcucaaauaauggaagucacagcaaaauggcuauggggauucuuaucuagaaauaagaaaccuagaauuugcacucgagaagaauuuacaagaaagguaagaucgaacgcagccaucggggcugucuuuguugaugagaaucaauggaacuccgcaaaagaggcagucgaagacgaacgauucugggacuuaguucaccgagagcgagaauugcauaaacaagggaaaugcgccacauguguguacaauaugaugggcaaacgagagaagaaauuaggagaguucgggaaagcuaaaggcucaagagcuaucugguacauguggcuuggagcgcgguuuuuagaauuugaagcucuaggauucaugaaugaagaccauugguuuucacgagaaaauucacuuaguggcguggaaggugaagggcuacacaaguuaggcuacauucuaagagauauaucaaagauuccgggaggaaauauguaugcagacgauacggccggaugggacacgagaauuaccgaagacgaucuacagaaugaagcaaaaauuacagauauaauggagccagaacacgcauuguuagcaaaguccaucuucaaauugacauaucaaaacaaaguggucagaguacaacgcccggcaaagaacggaaccgugauggauguaauaagcaggagagaucagagaggaagcgggcaaguuggcacauauggccuuaauaccuucacgaacauggaagcucaauuaauucgacaaauggaaagugaagguauuuucagcccauccgaacuggaaacaccaaaucuugcuggaagaguuuuggauuggcuugaaaaacaugguguugaacgauuaaaaagaauggcuaucucuggcgaugacuguguuguuaaaccaaucgaugacagauuugcuacugcacuaacugccuugaaugauaugggcaaaguucgaaaagauauuccacagugggaacccaguaaaggguggaaugauuggcaacaagugccguucugcucccaucacuuucaucaauuaauaaugaaagauggacgagaaauugucguaccaugcagaaaucaagaugaauuaguagggagggccagaguaucacaaggugcaggcuggagccuacgagagacugcauguuuaggaaaaaguuacgcccaaauguggcaauuaauguacuuucacaggagggauuuaaggcucgccgcaaacgcuauuugcucggcuguucccguugauuggguuccaacgucgcgaacuaccuggucaauucaugcucaucaucaauggaugacuacggaagauauguuaucaguauggaauagaguguggaucgaggaaaauccauggauggaagauaagacacacauuuccucauggggugauguccccuaucucggaaaaagagaggaucaauggugcgguucgcuuauuggauugacugcaagagcgacgugggccacuaauauucagguggcgauuaaccaaguaagacgacuaauugggaaugaaaacuauuuagacuauaugacaucaaugaagcgguuuaaaaaugaaucagauccagaaggggcauuaugguaa

SEQ ID NO: 21755 - RNA, 9879 nt, Artificial Sequence
  derived and/or modified CDS sequence (opt6) from DENV-1__FJ898412__SS-prME
ucaguuacgaugcuacuaaugcugaugccgacggcauuagcauuucacuuaacgacaagaggcggggaaccacacaugauagucacaaaacaagaaagaggaaaaucauuacuauuuaaaacaucagcaggaguaaauaugugcacguugauagcuauggaucuaggcgaauuaugugaagacacgaugacauauaaaugucccagaauaacggaagcggaaccagacgauguugacugcugguguaaugcaacagacacauggguuaccuauggaacauguucacaaacaggagaacacaggcgcgauaaaagaagugucgcauuagcgccacauguuggccugggacuagaaacaagaacagaaacauggaugucaucagaaggugccuggaaacaaauacaaagaguagagacgugggcccuucgucauccuggauuuacaguaaucgccuuguuuuuggcacaugccauaggaacaaguauaacacaaaaagggauaauauucaucuugcucaugcucgugacaccaagcauggcgaugaggugcguuggaauagguucgcgagauuucgucgaaggucuaucgggugcuacauggguagauguaguacuugagcacggaagcuguguuacaacuauggcgaaagauaaacccacauuagauauagaacuauugaaaaccgaaguaaccaauccagcagugcuucggaaauuaugcauagaggcgaaaaucaguaauacuacuacagacucacgaugccccacacaaggugaggcgacucuuauggaggagcaagacgcaaauuuuguauguagacguacauuugucgauagaggauggggaaauggauguggauuguuugguaaaggaaguuuaauaacuugcgcgaaauuuaaaugcguaacaaaacuagaaggaaagauaguucaauaugaaaaccugaaauauucuguuaucguaacaguucacacaggagaccaacaucaaguagguaaugaaaguaccgaacacggaacuacagcaaccauuaccccacaagcuccuacguccgagauacaguuaaccgacuacggagcccucacccuugauuguucgccccgaacaggacuggauuuuaacgaaaugguguuacuaacgaugaaggagaaaagcuggcugguacauaagcagugguuucuagauuuaccauuaccauggacgucuggcgccaguacaucacaagagacauggaacagacaggaucuguuagugacguucaagacagcucacgccaagaaacaagaaguaguaguuuuaggcucacaagagggagcaaugcauacggcuuuaacuggagcuaccgaaauacagacaucuggaaccacaacuauauucgcuggccauuuaaagugccgucuaaaaauggauaaacuaacacuaaaagguaugagcuacguuauguguacaggaucauuuaaacuugaaaaagaaguugcugaaacacaacacggaacaguauuaguucagaucaaguaugaaggaacugaugcacccuguaaaauuccauucagcacgcaagaugaaaaagguguaacacagaauggucgccucauuacugcaaacccaaucguaaccgauaaagaaaagccaguaaauauagaagcugagccuccuuuuggugagucauauauaguaauaggagcuggugagaaggccuugaagcugucuugguuuaagaaaggcuccaguauugguaaaauguucgaggcgacagcucguggagcaagacgaauggcaauccuaggggacacagcaugggauuucggcucaaucgggggugucuuuacauccgucgguaaguuagugcaucaaaucuuuggaacagcauacggaguacucuucaguggaguuucauggacgaugaaaauugguauugguguucuucuaacaugguuaggccuaaauagcaggucaacaucacuaucuaugacauguauugcagugggauugguaacguuauacuuaggaguaaugguucaagcagacagcggcuguguuauaaauuggaaaggcagagaacugaaaugugguaguggaauauucguaacaaaugaaguucacacguggacugagcaauacaaauuucaagcugauucacccaaaaggcuuagcgcggcaaucgguaaggcuugggaagaaggaguuugcgggauucgaucugccacuagacuggagaauauuauguggaaacagauuagcaaugaacugaaccacauauuacuagaaaacgauaugaaauucacuguagucgucggugauguagucggaauccuagcacaagguaaaaagaugauuagaccacaaccgauggaacauaaguauucuuggaaaagcuggggaaaagccaagauaauaggcgcggauguacagaauacaaccuuuaucauagaugggccaaacacaccugaguguccagaugaucaacgagcauggaauauaugggagguugaagacuacggauuugguauauuuacaacaaauauauggcucaaguuacgugacucauauacacaagugugugaucacagauuaaugucagcggcaauaaaagauagcaaagcagugcaugcagauauggguuacuggauugaaucugagaaaaaugaaacauggaagcuagcccgagccagcuucauugaaguuaaaaccuguauauggccaaaaagccauacgcuauggucaaacggaguccuugaaucggaaaugaucaucccuaaaauauauggaggcccuauuagucagcauaauuaccgacccggauauuuuacacaaacagcuggacccuggcaccuugguaaacuagaacuugacuuugauuugugugaaggaacaacaguaguugucgaugagcacugcggaaacagagggccaagucuuagaacaacaacaguaacaggaaagauuauacaugaauggugcugucgcucauguacgcuacccccacugcguuuuaagggagaagauggcuguugguauggaauggaaauacgaccugucaaggagaaggaagagaauuuagucaaaucuaugguuagugcugguucaggggagguagauaguuuuaguuugggacuauuauguaucaguauuaugauagaggaaguaaugcggucacgguggaguagaaagaugcugaugacagguacacuugcuguuuuucugcuguuaauaaugggacaauuaacguggaaugaccuuauuagauuaugcauaaugguuggagcgaacgcuagugacagaaugggaauggguacgacguauuuagcauuaauggcaacauuuaaaaugaggcccauguucgcgguaggacuuuuauuuaggaggcuaacaagucgugaaguucuacuacuuacgauuggucugaguuuaguagcaaguguggaacuuccaaauucacuugaggaauugggagauggucuggcgauggguauaaugauacuuaaacuacuaacagauuuucaaagucaucaauuaugggcaacacuuuugagccuuacuuucauaaagacaacauugagucuucauuacgcguggaaaaccauggcaaugguccucucgaucguuagccuuuuuccacuauguuuaaguacaaccagucaaaagaccacuuggcugccaguacuuuuagguagccuagggugcaaaccucuaacgauguuucuaauugccgaaaacaagauauggggccgaaaaucauggccucuaaaugaggggauaauggccguugguguuguaucuauauuacucucaaguuuacuuaaaaaugacguaccacucgcuggaccucuuaucgcagggggcauguuaauugcauguuaugucauuucagggagcucugcagauuugucauuagaaaaagcugcggaaguauccugggaggaagaagcggaacauaguggggcgucacauaauaucuuaguugagguccaagacgauggcaccaugaagauaaaagaugaggagcgggaugauacacuaacaauauuacuaaaggcuacuuuauuagcgguaaguggaguauauccauuaucgauaccugcgacgcuuuucgucugguauuuuuggcagaaaaagaaacaacgaucgggaguucugugggauaccccgagcccuccagaaguagaacgggccguucuagaugacgguauauaucguauaaugcaaagaggucuacuaggucgaucgcagguugggguagguguuuuccaagaaaauguuuuucacacgauguggcacguaacaagaggggcaguuuuaauguaccaaggaaaacgcuuggagccaucgugggccucagugaaaaaggaccuaaucaguuacggagguggauggaggcuacagggcucuuggaacacaggagaagaaguacaagucaucgcuguagagccagggaaaaacccuaaaaacguucaaacugcacccgguacguucaagacuccggaaggggaaguuggcgcaaucgcacuggauuucaaacccgggacaagcggcucacccauugucaaucgggagggcaagauugugggucuauacggaaacggggucguaacaacaucuggcacuuacguaagugcaauagcccaagcaaaggcuucacaagaaggcccauuaccagagauagaagaugaaguguuuagaaagagaaaucuaaccauaauggaccuucauccaggcaguggaaaaacgagacgcuaucucccagcaauuguacgugaagcaauaaaaaggaaauugagaaccuugauucuugcaccgacccgggugguagcauccgaaauggcagaagcacuaaaaggaaugccuauaagauaucaaacgacagccgugaaguccgagcacacagguaaggaaauaguagauuugaugugccaugcuacuuuuacuaugcgguugcuaucuccaguucgugugccgaacuauaacaugauaaucauggaugaggcacacuucacagaucccaguaguaucgcggcgagaggauauauuucuacaaggguuggcaugggcgaggcagcugcgauauuuaugacggcuacgccaccugguaguguggaagcauuuccgcaaagcaacgccgugauacaagacgaagaaagagacauacccgagagaagcuggaacucaggauaugaauggauaacugauuucccggguaaaacagugugguuugucccaucaaucaaaucggggaaugacauugcaaauuguuuaagaaagaauggaaaaagagugauacaacuaucucguaaaaccuucgauacugaguaccagaaaaccaaaaauaacgacugggauuauguaguaacgacugacauuucugaaaugggugcgaacuuuagagcggaccggguaauagauccuagacgauguuugaagccaguaauauuaaaagauggaccagagagaguuauccuugcaggaccaaugccugucaccguagcaagugcagcacaacgccgugggcgcauuggaagaaaucauaacaaagaaggugaccaauacauuuauaugggacaaccacucaauaaugacgaggaucaugcucauuggacugaagcaaagaugcuacuggauaauauaaacacgcccgaagggauuauacccgccuuguuugagccggaaagagaaaaaucggcagcuaucgauggugaguaccgacugcggggcgaagcgcggaaaaccuuuguagaauugaugagaaggggcgaccuuccuguuuggcucuccuauaaaguugcaucagaggguuuucaauacucugacagacguuggugcuuugauggugaaaggaauaaucaagugcucgaagaaaacauggauguggaaauauggacuaaggagggugaacguaagaagcuccggccccgauggcuggacgcucgaacauauagcgacccgcuggcauuacgagaauuuaaggaguucgccgcagggcgaaggucugucucaggcgaucucaucuuagaaaucgguaagcugccacaacaccuuacccaaagagcucaaaacgcgcuggacaaccuaguuauguuacacaauucggaacaagguggucgggcuuacagacacgcuauggaagaacucccggauacuaucgaaacuuuaaugcuuuuagcucucaucgcaguucuaacaggggguguaacuuuauuuuucuugucaggaaggggauugggaaaaacgucuauagguuugcuguguguuauggcaaguucaguauuauuguggauggccucgguggaaccccacuggauagcagcuucgauaauauuagaauuuuucuugauggugcuacucauacccgaacccgacagacaaagaacaccacaggauaaucaauuagcauauguuguaauuggguuacuuuuuaugauauugacuguagcagcgaaugaaaugggccuguuagagacaacuaagaaagauuugggaauuggccauguugcaguagaaaaucaucaccauguuacaaugcuugacguagaccuccaucccgcgagcgcauggacacuuuaugcaguagccacaacuauaauaacuccaaugaugagacacacaauagagaacacgacagcaaauauuucccuuacugccaucgcuaaucaagcagcaauacugaugggacuugacaaaggguggccuauuaguaaaauggauauaggaguaccguuauuagcauuaggaugcuauucucaaguuaauccgcuaacacugacagcugcagucuuaaugcuuguagcccauuaugcaauaauugggccaggcuugcaagcaaaagcgacaagggaggcgcagaaaaggacagccgcgggaauaaugaagaauccaaccguagacggaaucguagcgaucgaucuagacccaguugucuacgaugcaaaauuugaaaaacaacuagggcaaauuauguuacucauucuauguacuucacaaauacugcuuaugcguaccacuugggcgcuuugcgaaucaauaacacucgcuaccgguccuuugacaacccuaugggaagguucucccggcaaauucuggaauacaacuauagcuguaagcauggccaacauauuuagaggaucguacuuagccggagcaggucuagcauuuucuuuaaugaaaaguuuaggaggaggucguagaggcacaggcgcucagggggagaccuugggagaaaaauggaagagacaauugaaccagcuaagcaaaagugaguuuaauauauauaagaggucagguauuauggagguagacaggagcgaagcuaaagaaggcuuaaaacguggcgagacgacuagacacgcgguaagucgagguacagcuaaauugagaugguucguugaacgcaaccucguuaaaccagaagguaaagucauugauuugggauguggaaggggaggaugguccuauuauugcgccggacuaaagaaagugacagaaguuaaaggauacacaaaagguggaccuggccacgaggaaccuauuccaauggcaacauacgguuggaaccuaguaaagcuacacucgggaaaggauguauuuuucacacccccagaaaagugugauacauuauuaugcgacauaggggaaucaucuccuaauccaacaauagaggaagguagaacccuucgaguacuaaagaugguagaaccuugguuacgagguaaccaguucugcauuaaaauuuuaaacccguauaugccgucggugguggaaacuuuagaacaaaugcaacggaaacauggagguaugcuagugagaaacccucuuucuagaaacucgacccaugaaauguauuggguuucgugugguaccggaaacaucguaagugcuguaaauaugacuucccguauguuacuuaacagauuuaccauggcacacagaaaaccgacguaugaacgugauguggauuugggugcaggaaccagacauguagcaguagaaccagagguagccaauuuagacauuauuggccagagaaucgaaaauauaaaacaugaacacaaaucgacguggcauuaugaugaagacaauccauauaaaacgugggcauaucauggcuccuaugaagucaaaccaucugguucagcuagcuccauggugaauggaguaguuaaacuucuaacuaaacccugggaugugauucccaugguaacccaaauugcuaugacagauacaacgccguuuggucagcaacggguguuuaaagaaaaaguugacacuagaacgcccaaagcaaagagagggacagcccagaucauggaggugacugcaagaugguuguggggcuuucugaguaggaacaagaaaccuaggaucuguaccagagaggaauuuacaagaaagguuagaucaaaugcugccaucggagcuguauucguagaugaaaaccaauggaacuccgcaaaagaagcaguagaggaugaacgguuuugggaccuuguccaaaaagaaagagaauuacauaaacaggggaaaugugcuacuuguguauacaauaugaugggaaaaagagagaagaaacucggugaauuuggcaaagcaaagggcucuagagccauaugguauauguggcuaggcgccagguuuuuagaauuugaagcacuaggauucaugaaugaagaccauugguuuucaagagaaaacucacuuaguggcguugaaggagaagggcuucacaaauuaggauauauauugcgagacauuucgaaaauucccggcgguaauauguacgcagaugauacagcagguugggacacgagaauuacagaagaugacuuacaaaacgaagcuaaaauaacugauauuauggaaccugaacacgcguuauuggcaacaucaauauuuaaauuaacauaccaaaauaaagucgugaggguacaacgaccagcuaagaauggcacaguuauggacgugauaucaagaagggaucagagagguucaggacaaguggggacauacggauuaaauacauuuacgaacauggaggcucaacuaauuagacaaauggaguccgaaggcauauuccuccccucagagcuagaaacaccaaaucuugcagaacguguucucgacuggcuagaaaaauacggaguggaaagacuuaaaaggauggcaauuucaggagaugacugugugguaaaacccauugacgacagauuugcaacagcacuuaccgcucugaaugauaugggaaaggucagaaaagacaucccccaaugggaaccuucgaaaggguggaaugauuggcaacaagugccuuuuuguucucaucauuuucaucaauuaauuaugaaggaugggcgugagauaguaguuccuuguaggaaccaagacgaacugguugggcgcgcaagaguaagucaaggggcgggguggucuuuaagagaaacggccuguuugggaaaaaguuaugcgcagauguggcaacucauguauuuucacaggagagacuugagacuugccgcgaacgcaauaugcagugcaguaccgguugacugggucccaacuucuagaacuacauggaguauccaugcacaccaucaauggaugacgacugaggauauguuaucaguuuggaauagagucuggauagaagaaaaccccuggauggaagacaaaacacaugucagcucauggggagacguuccauaccuaggcaagagagaagaucaauggugcggcucacugauaggguuaacagcaagagcuacuugggcuaguaacauccagguggcgaucaaucaaguccgaaggcuuauagguaaugaaaacuauuuagauuauaugacaagcaugaagagguucaaaaaugaaggggauccagagggagcacuaugguag

SEQ ID NO: 21756 - RNA, 9879 nt, Artificial Sequence
  derived and/or modified CDS sequence (opt6) from DENV-1__GQ199852__SS-prME
ucuguuacuauguuauuaauguuaaugccuacugcguuagcguuccaucuaacuacaagagggggugaaccgcauaugaucgucacaaaacaagaacgcggcaaaucucuauuauucaaaacuucugcuggugugaauauguguacucucauagcuauggaccugggagaacucugcgaagacaccaugacauacaaaugcccuagaaucacugaagcagaaccggacgacguugauugcugguguaaugcgacugacacuuggguaacuuaugguaccuguagccaaacuggugaacacagaagagauaaaaggaguguggcgcuggcaccccauguaggccuaggcuuagagacucgaacagaaacguggaugucaucugaaggagcguggaaacaaauccaaagaguugaaaccugggcucugagacacccaggcuuuacggucauugcauuguuccuugcucacgcaauugguaccucuauaacccaaaaaggcauaauauucauacuuuugauguuggugaccccauccauggcaaugagauguguagguauaggcagccgggauuucguagagggauuauccggugcaaccuggguggaugucguauuagaacaugggagcugcgucacaacaauggcgaaagauaaaccaacucuggacauugaacuguuaaaaacggaaguaacuaauccugcaguucuucggaaacucugcauugaagcaaaaaucaguaauacuacaacugauucuagauguccuacgcaaggggaggcaaccuuaauggaagaacaagaugcuaacuuuguauguagaaggacauuugucgauagagguuggggcaauggaugcgguuuauuugggaaagguaguuugauaaccugcgcuaaauuuaaauguguuacuaaauuggaagggaaaauaguccaguaugaaaaucucaaauauucaguaauaguuacuguucacaccggugaucagcaucaaguagguaacgagucaaccgaacauggaacaacggcuacaaucacaccgcaagcaccgacgucagaaauccaacuaaccgacuauggggcauuaacacuugauugcucuccaagaacaggacuugacuuuaaugagaugguacuuuuaacaaugaaagagaaaucuuggcuagugcacaaacaaugguucuuagaucucccauuaccguggacaucgggggcuucaacaagccaagagacauggaauagacaggauuugcugguuacuuuuaaaacugcacacgccaagaaacaagaagucguuguacuagggucgcaagaaggugcgaugcacacggcccuuacaggugcaaccgaaauccagacgucaggcacaaccacgauuuucgcgggacacuuaaaaugucgucuaaaaauggacaaacugacccuaaaaggaaugucuuauguuaugugcacggguucauucaaacuagaaaaagaagucgcagagacgcagcauggaacuguauuaguucagauaaaauacgaaggaaccgacgcaccaugcaaaauuccuuucaguacucaagacgagaaaggugucacucaaaaugggagacugauuacggcuaauccaauaguaaccgauaaagaaaagcccguuaauauagaagccgaaccuccauuuggggaaucuuauauaguuauaggagccggugaaaaggcauuaaaauuauccugguucaagaaagggagcagcauaggaaagauguuugaagcaaccgcaagaggugcucgaaggauggcgaucuuaggggacacugcaugggauuucggguccguagggggaguuuucaccucugucggcaaacugguacaucaaauuuuuggaacagcauacggaguguuauucucaggugugaguuggacaaugaaaauagguaucgggguauugcuaacauggcucggacucaacucaaggucgacaucauugaguaugacuugcauugcggucggucuaguaacgcuuuauuuagggguaaugguucaagccgacagcggauguguaauuaauuggaaagguagagaacugaaauguggaucgggaauauuuguuacaaacgagguccauaccuggacggaacaguauaaguuccaagcagauucgccaaagcgauuaagugccgcaauagggaaggccugggaagaaggcguguguggaauaaggucagcaacacgacuagaaaacauaauguggaaacaaaucaguaaugaacuuaaucacauauuacucgaaaaugauaugaaauuuacaguaguaguaggagaugugguagggauuuuggcacaagguaagaaaaugauacgcccgcaaccuauggaacacaaauacaguuggaaaucguggggaaaagcgaaaauaauuggcgcagacguucaaaauacaacauucauaauugauggcccaaacacgccagaguguccagaugaucaacgagcuuggaauauaugggaaguagaagauuacggcuuuggaauauuuacaacuaacauaugguuaaaauuaagagauucauauacucaagucugugaccacagauuaaugucagcagccauaaaggauucuaaggcugugcacgccgacaugggauauuggauagaaagugaaaagaaugaaacuuggaaauuagcacgcgcaucuuucauagaagugaaaacauguauauggccuaagucgcacacauuauggaguaaugguguuuuggaaagugaaaugauaaucccaaaaaucuauggaggucccauaagccagcauaacuacagaccaggauacuuuacucaaacagcuggcccuuggcaucuuggaaaacucgaacucgacuuugauuuaugugaaggaacgacuguuguaguagaugagcauuguggcaaucguggcccuagccuaagaacaaccacaguaacggggaagaucauccaugaauggugcuguagaucuuguacauuaccuccuuugcguuuuaaaggagaggauggcugcugguauggaauggaaauacguccgguaaaggagaaagaggaaaaucuaguuaaaagcauggugagugcgggaaguggagaaguagauucauuuucauugggucuacuaugcauauccauaaugaucgaagaggugaugagaucacggugguccagaaaaauguuaaccaccgguacauuggcuguauucuuguugcuuauaaugggccaauuaacuuggaacgaccucauacgacuaugcaucaugguuggugcaaacgcuagcgauagaaugggaaugggcacuaccuacuuagcauugauggcgaccuuuaaaaugagaccuauguucgcgguagguuugcuauuuagacguuuaacuucgcgggaaguacucuuacuaaccauuggauuaucauuagucgccaguguagaauugcccaauaguuuagaagaauuaggagauggacuugcaauggguaucaugauacucaaacuacuaacugauuuccagagucaccagcuuugggcaacacuccucucccucacuuuuauuaaaacaaccuuaccucugcacugugcuuggaaaacgauggccaugguucuaagcauugcaucauuguuuccauuauguuugaguacuacaagucagaagacgacuugguuaccgguuuuauuggguucacuuggguguaagccuuuaacgauguuuuuaauaaccgaaaccaaaauauggggaaggaaaaguuggcccuuaaacgagggcauuauggcugugggaguaguguccauauuacuuaguucucugcuaaagaacgauguaccacuagccgggccuuuaauagcuggagggauguugaucgcgugcuacguuauaucaggcaguucugccgauuuaaguuuggaaaaagcggcagaaguaucuugggaggaagaggccgaacacuccggggcuagccacaauauacucguuguaguccaagacgauggaacgaugaaaauaaaagacgaagaacgagacgauacucugacgauucuccucaaagcaacauuacuggcaguaaguggaguuuauccacuaucaaucccagcuacucuuuuugugugguauuuuuggcagaagaagaaacagcgcagcgguguacuuugggacacaccauccccaccggagguagagagagcagugcuggacgacgguauauacagaauaaugcagagagggcuauuaggucguucucaaguugguguggggguuuuucaggaaaaugucuuccauacuauguggcacguuacucgaggcgcaguguuaauguaucaaggaaaacgcuuagaaccuucaugggccaguguuaagaaagaucugaucaguuauggagggggauggaggcuacaggguucauggaauacgggugaagagguucaaguuauugcuguagaaccuggcaaaaacccaaagaacguacaaacagcgccuggaaccuucaaaacuccagaaggugaagugggggcuaucgccuuggacuuuaaaccagguacaucugggucaccuauuguuaaccgggaggguaaaauaguagggcuguaugguaacggaguagucaccacaucaggaacauacguaagcgcaauugcccaagcaaaagcaagucaagaagguccuuuacccgaaaucgaagaugaagucuuucgaaagcguaauuuaacgaucauggaccugcacccaggcucgggaaaaacgcggcgauaucucccagcgaucgugagggaagcaauuaaaagaaaguuaagaacauuaauacuagcaccuacaaggguuguggcaucagagauggcugaagcacucaaagguaugcccauuagguaucaaacgaccgccguuaaaucugaacacacgggaaaggaaaucguggauuuaaugugucaugcgacauuuacaaugagacuauugagcccaguacguguaccaaauuacaauaugauaauaauggaugaagcacacuuuacagaucccucuuccauagcagcacgaggauauaucaguacgagaguaggcaugggagaggcggcugcaaucuucaugacagcuacgccaccuggaucagucgaagcguuuccacaaucgaaugcuguuauucaagacgaagagagagauauaccugaaaggucuuggaacucuggauacgaauggauuacugauuucccugguaaaacagucugguucguuccgagcauaaaaucgggcaaugauauagcgaauugccuucggaaaaaugguaagcgcgucauacaacucagucgcaagacguuugauacugaauaccagaaaacuaaaaacaaugacugggauuacguaguaacaacugauaucucagaaaugggagcaaacuuucgggcagauagagucauugauccgagacggugcuuaaaaccaguuauuuugaaagacggaccagaaagggucauccuagcuggaccaaugccuguaacagucgcaagcgcagcucaacggagagggagaauuggaagaaaucacaacaaagaaggagaccaguauauauauaugggccaaccacuaaauaacgacgaagaccaugcacauuggacggaagcuaaaauguuauuagacaauauaaacacuccugaaggaauuauaccagccuuguuugagccugagcgagagaaaagcgccgcaaucgacggcgaauauagacugaggggugaagcaaggaaaacuuuuguugagcuaaugcggagaggugaucuaccaguaugguuaucuuacaagguagccagcgaggguuuccaauacagcgacagaagauggugcuucgacggagaaaggaauaaucagguucucgaagaaaauauggacgucgaaauauggacaaaagaaggggagaggaagaaguugagaccucguuggcuagaugcgcgaaccuacucagacccacuggcuuuacgugaguucaaggaguucgcugccggaaggagguccguaucgggugauuugauacuagaaauuggcaaacucccgcaacaccuaacucaaagagcacagaacgcgcuggacaaucugguaaugcuacauaauagugaacaaggaggcagagcguaucgccaugccauggaagaacuuccagacacaaucgaaacacuuaugcuuuuggcacuuaucgcaguccucacuggaggagugacccuauucuuuuugagcggaaggggauuagggaaaacgaguauuggccuucuaugcgucauggcaucgaguguucuacuauggauggcgucaguagaaccgcacuggauagcugcaucgauaauacuagaguucuuucuuaugguauuacuaaucccggaaccugacaggcaacggacuccccaagauaaucaauuagcguauguagugaucggacucuuauuuaugauacugacuguagcggccaacgaaaugggucucuuagaaaccacgaagaaagaccuugguauaggacauguugcggucgaaaaccaucaucaugcaacaaugcuagauguugaccuacauccugcaagugcuuggacucuguaugcaguagccacaaccauuauaacaccaaugaugcgucauacaauugaaaacacuacugcuaacauuagucucacagcaauugccaaucaggcugcaaucuuaauggggcuggauaaaggauggccgauuagcaagauggauauuggaguaccauuacuugcauuaggauguuauagccaaguuaacccacucacacuuacagcugcgguucuaaugcuagucgcccauuacgcaaucauaggaccuggccuacaagcaaaagcuacaagggaggcacagaaaagaacugcugcagguauaaugaaaaauccaacaguggaugguauaguugcuauugaccuagacccgguaguauaugaugcaaaauuugaaaaacaguuaggccaaauaaugcuucuaauucuuuguacgucccaaauuuuauugaugaggaccaccugggcacuaugcgaaaguaucacuuuagcaaccgguccguuaaccacacuuugggaagguucacccggaaaauuuuggaacaccacuauagcagucaguauggcgaauauuuuccgcggcucuuauuuagccggugcaggacuugcauuuucguugaugaaaucauugggaggaggucggcggggcacaggugcucaaggugaaaccuuaggggagaaauggaaaagacaguuaaaucaauuauccaagucagaguuuaauauauauaaacggucaggaauaauggaaguugauagaagugaagcuaaggaaggauuaaaacggggagaaacaacucgacacgcgguaucaagagguacagcgaaacuucguugguucguagaaagaaaccucguuaaaccagaagguaaagugaucgauuugggaugugggagaggaggguggucauauuauugugcuggucuaaagaaaguaacagaaguaaagggcuacacuaaaggagguccaggucacgaggaacccauaccgauggcaacguauggauggaaccucguuaaacugcauagcgggaaagacguauucuuuaccccucccgaaaaaugugacacacuccucugugauauaggagaaucgucgcccaacccgacuauugaagaggguagaacgcuaagaguauuaaaaaugguugaaccuuggcuaagaggaaaucaauucuguauuaaaauauugaacccauacaugccaucugucguagaaacauuggagcagaugcaacgaaaacacggaggaauguuggucagaaacccguuaagucguaacucaacacacgaaauguauuggguaucuuguggaacaggaaauauaguaagugcuguaaacaugacaagucguauguuauuaaaucgcuuuaccauggcgcaccguaaacccacuuaugagcgugaugucgauuuaggugccgguacucgacacguagcaguggaacccgaaguagcaaaucuagauauaauuggacaaagaauagaaaacauaaaacacgaacauaaaucaaccuggcauuaugacgaagacaaucccuacaaaacaugggcauaucacgguaguuaugaagucaaacccucuggcucugcuucaagcauggugaaugguguagucaaacuacugaccaagccaugggacgucauacccauggucacacagauagcaaugacugauacuaccccuuucggucaacaaagaguguucaaggagaaaguagacacgcgcaccccuaaagcuaaaagagguacugcgcagauuauggaagugaccgcacgaugguuguggggauuccuuucgaggaauaagaaaccuaggauaugcacccgagaggaauuuacaaggaaaguucgcucaaacgcugcaauuggggccguuuuuguugaugaaaaucaauggaacucggcuaaagaggcuguggaggaugagcgauucugggaucuuguacagaaagagagagaacuacauaaacagggaaaaugcgcaacuugugucuauaauaugaugggcaaaagagagaagaaauuaggugaauuugguaaagcaaaaggcucuagggcuauaugguauauguggcuaggcgccagauuccuugaguucgaagcgcuaggauucaugaaugaagaccacugguuuucgcgagaaaauucgcuaucaggaguagaaggagagggauuacauaaacucggcuacauucuacgugauauauccaaaauuccuggcgguaauauguaugcagaugauacagcugguugggacaccaggauuacggaagacgaucuucaaaacgaagccaaaaucacugacaucauggaaccugaacaugccuuacuggcuaccaguauuuucaaacuaacauaucaaaauaaaguuguuaggguccaaagaccugcuaaaaacggaaccgucauggauguaauuucacgucgggaucagcguggcucaggucaagucggaaccuauggacuuaauacuuuuacgaacauggaagcacaauuaauacggcaaauggagucggaaggaaucuuuuugccgucggaguuagagaccccaaaccucgccgaaagagucuuggauuggcuagagaaauaugguguagagcgguuaaagcguauggcaauuuccggggaugauugugugguaaaaccaauagacgaccgauuugcuacagcauugacagccuuaaaugacaugggaaagguacgaaaagacaucccccaaugggaaccaagcaaagguuggaacgacuggcagcaaguaccauucuguucucaucacuuccaccaacugauaaugaaggacgggcgagaaauaguaguaccgugucgaaaucaagacgaguuaguuggucgagcacgcguuucacaaggugccggauggucuuuaagggaaacagcauguuuaggcaaaucauaugcucaaauguggcaauuaauguauuuccauaggcgggacuugcgacuugccgccaacgcgauuugcuccgccguuccaguggacuggguuccuacaagccguacaacauggagcauucacgcacaucaucaauggaugacuacagaagauaugcuaucgguauggaacagaguuuggaucgaagagaauccauggauggaggauaaaacgcauguuagcagcuggggugauguuccauauuugggaaaacgagaggaucaauggugcgggaguuuaaucgguuuaaccgcacgugcgaccugggcuucuaauauucagguugcaaucaaucaagucaggcguuugauugggaacgaaaauuaucuagauuauaugacgucaaugaagcguuucaaaaaugaaggugaucccgaaggugcacuuugguaa

SEQ ID NO: 21757 - RNA, 9879 nt, Artificial Sequence
  derived and/or modified CDS sequence (opt6) from DENV-1__FJ898415__SS-prME
agcguaacaaugcuucugaugcuaaugccaacugcgcuggcauuucaucuaacgacaagagguggagaaccacauaugauuguaacaaaacaagaaagaggaaaaagccuauuguuuaaaacuucugcaggagucaauauguguacacuaauugcuauggaucuaggagaauuaugugaagacacaaugacguauaaauguccccggauaacggaagcagaaccagaugacguggacuguugguguaaugcaacagauacaugggucacauaugguacuuguagccaaacaggugaacaucgaagggauaaaagauccgucgcacuagcaccacauguaggauuaggguuagaaacacggaccgagacuuggaugucuagugagggagcuuggaaacaaauacaaagggucgaaacaugggcucuccggcauccaggguuuacagugauagcauuauuucuagcacacgcgauaggaacaucuauuacacaaaaaggaaucaucuucauccuucuaaugcuugugacccccucuauggcaaugaggugcguagggauagguucaagggauuuuguagaaggacuaucgggggccacauggguggaugucguacuugagcaugguagcugcguaacgacuauggcaaaagauaaaccgacauuagauauugaauuacucaaaacggagguaacgaacccggcaguacugagaaaacuuugcauagaagcaaaaauaaguaauacaacaacagauagucguugcccgacacaaggugaggcaacacugauggaggaacaagaugcaaacuucgugugucgucgaacauuuguagaccguggguggggaaaugguugcgggcuauucgguaaagguucguugauaacuugugcuaaauuuaaaugcguuacaaaauuagaaggaaaaauugugcaauaugaaaacuuaaaauacucugucauagucacaguacauacaggagaccaacaucaaguugguaaugaguccacagagcacgguacaacggcuacaauaaccccucaagcuccgaccucggaaauccaauuaacagauuacggugcuuuaacgcuugauugcucgccaaggacagguuuagauuuuaaugaaaugguuuuacucacuaugaaagagaaaaguugguuaguacacaaacagugguuccuggaccuuccauuaccguggacgaguggagcgucaacaagucaagaaacauggaacagacaagauuuauuaguuacauuuaaaacugcacaugccaagaaacaagaaguuguuguauuaggaucacaagaaggggcaaugcauacugcauugacuggagcaacggaaauccaaacgucuggaacuacaaccaucuuugccggacacuugaaauguagacuuaaaauggacaaacuaacacugaaaggcaugucuuacgugauguguacuggcagcuuuaaacuagaaaaagaaguugcagaaacccaacauggaacaguuuuaguacagauaaaauacgaaggaacagacgcgccguguaaaaucccguucuuaacucaggaugaaaaaggugucacacaaaacggccggcuaaucacagcaaauccgaucgugacagauaaagaaaaacccgucaauauagaagccgaaccucccuucggagagagcuauauuguaaucggggcgggagagaaagccuugaaacuuagcugguuuaagaaaggaagcaauaucggaaaaauguucgaagcaaccgcuaggggugcaagacgaauggcuauauuaggagacacugcaugggauuuugggucuaucggcggaguuuuuacuucuguaggcaaacuuguccaucagauuuucggaacagcuuacgguguauuauucucgggaguuucguggaccaugaaaauugguaucggagucuuauuaacuugguuagggcuuaauaguagaaguacaucgcuaucaaugacauguauagcggucggacuggucacacuuuaucucggaguuaugguccaagcagauagcggauguguuauuaacuggaaagggagagagcuaaaauguggaucagguaucuuuguaacaaacgaaguacauaccuggacagaacaauauaaguuucaagccgacaguccgaaaaggcucucugcagccauuggaaaagccugggaagaaggcguuugcgguaucagaagugcuacuaggcuugagaacauaauguggaaacaaauaaguaacgagcugaaccacauucuccuugaaaacgauaugaaauucacuguaguuguaggagauguaguugggaucuuggcacaggggaagaaaaugauucggccccagccuauggaacacaaauauucauggaagucguggggaaaagcaaagauaauuggagcagauguacagaauacgaccuuuaucauagauggaccuaacaccccagaaugcccagaugaccaaagagcguggaacauuugggagguagaagauuauggcuuuggcauuuuuacaacaaauaucugguuaaaguugcgagauucuuauacucaaguuugugaucaucgacuuaugucagcagcaauuaaagauucaaaagcaguccaugcagauaugggauauuggauugaaucugaaaagaacgaaacauggaaacuagcaagagcgaguuucauagaaguaaagacuugcauuuggccaaagucccacacacucuggucgaauggaguauuagagagugaaaugaucauuccaaaaauuuauggaggcccuauaucucaacacaauuauaggccaggguacuuuacccagaccgcaggcccuuggcaucuagggaaauuggaacuugacuucgauuuaugcgaagggacaacggucguaguggaugaacacugugguaaucgcgguccaucauugagaacaacuacuguaacuggaaaaacuauacaugaaugguguuguagaucuugcacacucccgccauuaagauuuaagggagaagauggcuguugguaugguauggaaauucgaccaguaaaagagaaagaagaaaaucucgucaagaguaugguaucggcaggcucgggagagguugacuccuuuagcuuaggauuacuauguaucucgaucaugauagaagaaguuaugcgaucgcgcuggucaaggaagaugcuaaugacaggaacacuggccguauucuuauuauuaauuaugggucaauugaccuggaacgaucuaauuagacuuugcauuauggucggagccaacgcaucugauagaauggguauggguacaacguacuuagcauuaauggcuacguuuaaaaugcgaccaauguucgcaguaggacuauuauuccgccgauugaccagccgcgagguguugcuacucacuauaggguuaucguugguugccucaguagaauuaccaaauucauuagaagaacuaggugacggacuugcaaugggcauaaugauuuuaaaguuacuuacagauuuucaaagccaccagcucugggcaacguuacuaucauuaacuuuuauaaagacaacacuuucacuacauuaugcauggaagacuauggcaaugguuuugucuauagucagccuauucccuuuaugucugaguaccacuagccagaaaacuaccuggcuucccguacuauuagggucauuggguuguaaaccacucacgauguucuuaauugcugagaauaagauaugggggaggaaauccuggccauuaaaugaaggcauaauggcaguuggcguuguaucuauccuauuguccucuuugcuaaagaacgaugucccauuagcaggaccacugaucgcagggggaauguuaauagcuugcuacguaauuagcggaucgagugccgaucuuagccuagagaaagcagccgaagugucgugggaagaagaagcagagcacucaggugcaagucauaacauauuggucgagguccaagacgacgggacaaugaaaauaaaagacgaagaaagagacgacacguugacgauuuuauuaaaagcgacauuacucgccguauccggaguauacccucugucaauucccgcuacguuauuuguuugguauuucuggcagaagaagaaacagcgaagugggguacuaugggacacaccaucaccaccugagguugaaagagcaguacuugaugauggaaucuauagaauaaugcagagaggcuuauuaggacggucgcagguuggcguggguguguuucaggaaaacguuuuucauaccauguggcacguaacaagaggggcagugcuaauguaucaaggaaaacgccuagaaccuaguugggcaaguguuaaaaaggaccuuaucucuuauggaggaggauggcguuugcagggaucuuggaauacaggugaggagguacagguaauagcuguagaaccagguaaaaauccuaaaaacguccagaccgcgccaggaacauuuaaaacaccagagggugaaguuggugcuauagcucuagacuucaaaccugguaccagugguucccccauaguaaauagagaagguaaaauaguagggcuguauggaaauggcgugguaacgacaucggguacauauguaucagcuauagcacaagcgaaggcaucucaagaaggcccacugccugaaaucgaggaugaaguuuuccggaaaagaaacuuaaccauuauggaucuucacccaggaucugggaagacacgacgcuauuuaccagcaauagugagggaggccauuaagagaaaacuuaggacgcugauauuggccccuacaagaguaguugccuccgaaauggcagaagcacuaaaaggaaugccaauacguuaccaaacgacugccgucaaaagcgaacacacuggaaaagagauagucgacuuaaugugucaugcuacguuuacaaugagauuauuaucaccaguaagaguacccaauuauaauaugauaauaauggaugaggcccacuuuacagauccaucuucgauagcagcaagaggguauauaagcacacggguagguaugggugaagccgccgcuauauuuaugacugcgacuccaccuggauccguggaagcauuuccccaaucgaacgcgguaauacaagacgaagaacgcgauaucccugaaaggaguuggaacucaggcuaugaauggauaaccgauuuuccgggcaaaaccguuugguucguaccuaguauuaaauccgggaacgacauagcuaacugucugaggaaaaaugguaaaaggguaauacagcucagcaggaaaacauucgauacagaauaucagaaaaccaaaaauaaugauugggacuacguggugacaacugacauaagugaaaugggagcgaauuuuagagcagauagaguaauugacccucgacgaugcuugaagccaguaauauuaaaggaugguccugaacgugugauacuagcuggaccgaugccuguaacaguagcuagugcugcacaaaggcgggguagaauuggacggaaucauaacaaggaaggagaucaguauaucuauauggggcaaccauuaaacaacgaugaagaccacgcacacuggacugaagcuaaaauguuauuagauaacaucaauacuccugaaggaauaauacccgcuuuauucgaaccagaacgugagaaaucugcugcaaucgacggggaauaccgucuuagaggcgaggcucguaaaacuuuuguggaacuuaugagaaggggagaucuaccaguauggcuaucauacaaaguggccucagaaggguuucaauauucugaucgacgauggugcuucgacggcgaacgcaacaaucaaguauuagaagaaaauauggacguugaaauuuggacaaaagaaggagagagaaagaaauuacguccucgauggcuugaugcgaggacauauagcgauccguuagcauuacgugaguucaaagaauuugcggcagggagaagaucagucucgggggaucuuauauuagaaauuggcaaacuuccucaacaucuaacucaacgggcgcaaaacgcauuagauaacuuggugaugcuacauaacagcgagcaaggaggacgagcguauaggcaugccauggaagaacugcccgauacaaucgaaaccuuaaugcugcuagccuuaauagcaguuuuaacuggcggcgucaccuuauucuuuuugucuggaaggggacugggcaaaacuuccaucggacuacuauguguaauggccagcagcguacuuuuauggauggccuccgucgaaccgcauuggauagcugcgucuauaaucuuagaauuuuucuuaaugguccuccuaauaccagaaccugaucgacaaagaacaccgcaagacaaccaacuugccuaugugguuauaggucucuuauuuaugauccuaaccguugcugccaaugagaugggacuucuggagacuacaaagaaagacuuaggcaucggucauguggcagucgaaaaccaucaucaugcuaccauguuagacguagaccugcauccggcuucagcuuggacacuauacgcgguagcuaccacuaucauuacuccuaugaugcgacacacaauugaaaacacaacagcaaauauuucucuuacagccauugcaaaucaagcagcuauacuuaugggacuagacaaagguuggccgauaucgaaaauggauauuggaguaccccuuuuggcuuuaggaugcuacucucaagugaacccccuaacacuaacugcggcgguuuuaaugcuuguagcccacuaugccauaaucggcccuggucuacaagcaaaagcuacuagagaagcucaaaaacgaacugcggcgggaauuaugaaaaaccccacgguugacggaauuguagcuaucgauuuagaccccguaguauacgaugcaaaauucgaaaaacaacucggacagauaaugcuacuuauacugugcacaagucagaucuugcuaaugcguacaacuugggcucuuugcgagucuauaacccuagcaacagguccauuaacaacccugugggaaggcucacccggaaaguuuuggaauacgacaauagcaguaucuauggccaauaucuuuagagggucauaccuugcaggggcaggccuugccuuuucguuaaugaagucuuugggaggcggaagaagagggaccggagcacagggugaaacacucggugaaaaauggaagagacaacuaaaucaauuaagcaagucagaguucaacauuuauaaacgaucugguaucauggaaguugaccguucagaagcuaaagaaggauuaaaaagaggagagacaaccaggcacgcgguuaguagaggaacggcaaaauugagaugguuugucgaaagaaaccugguuaaaccugaaggcaaaguuauagaccuuggauguggacgaggaggguggaguuacuacugugcagggcugaagaaaguuacagagguuaaagguuacacaaaaggcggcccaggacaugaagaacccauuccuauggcuacauauggguggaaucuuguaaagcugcacagcggaaaagacguguuuuucacaccaccugaaaagugcgauacuuuacuaugugacauaggagagaguucuccgaaucccacaauugaggaagggaggacacucagagugcuaaagaugguagaaccauggcugcgaggaaaucaauuuuguauaaaaauacuuaacccauauaugcccagcguagucgaaacucuugaacaaaugcaacguaaacacggugguauguuaguucgaaauccauugucaagaaacuccacccacgagauguauuggguaucauguggaacugguaauauaguaagugcaguuaacaugacaucgaggauguuacugaaucguuucacaauggcucaucgcaaaccaacuuaugaacgggauguagaucugggagcagguacuaggcauguugcaguagaacccgaaguugcaaaucuugacauaaucggacaacggauagaaaacaucaaacaugaacauaaaucgacguggcauuacgaugaagacaauccauacaaaacgugggcguaccacggaucauacgaaguaaagcccucagguucugcuaguucuauggugaacgguguaguaaaauuacuaacuaaacccugggacgugauucccaugguaacacaaauagcaaugacagauaccacucccuucgggcaacaacgagucuucaaagaaaaaguugauacuaggacaccaaaagcgaaacguggaaccgcacaaauaauggaagugacagcucgauggcuuuggggauuccuuucacggaauaagaaacccagaauauguacccgggaagaguucacaagaaaaguaagaucgaacgcagcuauuggugcaguauucguugaugaaaaucaauggaacuccgcuaaagaagcaguugaagaugaaagguuuugggaccucguacaaaaggagcgcgagcuacacaaacaagguaaaugugccacuugugucuauaacaugaugggaaagagagagaagaaacuuggggaguucgggaaagcaaaaggcucaagagccauaugguauauguggcucggugcacgauuccucgaauuugaagcauuaggauucaugaacgaggaccauugguuuucacgcgaaaacucccuuucaggagucgaaggggaaggacuacauaaacuagguuauauauuaagagacauaucuaaaauaccgggaggcaauauguaugcagacgauacagcaggaugggacacgcguauaacagaagaugauuuacaaaaugaggccaagauaacggauauuauggaaccugaacacgcacuguuagcaacaaguauauucaaauuaacguaucaaaacaagguggucaggguucaacgaccggcuaaaaauggaaccguuauggacguuauaucuagaagagaucaaaggggcucaggacagguggguacuuauggucuaaacaccuuuacaaacauggaagcucaauugauccgccaaauggaaagugaagguauauuuucgccaucugaauuggaaauaccuaaccuagcggaaagaguacuugauuggcucgaaaaguauggggucgaaagacuaaaaagaauggcaaucucuggcgaugauuguguaguaaaaccgaucgaugacagauucgcaacagcucugacagcauuaaacgauauggguaaagugagaaaagacguaccucagugggagccaaguaaaggauggaaugacuggcagcaaguaccguuuuguagucaucauuuccaccaauuaauaaugaaagacggacgugagauagucguuccauguaggaaccaagaugagcucguuggcagagcgagagucucacaaggggccggauggucuuuacgagagaccgcuuguuuaggaaaaucauaugcacagauguggcaacuuauguauuuucauagaagagaccuaagacuugcugcaaacgcaauauguagugcaguucccguggauuggguacccacgagcagaacuacauggucaauccaugcucaucaucaguggaugacaacagaggauauguuaaguguauggaacagaguauggauugaagaaaauccguggauggaggacaagacgcacguaaguagcuggggcgaugucccuuauuuggguaaaagagaagaucaauggugugguucucugauugguuugacagcucgagccacuugggccucuaacauacaaguagcaauaaaccaaguucgaaggcuaauuggaaaugaaaacuaucucgauuauaugacgucaaugaaacgguuuaaaaaugagggugauccagaaggagcccugugguaa

SEQ ID NO: 21758 - RNA, 9879 nt, Artificial Sequence
  derived and/or modified CDS sequence (opt6) from DENV-1__FJ898416__SS-prME
ucaguaacuauguuguugauguuaaugccaaccgcccuagcguuucacuuaacuacacggggaggggaaccacauaugaucguuaccaaacaagaaagggguaaaucuuugcuuuuuaaaaccagcgccggcguaaacauguguacgcuuauagccauggacuuaggcgaacuaugugaagauacaaugacauacaaauguccgaggaucaccgaagcagaaccugacgauguggauuguugguguaacgcaacagauacaugggucacuuauggaacuugcagucaaacaggggaacaucggcgagacaaaaggucgguagccuuagcgccacauguuggucugggauuagaaacacguaccgaaacguggaugaguucagaaggcgccuggaaacaaauacaaagaguugaaacgugggcccuaagacauccaggauuuacaguuauugcacuauuuuuagcacacgcaauugguacaaguauuacccaaaaagguaucauuuucauacuucuuauguugguuacgccuuccauggcuaugagguguguugggauagggagccgagauuucguggagggguuaucaggggcaacauggguagacgucguauuagagcauggauccuguguaacgacgauggcaaaagauaaaccgacuuuagacauugaauuacuaaaaacugagguuacaaacccugcgguauuacgaaaacucugcauugaagcaaaaaucucuaacacgacaacggacucacggugcccaacucagggagaagccacguuaauggaagaacaggacgcaaauuucguuugcaggcggacuuucguagaccggggguggggcaacggguguggguuguuugguaaaggcucauuaauaaccugcgcgaaauucaaauguguaacaaaauuggaaggaaaaauugugcaguacgaaaacuuaaaauacagugugauugucacuguucauacaggcgaccaacaucaagugggaaacgaaucaacugagcacgggaccacugcaacuauaacgccacaggcaccuacaagugaaauacaacuaaccgacuauggagcacucacacuagacugcucaccuagaacgggguuagauuuuaaugaaauggugcuauuaacuaugaaagaaaaaucauggcuagugcacaaacaaugguuuuuagaucuaccauugccauggacaagcggagcuucaacaucccaagaaacauggaauagacaggaucugcuggucacuuuuaaaacagcucacgcaaagaagcaggaaguaguaguccugggcucgcaagaaggagcaaugcauacagcacuaacaggggccacagaaauacaaaccagcggcacaacgacaaucuuugcaggacaccuuaagugcagguugaaaauggauaaauuaacauugaaaggcaugucauaugucauguguacugggucguuuaaacuagagaaagagguagcggaaacccaacauggaacggugcugguucaaauuaaguaugagggaacagacgcuccuuguaagauuccauuuaguacgcaagaugagaaagguguaacucagaacggaagacuuaucacugcuaauccaaucgugacggacaaagaaaaaccuguuaacaucgaggcugaaccaccauucggagaaaguuacauuguaauuggggcgggggaaaaggcuuuaaaacuuagcugguuuaagaaaggauccuccauuggaaagauguuugaagcaaccgcaagaggcgcaagacgaauggcaauccugggugauaccgcgugggauuucggcaguguuggugggguauucacaagcgucggaaagcuaguucaucagauuuuuggaacggccuauggugugcuauuuagugguguaagcuggaccaugaagauugguauagguguauuauugacaugguuaggguuaaacaguagaucuacaagucuuucaaugacgugcauagccgucggguuagucacacuguacuuaggagucaugguacaggcugacucuggauguguaauaaauuggaaagggagggagcuaaaaugcgguagcgguauauucgucaccaaugagguucacacuuggacagagcaguacaaguuucaagcagauagucccaaacgucucucggcagccauaggaaaagcaugggaggaaggggugugcgggauucgaucagcaacuagacucgaaaacauaauguggaaacaaauaagcaacgaacuaaaucauauauuauuggaaaacgauaugaaguuuacaguuguagugggggacguaguaggaauuuuggcccaagguaagaagaugauuagaccccagccaauggaacauaaguauagcuggaaaaguugggguaaggcaaaaauuauuggugcugacguccaaaauacaaccuuuauuauagacggccccaacacaccugaauguccagaugaccaaagagcauggaacauuugggaaguagaggacuauggauucggaaucuuuaccacuaauauauggcuuaaacuucgggauaguuauacacaaguaugcgaucauagacucaugagcgcagcaauaaaagacucuaaagcaguacaugccgauaugggauauuggauagagagugagaaaaaugaaacauggaaacuagcaagagcaaguuuuaucgaaguaaaaacaugcaucuggccaaaaucucauacacucuggaguaauggaguccucgaauccgaaaugauaauaccuaagauuuauggaggaccuauaagucaacacaauuacaggccaggguauuucacgcagacagcgggaccguggcaccucgggaaauuagaauuggauuuugauuugugugaaggcacaaccguaguaguggacgaacauuguggaaaucgaggcccaagucuuaggacaacaacagucacagguaaaauaauucaugaauggugcuguagaucauguacgcucccgccacuaagauucaaaggcgaagauggguguugguacgggauggaaauccgaccagucaaagaaaaagaggaaaaucuuguaaaaucaaugguuucagcaggaucaggugaaguagauuccuuuagucuggggcuccuauguaucucuauaaugaucgaagaagugaugagaucgagauggucuagaaaaaugcuaaugacuggaacccuagcgguauuccuccuucucauaaugggacaacugacauggaaugauuuaaucagauuaugcaucauggucggugcuaacgcuuccgaccggaugggaaugggaacaacauauuuggcucucauggcaacauuuaaaaugcguccaauguuugcagucggucuccucuucagacgacugacuucgagagaagucuuauuacuuacaauaggacuuucccuuguagcaucaguagaguuaccaaauaguuuagaagaauuaggagacggauuagcaaugggaauaaugauucucaaacuauuaacagacuuucagucgcaccagcuaugggcuacucuacuaagccuuacauuuauuaaaacaacgcuaaguuugcauuaugcuuggaaaacaauggcuaugguguuaucuaucgcaagucuauuuccucuuugcuugucaacaacaagucaaaagaccacuugguuaccugucuuguuagguucacuuggauguaagccacuaaccauguuuuugauuaccgagaccaaaauauggggucgaaaaagcuggccuuugaaugaagggauaauggcaguggguguggugaguauauuauugaguucguugcucaaaaaugauguccccuuggccgggccacugauagcaggaggaaugcuuauugcauguuacguaaucucaggaaguucagcagauuuaagccuagaaaaggcagcugagguaaguugggaggaagaagcagaacacaguggggcaucccacaauauuuugguagugguacaagacgauggcacuaugaaaauaaaagaugaagaaagagacgauacuuuaaccauucuucuaaaagcaacgcuauuagcaguaucgggaguguacccacugucaauaccagcgacgcucuuuguaugguacuuuuggcagaagaagaaacagagaagcggaguuuugugggauacuccgucaccuccagagguggaacgugcuguauuggaugacggcaucuaucgcauaaugcaaagaggauuauuaggucgcagccaaguggguguaggaguguuucaggaaaauguauuccauacaauguggcaugucacacgaggugcaguacucauguaccaagguaaaagacuagaaccuucuugggcuucagucaagaaagauuuaauaagcuacgggggcgguuggcgcuugcaaggaagcuggaauacgggagaagagguacaaguuauugcaguagaacccgguaaaaaucccaagaaugugcaaaccgcaccgggcacguuuaaaacucccgagggcgaagucggugcaaucgcacuugauuuuaaaccgggaacgagcgguucaccuauuguaaaucgggagggaaagauuguaggucuauacgguaauggaguggugacaacguccgggacuuacgucagcgcaauagcucaggcgaaaaccagucaagaaggacccuuaccagaaauagaggacgaaguauuuagaaagaggaauuugacaaucauggaucuacacccugguagugggaaaacuaggagauaccuacccgccaucguucgugaggcaaucaaaagaaaauuaagaacauuaauauuggcgccaacuaggguuguggcgagcgaaauggccgaagcguugaaagguaugccaauaagauaccaaacaacagcaguaaaauccgaacauaccggcaaagagauaguagaccugaugugccaugcaaccuucacaaugagacuacucucaccuguaagaguaccaaacuacaauaugauaaucauggacgaagcacauuucacagaccccucaucaauagcagcacguggguacauuuccacucgaguugguaugggugaagccgcagcgaucuuuaugacagccacgcccccuggaagcguugaggcuuuuccucaaaguaaugccguaauacaggaugaagaaagagauauaccugaaagaucauggaacucaggauaugaauggauaacagauuuccccggaaaaacgguuugguuuguaccaucaauaaagagugggaaugauauagcaaacuguuugcguaaaaaugguaagaggguuauucaacugucucggaaaacauucgauacggaauaucaaaagacuaaaaacaaugauugggacuacgucguaacuacagauauaucggaaaugggcgcaaacuuucgagcagacagagugauagauccgaggcgaugcuuaaaaccuguaauauuaaaagacgguccagaacgcgucauacuagcugguccaaugccugucacagucgccagcgcagcacaaagacgaggcagaauuggacgaaaucauaauaaagagggggaucaguacauauauaugggucaaccccugaacaacgaugaagaccacgcucacuggaccgaagcaaaaaugcugcuugauaauauuaacacaccugaagggauuauuccagcucuauuugaaccugaaagggaaaaaucagcggcaauagauggagaauaucgacuacgaggagaggccagaaaaacauucguugaguuaaugaggagaggggaccuaccaguauggcugaguuacaaaguagcgucugaaggauuccaguauagugauaggcgauggugcuuugauggugaacgaaauaaccaaguuuuggaggagaauauggacgucgagauuuggacaaaagaaggggaaaggaagaaauugcguccgagaugguuagaugcaagaaccuauucagauccucuagcccuaagagaguuuaaagaauuugcagcaggacggcguucggugagcggugauuugauuuuagaaauaggaaaauuaccccaacauuugacacaaagagcucaaaaugcgcuggacaauuuaguaaugcuacauaacagugaacaagguggaagggcuuauagacacgcuauggaagaacucccggauacaauugaaacauuaaugcuuuuggcucugauagcaguucuuacaggaggagugacacuguucuuccuaagcgguagaggccugggaaagacuucuauuggccucuuauguguuauggcuucaucagugcuuuuguggauggcaaguguugaaccucacuggauugcugcauccauaauuuuagaauuuuuccuaaugguacuauuaauacccgagccugauagacaacgaacuccacaggauaaccaguuagcuuacguaguuauuggauuacuauuuaugauacucacugucgcagcaaaugaaaugggauuauuagaaacgacgaagaaagaucugggcauaggucauguagcaguagagaaucaucaucaugcaacaauguuagacgucgaccugcacccagccagugcuuggacucucuaugcaguagcuacuacgauaauaacuccgaugaugagacauacaaucgaaaacacaacagcuaacauuucucugacggcaaucgcaaaccaagcugcaauccuaaugggacuugacaaagguuggccaauuucuaaaauggacauuggagucccauuauuagcgcugggaugcuacagucaagucaacccacucacacugacagcggcaguacuaauguuaguagcccacuaugcaauuauagggccgggacuacaagcaaaggcaacacgcgaggcacaaaaacgaacggcugcggguaucaugaaaaauccgacagucgacggcauaguagcgauugaccuggauccuguuguuuaugaugcuaaauucgaaaaacaacuaggucaaauaauguuauuaauacucuguaccagccaaauuuuacuaaugagaacaacuugggcucucugugagucaauuacauuagcaacuggaccguugacuacucuuugggaaggcaguccuggaaaguucuggaauacaacaauugccguaagcauggccaauauauuccgagguucuuaccucgcuggugcuggccuggcguuuaguuuaaugaaaagccucggugguggacgacgcgggacuggcgcccaaggagagacacuuggcgaaaaguggaaacggcaacuaaaucaacuuucuaagucagaguucaauauauauaagcguagugguauuauggaaguugacaggagugaagccaaagaaggucuaaagaggggcgaaacaacuagacacgcagugucgagaggcacagccaaacuacguugguucguugagagaaauuugguaaaaccagaagguaaagucauugaccuuggcuguggaagaggugguuggucauacuacugugcagggcucaagaaagucacggaagugaagggcuauacuaaggguggucccggacaugaagaaccaauaccuauggcgacauacgguuggaauuuggucaaacuacauucuggcaaggaugucuucuuuaccccgccagagaagugugauacacuucugugugauauuggcgaaucaucgccaaaccccacgauagaagaaggaaggacauuaagaguauuaaaaauggucgaaccauggcuaagaggaaaucaguucuguauaaaaauucuuaauccuuacaugccgaguguaguagaaacacuagaacagaugcaaagaaaacacggcggaaugcuuguuagaaauccuuuaucaagaaauucaacacacgaaauguauuggguaucaugugguaccggaaauauagucucagcuguuaauaugaccucgcgaaugcugcuuaaucgauuuaccauggcgcacaggaagccgacauaugaacgagauguugauuuaggugcaggaacaaggcauguggcgguugaaccugagguugcaaaccuagacauaauaggacaacgaauagaaaacauaaagcaugaacauaaaucaacauggcauuacgacgaagauaauccauacaagacaugggcguaucauggaaguuacgagguaaagccaagugguucugcaaguucgaugguaaaugguguaguaaaacuacuuacaaaacccugggauguaauaccuauggugacacagauagcuaugacggauacaacuccuuuuggccaacagagaguguuuaaagaaaaaguugacacaaggacaccaaaagcaaaaagaggaacagcccaaauaauggaagugacggcaagauggcuguggggguucuugucccgaaauaagaaacccagaauuuguacaagagaggaguucacaagaaaaguaagaucuaaugccgcgauaggugcugucuucguugaugaaaaccaguggaacagugcaaaagaagccguagaagaugaaagguucugggacuuaguacagaaagaaagagaauuacauaagcaagguaagugcgccacauguguauacaacaugaugggaaaacgugagaagaaacucggagaguucggaaaagcgaaaggcucucgggcaauaugguacauguggcuuggagcucgauuccuggaguuugaggcacugggauuuaugaacgaagaucacugguuuucacgagagaacagucuaucaggcguagaaggugaaggauuacauaaauuaggauauauauuacgggauauaucaaaaauucccgguggaaacauguacgccgaugacacugcggggugggauacaagaauaaccgaagacgauuuacaaaacgaagccaagauaacugacaucauggagccggaacaugcguuguuagcuacaucaauauuuaaguuaaccuaucaaaacaaaguuguacgaguacagagaccagccaagaacggaacgguaauggacguaaucagcagacgugaucagagggguucagggcaaguuggaacuuauggacuuaacacauuuacaaauauggaagcacaacugauuagacaaauggagucagaaggcauauucuugcccucagaauuagaaaccccuaacuuagcagaacgaguauuagauuggcuggaaaaauacggaguagagagauuaaaaaggauggcgaucucaggcgacgauugugucguaaaaccaaucgacgauagauucgcaacggcccugaccgcucuuaaugacaugggaaagguucguaaggauauaccccaaugggaaccuucgaaaggauggaacgacuggcagcaaguaccauucugcucacaccacuuucaucaacucauuaugaaagauggccgugaaauagucguaccguguagaaaucaagacgaacuugucgguagggcacgcgugagucaaggagccgguuggucacuuagggagacugcaugccuugguaaaagcuacgcgcaaauguggcaauuaauguauuuucaucggagagaccuuaggcuugcagcaaaugcgaucugcagugcagugccgguggauuggguuccaacaagucgcacuacauggucuauacaugcgcaucaccaauggaugacaaccgaagacaugcuaagcguguggaaucgaguauggauugaagagaauccauggauggaagacaaaacacaugucucuuccuggggagacguaccauaucuuggaaaacgagaagaucaauggugcgguagccuaauaggguuaacggcaagagcaacaugggcuucaaauauacaaguagccaucaaccaaguaagaagauuaauugguaaugaaaauuaccucgauuacaugacaaguaugaagagguuuaaaaaugaaggugacccugaagggguucuaugguaa

SEQ ID NO: 21759 - RNA, 9879 nt, Artificial Sequence
  derived and/or modified CDS sequence (opt6) from DENV-1__FJ898417__SS-prME
uccgugaccaugcuucucauguuaaugccuacugcgcuggcauuucaucucacuaccagggguggugaaccgcacaugauagucucgaaacaagaacguggaaaaucuuuacuuuucaaaacaagugcggguguuaauaugugcacauuaauagcaauggauuuaggcgaauuuugcgaagacacuaugacguauaaauguccaaggauuaccgaagccgaaccagaugaugucgauugcuggugcaaugccacagacacaugggucaccuauggaacguguucacaaacgggagagcaucgacgugauaaaaggaguguugcucuugcgccacacguaggauuaggcuuggaaacgaggacggagacguggaugucauccgagggagcuuggaaacaaauccaaaggguugaaacuugggcauugcggcauccagguuucacuguuauagcccucuuccuagcucacgcaauugggacuagcauaacacaaaaaggaauuauuuuuauauuauugauguuaguuacgcccaguauggcgaugagauguguaggcaucgguucuagagacuucguagaaggacugucaggggcaacauggguugacgugguuuuagagcacggcucuugugucacaaccauggcaaaagacaaaccaaccuuagacauagaacuucuuaaaacggaagucaccaacccggcaguguugagaaaacugugcauagaagcgaaaauaagcaacacaacuaccgauucuagaugucccacucaaggagaagcaacauuaguagaggaacaggacgcuaauuuuguuugucgcagaacauuuguggaucguggauggggaaaugguuguggacuuuuuggaaaagguucacuaauuacuugcgccaaauuuaaauguguaacuaaacuggaaggcaaaauagugcaguacgagaauuugaaauauucagugaucguaacaguucacacuggcgaucaacaucaaguaggaaacgaaaguacugagcacggaaccacagcaacuauuacgccacaggcaccuaguacagaaauacaguuaacagauuauggcgcacuaacuuuagacugcucuccucgaacaggcuuagauuuuaaugagaugguacuacuaacuaugaaagaaaaaucauggcuaguacauaaacagugguuccuagaucucccucuuccauggacuucgggagccucaacaagucaagaaacuuggaauagaaaagaucuacugguuacauuuaaaaccgcacacgcaaagaaacaagaaguuguaguccucggcucccaagaaggagcaaugcauaccgcacucacgggcgccacggaaauucaaacaaguggcaccacuacuauauucgcuggccaucugaaaugcagauuaaaaauggauaaauuaacgcuuaaaggcaugucuuauguuauguguacuggauccuuuaaauuggagaaagaaguugcugaaacacaacaugggaccguacuuguacaaaucaaauaugagggaacggaugcaccauguaaaauuccauucaguacacaggaugaaaagggagucacccaaaaugguaggcuuauuaccgccaauccaauagucacagauaaagaaaagcccguaaacauugaagcagaaccgccauuuggugaaagcuacauaguaauaggugcaggagaaaaagcucucaaauuaucaugguuuaagaaaggaagcucaauagggaaaauguuugaagccaccgcaagaggggcccgaagaauggcgauucuuggagauacagcuugggauuucggaagcauaggggguguuuuuaccucaguggggaaauuagugcaccaaauuuuuggaacagcauacggaguauuauuuaguggugucucguggacuaugaagauugggaucggaguucugcugacauggcuuggauuaaacucacgaaguacaucacugagcaugacaugcauagcuguggguuugguaacauuauaucugggaguuauggugcaagccgauucagguugugucauaaacuggaaggggagagaguugaaauguggaucaggaauauuuguaacaaacgaggugcacaccuggacagaacaguauaaauuccaagcggauuccccaaaaagacuuagugccgcuauuggaaaagcgugggaggagggcguauguggaauaagauccgcaacgcgccuugaaaacauaauguggaaacaaauaucuaaugaauuaaaccauauucuucuagaaaaugauaugaaauucacuguuguaguaggcgaugucgcugguauucuagcgcagggaaagaaaaugauaagaccgcaaccuauggaguacaaauauucuuggaaaagcuggggaaaagcaaaaauaaucggagcugauguccagaauaccacauucauaauagacggucccaacacuccagaauguccugaugaucaaagagccuggaauauuugggagguugaagauuauggauuugguauauucacaacaaauauauggcugaaauugcgagacucauacacucaaguuugcgaccacagauuaaugagcgcugcuauaaaagacucaaaggcuguacaugcagacauggguuacuggauagaaagugagaaaaaugagacuuggaaacuagcacgugcuucuuucauagaggugaaaaccuguauauggccaaagucacauacacuuuggaguaaugguguacuagaguccgagaugauaauaccaaaaauuuauggaggaccuauuucacaacauaacuaucgaccgggauauuucacacagacggcugggcccuggcauuuagguaaacuagagcuugacuucgaccuaugcgaaggaacaacgguagucguugaugaacauugcggaaauagaggcccauccuuaagaacaacaacagucaccgggaaaauaauacaugaauggugcugcaggucauguacucuaccgccccucagauuuaaaggugaagacggaugcugguauggcauggagauaagaccagugaaagaaaaagaagaaaaccuaguaaaaucgauggucucugcagggaguggggaaguagacagcuucucacucggauuacugugcaucaguauaaugauugaagaaguaaugagaucucgauggaguaggaaaaugcucaugacagggacguuagcaguguucuuuuuacuuauaaugggucagcuaacguggaaugaccuaauucgguuauguauaaugguuggagcaaaugcgucugaccguaugggaaugggaaccacguacuuagcacuaauggcuaccuucaaaaugaggccaauguuugcagucggucuauuauuccgcagacucaccagcagggaaguccuguuacuaacgauaggccugagcuuaguugccaguguugagcuuccuaacagccuagaggaacuaggcgauggauuagcaauggguaucaugauacuaaaguuauuaacggacuuucagagucaucaguuaugggcaacacuccuuucauuaacuuuuaucaagacaaccuuuucgcuucauuaugcauggaagaccauggcaaugguccuuucuauaguuucacucuuucccuuaugucuuuccacaacaagucagaaaaccacaugguuacccguacuuuugggaucauuaggauguaaaccacuaacaauguucuugauagcugaaaacaaaauauggggacgcaaaucauggccauuaaacgaaggaauaauggcgguggggauagugagcauauuacuuucugcacuauugaaaaacgauguaccguuggcaggaccgcugauagcugggggaaugcuaauugcgugcuauguaauauccgggucuuccgcugauuugucccucgaaaaagccgccgaaguaucgugggaggaagaagcugagcauagcggugcaucacacaauauacuuguagaaguucaagaugaugggacaaugaaaaucaaagaugaagaacgggaugauacacuuacgauacuguuaaaagccacgcuccucgcugucucgggcguauacccucuaucuauaccagccacauuauucgucugguacuucuggcagaagaagaaacaacguucaggaguguugugggauacgccuagcccgccggagguagaacgugcaguucuagaugauggaauuuacaggaucaugcagcgagggcugcugggaaggagucaggugggaguagggguauuucaagaaaauguuuuccauacuauguggcacguuacaagaggggccguccuaauguaucagggaaaacgauuagaacccucuugggcaucugucaaaaaggacuuaaucucguacggaggaggauggcgucuacaaggauccuggaacacuggagaagagguacagguaauagcaguugagccgggcaaaaaucccaaaaauguacagaccgcucccggaacuuucaaaacaucagaaggugaagucggagcaauugcccuagacuuuaaaccagguacaucugggaguccuauaguaaauagagaaggaaagauagucggauuauacggaaacggcguggucaccacuucggguaccuacguuucagcuauugcgcaagcaaaagcuagucaggaaggaccacucccugagaucgaagacgaaguauuccguaaaaggaaccuuaccaucauggacuuacauccuggcucggggaagacaagaagauaucuuccagcgauuguaagagaagcaauaaagcgcaaauugagaacauuaauuuuagcaccaacccgaguaguagcaucagaaauggcugaagcauugaaggggaugccaauaagguaucaaacaacugccguuaaaucagaacauaccggaaaagaaauaguggaccuuaugugucaugccaccuucaccaugcgauuauuaucaccgguccggguucccaauuauaauaugauuaucauggacgaggcacacuuuacagaccccucaaguauagcugcacggggauauauaucaacacgagucgguaugggggaagccgcggccauauucaugacggccacaccaccugguaguguagaagcguucccacaaucuaacgcuguaauucaagaugaagaacgugauauaccggaaagaucauggaauagcgguuaugaauggaucacagacuucccagguaaaacaguaugguuuguaccaagcauaaaaucagguaaugauauagcaaacugccuaaggaaaaauggaaaacgaguuauucaauugucaaggaaaacauucgacacugaauaccagaaaaccaaaaacaacgacugggauuauguaguaaccacugauauaucggagaugggugcaaauuucagagccgacagagugauagacccaagacguugucuuaaaccuguaauccugaaagacgggccagagcgugugauucuugcaggaccaaugccaguaacaguugccagugcggcacaaagacgugguagaauagggagaaaccauaauaaagaaggagaucaguacauuuacaugggacaaccgcugaacaacgaugaagaucacgcgcacuggaccgaagcaaagauguuacuugauaacauaaauacgccggaagguauaauuccugcacuauucgaaccagagcgagagaagagugcagcuauugauggugaauauagacuacggggagaggcgcguaaaacauucguagaacugaugcgucgaggagaucucccaguaugguugucuuauaaaguggcgagugagggguuccaauauagcgauagacgaugguguuuugauggagaaagaaacaaucaaguuuuagaagaaaauauggauguugaaauauggacuaaggaaggagaaaggaaaaagcuccgaccuaggugguuagacgcaagaacauauagugauccuuuggccuugcgagaauuuaaagaguuugcggcgggccgacgaucgguuucgggugauuugauacuggaaauaggaaaauuaccgcagcaccucacgcaacgggcucaaaacgcauuggacaaccuaguaauguuacacaacucugaacagggcggccgagcauaucggcaugcuauggaagaacuacccgauacuauagagacauuaaugcuauuagcccuuaucgccgugcuuacaggaggaguaacauuauucuucuuaagugguaggggcuuaggaaaaacaaguauaggcuuguugugcguaauggcaagcagcgugcuucuguggauggcgucaguugaaccacauuggauagcugcgucaauuauacuagaauuuuuccuaaugguuuuacucauaccagaaccagauagacaaagaacaccucaagauaaccaacuagcauauguaguuauagguuuguuauuuaugauauuaacgguugcggcaaaugagaugggauuacuugagacuaccaagaaagaucuaggaauaggacacguugcgguugaaaaucaucaccacgcagcuauguuggacguagaccugcauccugcuucagcauggacauuauaugcaguggcgacuacuauuauuacacccaugaugagacacaccauugaaaauaccacagcgaauauaucguuaacggcaaucgccaaccaggcugcaauauuaaugggauuagacaaaggcuggccaauaagcaagauggacaucgguguaccgcuucuagcccucggaugcuacucacaggugaacccauuaacacucacagcagcgguacuaaugcuggucgcccacuaugcaauaauaggcccuggucuacaagccaaagcgacaagagaagcccagaaacgaacugccgcaggaauaaugaagaacccuacaguggaugggauagucgcaauagauuuggauccggugguuuacgacgcgaaauucgaaaaacagcuaggccaaauaauguuauugauacuauguaccucccagauucuauugaugagaaccacaugggcauuaugugaaagcauuacauuagcuacaggaccccuaacaacguuaugggaaggauccccgggcaaauuuuggaauaccacaaucgccguaucgauggcuaacauauucagaggguccuaucuugcaggagcuggacucgcuuuuaguuugaugaagucauugggaggagggcgcaggggaacuggagcgcaaggagaaacuuugggugagaaauggaaacgucaacuaaaucaauuaucuaaaagcgaguuuaacacauacaaaaggucagguauuauggaaguagaucgaucagaagcgaaagaaggacuaaaaagaggggaaacaacaaaacacgcagugagcagagguacggcaaaacuaaggugguucguggaaagaaauuuaguaaagccagaaggaaagguaauagauuuggguugcgguagagggggauggagcuauuauugugcaggucuaaagaaagucacggaaguaaagggauacacaaagggcggaccuggccacgaggaaccgauuccuauggcuacauacgguuggaaucuagugaaauugcacaguggaaaggacguauuuuucaucccgccugaaaaaugugacacucuucuaugugacaucggagaaucaagucccaauccuacuauagaggaaggaagaacauugcguguccuaaagaugguggaaccaugguuaagaggaaaucaauuuugcauaaaaauauuaaacccuuacaugcccucagugguggagacauuagagcagaugcaacgcaaacacggaggaaugcuagugcgaaacccacugucucgaaacucuacucacgagauguauuggguguccugcggaacaggaaauaucguaucagcagucaauaugacuucucguaugcuguugaaccgguucacuauggcacaucgaaaaccaacauacgaacgcgacguugaucucggagccggaacgaggcauguugcuguagaaccagaagucgcaaacuuggauauaauaggacagcgaauugaaaacauaaaacaugaacacaaaaguacguggcauuaugacgaggauaauccuuauaaaacgugggcauaucacggcaguuacgaaguaaaacccagcggaucagcaucaucaaugguaaaugguguaguaaaauuacuuacaaagcccugggaugucauaccaaugguuacacaaauagcaaugacagauacuaccccauucggacagcaacguguguuuaaagaaaaaguagauacucguacgccaaaagcaaaaagaggaacggcucaaauuauggaaguaacagccaaaugguuaugggguuuucucagccgaaauaagaaaccacgaauuuguacacgugaagaguucaccagaaaagugagaaguaacgcagccauaggggccguuuuuguugaugaaaaucaauggaacucagcuaaggaggcaguagaggaugagagauucugggaccuggugcaucgagaacgagagcuacacaagcaaggaaaaugugcaacuugugucuauaauaugauggggaaacgugagaagaaacucggagaguucggcaaggcaaaagggagcagagcaauuugguauauguggcugggugcaagauuuuuagaguuugaggcauuaggauuuaugaacgaagaccacugguucagcagagaaaacagucuaagugggguugaaggggagggguuacacaagcuaggcuacauccuacgagacauaagcaaaauaccgggagguaauauguacgccgacgacacagcagguugggauacgagaaucacagaggacgaccuccaaaacgaagcaaaaauaacagauauaauggaaccagaacaugcguugcuagcgaaaaguauuuucaaauuaacguaucaaaauaaagugguuagaguacaaaggccagccaaaaacgguacuguaauggacguuauuagucgucgugaucaaagaggaucgggacaaguagguacuuauggacuaaacacuuuuacuaauauggaggcacagcuuauacgacaaauggaguccgaaggcauuuucucuccaucagaacuugagacccccaaccuagccggucguguacucgauuggcuagaaaagcaugggguagaacgauuaaaacgaauggcaauaucgggagaugauuguguaguaaaaccgaucgacgaccgguuugcaaccgcucucacugcucugaacgauaugggaaaaguuagaaaagacauaccucaaugggaaccuagcaaaggauggaaugauuggcaacaaguaccuuucuguucacaucacuuucaccaauuaauaaugaaagacggacgagagauaguaguuccgugcagaaaucaagacgaacuuguaggccgagcuagggugagucaaggggcuggguggagucuaagagaaacugcaugcuuaggaaaaucuuaugcccaaauguggcaacuaauguauuuccacagacgagauuugcgcuuagccgcgaacgccauuugcuccgcagauccgguagauugggugccuacaucgaggacuacauggaguauccaugcacaucaccaguggaugacuacagaagacaugcuaaguguguggaauagggucuggauagaagagaauccuuggauggaggauaaaacacauaucagcagcuggggagaugugcccuaucuggggaaaagggaagaucaguggugcgguagucugauugguuugacagcacgcgcaacaugggcaacaaacauccaaguugcaauuaaucaaguacgaagauuaaucgguaaugaaaacuaucuggauuauaugacaaguaugaagcgauucaaaaaugaaucugauccggaaggugccuuaugguaa

SEQ ID NO: 21760 - RNA, 9879 nt, Artificial Sequence
  derived and/or modified CDS sequence (opt6) from DENV-1__GQ868612__SS-prME
ucaguaacgaugcugcuaaugcuaaugccuacggccuuagcauuucauuuaacuacucgugguggagaaccacauaugauuguuuccaaacaagaacgaggaaagagcuuauuauucaaaacuucugcaggaguaaauaugugcacucuuauagcgauggaucucggugaacuaugugaagauacaaugacuuacaaauguccuagaauuacggaagcggaaccggaugacguagacugcugguguaaugcaacggauaccuggguaaccuacggaacuugcagccaaaccggggaacacaggcgagacaaacgaagcguggcucucgcuccucacgucggauuaggacucgaaacaagaacugaaaccuggaugucguccgaaggggcuuggaaacaaauacaaagaguagaaaccugggcuuuacggcauccagguuuuacaguaauagccuuguuuuuagcgcaugcaauuggaacgucgaucacucaaaaaggaauaauuuucauauuacuaauguugguaacuccgucaauggcuaugagguguguagguaucggaaguagagacuuugucgaaggauuaagcggagcaacauggguagauguuguacucgaacacgggagcugugugacgacuauggcaaaagacaaaccaacucuagauauugaauuguuaaaaacugaaguaacaaauccugcgguacuacguaaacuaugcauugaagcaaaaauuagcaauaccacuacagauucuagauguccaacacaaggagaagcuacguuaguugaagaacaggacgcaaauuuuguuuguagaagaacguucguugaccguggaugggguaauggauguggacuuuuuggcaaaggaucacuuauuacaugcgcaaaauuuaaaugcguuaccaaacuagaagggaaaauaguucaauaugaaaaucuuaaauacagugugaucgucacagugcacacgggagaucaacaccaaguuggaaaugaaucuacugaacauggcacaaccgccacgaucacaccccaagcaccuacaacagaaauucagcuuacugacuauggggcccugacacuagauuguucuccucggacgggucuagacuuuaacgaaauggucuuguugacaaugaaagaaaaaucaugguugguccacaaacaaugguuccuagaucugccccuuccuuggacaaguggagcgaguacgucacaagaaacguggaaucgacaggacuuauuaguuacuuucaaaacagcccacgcaaagaaacaggagguuguaguacuaggaagucaagaaggggcaaugcauacggcauuaacaggggcaacggagauacaaacauccgggacaaccacuauuuuugcaggacaucuaaaaugccguuugaaaauggacaaacugacacuaaaaggaaugucuuacguaauguguaccggcuccuucaaauuggaaaaagaaguugcagaaacacaacauggcacgguccuaguacaaauaaaauacgaggggacggacgcacccugcaaaauuccuuucaguacacaagacgaaaaagguguaacacagaaugguagacugauaacagcaaacccuauuguaacugauaaagaaaaaccaguuaacauugaagccgaaccaccguuuggugaaucauauaucguuauaggggcuggugaaaaagcacuaaaacucagcugguuuaagaaagguucgucaauagguaaaauguuugaggcaacugcgcgaggggcuagaaggauggcuauuuuaggcgauacagcuugggacuuuggcuccauuggaggaguauucacuagcgucgggaaacuuguacaccaaauauuugguacugcuuacgguguauuguuuagcggcgucagcuggacaaugaagaucgguauuggaguacuuuuaacaugguuaggacuaaacucaagaucaacaucgcucagcaugaccuguauugcugugggccuaguaacccucuacuugggugcuauggugcaagccgacucgggaugcgugaucaacuggaaagggagggaguuaaaauguggcaguggaauuuucguaaccaaugaaguacauaccuggacugaacaauauaaauuucaagcggacucaccaaaaagacuaucagcugcuauaggaaaagcaugggaagaaggaguauguggaauaaggagugcaacacgauuagaaaauauuauguggaaacaaaucucaaacgaacuaaaccauauucucuuagaaaaugauaugaaauuaacaguagucguuggcgacguggcagguaucuuaggccaggggaagaaaaugauacgcccucaaccuauggaauacaaauauucauggaaauccugggggaaagcaaaaaucaucggagcagaugcgcaaaauacaacauuuauaauagauggaccgaauacgccugaaugcccagaugaucaaagagcauggaacauaugggaaguagaagacuacggcuuugguauauuuacgacaaauaucugguugaaacucagagacuccuauacucaagucugcgaccaucgacugaugucagcagcaauuaaagacucgaaagcaguccaugcagauaugggauauuggauugagucggagaaaaaugagaccuggaaacuagcccgugcgagucuaauugaagucaaaaccugcauauggccaaaaagccacacacuuugguccaaugguguacuugaaucggaaaugauaauaccaaaaaucuauggggguccgauuucacaacacaauuaucguccagguuacuuuacucaaaccgcuggcccauggcaucuaggcaaacucgaauuagacuucgaucuaugugaaggaacaacgguggucgucgaugagcauuguggaaaucgcggcccuucauugagaacaacaacaguuacaggaaagauaauccaugaaugguguugucgcucaugcacgcuaccaccccuuagguuucggggagaagaugggugcugguacggaauggagauuagaccaguuaaagaaaaagaagaaaauuuaguuaaaaguaugguaagcgcaggaagcggugaaguagauucauucagucugggacuacuguguauaagcauuaugauagaagagguaaugcgaucaaggugguccagaaaaauguuaaugacggguacucuagcuguguucuuuuuacuaauaaugggccagcuuacuuggaaugaccuaauuagacucugcauaaugguuggcgcaaacgcuagugaccguaugggaauggguacaacguaucuagcucucauggcuacauuuaaaaugcggccaauguucgcgguaggcuuacuauuucggagacugacuucacgagaaguccuacuuuuaacuauaggauuaagucuuguagcuaguguagaauugccgaauagccuagaagaauuaggagauggucuugcaauggguauuaugauauuaaaguuacuaacggacuuucagucacaccaacugugggcuacauuacuaagccuuacuuucauuaaaacaaccuucagucugcauuacgcauggaaaacaauggcuaugguacugucaauagucagcuuguuuccuuuguguuuaucaacaacgucacagaagacuaccuggcuaccuguacuucuaggaucauuagguugcaagccuuuaacgauguuccucauagcagaaaacaaaauaugggguaggaaaucguggccacuaaaugaagguauuauggcaguaggaauagugagcauccuucucucuagccuucugaaaaaugaugucccucuugcaggaccccuuauagcaggaggaaugcuaauugcaugcuaugugauuucaggaucaucggcggaucuaagucucgaaaaagcugccgaagugagcugggaagaagaagcggaacacucaggugcuagucauaauauauuaguagaaguacaagaugaugguacuaugaaaauaaaggaugaagaaagggacgauacacuuacaauccuccugaaggcaacuuugcuagccguuaguggcguauacccauuaucuauaccagcaacauuguucgucugguauuuuuggcagaagaagaaacaaaggucaggaguucugugggacacaccaaguccgccggagguagaacgggcaguucuggaugaugguaucuacagaauuaugcaaagggggcuauuaggaagaagucaaguaggugugggagucuuucaagaaaacguauuucacacuauguggcacgugacuagaggugccguucuuauguaccagggaaaaagauuagagccaaguugggcaagugucaagaaagaucugaucaguuacgggggcgguuggcgguugcguggaaguuggaauacuggggaagagguucaggugauagccguugaaccgggcaaaaaucccaaaaauguacaaacagcuccgggcaccuuuaaaacaccagaaggggaaguuggagcuauagcucuugacuucaaaccagguacaaguggaucgccaauaguuaaucgugaaggcaagauuguuggccuauacgggaauggaguagucacuacaucagggacguauguuucagcuauagcacaagcaaaggcuagucaggaaggaccauugccagagauugaagacgaaguauuccgaaaaagaaaccuuaccauuauggaccugcauccagggucaggcaaaacaagaagguauuuaccagccauaguacgcgaagcaaucaaacggaaacuaagaacgcuaaucuuggcuccaacgcgagucguugcuucugaaauggcagaagcgcuaaaagggaugccuauccgauaucaaaccacagcaguaaaaucagaacacacagggaaagaaauaguagauuuaaugugucaugcaacauuuacaaugagauuauuaucaccgguaagagugccaaacuauaauaugaucaucauggacgaagcgcacuuuaccgaccccucuucaauugcggcuagaggauauauuucaacgcgaguaggaaugggcgaagcugcugcaauuuucaugaccgccaccccgccugguucagucgaagcauucccucagucaaaugcagugauucaagaugaagagagagacauuccugaaagaucuuggaauaguggauacgaguggauaacagauuucccuggaaaaacugucugguuugucccuucaauaaagucaggaaacgacauugcgaauugccuucguaaaaacggcaaaagagugauucaacugucuagaaaaaccuucgacacugaauaucagaaaaccaaaaauaacgauugggacuacguagucaccacugacauaucagaaaugggcgcaaauuuuagggcagaucguguaaucgacccacgccgauguuugaaaccuguaauacuaaaggauggacccgagagaguaaucuuggcagguccuaugccgguaacaguagcgucugcggcgcaaagaagggguagaauaggccgaaaucauaacaaagagggggaucaguauauauauaugggccaacccuugaauaacgaugaagaucacgcacauuggacagaagcgaaaauguuguuggauaacauaaauacaccagaagggauuauucccgcauuauuugaacccgaaagagagaaaagcgcagcuguagauggagaauaucgacuacgaggugaagcaaggaaaacuuuuguagaauuaaugcgaagaggggaccuaccaguuuggcuaagcuauaaaguugccuccgaagguuuccaauacagugaucggcguuggugcuuugacggugaaagaaacaaucagguuuuagaagaaaauauggauguagaaauauggacaaaagagggagagaggaagaaacuaagaccgagguggcuugacgcgagaacuuauucggacccacuugcuuuaagagaauuuaaggaguucgccgcagggcgaagaucagucagcggugacuugauacuggagauagguaaauugccgcaacaucucacccagcgugcucaaaaugcgcuggacaauuugguuaugcuucacaauuccgaacaaggggguagagcauaccggcacgccauggaggagcuacccgauacuauagaaacauuaauguuacuggccuuaauagcaguuuuaacuggaggcguuacauuguucuucuuaagcggucggggucuaggaaaaacaaguauaggccugcuuugugucauggccucaagcguguuauuguggauggcaaguguagaaccacauuggaucgccgcgucaauuauauuagaguucuuucuuaugguauuauugauaccagaaccagauaggcaacgaacaccgcaggauaaucaauuagcuuauguagucauagggcuucuauucaugaucuuaacaguggcagcuaacgaaaugggauugcuugaaacaacuaagaaagauuuagguauaggacauguagcgguagaaaaucaccaucacgccgcaaugcuugauguagauuuacacccagcaagugcguggacgcuauacgcuguggccaccacuaucauaacaccgaugaugaggcauaccauagagaauacaaccgcuaauaucuccuugacggcaauagcaaaccaggcagccauuuuaaugggacuugauaaaggguggccaauauccaagauggauaucggagugccccuacuagcgcuggguuguuauucgcaagugaacccuuuaaccuuaacggcagcaguccugauguuaguagcucacuacgcaaucauagguccaggauuacaagccaaagcaacgagggaggcgcagaaaagaacugccgccggcauaaugaaaaacccuacaguagacggaaucguagcaauugaucuggaccccguuguauacgaugcuaaauuugagaaacaauuggggcaaaucauguuacuuauauuauguacaagucaaauacuauuaaugcgaacuacuugggcuuuaugugaaucaauuacuuuggcuacuggaccuuuaacaacguugugggaaggguccccuggcaaauuuuggaauacgacgauugcagugucuauggcaaacauauuucggggauccuaucuggccggggcgggacuugcauuuagccuaaugaagagucucggcggcggacgucguggaacaggagcacaaggggaaacuuuaggugaaaaauggaaaaggcaguuaaaucaacuuaguaaaagcgaauuuaacacauacaagagauccggcauaauggagguugacagaucagaagcaaaagaaggcuuaaaaagaggggaaacaaccaagcacgcgguuucaagaggaacugcaaaacuucgaugguuuguggaacguaaucuagucaaaccugaggguaaagugauugaucuaggaugcggccgagggggcuggucguauuauugugcaggcuuaaagaaaguaacagaaguuaaaggcuauacuaaaggagguccaggacacgaagaaccaauaccaauggcgacauacggauggaaccuaguaaaauuacacucaggaaaagaugucuucuucauuccaccagaaaagugcgauacacuauugugcgauauaggggagaguagcccuaauccuacaauugaagagggucguacauuacgaguccugaaaaugguggaacccuggcuacgcggaaaucaguucugcauaaaaauacugaauccauacaugccaucaguagucgagacccuugaacaaaugcagagaaagcaugggggaaugcucguaagaaauccuuuaagccgaaauucaacucaugagauguauuggguaaguugcggaaccggaaacauaguaagcgccgucaacaugacaucccggauguuauuaaaccgguucaccauggcgcacagaaaaccaacuuacgaacgggaugucgauuuagguaccgggacucgacacguagcuguagaaccugaaguugccaaccucgacauaauuggccaacguauugaaaauauaaaacacgaacauaaaucaacuuggcauuaugaugaagauaauccauauaaaacuugggcguaccacgguagcuacgaagugaagccuuccggaucagcaucaucuaugguaaacggagucgucaaguugcucacuaaaccaugggacgugauaccaaugguuacucaaaucgccaugacagacaccacuccguuuggucaacaacgaguuuucaaagaaaagguugauacucgaacacccaaagcaaaacgcggaacagcucaaaucauggaagucacugccagauggcuguggggauuucuuagcaggaacaagaaaccuagaauauguacaagagaagaguuuacaagaaaaguaaggucuaacgcugcgauaggggccguuuuugucgacgagaaccaauggaacucugcgaaagaagcuguagaggaugaaagauuuugggaucuaguacauagagagcgggagcugcauaaacaggggaaaugugcaacauguguuuacaacaugaugggaaaacgagagaagaaauuaggagaauuuggcaaagcaaaaggaucaagagcuauaugguauaugugguuaggagcuagauuucuggaauuugaggcccuaggcuucaugaaugaggaucacugguuuaguagggaaaauucuuugucuggcguagaaggagagggauuacauaaauuaggauacauucuacgagauauuucgaagauacccgggggaaacauguacgcugacgacacagcaggaugggacacgcguauuacagaagacgauuuacaaaaugaggccaaaauuacugacauaauggagcccgaacaugcucuauuggcuaaggcuauuuucaaguuaacuuaccaaaauaagguaguucgaguucaaagaccagccaaaaauggaacggucauggaugucauuucaaggcgugaccagagggguucggggcaaguagguacuuacggauuaaauacauucacaaacauggaagcacaauuaauccgacaaauggagagcgaaggaauuuucagucccucggagcuagaaacgccuaacuuagcugaacgggcauuggauuggcuagaaaaauauggcguggagaggcugaaaagaauggcaauauccggggaugauuguguugugaaaccaauagaugauagguucgccacagcuuugaccgcccugaaugauauggggaaggugcgcaaggauauaccccagugggaaccaucaaaagguuggaacgauuggcaacaagugccauucugcagucaccacuuucaccaacuaauaaugaaagauggaagagagauaguuguuccgugccggaaucaagaugagcuaguaggaagggcacgaguaucgcaaggcgcuggauggucauugagagagacagcauguuugggaaagagcuacgcccaaauguggcaacuuauguacuuccauagaagagaccuacgucucgcagcaaaugcaauauguagugcugugccgguggacugggucccuacaagucgaacaacauggaguauucacgcccaccaucaguggaugacuacagaagacaugcucucaguauggaaucguguuuggauagaagaaaauccguggauggaagacaaaacgcacaucaguucuugggaagaugugccauacuuggggaaacgggaggaucaauggugugguagucuuaucggacuaacagcucgcgcaacaugggcaacaaauauucagguagccauaaaccaggugcgacgguuaauugggaaugaaaacuaccuagacuauaugacaucaaugaaaagauuuaagaacgaaucugaucccgaaggggcguugugguaa

SEQ ID NO: 21761 - RNA, 9879 nt, Artificial Sequence
  derived and/or modified CDS sequence (opt6) from DENV-1__FJ898419__SS-prME
aguguaacaaugcuacugauguuaaugccaacagcacucgcauuucacuugacgacacgugggggagaaccucauaugauuguuucuaaacaagagagagggaaaucauugcuauuuaaaacaagcgcuggagugaacaugugcacacuaauagcuauggaucuaggagaauuuugcgaagacacaaugacuuacaaauguccuagaauaacagaagcugaaccggacgacguagauugcugguguaaugcaacagacacuuggguuacuuauggaacauguagucaaacuggagaacaucguagagacaaacgaucaguagcuuuagcaccacauguagguuugggacuggaaacgagaacagaaaccuggaugucaucagaaggggcauggaaacagauacaaaggguugaaacuugggcacuucgucauccuggauucacagugauugcuuuguuccuagcacacgcgauagguacaucgauaacacaaaaggguauaauauuuauuuugcuaaugcuaguuacaccaucuauggccaugagauguguuggaauagggucgcgcgacuuuguggaggguuugaguggagcaacuugggucgauguaguacuagaacauggaucuuguguaacuacuauggcaaaagauaaaccaacccuugauauagaauuauuaaaaaccgaaguaacaaacccagcgguacuucgaaaacugugcauagaagccaaaauuaguaauaccacgacugacucaagauguccuacgcaaggugaagcaacuuuaguugaagaacaggacgcaaacuuugugugucgacggacauucguagaucgaggcugggggaauggcugcggacucuuugguaaagguucucuuauaacgugugcgaaauucaaauguguaacuaaauuagaggguaaaauuguccaauacgaaaauuugaaauauaguguaauagucacuguacacacaggagaucaacaccaaguaggaaacgaaucaacagaacauggaacaacagcaacuauaaccccucaagcuccaucaacagaaauucaauuaacugacuauggggcgcuaacucuggacuguaguccaagaaccggauuagacuucaacgagaugguucuucuaacuaugaaagaaaaauccuggcuuguucacaaacaaugguuucuugaccuuccacuccccuggacaucaggcgcaucaaccagccaggaaaccuggaaccgaaaagauuuacuuguaacguucaaaacagcgcacgcuaagaaacaggaagucgucguauugggaucacaggaaggggccaugcacacagcuuuaacuggagccacagagauacaaacauccggaacaacuacgauauuugcaggacaccuaaaaugcagacucaaaauggacaaguugacacuaaaaggaaugagcuaugucauguguaccgguaguuuuaaacuggaaaaggaaguagcugaaacacaacacggaaccguucuaguccaaauuaaauaugaaggaacagacgcacccuguaaaauaccauuuucuacgcaagaugaaaaaggaguaacucagaacggccgccugauuacggccaacccaauagucacagacaaagaaaagccaguaaauauugaggcagaaccgccuuuuggagaaagcuacauagugaucggagcuggggaaaaagccuugaagcugucuugguucaagaaagggaguaguauuggcaaaauguuugaggcgacugcccguggagcacguaggauggcgaucuugggcgacacggcuugggauuucgguucgaucggagguguauucacaaguguagggaaauuagugcaccagauauuugguacagcauaugggguuuuauucucgggagucucguggacaaugaaaauaggaauaggaguacuauugacaugguugggcuuaaacaguaggucuacuuccuuaagcaugacguguauagcgguuggauuagugacguuauaucuuggugucauggugcaagccgauaguggaugcgucaucaacuggaaaggucgagaacuaaaaugcggaagcggaaucuucguaacuaaugaaguacauaccuggaccgaacaguacaaauuccaagcugauuccccuaaaagauuauccgcugccaucggaaaagcaugggaagaagguguauguggaauaagaucagcaacacgucuagagaauauuauguggaaacaaauuuccaaugaguuaaaucauauacugcuagagaaugauaugaaauucacagugguaguaggagacguagcaggcauccucgcucagggcaagaaaaugauccgcccucaaccgauggaauauaaauauagcuggaaaucaugggguaaagcuaaaauaauuggcgcagauguucaaaauacuacuuucauaauugaugguccaaacacgccugaaugcccagaugaucagcgagcuuggaauauuugggaagucgaagacuacggguuuggaaucuuuacgacuaauaucuggcuaaaauuacgggauaguuauacucaaguuugugaccaccggcuaaugagcgcagccauaaaggauaguaaagcagugcacgcagauaugggcuacuggauagagagugaaaagaacgagaccuggaaacuugcacgagccucauuuauagaaguaaaaacaugcauauggcccaagucucacacacuauggagcaacggaguauuggaaucagaaaugauaauccccaaaaucuacggagggcccauaucacagcauaacuauagaccuggcuacuuuacacaaacagccggcccuuggcaccucggcaaauuagaacuugauuuugaccucugcgaagggacuacaguagugguugaugaacauugcggaaacagaggaccuucauuaagaacuacaaccguuacaggaaagauaauacacgagugguguuguagaucuuguacacuaccgccacuaagauucaaaggugaagaugguuguugguacggaauggagauuagaccugucaaagaaaaagaagaaaaucuaguuaaaucaauggucucugcagguucaggagaaguggacuccuuuuccuuaggucuacuuugcauaaguauuaugauugaagaagugaugagaagucgauggucacgcaagauguuaaugacaggaacacuagcagucuucuuucuucucauaaugggccaauugaccuggaacgacuugaucagacuaugcauuaugguuggugcuaaugcaucugaucgaaugggcauggguaccacauaccuagcacugauggccaccuuuaaaaugagaccuauguucgcggucggccuguuguuccgucgauugacuucacgagaaguuuuauuguuaacuauuggccucucuuugguagcuagugucgagcuaccaaauagccuagaagaacuaggagauggauuagcaauggguauaaugauucuaaaauugcucacagauuuccaaucucaccaauugugggcuacguuacuaucauuaacauucauaaaaacaacguuuagucuacauuaugcauggaaaacuauggcuaugguacuuaguaucguaucccuuuuuccuuuaugucuuucgacaacuagccagaagacuacauggcucccaguacuguuaggcagcuuaggauguaaaccacuuacaauguucuuaauagcagaaaacaagauuugggggcgaaaguccuggcccuuaaacgaagguaucauggcaguagggauuguuucaauucugcugucagcacuucucaaaaaugacgucccacuugcgggcccccuuauugccggcgggauguuaauugcguguuaugucauaaguggaucuuccgccgaucucucucuagagaaagcagcagaggucucaugggaagaagaagcagagcauucaggagccagucauaacauccuaguagaggugcaagacgaugggacgaugaaaauaaaagaugaagaacgugaugauacucuuacaauauuacugaaagcgacucuacuugcaguuagcgguguuuauccuuuaaguauaccugcuacauuauuugucugguacuucuggcaaaagaagaaacaacggucuggaguccuaugggauacaccgaguccgcccgaaguugagcgagcgguuuuagacgacggaauuuacagaauuaugcaaagaggccuauuaggaagaagucaaguaggcguaggaguauuucaagaaaauguauuccacacuauguggcauguaacacgaggagccguguugauguaucaaggaaaaagauuagaacccuccugggcgucaguaaagaaagaucugauaaguuauggagguggcuggagacuacaaggaagcuggaauaccggggaagaggugcagguaauagcuguugaaccggggaaaaaucccaaaaauguccagacggcccccggcacguucaagacaucagaaggcgaaguaggggcuauugccuuagauuuuaaaccagggacgucaggcagcccuauaguaaauagagaagguaaaauaguaggcuuauacggaaauggcguaguaacgacaucaggaacauacgugucagcaauagcacaagcaaaggcgucacaggaagggccuuuaccugaaauugaagacgaaguuuuuagaaaaagaaaccuaacaaucauggaucuacacccuggcucagguaagacccgucgauauuuaccagcuauuguuagggaggcaauuaagagaaagcuccgaacucuaauuuuagcuccgacaagaguaguagcuagugagauggcggaggcccugaaggguaugccuaucagauaucaaacaacugcugucaaauccgagcauacaggaaaagaaauuguugacuuaaugugucacgcaacauuuacaaugagacuucuuucgcccguucgaguaccaaacuacaauaugauuaucauggaugaggcacacuucacggacccgagcucaauagcagcaagaggcuauauaaguacaagaguuggaaugggcgaagcagccgcgaucuuuaugaccgcgacgccaccgggauccguggaggcuuucccacaaaguaacgccguuauccaggaugaagaacgagauauuccagaaagaucauggaauagcggguaugaauggauaacagauuucccgggaaagacagugugguuuguuccaaguauaaaguccggaaacgauauugcaaauugccuacguaaaaauggaaaacgugugauccaacuguccaggaagacguuugauacagaauaucagaaaacuaagaauaacgauugggauuacguaguuacaacagacauaucagaaaugggugcgaacuuucgagcagacagagugauagauccaaggagaugcuuaaaacccguuauacuaaaagauggaccggaacguguaauucuggcugggccuaugccaguuacaguagccucagcugcacagcgucgaggacgaaucgggcgaaaucacaauaaagaaggcgaucaauauauuuacaugggucaaccuuuaaauaacgacgaagaccacgcgcauuggacagaagcgaagaugcuauuagauaauauaaauacaccagagggaaucaucccagcgcuuuuugagccugaaagagaaaaaucggcagcuauugacggugaauauagacugcggggagaggcaagaaaaaccuuuguagagcuuaugaggagaggggaccuaccgguauggcugagcuauaaagucgcgucggaaggguuccaauacucugaccgcagauggugcuuugauggagaacguaacaaccagguauuagaagagaacauggauguggaaauuuggacuaaggaaggcgaaagaaagaaauugagacccagauggcuagacgcacgaacauacagugacccacuagcucuccgugaguuuaaggaguucgcagcugggcgaagaaguguuagcggagacuugauacucgaaauagguaaacuaccacaacauuuaacacagcgugcgcagaacgcgcuugauaauuuaguaaugcuccacaauagcgagcaaggaggacgagccuaccgacaugcuauggaagaguuaccagacacaauagaaacguuaaugcugcuagcauugauagcgguauuaacuggcgguuggacauuauucuuuuugucgggacguggguugggcaagaccuccaucggauuauugugcguaauggcaucaucugugcuacucuggauggcaagcgucgaaccccacuggauagcugccagcaucauauuggaguuuuucuuaaugguuuuguuaauaccggaaccagaucgacagagaacaccucaagacaaucaauuagccuauguaguaauaggauuauuauuuaugauucuuacaguagccgcaaacgagaugggauuauuagaaacaaccaagaaagacuuaggaauaggucauguugcagucgaaaaucaccaccaugccgcuauguuagacguggacuuacauccagcuagugcuuggacacuauaugcgguugcaacaacuauuauaacaccaaugaugagacacacuauagaaaauacaacagcaaacauaucacuaacagcaauagccaaccaagcagcaauacuaauggguuuagauaaaggguggccgauaucaaagauggauauagguguuccacucuuagccuuaggaugcuauucacagguuaauccuuuaacgcucacugcagcgguuuuaaugcugguagcccauuaugcgaucauaggaccuggccuacaagcuaaagcgacuagagaagcccaaaaacgaacugcggccgggauaaugaaaaaccccaccguugauggcauaguugcuauugaccucgauccaguaguauacgacgcaaaguucgagaaacaacuuggucagauuaugcuauugauacuguguacuucacaaauacuacugaugagaacaacaugggcauugugugagaguauaacauuagcaacagggccguuaacgacgcuaugggaagggucaccggguaaguucuggaauacaaccauugcgguaaguauggcaaacauauucaggggaaguuauuuagccggcgcaggacucgcauucucacuaaugaaaucacuagggggcgguagacgaggaacaggggcacagggcgagacgcuuggcgagaaauggaaaaggcaauuaaaucaacuaucuaagagugaauuuaacacuuacaagaggucaggcauaauggaggucgacaggucggaagcaaaagaaggucuuaagagaggugaaacgaccaaacacgccguaaguagagguacagcgaaguuacgcugguuuguagaaaggaacuuaguaaaaccagaaggcaaagucaucgaccugggauguggccgaggcggauggagcuauuacugugcugggcuuaagaaagucacggaagugaaaggauauacaaaaggaggaccaggacacgaagaacccauacccauggccacauauggguggaaccucgugaaacuacauucuggaaaagacgucuuuuucauaccuccagaaaaaugugauacucuucuaugugauauuggagaaucaucuccaaauccaacuauagaagaagguagaacacuucgaguacuaaagaugguugagccauggcuaagggguaaccaauuuugcauaaaaauuuuaaaucccuauaugccuucaguaguugagacauuggaacagaugcaacguaagcacgguggaauguugguaagaaacccuuugucuagaaauaguacgcacgaaauguauuggguuagcuguggaacuggaaauauagugagcgccguuaacaugacgucuagaaugcugcuaaaucgauucacaauggcacaucgcaagccuacauaugaaagagauguagaccuaggcgcuggaacacgacacguugcgguugaaccggagguagcaaaucuagacauaaucggccaaaggauagagaacauuaaacacgagcauaaaagcacuuggcacuaugaugaagauaauccauauaaaacaugggcguaucauggauccuacgaagucaaaccuagcgggucagcaucaaguaugguaaacgggguuguaaaacuacugaccaagccgugggauguaauuccgauggucacccaaaucgcgaugacagacacaacaccauuuggccaacaacgagucuucaaagaaaagguagauacgagaacgccuaaggccaaacgcggcacagcgcaaauaauggaaguaacagcgaaauggcuauggggauuuuugucgagaaacaaaaagccucgaauauguacacgggaggaauuuacacgcaaaguuaggucaaaugcagccauaggcgcagucuuuguagaugagaaccaguggaauagcgccaaagaagcuguagaggaugaaagauuuugggaccuuguacaucgggaacgagaacuccauaagcaagguaaaugugcaacuugugucuauaacaugauggguaagcgagagaagaaacuaggagaauuuggaaaagcaaaaggaucucgggcaauaugguauaugugguugggugcgagauucuuagaauuugaagcauuagguuucaugaaugaggaucauugguuuucgagggagaauagcuuaucggguguugaaggcgaaggccuacauaaacucgguuauauuuuacgcgacauuucuaaaauuccagggggaaauauguaugcagaugauacagcggguugggauacaaggauuaccgaagaugauuuacaaaacgaagccaagauaacugacaucauggagccagaacaugcccuuuuagcaaaaucuauauuuaaauuaacauaucaaaauaaaguaguacgaguccaaagaccugcuaagaacgggacggucauggacguuauuagcagaagagaccaaaggggguccggucaaguagguacauacggguuaaauacauuuacuaacauggaagcacaacuuauacgacagauggagagcgagggaauuuuuaguccgucagaacuggaaacaccgaacuuagcuggaagagucuuagacugguuggaaaaacaugguguugagagacuaaaacggauggccauaucaggagaugacuguguaguuaaaccuauagaugauagguuugcaacagcacuuacggcacuuaaugauauggggaaagucaggaaagauauaccacaaugggagccuucgaaggguuggaaugauuggcaacaagugccauucugcucacaucacuuccaucagcuaauaaugaaggauggacgggaaauagucgugcccugcagaaaucaagaugagcuaguaggccgagcaagagucucucagggugccggguggucacuuagagaaacagccugucuugguaaaucuuaugcgcagauguggcaauuaauguacuuccaccgucgagacuugcgucuugcagcaaacgccauuuguucagcaguuccuguagauuggguaccaacaucucgcaccacauggaguauucacgcucaucaccaauggaugaccacagaagauauguugucaguauggaaccgcguauggauugaggaaaaccccuggauggaagacaaaacccauaucuccucauggggagauguuccuuauuuagguaaacgcgaagaccaguggugugggagucuuauuggauuaacggcacgugcaacaugggcuaccaauauacaagucgccaucaaucagguaagacgccuuaucgguaaugagaauuaucuagauuauaugaccaguaugaaacgauucaagaacgaaucggacccagagggcgcgcuaugguag

SEQ ID NO: 21762 - RNA, 9879 nt, Artificial Sequence
  derived and/or modified CDS sequence (opt6) from DENV-1__FJ898420__SS-prME
aguguuacaauguuacuuauguuaaugccgaccgcccuagccuuccaucugacuacacggggaggagagccccacaugauaguuucaaaacaagagcgcggcaagucacuccuauuuaaaacuucagccggcgucaacaugugcacccucauagcaauggacuuaggagaguugugcgaagauacaaugacuuauaaauguccacgaaucacggaagcugaacccgacgacguugacugcuggugcaacgccacugauaccuggguaacauacggaacauguucacagacaggugaacacagacgagauaaacgcucaguagcguuagcaccccaugugggacuaggucuagagacgcggacagagaccuggaugucaucagaaggagccuggaaacaaauacaacggguagaaacuugggcgcuacgacacccagguuucacaguuaucgcacuguuuuuagcgcacgcgaucggaaccagcauaacucagaagggaauaauauuuaucuugcuaauguuagugacaccaaguauggcuaugaggugugugggcaucgguucacgagauuuuguugaagguuuaucaggugcgacauggguagacguagucuuagaacauggcuccuguguaacuacaauggcgaaagauaaacccacacuugauauugagcuacugaaaacugaaguaacgaauccugcgguuuuaagaaaauuaugcauagaagcaaaaauaucgaauaccacaacugacucaaggugcccaacucaaggcgaagcaacauuaguugaggagcaagacgcgaauuuugugugcagaagaacauuuguagauaggggcugggggaauggaugcggucuguucggaaagggaucgcucauuacaugugcgaaauuuaagugcgugacaaagcuugaagggaaaaucgugcaauacgagaaucuaaaauauucagugauagucaccguccacaccggugaucaacaccaaguagggaaugaaucgacugaacacggaacuacagcuaccauaacgccucaagcaccgacuacugaaauccaauuaacagacuauggugcacuaacauuagacugcucaccccgaacaggacucgauuucaaugaaaugguccucuuaacaaugaaggagaagucauggcuaguacacaaacaaugguuucuagacuugccauuaccauggacaaguggugcaucaacaucccaagaaaccuggaacagacaagacuuacuuguaacauuuaaaacagcucacgcaaagaaacaagaaguaguaguacugggaucgcaggaaggcgcaaugcauacggcccuaacgggggccacggaaauacagacaucuggcacuaccacuauuuuugcgggucaucucaaauguaggcuuaaaauggauaaacuuacuuugaaagggauguccuauguaaugugcacuggaaguuucaaacuagaaaaagaagucgcagaaacccaacacggcaccguucuaguccaaauaaaauacgagggcacagacgcgccuugcaaaauuccguuuucaacccaagaugaaaaaggcgugacacaaaaugguagacuuaucacggcgaauccaauagucacagacaaagaaaagcccgugaauauugaagcugaaccgccguuuggagaaaguuacaucguaauuggggcgggugaaaaagcuuugaaacuuucaugguuuaaaaagggcuccucaaucgguaagauguuugaagccacugcacgcggugcgaggagaauggcgauauuaggagacacagccugggacuuuggaaguauaggaggcgucuucacuagcgugggaaagcuaguacaucagauauucggaaccgcauauggcguccuguuuuccggagucagcuggacaaugaaaauuggaauaggugucuuauuaacaugguuaggauugaauucgaggucgacuuccuugaguaugacuuguauagcugucggucuaguaacucuauaucuuggagcgaugguacaagcggauucgggaugcguuauuaacuggaaaggccgagaacuaaaaugcggauccgguauuuuuguaacaaaugagguccacacauggacugaacaauacaaauuccaggcagacucacccaaaagauuaucagcagcaauagguaaagcaugggaagagggaguuugcggaauuagaucagcaacgaggcuggaaaacauaauguggaaacaaauuagcaaugaauugaaucauauacuacuagaaaaugacaugaaacucacaguaguugucggcgauguugcagguauacuaggacaaggaaaaaagaugaucagaccucagccuauggaauauaaauauagcuggaaaucauggggaaaagccaagauaauaggugcagaugcacagaacaccacguucauuauagacggcccaaauacuccagaauguccugaugaccaaagggcguggaacauaugggaaguggaagauuacggguuugggauauucacaacgaauauuugguugaaauuacgugauagcuauacacaaguaugugaucaucgcuugaugagcgccgcgaucaaagacaguaaagccgugcaugccgauaugggauauuggauagagagcgaaaagaacgaaacguggaagcucgcuagagcaucauucauugaagucaaaacauguauauggcccaaaagucacacucuuuggagcaauggcguuuuagagucugagaugauuauuccuaaaaucuacggaggucccaucagucaacacaacuacagaccugguuacuuuacacaaacugcggguccuuggcaucuggguagauuagaacuggauuucgauuuaugugaaggaacaacuguaguaguggacgaacauugcggcaaccguggacccuccuuaagaacuacgaccgucaccgguaagaucauccaugaauggugcugucggucuuguacgcucccucccuuaagguuccggggggaagacgguugcugguacgggauggaaauacggccaguaaaagaaaaagaagagaauuuagugaaaaguauggucagugcagggaguggagaaguagauaguuucuccuuaggucuacucuguaucagcauaaugauugaagaaguaaugagaagucguuggucacgaaaaaugcugaugacaggcacccuugcuguauuuuuccuccuaauaaugggacaacuaacauggaaugacuugauaagacuguguaucaugguaggagcaaacgcaagcgaucgcauggguaugggaacaacguauuuggcccuaauggcuacauucaaaaugcguccaauguucgcugugggauuacuuuucagaagacuaacgucaagagaagucuuauuacuuacuauuggauugagccuuguagcuucuguugaacuuccgaauaguuuagaggaacugggugauggacucgcaaugggcauaaugauacuuaagcuucuaacggauuuccagucacaucaguugugggccacccuucuuagucuaacuuuuauaaaaacaacauuuucacuacacuacgcauggaaaacaauggcaaugguguuauccauaguaucguuguucccccucuguuugucuacuacuagucagaaaacaaccuggcugccagucuuauuagguucacuagguugcaaaccacugaccauguuuuuaaucgcagaaaauaagauauggggaagaaaaagcuggccgcuuaaugaaggaauuauggcagucggaauuguuaguauauuacugucgucauuauuaaaaaaugaugucccuuuagcaggcccauuaaucgcuggggguauguuaauagcaugcuauguuauuaguggaucauccgcagaccuuucacuagaaaaagcugccgaagugaguugggaagaagaagcugaacauucaggugccagucauaauauucugguagaaguucaagaugaugggacuaugaaaauaaaagacgaagaaagagacgauacacugacuauacuguuaaaagcuacucuccuagcaguaucaggcguauacccacugaguauaccggcaacucucuuuguuugguauuucuggcaaaagaaaaaacaacguucuggaguauuaugggauacaccaagucccccagaagucgaaagagccguauuagacgaugguauauaucggauaaugcaacguggcuuauuagguaggucacaagugggaguagguguauuucaagagaacguauuucacacgauguggcauguuacaaggggagcaguuuuaauguaucaaggaaagagacuugaacccaguugggcaucaguaaaaaaagaucuaauuucauauggaggagguuggcgacuucgaggaaguuggaauacaggagaagagguucaaguuauagcuguagaaccuggcaagaauccaaaaaauguacaaacagcgcccgguacuuucaagacaccagaaggcgaaguaggggcaaucgcucucgauuucaaaccaggaacgucugggaguccaauugugaaucgcgaaggaaaaaucguugggcuauaugguaaugguguuguaacaacaaguggcacauauguaagugcaauagcccaggcaaaagcuucacaggagggaccacuuccagaaauagaggacgaaguuuucagaaaacgaaaccuaacaauaauggaccuucauccugggaguggaaaaacacguagguaucuuccggcaauaguacgggaagcgaucaaaagaaaacuucgaaccuuaauacuagcacccacccgggucguagccagcgaaauggcugaggcuuugaaaggcaugccuauccgcuaucaaacaaccgcgguuaaaagugagcauacgggcaaggaaauaguugacuuaaugugccacgcgacauuuacaaugagacuacuuucaccagucagaguccccaauuauaauaugauaaucauggaugaggcacacuuuacagauccgucuuccauagcagcaagaggauauauaaguacuagggugggaaugggagaagcugcagcuauauuuaugacggcaaccccaccaggcuccguagaagcuuuuccacagucuaaugcaguaauccaggacgaagaacgggacauaccugaaaggucuuggaacuccggcuaugaauggauuacagacuuuccugggaaaacagugugguucguacccaguauaaagagugguaaugauauugcuaauuguuuacgcaaaaauggcaagcguguaauccagcuaaguaggaaaacauuugauacagaauaccaaaaaacgaaaaacaacgauugggacuauguaguuacuacagauauaagugaaaugggggcaaacuuucgcgcugaucgagucaucgacccuaggcgaugucugaaaccggucauauuaaaagauggacccgaaagagugauauuagccggaccaaugccuguaaccguagcaucugcggcucagcgccgagggcgaauaggaagaaaucacaauaaagaaggugaucaauacaucuauaugggacagccccuuaacaacgaugaggaucacgcacauuggacugaggcaaaaaugcuuuuagacaauaucaacacgccagaagggauaaucccagcacuuuuugaacccgagcgggaaaaaucugcagcuguagauggggaauacagacuaagaggagaagcacgaaagacauuugucgagcuuaugcggaggggagaucuuccagugugguuaagcuauaaaguggcgucggaggguuuccaauacucagacagaagaugguguuucgauggcgaaagaaauaaccaaguacuugaagagaacauggauguggagauauggaccaaggaaggugagagaaaaaagcucagacccagaugguuagaugcuagaaccuauucugaucccuuggcuuuaagagaauuuaaggaauuugccgcggggcgcagaucaguaagcggugaccugauacuagaaaucggaaaacucccacaacaucuaacacaacgcgcacagaaugcccuagauaauuuaguuaugcuacacaauagugaacaaggcggucgggcguaucgccacgcuauggaggaauugccugauacaaucgaaacucuuaugcuacuggcauuaauagcaguauugacugggggaguuacgcuguuuuuccuaucuggucgaggucuaggcaaaacaucgauuggacugcuaugcguuauggcauccagcguacuucuauggauggccucaguugaaccccauuggauagcugcgagcaucauacuugaguuuuuccucaugguacuuuuaauuccggaaccugaccgacaacguacuccgcaagauaaccagcuggcguauguagucauuggcuuacuuuucaugauucuuacagucgcagcaaaugaaaugggacuuuuagaaacuacgaaaaaagaucuaggaauaggccacguugccguagaaaaucaucaccaugcagcaaugcucgauguugauuugcauccugcaucugcauggacacuauacgcaguugcuacuacaauuauuacgcccaugaugagacauacaauagaaaacacaacugcaaacauaucauuaaccgcuauagccaaucaagcagccauacuaauggguuuggacaaagguuggcccaucucgaagauggacauugggguuccacugcuagcacucggcuguuacagccaaguuaacccccucacgcuuacagccgcuguucuaauguuagucgcacacuacgcgaucauugggccaggauuacaagcaaaagcaacacgugaagcccagaagagaacggccgcaggaauaaugaaaaacccuacaguagaugguaucguagccaucgaccuagauccagucguuuaugaugcgaaauucgagaagcaacuaggacaaauuauguuauuaauccucugcacuagccagauccuuuuaaugcgaacuacgugggcguuaugugaaaguauaacuuuagcaacaggaccauuaacaacccugugggaaggcaguccaggaaaauucuggaacacuacaaucgcgguuuccauggcaaauauauuucgagggucauaucuagcuggagcgggucucgcuuucagcuuaaugaaaucucuugggggugguagaagagggacaggugcccaaggggagacucucggagaaaaauggaaacgucaguuaaaucaauugucaaagucagaauuuaauacguacaagagaaguggaauaauggagguggaccgaagcgaggcgaaagaaggacuaaaacguggggaaacgacgaaacaugcuguuaguagaggaacggcuaaauuaagaugguucguggaacgaaaccuaguuaagccagagggcaaaguaauagaccucggauguggucggggaggauggucauauuacugugcgggacuaaagaaaguuacagagguaaaagguuauacaaaaggaggaccuggucaugaagaaccaauuccuauggcaacauauggcuggaacuuaguaaaacuccauaguggaaaggacguauucuuuaucccacccgaaaaaugugauacccuacugugcgauauuggggaguccucgcccaauccgacuauagaagaaggccgaaccuugcguguucuaaagaugguagagcccuggcuucguggcaaucaauuuugcauaaaaauacuaaauccuuacaugccuucgguuguggaaacacuugaacaaaugcagcgcaaacacggaggaaugcucguucgaaauccucuaaguagaaauagcacgcaugaaauguauuggguaucuugcggcacaggaaacauagugagcgcuguuaauaugacuucccgaauguuguuaaauagauucaccauggcgcauaggaaaccuaccuaugaacgggacguggaucuaggaaccggcacaaggcacgucgcaguugaaccagaggucgccaauuuagauauaauaggacagcggauugagaacauaaaacacgagcauaaaucuaccuggcauuacgacgaagauaauccuuauaaaacaugggcguaucaugguucuuaugaggucaaacccucugguucagcaucuucaaugguaaacggaguaguaaaauuacuaacaaagccgugggacguuauuccaaugguaacacaaauugcaaugacggauacuacuccguuuggacaacagcgaguauucaaggagaaaguagauaccagaaccccuaaagcaaagcguggcacugcacagauuauggaaguuacagcacgcuggcuauggggguuuuugucaaggaacaaaaaaccccgaauuuguacgagagaggaauucacaagaaaagugcggagcaacgcagcgauaggagccguguuugucgaugaaaaccaguggaacucagccaaagaagccguugaagaugaacgauuuugggaucucguucauagggagcgagaacuccauaagcaagggaaaugugcuacguguguauacaauaugaugggcaaaagagagaaaaaauuaggugaauuuggaaaagcaaaaggauccagagccaucugguacaugugguugggugcaagguuccuggaauuugaggcuuuaggauucaugaaugaagaucacugguucucaagggagaauucacuaucaggugucgaaggagaggguuuacacaaauuaggguauauacuacgagauauuaguaaaauaccagggggaaauauguaugcagacgacacggccgguugggauacgagaauaaccgaagaugauuuacaaaaugaggcaaagauaacagauauuauggaaccagaacaugccuuguuagcaaaggcaaucuuuaaauugaccuaucaaaauaaaguaguaagaguucagcguccggcaaagaaugguaccguaauggauguuauaucaagaagagaucaaaggggcucggggcaagucggaacuuacggguuaaauacauucaccaacauggaagcacaacugauaaggcaaauggagagugaaggaaucuucucaccuagugaacuggagacucccaaccuagcggagagggcgcuggauuggcuagaaaaauacggaguagaacguuugaagagaauggcaauuaguggagaugauuguguagucaaaccaaucgaugacagguuugcaacugcccugacggcccucaacgauauggguaaagugaggaaagacauaccacaaugggagccauccaaaggcuggaacgacuggcagcaggucccguuuugcagccaccacuuccaucaacuaauaaugaaagacggaagagaaaucguuguuccaugucgaaaucaagaugagcucguuggaagggcaagagugucgcaaggagcagguuggagucuuagagaaaccgcguguuugggaaaaucguacgcacaaauguggcaauuaauguauuuccauaaacgcgacuuacgacuugccgccaaugcaaucuguucggcaguccccguggauugggugcccacuucaagaacaacuuggucuauacaugcacaucaucaauggaugaccacggaagacaugcucucuguuuggaaucgaguuuggauugaagaaaacccuuggauggaggauaaaacccacauuucuagcugggaagaugugccguacuuaggaaagagagaagaccaauggugcggaucacuuauagguuuaacggcaagagcuacuugggcaacgaacauucaaguggcgauaaaccagguaaggagauuaauagguaaugaaaacuacuuagacuauaugacgagcaugaaacgauuuaaaaacgaaucagacccagaaggggcacucugguaa

SEQ ID NO: 21763 - RNA, 9879 nt, Artificial Sequence
  derived and/or modified CDS sequence (opt6) from DENV-1__FJ898421__SS-prME
ucaguaacaaugcugcugaugcuuaugccuacagcacuagcauuccacuuaaccacacgugggggagaaccucacaugauagugucuaaacaagaaagaggaaagagcuuacuguucaaaacaucagcaggggucaauauguguacccuuauugcuauggaccugggagaacuaugugaagauaccaugacguacaaauguccgagaauaacugaagcagaaccagaugacguagauugcugguguaacgcaaccgauacauggguaacuuacggaacguguucgcagacaggagaacaucgacgagacaaacguaguguugcuuuggcaccacacgugggcuuggguuuagaaacacguacagaaacauggaugucaucagaaggcgcauggaaacaaauacaaagagucgaaacuugggcauuaaggcauccaggguuuacaguaauagcucuuuuucuagcacaugcaauaggaacaucaauuacacaaaaaggaauuauauucauauuacuaaugcuuguaacacccucaauggcuaugcgaugcguugggauagguagccgggacuuuguggaaggucuaaguggcgcaacguggguagauguuguacuggaacacgggucaugugugacgaccauggcaaaagauaaaccaaccuuagacauugaacuauugaaaacagaaguaacgaacccugcugugcucagaaagcugugcauugaagcuaaaauuagcaauacgacaacugacagucgguguccaacacaaggugaagcaacauuaguugaagaacaagaugcaaacuuuguauguaggcguacauuugucgauaggggcuggggaaacgguugugguuuauuuggaaaagguuccuugauuacgugugcaaaauucaaaugugucacaaagcuagaaggaaagauagugcaauaugaaaauuuaaaauauucuguaaucgugacaguucauacuggugaccaacaccaaguaggaaaugaaucgacagaacaugguacuacagcgaccauaacuccacaagcaccgacuacggaaauacaacuaacugacuauggagcacucacauuagauuguucuccuaggacuggccuagauuuuaacgaaaugguucucuugacaaugaaagaaaaaucaugguuaguccacaaacaaugguuccuugaccuaccacuaccauggacaucaggcgcuucgacaucccaggaaacauggaauagacaggaccuccuagugacauuuaaaacggcccacgccaagaaacaagaaguagugguguuagggagccaggaaggugccaugcauacagcucuuacuggcgcaacggaaauacaaacaaguggaacaacaacaauuuuugcgggacaccuaaaauguagguuaaaaauggacaaauugacucuaaaagggaugucauacgugauguguaccgggucauucaaacuagaaaaagagguagccgagacacagcacgggacagucuugguucaaauaaaguaugagggcacagaugcacccuguaaaauaccauuuucgacgcaggaugaaaaggggguaacucaaaauggaaggcugauuacggccaauccgauaguuacggauaaagaaaaaccugucaauauagaagcggaaccaccauuuggagaauccuacauaguaauaggcgcuggagaaaaagccuuaaaacugucaugguuuaagaaaggcucauccauaggcaagauguuugaagcgacagcccgcggugcgagacgaauggcgauuuuaggagacacugcgugggacuuuggcucaauaggaggaguauuuacaucaguaggaaagcugguccaccagauauuuggcacagccuacggugucuuauucucggguguuucuuggacgaugaagauagguauugguguauugcuaacaugguuaggauuaaacagcagaucuacaagucugaguaugacuuguauugcaguaggauuggugacacuuuauuuaggaguaaugguucaagcagauucaggcugcguaauaaacuggaaaggucgggaauuaaaauguggaagcggaauauuugugacaaacgaaguacacacauggaccgaacaauacaaauuucaggcggauucacccaaaagauugucagcagcuauagguaaggccugggaagaaggaguuugcggaauacggagugcgacccgauuagagaauaucauguggaaacagauaagcaacgaguuaaaccauauccuguuagagaaugacaugaaacugacuguagucgucggagaugucgcaggaauacuaggccaagguaagaaaaugauacgaccucaaccaauggaguauaaauacagcuggaagucauggggaaaagcgaagauaaucggagccgaugcucagaauacaaccuuuauaauagacggcccaaacacgcccgaauguccagaugaucaacgcgcauggaacauuugggaaguggaagacuauggauuuggaauauucaccacaaauauuuggcucaagcuaagagauucuuacacccaggucugcgaucacagauuaaugagcgccgcaauuaaagauucaaaggccgugcaugcggauaugggcuauuggauagaaagcgagaaaaaugaaacauggaagcuagcuagagccagcuuuauagaagucaaaacuuguauauggccgaaaagccauacccuaugguccaacggaguucuugaaucagaaaugauaauuccaaaaauauauggaggcccuauaucucaacauaauuauaggccaggcuacuuuacccaaacugcggggcccuggcaccuagggaaacuagagcucgauuuugacuuaugugaaggaacaacagucgucguggaugaacauugcggaaaucguggaccaucuuuaagaaccaccacaguaacaggcaaaauaauacacgaauggugcugucgauccuguacauuaccuccuuugagauuuagaggcgaagauggcuguugguauggaauggaaauacgaccugugaaagaaaaagaagaaaauuuaguaaaguccaugguaucugcgggaucaggugaaguagauagcuucucuuuaggacuucucaguauauccaucaugauagaagagguaaugagaucuagguggagccguaagaugcuaaugacugggacacuugcuguuuucuuucuucugauuaugggucaauuaacguggaacgauuuaauacgacuuugcauaauggucggagcaaacgcuucagaucgaauggggauggguacgacauaucucgcccuaauggcaaccuuuaaaaugagaccaauguucgcugucggccuacuuuuuagaagguugacaagucgagaaguauuauuauuaacuaucggguuaucacucguggcgucaguugaacuuccaaacagucucgaagaauugggagauggauuagcaaugggaaucaugauccucaaacuguugacagauuuccaaucccaccaacuaugggcaacacuauugaguuuaacuuuuauaaaaacuacguuuucgcuacacuaugcuuggaaaacaauggcuaugguauuaagcauaguaucccuauucccucucugucuaucaaccaccagccagaaaacuacauggcucccaguacucuuagguagucuugguuguaaaccauuaacgauguuucuaauagcagaaaauaaaaucugggggagaaaaagcuggccauuaaacgaagguauuauggccguagggaucguaucaauacuguuaucuagucugcuuaaaaacgacgucccguuggcugggccacucauugcggguggaauguuaaucgcauguuauguuauuuccgggagcagcgcagaucuaucauuagaaaaagcagcugaagucuccugggaagaagaggcugaacacaguggugcuucccauaauauuuugguagaaguucaagaugacggcacgaugaaaaucaaagacgaggaaagggaugauacucucaccauauuacucaaggcaacccucuuagcggucagcggaguuuacccccuaaguauucccgcuacguuguucguuugguacuuuuggcagaagaagaaacagcgcagugguguucuaugggacaccccaagcccuccagaaguagaacgugcaguacuagaugauggaauuuauagaauaaugcaaagaggguuacucggccgcagucaaguaggagucggcguauuucaagaaaaugucuuucacacuauguggcauguaacuagaggugcuguuuuaauguaccaagggaaacgccuagagccuucaugggcuaguguuaagaaagaucuaauaucauacgguggcggauggagacuuagaggaucauggaauacaggcgaagaggugcaagucaucgccguagaaccuggcaaaaaucccaaaaauguacaaaccgccccagggacauuuaaaacaccagaaggugaagucggagcgauagcuuuagauuucaaaccagguacauccggaucccccauagucaaccgagaaggcaagaucguaggauuguaugguaaugguguuguuaccacaagcgggaccuaugugagugcuauagcucaagccaaagcuagccaagaaggcccuuuaccggagauagaagacgaaguguuuagaaaaaggaauuugacaauaauggaccuucauccgggguccggcaagacuagaagauaucuaccugcaauagucagagaggcgauaaaacgcaaacuccgaacauugauucuagccccuacaagaguaguagccagcgaaauggcugaagcgcucaaaggaaugcccauuagauaucaaacaaccgcagugaagucggaacacacuggaaaagagauaguggauuuaaugugucacgcaacauucaccaugagauuacuaagcccaguaagaguacccaacuacaauaugaucauaauggaugaagcucauuucaccgauccaaguucuauagcagcgcgaggauacaucucuaccagaguaggaaugggagaagcugccgcuauuuuuaugacugcuacaccucccgggucgguagaagcauuuccgcaauccaaugcagugauacaggaugaagaaagagacauaccagaacggagcuggaauagcggcuacgaauggaucacugacuucccagguaaaacaguaugguuuguuccgucuauuaaaucgggaaacgauauugccaauuguuuaaggaaaaauggaaaacgaguaauacaauuaucacgaaagacauuugacacagaguaucagaagacaaagaacaacgacugggauuaugucguuacuacagauauuuccgaaaugggggcaaacuuuagagcagauagagugauugacccuagaaggugcuugaagccagucauacugaaagacggaccugaaagagucauacucgcaggaccaaugccaguaaccguugcaagugcagcacaaagaagaggccgcauaggaagaaaccacaauaaagaaggcgaucaauacauuuauaugggucagccuuugaauaaugacgaagaucacgcacauuggaccgaggccaagaugcuuuuagacaacaucaauacaccagaaggaauaauaccagcauuauucgaaccugaacgagagaaaagcgccgcaguugacggagaauauagauuacggggagaggcaagaaaaacauucguugaguuaaugagacgaggugacuugccaguguggcuauccuacaagguggccagcgaaggauuucaauauucugacagacgcugguguuuugacggcgaaagaaauaaucaaguauuagaagaaaauauggacgucgagauauggacaaaggaaggcgaaagaaagaaacuucgaccacgaugguuagaugcaagaacuuauuccgauccacuagccuugcgggaauuuaaagaauuugcagcuggacgacguuccguuucuggagaucucauucucgagaucggcaagcuaccucagcaccuaacgcaaagggcucagaaugcgcuggauaauuuagucaugcuacauaauucagagcaaggaggucgugcguaucgucaugcaauggaggaauuaccugauaccauagagaccuuaauguuauuagcguuaauagcaguuuuaacugggggaguuacauuauucuuucucucggguaggggguuaggaaaaacuucgaucgguuuguuaugcgugauggcauccucuguacuuuuauggauggcuucagucgagccacacuggauagcagcuaguauaaucuuggaguucuuuuugaugguuuuacuuauaccggaaccugaucgacaacgaaccccgcaagauaaccaauuagccuauguaguuauuggguuacucuucaugauacuaacaguggccgccaaugaaauggggcuauuagaaaccaccaaaaaggaucugggaauuggucacguugccguagagaaccaccaucaugccgcgaugcuugauguagacuuacauccugccagugcguggacauuauacgcagucgcaacaacuauuaucacgccgaugaugaggcacacgauugaaaauacgaccgccaauauuucacuaaccgcuauagcuaaccaagcagcuauuuuaaugggacuagauaaaggguggccaauaaguaaaauggacaucgggguaccauuacuggccuuaggcugcuauagucaagucaauccguugacuuuaacagcagcaguauugaugcuaguugcacacuaugcgauaauugggccaggacuacaagcuaaagcuacaagggaagcacagaaacgcacugccgccgguaucaugaaaaaucccacaguagauggaauuguagcaaucgacuuagacccaguuguuuaugacgcuaaguucgaaaagcaguuagggcaaauuaugcucuugauacuuuguacgagccagauuuuacuaaugcgaacaacaugggcacucugugaaaguauaacguuggcaacaggcccauuaacuacguugugggagggaucacccgggaaguucuggaauacuacaauagcgguaucaauggcaaacauauuuagaggaucguaccuugcuggugccggacuagcuuuuucccugaugaaaucgcuuggaggcggcagaagagguacaggugcccaaggugaaacucuuggcgaaaaauggaagagacaauuaaaucaacuaucuaaaucagaauuuaauacguauaaacggucugguauuauggaaguagaccgaucugaagccaaggaaggacuaaaacgaggggaaacaacgaaacacgcuguaucccgagguacggcaaaauuaagaugguuuguugagagaaaccucgucaaaccggaaggcaaagucauagauuuaggauguggacgcggaggaugguccuauuacugcgcgggacuaaagaaaguuacagaaguuaaggguuauacaaaaggcggaccaggacaugaggagccuauaccuauggccacauauggcuggaaucuaguaaaacuacauagugguaaagauguauucuuuauucccccagaaaagugugauacauuacuuugcgauauuggugaaucaucgccgaaccccaccaucgaagaaggaaggacuuugaggguguuaaaaaugguggagccgugguuaagaggaaaccaauuuuguauaaagauccuaaacccauacaugccaucaguaguagaaacucucgaacagaugcaacgcaaacauggugggaugcuggucagaaauccguuaaguagaaauucgacccacgagauguauugggugucuuguggaacgggcaacauagucucagcagucaacaugacgagccgaaugcuauuaaaucgauucacaauggcgcaucgcaaaccuacauacgaacgugacguggaccuagguacgggaacccgacauguggccguggaaccagaggucgcgaaccuugauauaauuggucaacguauugaaaauauuaaacacgaacauaagucaacuuggcacuacgaugaagauaacccuuauaaaacaugggcauaucacggaucauacgagguaaagcccuccggaucagccucaucuaugguaaauggcgucguuaaauuacuuacaaagcccugggauguuaucccaauggucacacaaaucgccaugacugauacuacaccguuugggcagcaaagaguauucaaagaaaaaguagauacuaggacaccaaaagccaaaagagguacugcacaaauaauggaagugaccgcccgauggcuauggggauuccuauccagaaauaagaaaccucguauaugcacucgagaggaguuuacuagaaaaguuaggaguaaugcugcuauaggugccguauuuguggacgagaaucaauggaauagugcaaaggaggcagucgaagacgagcgauucugggaccuaguucacagagaacgugaacuacacaagcaggggaaaugcgcgacguguguuuacaauaugaugggcaaaagggagaagaaauuaggagaauuugggaaagccaagggcagcagggcgauaugguauaugugguugggcgcgcgauuccucgaguucgaagcacuuggauucaugaaugaagaccauugguuuagccgggaaaauaguuuaucuggaguugaaggagagggcuuacacaaacuaggguauauacuaagagacaucagcaagauaccuggaggaaacauguacgcugaugacacagcuggcugggacacccgaauuacagaagaugacuuacaaaacgaagcuaagauuacagauauuauggagccagagcaugcauuauuagccaaagcgaucuuuaaauuaacauaucaaaauaaaguagugcggguacaaagaccugccaaaaacggaacaguaauggauguaauaucacggcgggaucaaagagguagcggacaaguugggacauacgguuuaaauacauuuacuaauauggaagcgcagcugauucgacaaauggaaucagaagguauuuucaguccgucagaguuagaaacaccgaaucuagcggaacgagcuuuagauugguuagaaaaguauggaguagaaagauuaaaacggauggcaauaucuggcgaugauuguguggucaaaccaauagacgaccgauucgcgacugcauuaacggcguuaaaugauaugggaaaaguacggaaggauauaccucagugggagcccagcaaaggcuggaacgacuggcaacaaguaccguuuuguagccaucacuuccaccaacuaauaaugaaggaugggcgagaaauugucguuccaugccgaaaccaggaugaauugguuggccgugcaaggguuucccagggagcagguuggagucuuagagaaacagccugccuaggcaaaucguaugcacaaauguggcaauuaauguacuuucaccgucgugauuuacgucuagcugcgaaugccauuugcucagccguaccaguugauuggguacccaccucaaggacuaccugguccauacaugcgcaucaccaauggaugacaacagaagauauguuauccguauggaacaggguauggauugaagagaauccauggauggaggauaaaacccauauuucuaguugggaagacgugccauaccuaggaaaacgagaagaccaguggugcgggagcuuaaucgggcuaacagcacgugcaacaugggcaacaaacauacaaguagcuauuaaccaaguucgucgucuuauaggaaacgaaaauuauuuagauuauaugacaagcaugaaaagauuuaagaaugaaaguggucccgaaggugcucuuugguag

SEQ ID NO: 21764 - RNA, 9879 nt, Artificial Sequence
  derived and/or modified CDS sequence (opt6) from DENV-1__FJ898423__SS-prME
agcguaacaaugcuguuaauguuaaugcccacagcguuagcuuuccaucucacaacuagaggaggagagccgcacaugauagugaguaagcaagaaagagggaaaagucuucuauucaagaccuccgcaggugucaacauguguacuuuaauagcaauggaccuaggagaauugugugaagacacaaugaccuauaaauguccaaggauaacagagguagaaccagaugaugucgauuguugguguaauacaacggacaccugggucacauauggaacaugcagucaaacgggggaacacagacgcgauaaacguucugucgcucucgccccacacgugggccuuggucucgaaaccagagccgaaaccuggaugucaucugaaggggcauggaaacagauacaaaaaguagaaacgugggcccuaagacaucccggauucacuguuauagcgcuuuuucuggcccaugcuauaggaacaucgaucacccaaaaagguauuaucuuuauccuucuaauguuggugacaccauccauggccaugcggugcgugggaauagggagcagagacuucguagagggccuuucaggugcuacauggguagauguaguuuuagaacaugggucaugcguaacaaccauggcuaaagauaaaccuacauuagacauugaacuucuaaaaacagagguaacgaauccagcaguccugagaaaauuauguauugaagcaaaaaucaguaauaccacaacagacucgagauguccuacacaaggagaagcuacgcuagucgaagagcaagaugcgaauuucguauguagacggacguuuguagaucggggauggggaaaugguugcgguuuauucggaaagggcucccucauuacaugugcaaaauuuaaauguguuacaaaacucgagggaaaaauaauacaauaugaaaauuuaaaauauucaguuauaguuacuguccauacaggugaucaacaccaaguugggaacgaaucaaccgagcauggaacuauagccacgauuacuccgcaagcgccuacuucagaaauccagcuuaccgauuacggagcucuaacacuugauugcucgccucgaacaggauuagauuuuaacgaaaugguacuauuaacgaugaaggagaaaucauggcuuguacacaagcaaugguuucucgauuugccgcuuccauggacgagcggugccaguacaucacaagaaacuuggaaucgccaggauuuguuaguuacauuuaaaacggcccacgcaaaaaaacaagaggugguagugcuagggagucaagaaggugcuaugcauacagcgcuaacaggugcuaccgaaauucagacuacaggaacaacuacaaucuuugcaggccaccuaaaaugcaggcugaaaauggacaaacuaacacuuaaagggaugucuuauguaauguguacgggaucuuucaaguuagaaaaagaaguugcugaaacucaacacggaacaguuuuaguccagauuaaauaugaaggaacugaugcaccauguaaaauuccauuuuccacacaagaugaaaagggaguaacacaaaauggaagacugauaacggccaauccaauuguaacugauaaagaaaagccagugaacauagaagccgagccuccauucggcgagagcuacaucgugauaggggcaggugagaaagcacuaaaauuaucaugguucaagaaaggaaguagcauugggaaaauguuugaagcgacagccagaggugcucgaagaauggccauauuaggagauacagcuugggauuucggaaguaucgguggcguauucacuucaguaggaaaguuagugcaccaaauauucggaacagcuuacggugucuuauuuucagggguauccuggacaaugaaaauuggaauugguguuuuauuaaccuggcuagguuuaaauagccggaguacaucauuaaguaugacauguauagcggugggacuuauaacccuuuaccuuggaguaaugguacaagcagacuccggauguguaauaaauuggaaaggacgugaacuuaaauguggaaguggaauauuugugacaaaugagguucacacauggacugaacaguauaaauuucaggcggauuccccaaaaagauuaucugcggcuauaggcaaggcuugggaagaaggcguaugugggauaagaucagccacaagacuggaaaacauuauguggagacagauaaguaaugaacuaaaucauauauuacuggaaaaugauaugaaguuuacaguaguagugggggaugugguugggauuuuggcgcaaggaaaaaaaauggucagaccacaaccaauggaacacaaauauagcuggaaauccuggggaaaagcuaaaaucaucggagccgauguacaaaauacgacauuuauaauugaugguccgaacacgccagaauguccugaugaccaaagagcauggaauauaugggaaguagaggauuacgguuucggaauauucaccacuaauauuuggcuaaagcuucgugacagcuauacacagguaugugaccaccgauuaaugucggcggcgauaaaggacucaaaagcaguucaugcugacaugggauauuggauugaaagugaaaaaaaugagacuuggaagcuugcacgagcaucauuuauagaggucaaaacuugcauuuggcccaagagucauacgcuauggucaaacggaguacuagagagcgaaaugauaauccccaaaauuuauggaggcccaauuucucaacacaauuaucgaccaggcuacuucacucagacggcgggcccguggcaccuagguaaauuggaauuagacuucgaucuuugugaaggaacaaccguggucguugaugaacauugugggaacagggguccgucauuaagaacgaccacaguaacggggaaaaucauacaugaauggugcugucguucuugcacucuuccuccccuacgcuuuaaaggcgaggacgguuguugguauggaauggaaauacgucccgucaaagagaaggaagaaaaucuaguaaaguccaugguaagugcgggaagcggagaaguugacucguucagcuuaggguuguuaugcauaucaauaaugauagaagagguaaugcguucacgguggagccgaaaaaugcucaugacaggaacauuagcuguuuuuuucuuacuaauaaugggccaguuaacuuggaaugaucuaauaaggucuugcauuaugguuggagcuaacgcuagugauaggauggggaugggcacaacauaucuagcacuaauggcaacguucaaaaugagacccauguucgccguuggucuccuauuccgucgccuuacgucucgcgaaguauuacuccugacuauuggguuaagucuaguugcaucuguugaauuaccgaacagcuuagaggaacuuggagacgggcucgcuauggguauuaugauuuuaaaauuauuaacagacuuccaaagcuaccaguugugggcgacguuauuauccuuaaccuuuaucaaaacaacauuuucccuucacuacgcauggaaaacgauggcgaugguccucucgaucguaucacugcugccacuuugucucucuacuacuucacaaaaaaccacguggcuuccugucuuacugggcagccuaggguguaagccccugacaauguuuuuaauugcggagaauaaaauuugggggcgaaagucuuggccauuaaaugaggguaucauggccgugggaauugucucaauucuucuaaguagcuuguuaaaaaacgauguaccauuagcagguccauuaauugcuggagguaugcuaaucgcuugcuacguaauauccggaucaucagcagauuuaaguuuagaaaaagcagcagagguuucgugggaagaggaagcggaacacucaggggcgagucauaauauuuuaguggagguacaggaugaugguacgaugaaaauuaaagaugaagaaagagaugacacacuaacuauauuguuaaaagcuacccucuuagccgucucuggaguguauccucuaagcauuccagcuacauuauucguaugguacuucuggcagaagaaaaagcaaagauccggugugcucugggacacaccgucuccgccugaaguagaaagagcgguccuugacgacgguauuuauaggaucaugcaacguggucuacuaggaagaucccaaguaggcguaggaguguuucaagaaaacguguuucauaccauguggcacguaaccaggggcgcggucuuaauguaucagggaaagagguuggagccaagcugggcauccguuaaaaaagacuuaauuucauauggcggagguuggagacuccaagguagcuggaacacuggagaggaaguacaagugaucgcuguugagccaggaaagaacccaaaaaacgugcaaacagcucccgggacauuuaaaacacccgagggcgagguaggagcuauugccuuagauuuuaaaccagggacauccggaucgccaaucgucaaccgagagggaaagauaguuggauuauauggaaacgggguaguaacuacgagcgguacguacgucucagcaauugcacaagcaaaggcaucucaagagggcccacucccggaaauugaggaugaaguuuuccggaaacgaaaucuuacuauaauggacuuacauccugguucuggaaagacuagaagauauuuaccugcuaucguucgagaagcaauuaaacgcaagcucaggacuuuaaucuuagcaccgacacgaguuguagcuagugaaauggcggaagccuuaaaagguaugcccauacguuaccagaccacagcuguuaagucugaacauaccggucgagaaauaguggaucuaaugugccacgcgacauucacaaugagacucuugucuccagugagggugccuaauuacaauaugauaauaauggacgaagcgcauuuuacagauccguccucaauagcagcacgaggauauaucuccacccguguuggaaugggggaagccgcagccauuuuuaugacagccacgcccccagggagugucgaagcguuuccccaaucuaacgccguaauucaggaugaggaacgugauauaccugaaagaagcuggaacaguggcuaugaguggauuacagauuucccagggaaaacaguuugguuuguuccaagcauaaagucuggcaaugauauagcgaauuguuugcgcaaaaacgguaaacgugucauacaauuaaguagaaaaacauuugacacagaguaucaaaaaacaaaaaauaacgauugggauuauguagucacuacggacauuuccgagaugggagcaaauuuccgagccgaccgagucauugauccacgucguugucuaaagccaguaauucuaaaagaugggccugagcgggugauacuggcaggacccaugccuguaacuguagcgagcgcugcacaacgaagggguaggaucgguaggaaucacaauaaagaaggagaucaauacauauacaugggacagccauugaacaaugaugaagaucaugcacacuggacugaagcaaaaauguuauuagauaacauuaacacuccagaaggcauaauacccgcacuauuugaaccugaacgagaaaaaucagccgcuauagacggagaauauagacugaggggugaagcuagaaaaaccuuugucgaguuaaugcgucgcggcgaucuaccaguguggcugagcuauaaggucgcaucagaggguuuucaauauagugauagacguuggugcuuugauggcgaacgcaacaaucaaguccuagaagaaaauauggauguugaaauauggacaaaagaaggugagcguaagaaacuaagaccccgaugguuagacgcgaggacauauagugauccucuugcucuaagggaauuuaaggaauucgcagcgggcaggagaucagugagcggagauuuaauauuggaaaucgguaaacuaccucaacaccuaacccaaagggcacagaacgccuuagacaauuuaguaaugcuacauaauagugaacaagggggacgagcuuauagacacgcaauggaagaguuaccagauacuauagaaacacuuauguuacuagcuuugauagcuguacuuacagguggggucacguuauuuuuuuuaucagguagaggcuuaggaaaaacuaguauaggucucuugugcguaauggcuucaagcgcacucuuguggauggccuccguagagccacacuggauagcugcaucaauuauucuagaauuuuuccuaaugguacuauuaauaccugaaccagaucgacaaagaacuccccaagacaaccaacucgccuauguagucauaggauuauuauuuaugauucugacuguugcagcuaacgaaaugggacuauuagaaacaacaaagaaggaccuaggaauugggcauguagcaguagaaaaucaucaccaugcaacgaugcuugauguugauuugcacccugcaucagccuggacauuauaugcuguagcuacuacaauaauuacaccaaugaugagacauacuauagaaaacacaaccgcaaacauaagcuugacagcuauagccaaucaagcagcgauucuaaugggacuagacaaagguuggccuauuuccaaaauggauauagggguaccacuauuagccuuaggcugcuacucacaaguaaauccauuaacauugacagcagcaguuuuaaugcuugucgcacauuaugcaauaauaggaccagggcugcaagcgaaagccacaagagaagcacaaaaaagaaccgcagcggggaucaugaaaaacccaacaguagaugggauaguugcgauagauuuagacccgguagucuaugaugccaaauucgaaaagcaacuaggccaaauaaugcuacuaauccucuguacgagccagauuuuacuaaugaggacaacgugggcucuuugugaaaguauaacacuagcaacaggcccucuaacuacgcuaugggaaggaucaccugguaaauuuuggaauacuacuauagccguuucaauggccaacauuuucaggggaaguuaucuugcaggagcagggcuagcuuucagccucaugaaaucacuuggaggagguaggaggggcacuggugcucagggggaaacauuaggagagaaauggaaacggcagcuaaaucaauuaucuaaaucugaauuuaauacauauaaaagauccgguauaauggaaguggauagaucugaagcaaaggaaggacuuaggcgaggugaaacaacuaagcaugccgugucuagaggaacugccaaauuaagaugguuuguugagagaaauuuggucaaaccugaagguaaagucauagaccuuggauguggucgaggugguuggucguacuauugugcugguuuaaaaaaaguuacagaagugaaaggauauacaaaaggagguccgggucaugaagaaccaauuccgauggcuacguauggauggaaccuugucaaacuacacaguggaaaagauguauucuuuauaccaccagaaaagugcgacacauuguuaugugacauuggggagaguucuccuaaucccacuauugaagaaggaagaacguugagaguacugaaaaugguugaaccauggcuaagggggaaucaauucuguaucaaaauucuuaacccuuacaugccauccgucguugagacauuagaacacaugcagagaaaacauggagggaugcuggugcgcaacccauugagccgaaacucuacccaugaaauguacuggguaagcugcggaacagguaauauaguuagcgccguaaauaugacgucccgaaugcugcuuaauagauucacaauggcucauagaaaacccacauacgaacgcgacgucgaucuaggggcaggaacacgacacgucgcuguugagccugaggucgccaaucuugauauaauaggucagaggauugaaaacauuaaacacgaacacaaaucuacauggcacuacgaugaagacaacccguauaaaaccugggcauaccacggcucauacgaaguuaaaccuucaggaucugcuucaucgaugguaaacggaguaguaaaacuuuuaacuaaacccugggacguaauccccaugguuacucagauagcaaugaccgacacaacgccguuuggacagcaacgaguauucaaagaaaaaguagauacaagaacaccaaaagcaaaaagaggcacagcacagaucauggaaguuaccgcucguuggcucuggggauuuuuaagucggaauaaaaaaccgaggauauguacucgcgaggaauucacaagaaaaguccgaucaaaugcugccauaggggcaguauucguggacgagaaucaauggaauucagcaaaagaagccguugaagaugaaagauuuugggaucuuguucacagagaacgagaguuacacaaacaaggaaaaugugcuacguguguauauaauaugauggggaaaagagaaaaaaaguuaggagaauucggaaaggcaaagggaucacgggcuauuugguauauguggcucggagcuagguucuuagaauuugaagccuuaggguuuaugaaugaagaucacugguucucacgugagaauagccuauccgguguugaaggcgaaggucuacauaaguugggauacauucuaagagauauaaguaaaaucccaggaggaaauauguacgcugaugacacagcaggaugggauacacggauaacggaagaugacuuacaaaacgaggcaaaaaucacagauauaauggagcccgaacacgcccuauuagccacgucgauuuuuaaguugacauaucaaaacaaggucguuaggguucaaaggccagccaaaaauggaacggugauggaugugaucagcaggagagaccaaaggggaucaggucagguagggacuuacggauuaaacacauucacuaauauggaagcgcaauuaaucagacagauggaaagugaaggaauauucaguccgagugaguuagagacaccaaaucucgcggaacgcguuuuggacugguuagagaaguacgguguagagcgucuaaagagaauggccauuucuggagacgacuguguuguuaaaccaaucgacgacagguucgccacugccuuaacugcgcuaaaugauauggggaagguuagaaaagauauuccacaaugggaaccuucaaaaggauggaaugacuggcaacaaguaccuuucugcucccaucauuuucaucaauuaauuaugaaggacggucgagaaauaguugucccauguaggaaccaggacgagcugguuggaagagcuaggguuagccaaggagcaggguggucccugcgggaaacugcuuguuuggguaaaaguuaugcucaaauguggcaacuaauguauuuucaucgccgugaucuucgucuugcagcuaaugcgauuugcuccgcaguuccaguagauuggguacccaccagucggacaacauggucgauccacgcccaucaccaauggaugaccacagaggauaugcugaguguuuggaauagaguauggauagaagagaauccuuggauggaagauaagacacacauuuccaguuggggagauguaccguaucuaggaaaacgugaagaucagugguguggaucauugauaggccuaacggcacgggcgacaugggccaccaauauacaagucgcaaucaaucaggugcgaagacuaauaggaaacgagaacuaucuggauuauaugacgaguaugaaacgauucaaaaacgaaucggacccagaaggugccuugugguaa

SEQ ID NO: 21765 - RNA, 9879 nt, Artificial Sequence
  derived and/or modified CDS sequence (opt6) from DENV-1__FJ898424__SS-prME
ucagugacuaugcuucuuaugcuaaugccaacugcacuagcuuuucacuugacaacucgugggggagaaccccauaugauugucaguaaacaagaacgggguaaaucccuuuuauuuaaaacuagcaccggagucaauauguguacacucauagcgauggaucucggagaacuuugugaagauacgaugaccuauaaaugcccuagaauaacggaagucgaacccgacgauguagacugcugguguaauaccacggauacguggguuacuuaugguacauguucucaaacaggagaacauaggcgagacaaacgcucagucgcccuggcaccacacguaggucucggccuugaaacgcgcgccgaaacuuggaugucauccgaaggcgcuuggaaacaaauacaaaaaguagaaacaugggcguuacgacacccagguuuuacaguaauugcuuuguuuuuagcacacgccauaggaacaagcaucacucaaaaagggauuaucuuuauacuucuaaugcuaguaacuccgaguauggccaugcguugugucggaauagggucgcgggacuucguugagggcuugaguggcgcaacauggguugaugucgugcuagaacacggaucguguguuacgacgauggcuaaagacaaaccuacucuagauauagagcugcucaaaacagaaguuaccaauccagcgguccuacgaaaacuauguaucgaagcaaaaaucagcaacacaaccacagauaguagguguccuacucaaggagaagccacuuuaguugaggaacaagaugcuaauuuuguguguagacggacuuuugucgaucgaggcugggguaauggauguggauuauuuggcaaggguucccuaauuaccugugcaaaauuuaagugcgucacaaaacuagaaggaaaaauuguucaauacgaaaaucuaaaauacucaguuauaguuacgguucacacaggagaucaacaucaaguuggaaacgaaagcacugagcaugguacaacagcgaccauaacaccgcaagcuccuacaucagagauucagcucaccgauuacggcgcuuugacguuagacuguucucccagaacuggcuuagauuuuaacgaaaugguauuacucaccaugaaagaaaaaucaugguuaguccacaaacaaugguuucuagauuugccauuaccauggacaucaggggcuaguacaagccaagaaacauggaauaggcaagaccuacucguuaccuuuaagacugcccacgccaagaaacaggaaguaguaguuuuagggucacaagagggugccaugcacaccgcgcucacuggagcuacugaaauucagacuucgggcacgacuacuauauuugccggccacuuaaaauguagacuaaaaauggacaaacuaacucuaaaagguaugucauauguuaugugcaccggaucuuuuaaauuagaaaaagaaguagcggaaacucaacacggaacaguuuugguccaaauaaaguaugaggguacugacgccccaugcaaaauuccuuuuucaacccaggaugaaaaggguguuacucaaaaugguagacucauaacugcaaauccaaucguaacagauaaggaaaaaccuguaaauauugaagcagaaccaccauucggggagucguauauaguaauuggagccggagaaaaagcauugaaauuaaguugguucaaaaagggaagcucuaucgguaaaauguuugaggcuacagcgagaggugcacgaaggauggcgauauuaggugauacugcaugggacuuugguucuaucggaggcguuuucacaaguguggguaaguugguacaucaaauuuucggcacugcauacggaguuuuauuuaguggcgucucguggacuaugaagauagguauagguguacuucucacuugguuagggcuaaauucacguucuacgucacuaucuaugacuugcauagccguaggauuagugacauuauaucugggaguuaugguacaagcagacucuggauguguaauaaacuggaagggacgugaacuaaaaugugggucggguauuuuuguaacaaacgaaguucauacauggacagagcaauacaaauuucaagcagauaguccaaaacgauugagugcagcuauaggcaaagcgugggaagaaggcguuugcggaauccggucggcaacgagacuugagaacauaauguggagacaaaucucaaacgaauuaaaucacaucuuguuggaaaacgauaugaaguuuacagucguuguaggugauguaguaggaauauuggcacaagggaaaaagaugauaagaccacaaccaauggaacacaaguacaguuggaaaucaugggguaaggcaaaaauaauaggcgcggauguacaaaacaccacauuuauaauugacgguccuaacacaccugaaugcccagaugaucaaagagcauggaacauaugggaagucgaagacuauggauuuggaauuuuuacaacaaauaucugguuaaagcuacgagauuccuauacacaaguaugugaucaccguuugaugagugccgcaaucaaagauuccaaagcgguucacgcagauaugggauauuggauugaaucugagaaaaaugaaaccuggaagcucgcccgugcauccuuuaucgaagugaaaaccugcauauggcccaaaagccauacacuauggucaaaugggguuuuagagucagagaugauuauucccaagauauaugggggaccgaucucucaacauaacuacagaccaggcuauuuuacucagacagcugguccguggcacuuagggaaacuggaacuagacuucgauuuaugugaaggcaccacagugguaguagacgaacauugcggcaaucgaggaccaucccuacguaccaccaccguuacugggaagauuauccaugagugguguuguaggagcuguacauugccgccguuacgcuuuaaaggggaagauggcugcugguauggaauggaaauaagaccugucaaggagaaagaagaaaaucucguaaagagcaugguuagcgcaggaucaggugaaguagacucauuuucacuggguuuauuguguaucucgauaaugaucgaggaagugaugagguccagguggucaaggaaaauguuaaugacaggaacacuugcgguauucuuucuauuaauaaugggccaauuaacauggaaugacuuaauacgaaguugcauaaugguuggcgcgaacgccucugaucgaauggguaugggaacaacguauuuagcacugauggcgacuuuuaagaugcguccgauguucgcggucggucuccuuuucagacgauuaacgucaagggaaguucuacuacucacaauaggucucaguuuagucgccucaguagaauugccuaauaguuuagaagaauuaggagacggauuggccaugggaauaaugauucuuaaacuauuaacagacuuucaauccuaucaguugugggcaacuuuguuaagucuuacauucaucaaaacaacguuuaguuuacauuaugccuggaagacaauggcgaugguuuuaucaauagucucguugcugccccucugccucucuaccaccucucagaaaaccacaugguuaccaguucuauuaggaaguuuaggauguaagccauugaccauguuucuaauugcggagaauaaaaucugggguagaaaaaguuggcccuuaaaugaagggauuauggcuguugguauugucucuauauuacuuucaaguuugcucaaaaaugacguuccauuggcagguccacuaauugcaggagggauguuaaucgcaugcuauguaaucagugggucauccgcugaucucaguuuagaaaaagcggcagaaguuagcugggaagaagaagcugaacauucaggugccucacauaauauccuagucgagguccaagacgacggaacaaugaaaauuaaagaugaggaacgggaugauacccucacaauauuguugaaggcaacauugcuggcagucucuggcguuuacccauuaucuauacccgcaacucuauuuguuugguacuuuuggcagaagaagaaacaaagaucugggguacuaugggacacuccgaguccaccugaggucgagcgggcaguccucgacgacggaaucuauagaauaaugcaacguggcuuacuaggucguagccaaguaggaguugggguguuucaagaaaauguauuucacacaauguggcacguaacuagaggcgcaguauuaauguaucaagggaagcgucuggaaccuaguugggcuucgguaaagaaagacuuaauuucauauggaggcgguuggcgccuucaaggaucuuggaacacaggagaagagguucaaguaaucgcaguggagccaggaaagaauccaaagaacguucaaacggcuccagggacauucaagacaccugaaggagaaguaggggcuaucgcauuagauuucaaaccagggacuagcggaaguccuauuguaaauagggagggaaaaauaguaggucuguacgguaauggaguagugacaacaucaggaacuuacgucagugcuauagcacaagcuaaggcgucacaagaaggcccauugccagaaauagaagacgaaguauuuaggaaaagaaaucuuacaauaauggaccuucacccugguucagguaaaaccagacgcuauuuaccagccauaguacgggaggcgaucaaaagaaaauugagaacuuuaauacuagcaccuacaagagucguugcauccgaaauggcagaagcauuaaaaggaaugccaauacguuaucaaacuaccgccguuaaaagcgaacauacuggacgagaaaucguggauuuaaugugucacgcaacauuuaccaugcgccucuuauccccuguucgaguuccgaauuacaauaugauaauuauggacgaagcucauuucacugauccaucaagcauagcagcuagaggauacauaucuacgcgggugggaaugggugaagcagcagcuauauucaugacugcaacuccaccagguagugucgaggcuuuuccucaaaguaacgccguuauucaagacgaggaaagggacauaccugaaagauccuggaacucaggcuaugaauggauuacagauuuuccugguaaaacgguaugguuuguaccaaguauaaagagcgggaacgauauugcaaauugucugagaaagaauggcaaacgagucauucaacuaucacgcaaaacauuugauacugaauaucagaaaacgaagaacaaugacugggacuacguugugacgacagacauaucggaaaugggagcuaacuuuagggcggaccgagucauagaucccagaagauguuuaaaaccuguuauucugaaagauggucccgaaagagugauacuagcgggcccaaugcccgucacuguagccagugcugcccaaaggagaggccgcauaggaagaaaucauaacaaggaaggugaccaauauauauauaugggccaaccccuaaacaacgaugaagaccaugcucauuggacagaagcaaagaugcuguuggauaauaucaacacgcccgaaggaaucauaccagcucuauucgaaccagaaagagagaaaagugcagccauugauggcgaauaucgcuugcggggagaggcaagaaaaacauuugucgaacuuaugcgaagaggggauuuaccugucugguuauccuauaaaguugccuccgaaggauuccaauauagcgauaggagaugguguuuugacggugaacgaaauaaucaaguauuagaagagaauauggaugucgagaucuggacaaaggagggugaacgaaagaaauugagaccuagguggcuagacgcacguaccuauagugauccuuuggccuugcgagaguucaaagaauuugcggcaggucgaagaucaguuagcggcgauuuaauucuugaaauuggaaaacugccacaacauuuaacccagagagcucagaacgcauuagauaauuugguaaugcuacauaauucugagcaaggagggagagcauacagacaugcuauggaagaacugccagacacaauagaaacauugaugcuccuugcgcuaaucgcuguuuuaacagguggagucacacuauucuuucugagugguagaggauuaggaaaaacuuccaucggucuguuaugugucauggccagcuccgcucuauuauggauggccucaguagaaccccacuggauugccgcuuccauaauuuuggaguucuuucuaaugguauugcuaauacccgaacccgacagacaaagaacaccacaagacaaucaacuagcuuacgucguaauugguuuacuauuuaugauauuaacuguugcugcaaacgaaaugggguugcuagaaacuacgaaaaaggacuuagggaucggacacguagcaguagaaaaccaccaucaugcaacuauguuagacguagaucuucauccugcuucagcauggacccuguaugcugucgccacaacuauuauuacgccaaugaugagacauacuauugaaaacaccaccgcgaauauaucccuuacagccauugcgaaucaagcagcgauacucaugggccuggauaaaggguggccuauaucuaaaauggauauagggguuccgcuauuagcauuaggauguuacagccaagucaauccacucacacuaacagcagcuguacuaauguuaguagcucacuaugcaauaauuggccccggacugcaagcgaaagcaacgagagaagcucaaaaacgaacagcggcgggaauaaugaaaaacccaaccgucgacggaauaguagcuauagacuuagauccaguugucuacgaugccaaauuugagaaacaauuagggcaaauaaugcuauuaauacucuguacaagucaaaucuugcuaaugcgaacuacuugggcucuaugugagaguauuacauuggccacuggaccuuugacgacuuuaugggaagguagucccggcaaauuuuggaauacgacaaucgccgugaguauggcuaauaucuuucgcggcuccuauuuggcgggugccggccuagcguuuucacuuaugaaaucauuagguggaggucgccgaggcaccggagcgcaaggugaaacacuuggagagaaguggaaacgccagcuaaaucaauuaucaaaaucugaguuuaauaccuacaaaagauccggcauaauggagguagaccgaucugaagccaaagaaggucuuagacgaggagaaacuacuaaacaugccgucucccgcggaacggcuaaacuaagaugguucguugaacguaaucucguaaaaccagaaggcaaagugauagaucuagggugcggaaggggcggcuggucuuacuauugugcuggauugaagaaaguuacggaaguaaaagguuacacaaaaggagggccgggacaugaggaaccaauaccaauggcaaccuacggauggaauuuagugaaauuacauagugggaaagacguguuuuucaucccgccagaaaagugugauacucuucuaugugauauaggagaaucauccccgaacccuacuauagaagaaggcagaacucuuaggguacuaaagaugguugaaccuuggcuccggggaaaucaauuuuguaucaaaauauugaacccuuauaugccaucuguuguugaaacauuagaacaaaugcagcggaaacauggcgguauguuagugaggaauccauugagcagaaauaguacacaugaaauguauugggugucguguggaacaggcaauauugucucugcaguaaauaugacaaguagaauguugcuaaauagauuuacaauggcacauagaaagcccacauacgaacgggauguggacuuaggcgcuggaacuagacauguugcaguggaacccgaaguggcaaauuuggauauaauuggacaaagaauagaaaacauaaaacaugaacacaaaagcacauggcacuaugacgaagauaaucccuacaaaacuugggcauaccacggaaguuacgaggucaaaccgucaggaucugcgaguucuauggucaauggaguuguuaaauugcucacuaaacccugggauguaauuccgaugguuacgcaaauagcuaugacggauacgacuccuuuugggcaacaaagaguauucaaagaaaaaguggacacaagaacgcccaaagcgaagagaggcacagcacaaauaauggaagucacggccagaugguuauggggguuucuaaguagaaacaagaaaccaagaaucuguacaagggaagaauuuacgcgcaagguaagaucgaacgccgccauuggcgcugucuuuguagaugaaaaucaauggaacagcgcaaaggaagcgguagaagaugagcgcuuuugggacuuaguucaucgagaacgugaacuccauaaacaaggaaaaugcgcgacuuguguguauaacaugaugggaaaaagggaaaagaagcucggagaauuuggcaaagcaaaaggaagcagggcgauuugguauauguggcuaggcgccagguuccucgaguucgaggcauugggauucaugaaugaagaucacugguucucaagagagaacagcuuaucuggagucgaaggcgaaggacuucauaagcucggauacauacuucgcgauauaucuaaaauaccagguggaaauauguaugcggaugacaccgcagguugggauacuaggaucacagaagaugauuugcaaaacgaagcaaagauaacagacauaauggagccagaacacgcauugcuugcaacuucuauauuuaaauuaaccuaucaaaacaaaguuguuagaguccaaaggccagcacggaacgggacugucauggacguaauuaguagaagagaucaaagaggauccggucaaguggguacauacggacuaaauacauuuacaaauauggaagcucaauugauaagacagauggaaagugaagguauuuucagcccuucagaacuagaaacucccaaccucgcugaacgaguccuggacugguuagagaaacauggaguggaacguuuaaaacgcauggccauaucaggcgaugacugcguagugaaaccaauagaugauagauucgcgacggcguuaagugcucuuaacgacaugggcaagguucgcaaagauauaccacaaugggaaccaucaaaaggauggaaugauuggcagcagguuccuuucugcucacaucauuuucaccaauuaauuaugaaggauggucgugaaauaguaguaccuugcagaaaucaagaugaacuuguggggagagcccggguuucucaaggagcgggauggagucuccgagaaacagcuugucuagguaaaucauaugcccaaauguggcaauuaauguauuuccauagaagagaccuccgucuagcugcuaaugccauaugcagcgccgucccaguagacugggugcccacuucaaggacaacguggucuauacaugcgcaucaucaauggaugacaacagaagacauguuaucaguauggaaucgcgucuggauagaagaaaauccauggauggaagauaaaacacacaucuccucauggggagacgucccauacuuaggaaaaagagaagaccaauggugcggaagucuuaucggguuaacugcuagggcgacaugggcaacuaauauacaagucgccaucaaccaaguacgucgccucauaggcaaugaaaauuauuuggauuacaugaccucuaugaaacguuuuaaaaacgagagugaucccgagggagcauugugguaa

SEQ ID NO: 21766 - RNA, 9879 nt, Artificial Sequence
  derived and/or modified CDS sequence (opt6) from DENV-1__FJ898425__SS-prME
agcguaacuaugcuuuuaaugcuuaugcccacugcauuggcauuccaucuaacaacccgagguggggaaccgcacaugauuguaacaaaacaagaacgugguaaaucacugcuguuuaaaacaagugcaggaguaaacaugugcacacuaauagcuauggaucuaggagaacuaugcgaagacacaaugacuuauaaaugcccgcgaauaacagaagcagaaccagacgauguugauugcugguguaaugcuacagauaccuggguaacauaugguacuugcucgcaaaccggagaacaccguagggauaaaaggucgguugcacucgcgccacacgugggacuuggacucgaaacgagaaccgaaacguggaugaguucugaaggugcguggaaacaaauacagagaguagaaacaugggcucuaagacacccaggcuucacagugaucgcguuauuucuugcacaugcaaucggcacaagcauuacccaaaaagguaucaucuucauacuacuaauguuaguuacuccauccauggcaaugcguuguguuggaauugggaguagggauuucguagaaggcuugucuggggcaaccuggguggauguuguguuagaacaugggucauguguaacuacuauggcuaaagauaaaccgacguuggauauagaacuccuaaaaaccgaaguuacaaacccagcuguauuaagaaaacuuuguauagaagcgaaaauaucaaauacaaccacugacagccgaugucccacucagggugaagcgacacuaauggaagaacaagacgcuaacuuuguuugccgacgcacauuuguagaucgagguuggggcaacggcuguggacuauucgggaaaggaagucuaauaaccugcgccaaauuuaaaugcgugacaaaacuggaaggaaaaauaguacaauaugaaaaucugaaauauucugugauuguaacaguacauaccggcgaccaacaucagguugguaacgaaagcacagaacauggcacuacagcaacgauaacaccucaagcaccgacaagugaaauacagcuaacagacuauggagcgcuaacucuagauugcucaccgcgaaccggauuagacuucaaugagaugguauuacuaacuaugaaagaaaaaucuugguuaguccauaaacaaugguucuuagacuuaccacuaccguggacaucaggugccaguaccagccaagagacauggaaucgacaagauuugcucguaacauucaaaacagcucacgcuaagaaacaagagguaguuguguugggaucacaagaaggagcaaugcacacugcucucacuggggcaacggaaauucaaaccaguggcacuacaacgaucuuugcaggacaucuaaaaugccgauuaaaaauggacaagcugacacugaaaggcaugucauauguaauguguacaggaucauucaagcuggaaaaggaaguagcagaaacucaacauggaacugucuuaguacaaauaaaauaugaaggcacagacgcaccauguaaaauaccauuuagcacacaagaugaaaaaggggucacacaaaacgggagauugaucacugcgaauccgauaguaacggauaaagaaaaaccagucaacauagaggcagagccaccuuucggugaaucauauauagugaucggagcaggagaaaaagcacucaaauuaucaugguucaagaaaggcagcucgauugggaaaauguuugaggcaacagcucgcggugccagacguauggccauccuuggagacacagcuugggauuucgguuccauaggagggguguucacauccauaggcaaauuaguucaucaaauauuugguacagcuuaugguguccucuuuucuggugucaguuggacaaugaaaaucggaauagguguguugcucacuuggcuuggacugaacucaaggaguacaucgcuaucaaugacuuguauagcagucggauugguaacucuuuauuugggaguaaugguucaagcagacucaggcuguguuaucaacuggaaaggccgugaauuaaaaugugggucuggaauuuucgugacaaaugaaguacauacauggacugaacaauauaaauuucaagcugauucaccaaaacgucuaucagcugccauaggcaaggccugggaagaagggguuugcgggauacgaagugcaacccgcuuagaaaauauaauguggaaacagauaucuaaugaguuaaaucacauacuccuagagaaugauaugaaauuuacaguagucguaggagauguagucggaauccuagcacaggguaagaaaaugauuagaccgcaaccaauggaacauaaauauaguuggaagucgugggguaaagcaaaaauuauaggagcagauguacaaaacacaaccuuuauaauagaugggccaaauacaccggaaugccccgaugaucaaagggcauggaauauuugggagguugaagacuauggauuuggaauauuuacuacgaauaucugguuaaaaaugcgggauucauauacacaaguaugugaccaccggcuaaugucggcugcgaucaaagacaguaaagcaguccaugcugauaugggauacuggauagaauccgagaaaaaugaaacauggaaauuggcgcgugcaucuuucaucgaagugaagacgugcauauggccgaaaucccauacucucuggagcaacgguguucuagaaagugaaaugauuauuccuaaaauuuaugggggcccuauuucccaacacaauuauaggccugguuauuuuacacaaacggcaggacccuggcaucuuggaaaacuagaguuagacuuugauuugugcgaaggaaccacuguaguagucgacgaacauugugguaacagagggccaucuuuacguacaacaacggugacuggcaaaauaauccaugaaugguguuguagaucuuguacuuuaccuccguuaagauucaaaggagaggaugguugcugguacgggauggaaauaagaccgguaaaggaaaaagaagaaaaucucgucaaaucuaugguauccgcaggaagcggugagguagauucuuucaguuuaggauuauuaugcauuucgauuaugauagaagagguuaugcgcucuagauggucaagaaaaaugcuaaugaccgguacgcuagccguguuucuuuuacuuaucaugggccaauugacuuggaaugacuugauaagacucugcauaaugguuggugcaaacgcaagugaucguauggguaugggaacgaccuauuuggcacuuauggcaacguuuaaaaugcgaccuauguucgcugugggauuacuauucagacgacuaacaagcagagaggugcuacucuuaacuauagguuuaagucugguggcaaguguagaacuuccuaauagucuggaagaauuaggugauggcuuggccaugggcaucaugauauuaaaguuacucacugauuuccaaucccaucaacuaugggcuacuuuguuaagucuaacuuuuauuaaaacaacccuuagcuugcacuaugcauggaaaacuauggcaauggugcuauccauaguaucacuaauaccccugugcuuaucaacuaccucacaaaagacaacauggcugccagucuuguugggaagucucggguguaagccucuaaccauguuccuuauugcugaaaauaaaauuugggguagaaagaguuggccacucaaugaagggauuauggccgucggggucguuaguauacuccuaaguaguuugcugaaaaacgaugugccguuggcugguccauugauagcaggcgggaugcugaucgcauguuauguuauaagcgggucgucggcggauuuaagucuugaaaaagcggcugaaguuagcugggaggaggaggccgagcacucgggggcuucccauaauauucuaguagaaguucaagacgaugguacaaugaaaaucaaagaugaggaacgagaugauacauugacuauccuucuaaaagcaacgcuauuagcggucucgggaguauacccccuaucaauaccagcaacucucuucgucugguacuucuggcagaaaaagaaacaaagaagcggugugcuuugggauacuccguccccuccugaaguagaaagagcugucuuagaugacgguauauacagaauaaugcagagaggauugcuaggacguucgcaaguuggaguaggcguauuccaagaaaaugucuuucauacaauguggcauguaacgagaggagcaguucuuauguaucaaggaaaaagacuugagcccucaugggcauccgucaagaaagauuuaauaucguaugguggugguuggagacuucaaggaucauggaauacuggagaagagguccaaguaaucgcggucgaaccaggcaaaaauccuaagaacguucaaacugcaccggguacauuuaaaacaccagagggggaaguuggugccauagcacuagacuucaaaccagguacgagcgguucuccaauuguaaauagagagggcaaaaucguuggcuuguacgguaacggcguugucacaacaucggguacuuacguaagcgcaauagcucaagcaaaggcuagucaagaaggaccucuacccgaaauagaagaugaaguauucagaaaacgaaaccuuacgauaauggacuuacauccaggaucuggaaaaacaaggagauacuuaccagccaucguucgagaagcuauaaaacgaaaacuacguacguuaauccuugcgccuacacgagugguagccagcgaaauggcagaagcauuaaaaggcaugccgaucagauaucaaacgacugcaguaaagucagaacacaccgguaaggaaauaguagaccuaaugugccaugcuacguucacgaugagacuacucagcccaguaagagugccaaauuauaauaugauaauuauggaugaagcacauuuuacugauccuaguucaauagcugccaggggauauauaucaacaagggucgguaugggcgaggcugcugcaaucuuuaugacugccacuccucccgguagcguugaagcguucccucaaucgaacgccguaauacaagacgaagaacgagacaucccugaaagaagcuggaauagcggguaugaauggauuacugauuuuccugguaaaacgguaugguucgugccuucaauuaaaagcggaaacgauauugcaaauugcuuaagaaagaaugggaaacguguaauacaacuaucaaggaagacauuugacaccgaauaucaaaagacuaaaaauaaugauugggauuacguuguaacaacugauauauccgaaaugggagcuaacuuccgagccgaucggguuauugaucccaggagauguuuaaaaccagucauauuaaaggaugguccagagagaguaauucuagcaggaccaaugccaguuacgguggcauccgccgcacaacggagaggcagaaucggucggaaucauaauaaggagggcgaucaguauauauauaugggacaaccucucaauaacgaugaagaccacgcccacuggacggaagcaaagaugcuccuagacaacauuaacacaccagaaggaauaauaccagcacuauucgaaccagaacgagagaaaagugcagcuauagauggugaauauagacucagaggugaagcgagaaagacauucguugagcucaugcgcagaggugaucuuccuguguggcuaucauauaaaguugcaucagaaggauuccaauauucagacaggagaugguguuuugauggugaaagaaacaaucaaguccuagaagaaaauauggauguagagaucuggaccaaagagggugaacgcaagaaauuacgacccagauggcuugaugcucgaacguauucagacccauuggcacuaagagaguuuaaagaguucgcugcugggagaagaaguguuucuggcgaucuaauuuuggaaauaggaaaauuaccgcaacaucugacucaaagagcacaaaacgcgcuggauaauuuaguuauguugcacaauucggagcagggaggaagggcauauagacaugcuauggaagaacuuccggauacuaucgaaacccucauguuacucgcauuaauugcgguguuaaccggcggaguuacccuauuuuuccuaaguggaagaggucuuggaaaaaccucaauuggcuuacuaugcgucauggcauccaguguauuauuguggauggcuagugucgaaccacauuggaucgccgcgucaaucauuuuagaguucuuccuaaugguacuccuuaucccagaacccgacagacaaaggaccccacaagauaaucaacuagcguauguaguaauagggcuacucuucaugauacuuacaguagcggccaaugaaaugggguuguuagagacuacuaagaaagauuuagguauaggacacguagcuguagaaaaccaccaucacgcaacgaugcuagacgucgaccuucacccugcaucagcuuggacauuguaugcaguagccacaacuauuauaaccccuaugaugagacauacaaucgagaacaccacugcuaauauaucacuuaccgcuaucgcaaaucaggcagccauacucaugggucuagauaaggguuggccgaucucaaaaauggacauagguguaccauuacuggcguuagggugcuacucacagguaaacccacugacccucacagcggcaguauuaauguuaguugcccacuaugcaauaauuggaccuggcuuacaagcuaaggcuacaagagaagcgcagaagagaacagcggcugguauuaugaaaaauccgacuguagaugggauuguggcuauagauuuagauccuguaguauaugaugcuaaguucgagaaacaguuaggacaaauaauguuacugauucugugcacuucgcaaauccuacuaaugaggacaacaugggcccucugcgagucuauuacacuugcaacaggaccguugacaaccuugugggaagguaguccugggaaguucuggaacacgaccauugcaguuucuauggcaaauauauuccgagguucuuauuuggcaggcgcagguuuagcauuuuccuuaaugaagucuuuaggcgguggucgcagagguacgggggcucagggagaaaccuuaggcgaaaaauggaaacgccaauuaaaucaacuuucuaaaagcgaauuuaacauauacaagagaucgggaauuauggaaguagaccgaucagaagcaaaagaaggguuaaaaaggggugaaacaacccgucacgcuguauccaggggaacugcuaaacuaaggugguuugucgaaaggaauuugguuaagccagaagguaaagucauagauuuagguugcggaagaggaggguggucauauuacugcgcugggcuaaagaaagucacagaagugaaaggauauacuaaaggaggcccaggccaugaagaacccauaccaauggcuaccuauggguggaaucuuguaaaauugcauucaggaaaagacguauucuuuacgcccccagagaaaugcgacacccuguuaugcgauauaggcgaaagcaguccaaacccaacaauagaagaaggaaggacuuuacggguccucaaaaugguugagccgugguugagagggaaucaauuuuguauuaagauacuaaaccccuauaugccaucgguggucgagacauuggaacaaaugcagcggaaacauggagguauguuaguaaggaacccauuaagcaggaacucuacacaugaaauguacugggucucaugcgggaccggaaauauaguaagugcuguuaauaugacuucccggauguuauugaaucgauuuacgauggcucaucgaaagccgacauaugagaaggaugucgauuuaggggcgggaacgcgacacguugcggucgaaccagaaguugcgaauuuagauaucauuggucaaagaauagagaacauaaaacaugaacacaaaucgacuuggcauuaugacgaagauaauccuuauaagacgugggcuuaucaugguaguuaugaaguaaagcccagcggcucagcuucuuccaugguaaauggagucguaaaauuauugacuaagccaugggauguuauaccuaugguaacucagauagcgaugacggauacaacuccauucggacaacaacgaguuuucaaagaaaaaguagacacgagaacgccaaaagcaaaaagagguacuguacagauuauggaaguaaccgcacgauggcuguggggcuucuuaaguaggaauaagaaaccaagaauuuguacaagagaagaauuuacuaggaaaguaagaagcaaugcagcuauuggagccguuuuuguugaugaaaaccaauggaacuccgcaaaggaggcuguagaggacgaacguuuuugggacuuaguacaaaaggagcgagagcuucacaaacaaggaaaaugugcaacuuguguauacaauaugaugggaaagcgggagaagaaauuaggagaguucgguaaagcgaaaggauccagagcuauuugguauaugugguugggagcuagauuuuuggaauuugaggccuuaggguucaugaacgaagaucacugguuuagccgagaaaauucucuuaguggagucgagggugagggccuacacaaacuaggauacauacuuagagauauuaguaaaauuccuggaggcaacauguaugcugaugacacagcaggcugggauacccguauaacggaagaugauuugcaaaacgaagccaaaaucaccgauauaauggaaccagaacaugcacuacuagcaacaaguaucuuuaaauuaacauaucaaaauaaaguaguaagggugcagcggccugccaaaaacggaacggugauggauguaauuagucggagagaucagcggggaaguggucaaguagggacuuauggguugaacacguuuacuaauauggaagcacaauuaauuagacaaauggagucugagggcauauuucugccauccgaguuagagacgccgaauuuagcagaaaggguacuggauugguuagaaaaauacgggguggagcgacuuaagagaauggcuauaucaggggacgacuguguaguaaagccuaucgaugaccguuuugcuacugcuuuaacugcguuaaaugauauggggaaaguacgaaaagauauaccucaaugggagcccucaaaaggguggaacgacuggcaacagguaccguuuugcagccaccauuuccaccaguuaaucaugaaagaugggagagaaauaguaguaccaugccgaaaucaggaugaguugguagggagagcaagaguaucucagggagcugguuggucuuuaagggagacggcuuguuuggggaaaaguuaugcgcaaauguggcaguuaauguauuuucaucgaagagacuuaaggcuugccgccaaugcgauaugcucugccguuccaguugauugggugccgacuucuaggacgacauggagcauacaugcacaucaucaauggaugacaacagaagauauguuaucgguauggaaccgaguguggaucgaagaaaacccuuggauggaagacaaaacgcauguaucgucuuggggagauguaccauauuuaggaaaaagagaagaccaauggugcggaucacuaauaggauugaccgcgcgugcaacaugggccuccaauauacagguagccauaaaccaaguacggcgguugauagguaaugagaauuauuuagauuacaugaccucaaugaagcgauucaagaaugaaggagacccggagggagcguugugguga

SEQ ID NO: 21767 - RNA, 9879 nt, Artificial Sequence
  derived and/or modified CDS sequence (opt6) from DENV-1__FJ898426__SS-prME
agcgugacaauguuauuaauguuaaugccgacagcucuagcguuucauuuaacuacaagaggaggagaaccucauaugauagucucaaaacaagaacgagggaaauccuuacuguuuaaaacaucagccgguguuaacaugugcacuuuaauagcaauggaucugggggaauuuugugaagauacuaugacauacaaauguccucggauaacugaagcugaacccgacgauguagauugcuggugcaaugcaacugacacuugggucacuuaugggacaugcagucaaacaggagaacauagaagagacaaacgcucaguagcguuggcgccgcauguugguuuaggacuagaaacuagaaccgaaaccuggaugagcagugagggagccuggaaacagauacaaagggucgaaacuugggcauugagacacccgggguuuaccguaauagcguuauuucuagcacaugcaauugggacaucaauaacccaaaaagguauuauuuuuaucuuacuuaugcuuguuacaccuucuauggcaaugcguugcgugggaaucggaucucgagacuuuguggaaggguuguccggggcgacauggguagauguaguguuagaacauggaucuuguguuacuacuauggccaaagauaaaccaacucuagacauugaauuauuaaaaaccgaaguugcaaacccagccguauuacgcaaauuauguauugaagcaaaaauauccaauacaacaacggauuccagauguccaacacaaggugaggccacccuaguagaagaacaagacgcaaauuuugugugccgucgaacauuuguagacaggggauggggaaacgggugcggccuguuuggaaaagguagccugauuacaugugcuaaauucaaaugcguaacgaaacuagaaggaaaaaucgugcaauaugaaaaccuaaaauauucuguaauagucaccguccacacaggcgaccaacaucaaguuggaaaugaaaguacagaacacggaacaacugcaacaauuacgccucaagcucccucaacugaaauacaacuaacugauuauggcgcucuaaccuuggacugcucaccucgaacaggauuagauuuuaaugaaauggugcuacuuacaaugaaagaaaaaucaugguuggugcacaaacaaugguuuuuagaccuucccuugccuuggacaucgggggcaaguacaucacaagaaacauggaauaggaaagacuuauuagugaccuucaaaacagcacaugcgaaaaagcaagaaguaguaguacuggguagucaagagggugcuaugcacacugccuugacuggagccacugagauacaaacuuccgggaccacaacaauuuuugcgggucauuuaaaaugcaggcuaaagauggacaaacuuacucuaaaagguaugucauacguaauguguaccgggaguuuuaaauuagagaaagaaguagcggaaacucaacauggaacaguacuugugcaaauuaaauacgaaggaacagacgcacccuguaaaauaccauucagcacacaagaugagaaaggggucacacagaauggccguuuaauuacagcuaauccaaucguaacggacaaagaaaaaccaguaaauaucgaagcagaacccccauuuggagaaagcuauaucguaauaggcgccggagaaaaggccuuaaaauugucuugguuuaagaaaggauccucaauugggaaaauguuugaggcaacugccagaggagcucgacgaauggccauucuuggagauacagcaugggauuucgggagcauagguggaguuuucacaagugugggaaaacuugugcaucaaauauuuggaaccgcuuauggaguauuguucuccgggguuucauggacaaugaagauugguauuggaguauuauuaacuugguuaggccuaaacucaagaucaacgagccuuagcaugacuuguauagcuguuggacugguaacgcuuuaccuuggaguaaugguccaagcugacucggguugugucauaaauuggaagggacgagagcugaagugcgggaguggcauuuucguuacuaacgagguacacaccuggacagaacaauacaaguuucaagcugauucuccaaaacgacuuagcgcagcuauugguaaagcgugggaggaagguguauguggaauuaggagugcaacccgacucgagaauauuauguggaaacaaauaaguaaugaacuuaaucacauacuguuagaaaaugacaugaaauucaccguugucgucggcgauguugccgggauccuggcccagggaaagaaaaugauuagaccucaaccaauggaguauaaauacucuuggaaaucgugggguaaagccaaaauaauaggagccgauguacaaaacacaacuuuuauuaucgacggucccaauacgccagaaugccccgaugaucagcgagccuggaauaucugggaaguagaggauuacggguuugguaucuuuaccacaaacauaugguugaaauugagggacagcuacacucaagugugcgaucaucgcuuaaugucugccgccauaaaagacucaaaagccgugcaugcagauaugggguauuggauagaaucugagaaaaacgaaacauggaaauuggccagggccucguucaucgaaguuaagacaugcauuuggccuaaaucacauacguuaugguccaauggaguguuagagagcgaaaugauaauaccuaaaauauauggagguccaauaagucaacacaauuacagacccggauauuuuacccaaacagccgggcccuggcaccuaggcaaacuagagcuagauuuugauuuaugugagggaacuacgguaguuguugacgaacauugcgguaacaggggaccaucacucaggacuaccaccgucaccggaaaaauuauccaugaaugguguugucgaucuugcacacuuccuccgcuaagauucaagggagaagacgguugcugguauggaauggaaauacgaccaguaaaagaaaaagaggaaaauuuaguaaaaucaaugguaagugcaggcucaggcgaaguugacucauuuuccuuaggauuacuauguauuucgauaaugauugaggaaguaaugagaaguagguggucuaggaaaauguugaugacagguacucuugcgguauucuuuuuacuaauaaugggucaacugaccuggaaugaccuaauacgucugugcauaaugguaggagcgaacgcguccgaucgaauggguauggggacaacauaucuagcccuuauggcgacauucaaaaugcggccaauguucgcagugggucuguuauuuagacgccugaccagcagagaagugcuauuauuaacuauuggcuugagucucgucgccucaguugaauugccgaacagucucgaagaauuaggugacggguuagcaauggguauuaugauauuaaaguuauuaacggacuuucaaagucaccaauuaugggccacccuucuaaguuuaacauucauaaagaccaccuuuagccuacauuaugcuuggaaaacuauggccaugguccugucuauagucagucuuuuucccuuauguuuaucgacaacuucgcagaaaacgaccuggcuuccaguccuauuaggcagccuaggauguaaaccccugacaauguuuuugauugcagagaacaaaauauggggccgaaaaucauggccuuugaaugaagggauaauggcagugggaauaguaucaauccuacuaaguucucuacuaaagaaugacguaccgcuugcugggcccuuaauagccggugggaugcucaucgcauguuaugucauaucuggaaguagcgcugaccuaucacuugaaaaggcagcugaagucaguugggaagaggaggcggagcacaguggagcaagucauaauauacuugucgaaguacaagaugacgggacaaugaaaaucaaagaugaggaaagagaugacacacuaaccauccuuuuaaaggcgacgcuauuggcggugaguggaguauauccacuuaguauaccugcaacauuauuuguaugguacuuuuggcagaagaagaaacagcggucugguguauugugggauacacccagcccaccggagguggaacgggcgguccuagacgauggaauauacaggauaaugcaaaggggacuucuuggucgaucgcaaguaggugucgguguauuucaagaaaacgucuuccacaccauguggcaugucaccagaggugcaguucuaauguaucaagggaaaagauuagaaccaucgugggcuagcgugaagaaagaccuaauuucauauggagguggguggagauugcagggaucauggaauacaggggaagaaguucaaguaauagcaguggaaccuggcaaaaauccuaaaaaugugcagacagcaccagggacauuuaaaacuucagaaggagaagugggugcaauagcucuagauuuuaaaccgggaacaagcgguaguccuauuguuaaccgugaaggaaaaauaguuggacuuuaugggaauggagugguuacaacuucagguacauauguaucugcgauagcacaggcaaaagcgucgcaggaaggaccucugccugaaauugaagaugagguauuuaggaaaagaaaucuaaccauaauggaccuucaccccggaaguggcaagacaaggagauaucuccccgccauuguacgagaggcaaucaaaagaaaguugcgcacacuaauuuuagcacccacacgugugguagcuucagaaauggcagaggcguuaaaagguaugccuauacgauaccagacaaccgcagugaagucugaacauacuggaaaagaaaucguagacuuaaugugucaugcgacguucaccaugaggcuccuuucuccaguucgaguacccaauuauaacaugauaauaauggaugaggcucauuucacagauccaaguucaauugcugcaagaggauacaucucuacuagggugggaaugggugaagcagcggcaauuuucaugacugcuacuccaccaggaagcguugaagccuuuccgcagucuaacgcugugauccaagaugaagaaagagacauaccagaacgcaguuggaauagcgguuaugaauggaucacggauuuuccagggaaaacagucugguuuguacccucgauuaaaaguggcaaugacauugcaaauugccuuagaaagaauggcaaacgcguaauacaacuuagcaggaaaacauucgauacagaauaccagaaaacuaagaauaaugauugggauuauguaguaacgaccgauauaucagagaugggcgccaauuuuagagcugacagagucauugacccaagaagaugcuuaaaaccuguaauacuaaaagaugggccagaaagagugauacuugcuggaccgaugccugugaccguagcaagugcugcgcagaggcgaggaaggauaggucgaaaucauaacaaagaaggggaccaguauauauauaugggacaaccccuuaauaaugacgaagaccaugcgcacuggacugaagcaaagaugcucuuagacaauauaaacacgccagaagguauaauacccgccuuauuugaaccagaacgggagaaaagcgcagcaauagacggggaguauagguugagaggagaagcacgaaaaaccuuuguagaguugaugcgacgaggugaccugccuguuugguugaguuauaaaguggcuagugaaggauuucaauauucagaccgcagaugguguuuugacggagaacgcaauaaucaggucuuagaagaaaauauggacgucgaaauauggacuaaagaaggagagcguaagaaauuaaggccgcgauggcuggacgcaagaaccuauagcgacccgcuagcucucagagaauuuaaagaauuugcugcaggacgucguucaguuucuggggaccuuauuuuggaaauugguaaacucccucaacauuuaacgcagcgagcacaaaaugcucuagacaaccuuguaaugcuucauaauagugaacaaggaggucgcgcuuaucgacacgcaauggaagaacuaccugauaccaucgagacguuaaugcuucuagcuuugauagcgguuuuaaccggcggcgucacccuguucuuucuauccggaagaggucucggaaaaacuucaauagguuuacucugcgucauggcaagcagugucuugcuguggauggcuucgguggaaccccacuggauagcagccucuauaauauuagaguucuuuuuaaugguccucuugauaccagaaccggaccgacaacggaccccucaagauaaccagcuagcuuacguaguaauaggauugcuguucaugauacucacgguagcagcuaacgaaaugggcuuacuggaaacuacgaagaaagaucucggaauaggucacguugcuguagaaaaccaccaccacgcagcgaugcuggacgucgauuuacauccagcuagcgccuggacacuuuacgcgguagcaacaacaauuauaacgccgaugaugcgacacaccauugagaauacuacagcaaacaucagcuuaacugccauugcaaaucaagcugcuauuuuaaugggauuagauaagggauggcccauauccaaaauggauauuggaguaccauugcuagcucuagguuguuauucacaaguuaauccccucacauuaaccgcagccguauuaaugcuaguagcgcacuacgccauaauugggccugggcuacaggcaaaggcaacacgagaggcccagaaaagaaccgcggcgggaauaaugaagaacccaacuguggacgggauaguugcaauagauuuggauccagugguuuaugacgcgaaguucgagaagcaauuaggucaaaucauguugcuaauacuuuguaccucucaaauauuauuaaugagaacuacgugggcauugugugaaucgauaacacuagccacuggaccguuaacgaccuuaugggaggguucacccgggaaguuuuggaacacuaccauugcagucuccauggcgaauauauuuagaggaucauaucuggcaggagcuggucuugcuuucaguuugaugaagucacuagguggagguagaagaggaacuggggcacaaggagagacacugggcgaaaaguggaaaagacaacugaaucaacuuaguaaaagugaauuuaauacuuauaaaaggucaggaaucauggaaguugauaggucagaggccaaagaaggguuaaaacgaggugagaccaccaaacacgcaguaaguaggggaacggccaagcuacgcugguucguugagaggaaccuaguuaagccagaaggaaaaguaauagauuuaggauguggucgcggaggauggagcuacuauugugcaggacucaagaaagugacugaagugaaaggauauacaaaagggggaccugggcacgaagaacccauaccaauggcuacuuauggcuggaauuuaguuaagcugcauagcgguaaggacguauucuuuauaccuccagaaaaaugcgacacacuacuuugugacauuggggaaucuaguccaaacccgacaaucgaagaagggagaaccuuaaggguacugaaaaugguugaacccugguuacgugguaaccaguuuuguauuaaaauuuuaaauccuuauaugccuucuguuguugaaacuuuagagcaaaugcaaaggcggcacggcggcaugcuugugagaaauccccuaaguagaaacucuacucaugaaauguacugggugagcugcggcacaggaaauauuguuagcgcaguaaacaugacaucuagaauguuauugaaucgauuuacaauggcucacagaaagccgacauaugaacgagacguggauuugggcgcgggcacucggcaugucgccguagaaccggagguugcgaauuuagauauaauuggccaaagaauugagaacauaaaacacgaacacaaaaguacuuggcauuacgaugaagauaauccuuauaaaacaugggcuuaccaugguucauaugagguaaaacccagugggagcgcaucaucgauggugaacggcguuguaaaauuauuaacaaagccgugggauguuaucccgaugguuacacaaauugccaugacagauacgaccccuuucggacaacagcgaguguucaaagaaaaaguagauacccgaacaccuaaagcgaagcggggaacggcacagauaauggagguuacagccaaauggcuauggggauucuugucacgaaacaaaaagccuagaaucuguacacgagaagaauuuacacgaaaaguccgaucuaaugcagccauaggagcuguguucguggaugaaaaccaauggaacagcgcuaaagaagcuguugaagaugagagauucugggaucuaguacauagggaaagagaacugcauaagcaaggaaagugugcaacuuguguguauaacaugaugggaaagcgugaaaagaaacuaggugaguuugguaaggccaagggaucgcgagcgauuugguauaugugguuaggggcuagauucuuggaauuugaagccuugggguuuaugaacgaagaccauugguucucgagggaaaauucccuaaguggaguugaaggggaaggucuacauaaauuagguuacauauuaagagauaucucuaaaauacccggaggaaauauguacgcagaugauacagcugguugggacacaagaauuacagaagaugauuuacaaaaugaagcgaaaaucacugauauaauggaaccggaacaugcacuacuugcaaaaucaauuuuuaaauuaacauaucaaaacaaaguagugaggguucaaaggccagccaaaaauggaacaguuauggauguaauaagucgaagagaucaaagggggagcgggcaaguaggaacuuaugggcucaauacauucacuaacauggaagcgcagcuaauacgacagauggaaucugaaggaauauucaguccaagcgaauuagagacaccaaaccuugccggaagagucuuggacugguuagagaagcaugggguagaaagacuaaagagaauggcaauuucaggagaugauugcgugguaaagccaaucgacgaccgauucgcaacagcucugacagcauugaaugauauggguaagguaagaaaagauauaccccaaugggaaccauccaaaggcuggaacgauuggcaacaaguaccguuuuguucacaucacuuucaccagcuaauuaugaaggaugguagagagauugucguuccaugccgaaaucaagaugaauuaguggggagagcacgggugagucaaggagcagguuggucuuuaagagaaacugcaugucuuggaaagucuuacgcacagauguggcaacuaauguacuuccauagacgagaucugagacuugccgcuaaugcuauuugcagugcagucccagucgauugggugccuacuucucguacuacauggaguauacacgcucaccaucaauggaugacuacagaagauaugcuaaguguauggaaccgaguauggauagaagaaaacccguggauggaagacaaaacccauauuaguucauggggcgacguaccauaucuaggaaagcgggaggaucagugguguggcagcuuaaucgguuuaacagcuagggccacgugggcgacaaauauacaaguagcuaucaaccaaguaagaagacuaaucgggaacgaaaacuaucuagauuacaugacguccaugaaacgauuuaaaaacgaaagugacccagaaggagcauugugguga

SEQ ID NO: 21768 - RNA, 9879 nt, Artificial Sequence
  derived and/or modified CDS sequence (opt6) from DENV-1__GQ199856__SS-prME
ucagugacaauguuacugaugcuaaugccaacugcacuagcauuccauuuaacuacaaggggaggcgaaccccauaugauaguuagcaaacaagaaagaggaaaaucacuucuuuuuaaaacaagugcaggaguaaauaugugcacauugguggcgauggacuuaggugaauuuugcgaagauaccaugacguauaaaugcccgagaauaaccgaagcagaaccagaugauguugauuguugguguaaugcaacagauacguggguaacauacgguacuugcagccaaacgggugaacauaggcgagacaaaagaaguguggcauuagcaccucauguagguuugggucuagaaacaaggacagaaacauggaugucuuccgaaggcgcuuggaaacaaauacaaagaguugaaaccugggcacucagacacccaggauucacgguaauagcccuauuuuuggcccacgcaauaggaacaucgauuacacaaaaaggcauaauuuuuauacuacugaugcugguaacuccuaguauggcaaugcgaugcgucgggauuggaucuagagacuucguagaaggauuaucgggagcaaccugggucgacgucgucuuagaacauggaaguuguguaacaacaauggcaaaagauaaaccuacgcuugacauagaauuacuaaaaacagaagugaccaacccggcaguccuaaggaaacuguguauugaagccaaaauuuccaauacaacuacagauaguaggugcccaacccaaggagaagcaacucucguagaagaacaagaugcaaauuucgugugccgcagaacguucguugauagagguugggguaauggcugcggauuauucggaaaaggcucguuaauaaccugcgccaaauucaaauguguaaccaaacuagaaggaaaaacgguacaauaugaaaacuugaaauacucgguaauuguaaccguacacacaggcgaucaacaccaagucggaaacgaaucgacagaacacggcacaacagcgacaauuacgccacaagcacccucgacggagauacaauuaaccgauuauggagcccuaacuuuagauuguucaccaagaaccggccuugauuucaacgaaaugguauuacuaaccaugaaagaaaaauccugguugguacacaaacaaugguuucuagaucugccuuuaccguggaccucaggugcgagcacaucgcaagaaacuuggaauaggaaagaucuccuaguaacauuuaaaaccgcccacgccaagaaacaagaaguaguaguauuagggucccaagagggggcaaugcauaccgcacucacaggagcuacggaaauacaaaccucuggcacuacuacgauauuugcaggucaucuuaaaugcagacuaaaaauggacaaauugacacuaaaaggaaugagcuacgucaugugcacgggcaguuuuaaacuagaaaaagagguagcagaaacacagcaugguaccgucuuagugcagauuaaauaugaaggaacggacgcaccaugcaaaauucccuucuccacgcaggaugaaaaagguguaacccaaaacgguaggcugaucacagcaaacccgauaguaacagauaaagaaaaacccgucaauauugaagcggaacccccuuucggugaaucauauauuguuauuggcgcgggagaaaaagcauuaaaauuaucaugguucaagaaaggaagcucaauagggaaaauguuugaagcaaccgccagaggagcacgacgcauggcaauucuuggagauacagcuugggacuuuggaucaauuggcggugucuuuaccucgguaggcaagcuaguucaccagauauuuggcacugcuuacggaguauuauucuccggaguuuccuggacaaugaaaauuggaauaggaguauuauuaacuuggcuaggauuaaauucaaggucuacaucuuuaucaaugacauguauagcgguaggccuaguaacauuguacuuaggaguaaugguacaagcugacagcggaugugucaucaauuggaaaggucgagagcuuaaaugugguucaggaauauucguuacuaacgaaguacacacauggaccgaacaauauaaauuucaagcggauagcccaaaaagacuuuccgcagccauaggaaaagccugggaagaaggagucugugguauuagaagugcaacgcgacuagagaacaucauguggaaacaaauaaguaacgaacuaaaccacauucuucuggagaaugauaugaaauucacgguaguagucggcgauguugcaggaauccucgcacaagggaagaaaaugauuagaccucaaccgauggaguauaaauacagcuggaaaucauggggaaaagcaaagaucauaggugcagacgugcaaaauacaacauuuauuaucgaugguccaaacacaccggagugcccugaugaccagagagcauggaacauaugggagguagaagauuauggauucggaauauuuaccacuaacauaugguuaaaacuuagagauucauauacucaaguaugcgaccaucgucuuaugucagcggcgauuaaagauucgaaggcgguccaugcagacaugggguauuggauagaaucggagaagaaugagacguggaaacuugcaagggccagcuucauagaaguaaagacuuguauauggccgaaaagucauacguuguggucaaaugguguacuugaaagugaaaugaucauaccaaagauauauggaggaccuauuucacaacauaacuacagacccggauacuuuacacagaccgcaggacccuggcacuuaggaaaauuagaauuagauuucgauuuaugugaaggcacaacuguagucguagaugagcauugugggaacagagguccuaguuugagaacuacaacaguaacgggaaaaaucauacacgaaugguguugcagaagcuguacgcuacccccacucagauucaaaggcgaggauggauguugguacggcauggaaauucggccuguuaaggaaaaggaagagaaucuuguaaaaaguaugguaucagcggguaguggggaaguugauucuuuuucccuaggauuauuaugcauuuccauaaugauagaagaaguaaugcgauccagauggucuagaaaaaugcugaugacggggacauuggcaguauucuuuuuacugaucauagggcaauugacguggaaugaccuaauacgccugugcauaauggugggcgcaaacgcaagugauagaauggggauggguacuacuuaucuagccuuaauggcgacguuuaagaugagacccauguuugcugucgguuuauuauuucgaagauugacgagucgugaaguauuacuuuugacuaucgggcugagcuuaguagcuucagucgaauuaccgaacaguuuagaagaacuaggggacggguuggcaaugggaauaaugauacuaaaguuguugacggacuuccaaucacaucaauugugggcuaccuuacuuucucuuacguucaucaagaccacauuuagccuacauuacgccuggaaaacaauggcgaugguguuaucaauaguaagccuauucccauuaugccucaguacuacgagucagaaaacuaccugguugccuguucugcucggauccuuaggcugcaaaccacuuacgauguuccuaauagcagagaacaaaauauggggacgaagaagcuggccucuaaaugagggaauuauggcgguuggaauaguaucuauauuauuaucaagucuacucaaaaaugaugugcccuuagcggguccauuaauagcaggagggauguuaaucgcauguuacguaauaagugguaguagcgcagaccucucucuagaaaaggcagcugaagugucaugggaagaagaagcagagcauuccggagcuucccauaacauucuuguugaaguacaagacgacggaaccaugaaaaucaaagacgaagaaagagacgauacauuaacgauacuauugaaagccacuuuauuagcaguaagcggaguuuauccgcucuccauccccgcaacccuauuuguuugguauuuuuggcaaaagaaaaagcaacgaagugggguccuaugggauacgccaucaccgccugaaguugaacgugcaguuuuggaugauggaauauauagaauaaugcaaagaggacuacuaggaaggucucaggucggaguagggguuuuucaagaaaauguauuucauaccauguggcauguuacaagaggggcgguucuaauguaccaggggaagcgucuagaacccagcugggcgagcgucaagaaagauuugauaaguuacggaggcggauggagacugcagggaucauggaauacaggugaggaaguucaaguaauugcggucgagccgggcaaaaauccuaaaaauguacaaacagcaccugguacuuucaaaacauccgaaggagaaguaggagcuauagcauuagauuuuaaacccggcacgucaggaucgccgauaguuaauagggaagguaaaauagucggucuuuauggaaauggaguaguaacuacuagcgguaccuauguaucggccauugcucaggcaaaggcaucacaggaggguccccuaccugaaauugaggaugaaguauuuagaaaaagaaaucuaaccauuauggacuuacauccgggcaguggcaaaacacgcagauauuuaccugcuauaguucgugaagcaauaaaacggaaacuucgaacuuuaauuuuagcacccacgagaguuguagcaucugaaauggcugaggcauuaaaagguaugccuauuagguaccaaacuacggcuguaaagucagaacauacugguaaagaaauuguggauuuaaugugucacgcaacguuuacgaugcguuuguuaucaccaguacgagucccaaacuauaauaugauuauuauggacgaagcacacuucacagauccuagcaguauagccgcuagaggauauaucucuacaagaguagguaugggcgaagcugcagcuaucuuuaugacggcaaccccgccaggaagugucgaagccuucccgcaaaguaaugcgguaauucaagaugaagaaagagauaucccagagcguucuuggaacucaggcuacgaauggauaacagauuuuccagggaaaacaguuugguuuguaccuuccauuaaaagcgguaaugacauagcuaauugcuuacguaaaaauggaaagaggguuauacaauuaagucgaaaaaccuuugacaccgaguaccagaaaacuaaaaauaaugauugggacuacguaguuacaacagacaucagugagaugggggcaaauuuuagagcggaccgcguaauagaucccagaagaugucugaagcccguaauauuaaaggauggucccgaacguguaauuuuagcaggacccaugccggucacuguagcuucagccgcgcagcgacgagguagaauaggccgcaaccauaacaaagaaggggaucaguauaucuacaugggucaaccguuaaauaacgaugaagaucacgcccacuggacugaggcaaaaauguuauuggauaacauuaauacucccgaaggcauaauuccagcccuuuucgaacccgaaagagaaaaaucggcugcaauagauggagaauacagauugagaggggaagccagaaagacguuuguagagcugaugcgacgaggcgauuugccuguguggcuauccuacaaaguagcuagugagggcuuccaauacagugacagaaggugguguuuugauggggaaagaaauaaucaaguguuggaagaaaacauggauguagaaauuuggacuaaagaaggagaaaggaagaaauugagaccacgaugguuagaugccagaacguauagugauccauuagcacuaagagaguucaaagaauuugcugcuggaagaagaagcguuaguggcgaucugauucuagaaaucggaaagcugccacagcaccuaacgcaaagagcacaaaaugcacuugauaacuugguaauguuacauaauagcgagcaaggagguagagcauacagacaugccauggaagaauuacccgacaccauugagacucugaugcuauuagcauuaauagcaguguuaacggguggagucacguuauucuuuuuaucagggagaggcuuaggcaagaccaguauugguuuguuauguguaauggcaucaagcgucuuauuauggauggcaagcguugagccgcacuggauagcagcaucgauaauauuagaguucuucuuaauggucuuacucauuccagagccugaucgacaacggacuccacaagacaaccaauuagcuuauguagugauaggucuauuguucaugauucugacaguggcagcaaacgaaauggggcuguuagagacaaccaagaaagaccuugguauaggacauguagcaguagagaaccaccaucacgccgcaaugcuugauguagaucugcauccagccucggcauggacauuauacgccgucgccaccacaauuauuacuccaaugaugagacauacuauugaaaacaccacagcuaacauuucucuaacagcuauugcgaaucaagcagcaauacuaaugggucuagacaaggguuggcccauuaguaaaauggauauugggguaccucuauuagcacugggauguuauucucaagucaacccgcuaacucuuacagcagcaguguuaaugcuaguugcacauuaugcuaucauuggaccaggcuugcaggcgaaagcgacaagggaagcacagaaaaggacggcugcagguauuaugaaaaauccuaccguagaugguauaguggccauagacuuggacccuguaguguacgaugcaaaguuugaaaaacagcuuggucagauaaugcugcuaaucuuauguacgucgcaaauucuccucaugcgaacgacgugggcuuuaugugaaucaauaacgcuagcuacuggcccuuuaacuacucuaugggaaggaucaccagggaaauuuuggaauacgaccaucgcgguaucaauggcaaauaucuucagagguucuuauuuggccggcgcuggguuggcauuuagccucaugaagucacuuggagggggaaggagggggacaggcgcacaaggcgaaacccuuggcgaaaaauggaaacggcaauuaaaucaacuuucaaagagcgaguucaacacguacaagcguucugguauaauggaggucgacagaagugaggcuaaggaaggauuaaagcgcggagaaaccacuaagcacgccguaucuagagggacggcuaaauuacgcugguucguagagcguaacuucguaaagcccgaagguaaaguaauugaccuaggcuguggacgugggggauggaguuauuacugugcuggguugaagaaaguaacagaaguuaaaggauauacgaaaggugggccuggacacgaagaaccaauucccauggcaacauauggcuggaaucuaguuaaauuacacagcggcaaagacguauucuuuauaccgccagaaaaaugugauacauuauuaugcgauauuggagaaucuucuccuaauccaacaauugaagagggcagaacuuuaagaguacucaaaaugguagaaccauggcuucgaggaaaccaauucuguauaaaaauucuaaacccauacaugccaagcguaguugaaacauuagagaggaugcaacguaaacacggcggaaugcucgugaggaauccucuaucccguaacaguacccacgaaauguauuggguaagcugcgguacggguaauaucguaagugcugucaacaugacuucgaggaugcuuuugaaucgguucacgauggcccauagaaagccaacauaugaaagagauguugacuuaggagcagggacaagacauguagcaguggagccagagguugcaaauuuagacaucauaggccaaagaauugaaaacauuaaacaugaacauaaacuaacguggcacuaugacgaagauaacccuuacaaaacuugggcguaccaugguucuuacgaggugaaaccaucuggaucagcaucaucgauggucaacggcguuguuaaauuacuuaccaaaccaugggacguuauaccuauggugacacaaauugcaaugacagauacaacacccuucggucaacaaagggucuucaaagaaaagguagauacaagaacaccaaaagcaaaacgaggcaccgcacagauaauggaaguaacggcuaaaugguuauggggguuuuugaguaggaacaaaaagccccguaucugcacuagagaagaauuuacuagaaaaguaaggucuaacgcggcaaucggcgcaguauucgucgacgagaaucaguggaacagugccaaagaagccguagaagaugagagauucugggaccuuguucacagagagagggaacugcacaaacagggcaaaugcgcuacgugcgucuacaacaugauggggaaaagagagaagaaacuuggagaguucgggaaagcgaaagggucuagagcaaucugguacaugugguuaggggccagauuucuagaguucgaggcuuugggguuuaugaaugaagaccacugguuuucccgcgaaaauucguugucagggguggaaggggaaggccuucauaaguuaggguacauauugagggacauuagcaagauuccagggggcaauauguaugcggaugacacagcagguugggauacuaggaucaccgaagacgaucuccagaacgaggcaaagaucaccgacauuauggaaccagaacaugcucuuuuagccaaaucgauauucaagcucacauaucaaaacaaggugguaagagugcaaagaccggcuaaaaacggaaccguaauggacgucaucucacgacgugaccaacgaggaaguggacagguaggaacuuauggacuuaacaccuuuaccaacauggaagcucaguuaauuagacagauggaaagugaagggaucuucagcccuucagaacuagaaacgccaaacuuggccggacgcguccuugacuggcuugaaaagcacgguguugaaagauuaaaaaggauggcaauaagcggugaugacuguguaguuaaaccaaucgaugaucgauuugcaacggcucuuacugcacuuaacgauauggguaaagucagaaaagacaucccucaaugggaaccgucuaaggguuggaacgacuggcaacaaguucccuuuugcagccaccauuuucaucaacuuaucaugaaggacggcagagaaauaguagucccaugcaggaaucaagacgaguuggucggaagggcuaggguuucucaaggcgcgggauggucauuaagagaaacagcuugucuagguaagucauacgcacagauguggcaacuaauguacuuucacagaagagauuuaaggcuagcagccaaugcuauauguucagccguaccgguagauugggucccaacgucacguacuaccuggucaauacaugcccaccaccaauggaugaccacggaagauauguuaagcguauggaaucggguuuggauagaggagaaccccuggauggaagauaagacgcacauauccucauggggagacguuccauacuuggggaagagggaagaccaaugguguggcucuuugauuggauuaacagcuagagcgacuugggcgacgaauauucaaguagcgauuaaccaaguacgacguuuaauuggcaacgaaaacuaccuagacuacaugacuucgaugaaacgcuucaaaaacgaaucugauccugaaggagcguugugguag

SEQ ID NO: 21769 - RNA, 9879 nt, Artificial Sequence
  derived and/or modified CDS sequence (opt6) from DENV-1__FJ898427__SS-prME
ucgguuacaaugcuuuugauguuaaugccgacugcccuggcuuuccaccuaacaacuagaggaggagaaccucacaugauugucacgaaacaagaaagagguaaaagccuguuguucaaaacuucugcaggagugaauaugugcacacuaauagcgauggaccucggggaacuuugugaagacacuaugacauacaaaugucccagaaucacagaagcagagccagacgacgucgacugcugguguaaugcaacagauacuugggucaccuacggaacuuguucccaaaccggugaacaccgcagagacaaaagaucaguugcauuggcaccucaugugggucuuggauuggaaacaagaacugaaacauggaugucguccgagggagcauggaagcaaauacaaagaguggagacaugggcacucagacaucccggauuuacagugauagcgcuguuucuggcgcaugccauaggaaccaguauuacucaaaaaggaauaauauuuauauuguugauguugguuacgccuucuauggccaugagaugcguuggaaucgguucgcgagacuucguggaaggauuauccggagcaacuuggguugacguagucuuggaacaugguucauguguuacuacaauggcaaaagacaagccaacucuggauauugaguuacuaaaaacggaaguaacaaauccggcgguuuugagaaagcuauguauagaggcgaaaauaucaaacacaaccacugacucuagauguccgacucaaggugaagcuacacucauggaagaacaagacgcaaacuucguaugucgacgaacuuuuguggaccgcggauggggaaauggauguggacuauuugguaaaggaagucucauaacaugugcaaaauuuaaguguguaacuaaguuagaagguaaaauaguacaauaugagaauuugaaguacucagugaucguuacuguacauacaggggaucaacaucaaguugguaacgaaucaacugaacacggaacuacagcuacuauuacgccacaagccccgacaagcgagauacaacucacagauuacggugcguuaacccuagacuguagccccagaacaggucuugauuucaacgaaaugguuuuauuaacaaugaaagaaaaaucuugguugguacauaaacaaugguucuuagacuugccauuaccauggaccucaggcgccucuaccucacaagaaacuuggaaucgacaagaccuauuaguaacuuucaagacggcacaugcaaagaaacaagaagugguugucuugggcucacaagagggagcgaugcauaccgcucuuacgggcgccacagagauucaaacaucgggaacgacuacuauuuucgcugggcaccugaaaugccgacuuaaaauggauaaacuaacgcuuaaaggcaugaguuauguuauguguacugggucguuuaaauuagaaaaagaaguggcugaaacacagcauggaacaguucucgugcaaauaaaauaugaaggaaccgacgcgccaugcaaaauaccguuuucuacccaagacgaaaaaggggugacacaaaaugggcgcuuaauaacugcuaauccuauaguaacugauaaagaaaaaccagugaacaucgaagcagaaccaccguucggcgagagcuauauuguaauuggugcgggggagaaggcccuuaaacuaaguugguucaagaaagggucaucaauaggaaaaauguuugaggcaacagcccgaggagcaaggagaauggcaauccugggugacaccgcuugggauuuuggaaguguagggggaguuuucacaaguguugguaagcuagugcaucaaaucuuuggaacagcguacggaguacuauucagcggaguuucauggacuaugaaaauaggaaucggaguguuauugacauggcuaggguuaaauaguagauccacaucccuaagcaugacauguaucgcaguggguuuaguuacacuguacuuaggagucauggugcaagcagauagcgguuguguuauuaauuggaaggggagagaauuaaagugcgguucagggauauucguaacaaaugaaguacacacauggacagagcaguacaaguuucaagcggauucuccgaagagguuaagugcggcgauaggaaaggcaugggaagaaggagugugcggaauuaggucggcaaccagacuugagaacauaauguggaaacaaaucaguaaugaauugaaccauauuuuauuagaaaaugauaugaaauucacagucguaguaggcgacgucgugggaauacucgcccaaggcaagaaaaugauacguccacaacccauggaacauaaauacagcuggaaaucauggggcaaggcaaaaaucaucggcgcagacguccagaauacaacuuuuaucauugauggcccuaauacuccagaaugcccugacgaccagcgagcauggaacauaugggaagucgaagauuacggauuuggaaucuuuacgacaaacauuugguuaaaauuacgagacuccuauacccaaguaugugaucaccgacuuaugucugcggcuauaaaagacagcaaagcagugcaugcggacauggguuauuggaucgagagcgagaaaaaugaaacuuggaaguuggcgagggccucuuuuauagaaguuaaaacgugcauauggccaaagucacauacauuauggucgaauggagucuuagaaagcgaaaugauaauaccuaagauauacggcggcccaauaucucaacauaacuauaggccaggguacuuuacacaaacagcagggcccuggcauuuaggcaaacucgaacuagauuucgaccuaugugaaggcacuacugucguuguagacgagcacugugggaaccgggguccuaguuugaggacuacuacagucacagguaaaauaauacaugaauggugcuguagaaguuguacacuuccaccacuuagauuuaaaggagaagacgguugcugguauggcauggaaauacgucccguaaaagaaaaggaagagaaccuagugaaaucuaugguaagcgcaggaagcggagaaguggauucguuuucauuggguuuguugugcaucucaauaaugauugaagaaguaaugagaaguagauggaguaggaaaauguugaugacgggaacauuagccguuuuucuccuacuaauaaugggacaauugacuuggaacgaccuaaucagauuauguauuaugguaggagccaacgcaagugaccgaaugggaauggguacuaccuacuuggcuuuaauggcaaccuuuaaaaugagaccuauguuugcggucggauuauuauuccguagacuaacuucacgugaaguauuauuacugacuaucggucucaguuuaguugcaucuguugaacucccaaauucucucgaagaauuaggagacggucuagcaaugggaauuaugauauuaaaauuacuaaccgauuuccaaucacaucaauuaugggccacacuauuauccuugacauuuaucaaaaccacgcuaucucuacacugcgcuuggaagacgauggcaauggugcuuucaauagccucucuauucccguuaugucuuagcacgaccucgcagaaaacuacauggcuuccgguuuuacugggcucauuaggcugcaaaccccugacaauguuucuaauuacugaaacaaagauaugggggagaaaauccuggccauuaaaugaagguauaauggcuguugguguagucucgauacuucuuaguaguuugcuuaaaaaugaugucccucuugccggcccacucauagccggugggauguuaauagcaugcuauguuauaucaggaagcuccgcggaucugucacuagagaaagcugcugaaguuucuugggaagaagaagcugagcacucuggugcuagucauaauauucuuguugugguucaggaugaugggacaaugaaaauaaaggaugaagaaagagacgacacauuaacuauccuucuaaaagcaacauuauuagcaguaucaggagucuacccacugaguauaccggcaacauuguucgucugguauuuuuggcagaaaaagaaacaaaggagcggcguacugugggauacaccaaguccucccgaaguugagcgagccguccuggaugauggaauuuacagaauaaugcaaagaggauuauuaggacggucacaggucggagucggcguuuuccaggagaacguauuccauacaauguggcacgugacaagaggggcgguguugauguaucaagggaaacggcuagaaccuagcugggcuucggugaagaaagaccucauuaguuacgggggaggguggagauuacaaggaucauggaacacuggggaagaaguacagguuauagcuguggaacccggcaaaaauccuaaaaauguucaaacugcgccaggaaccuuuaaaacuccagaaggggaaguaggagcgauagcacuggauuucaaaccaggaacaucaggaagcccuauaguuaaucgcgaagggaaaauaguaggucucuacggaaaugggguagucacaacaucaggcacguaugugagcgcaauagcucaagcgaaagccagccaggaaggaccacuaccggaaauugaggaugagguauuccgcaagcgaaauuuaacuauaauggauuuacauccaggcagcggaaagacacgcagguauuuacccgccauaguuagggaggcgauuaaaagaaaauuacggacacuuauuuuggcaccaacacguguuguggcgucagaaauggcugaagcacugaagggaaugccaauaagauaucaaacgacggcagucaagucugaacacacagguaaagaaauuguagacuuaaugugccacgcaacuuuuaccaugcgucuacuaucacccguaagaguaccgaauuacaacaugauaauaauggaugaagcgcauuuuacagacccaucgaguauagcggcaagaggcuauauuaguacccgaguagggaugggagaggccgcagcuaucuuuaugacggccacuccgccagguaguguagaggcauucccgcaaucgaaugcaguaauacaggaugaagaacgugauauacccgaacgaucguggaauagugguuaugaguggauaacggauuucccugggaagacuguaugguuuguuccaaguauuaaaucaggcaaugauaucgcaaauugucugaggaagaauggaaagcgcguuauucagcuaucaagaaaaacauucgauacagaauaucagaagacuaagaauaaugacugggauuauguuguaacgaccgauauuuccgagaugggagcaaacuuucgcgcugauagaguaauagauccuagaaggugcuugaaaccgguuauacuaaaggauggacccgaaagagugauccuggcugggccgaugccuguaacuguugccucagccgcgcaacgaagaggaaggauaggacgcaaucauaauaaagagggagaccaauauauauauaugggucaaccuuugaacaaugaugaggaccacgcgcauuggacagaagccaaaaugcuucuugacaacaucaacacuccggaaggcauaauaccugcgcuuuucgaaccggaaagagaaaaaucggcggcuauugacggagaguaucguuuacgaggagaagcaaggaagacauuuguugaacuaaugcgccgaggugacuuaccgguuugguuauccuacaaaguagcuucggagggcuuccaauacagugauaggcggugguguuuugauggugagaggaauaaccagguuuuagaagagaauauggacguagaaauauggacaaaagagggugagaggaagaaacuacgaccucgaugguuggaugcuagaacguauagugacccacuugcuuuacgggaguuuaaagaauuugcagcugggagacgaagcguaucuggggauuuaauuuuagaaauugguaaacugccgcaacaucucacucaaagagcucaaaaugcacuagauaacuuaguaauguugcauaacuccgaacaaggagggagggcuuaucggcacgcuauggaagaauugccugacacgauagaaacacucaugcuacucgcguuaauugccguuuuaacuggcggggugacguuauucuuuuuaucuggccgaggguuagggaaaacaucgauaggucuacuauguguuauggcauccucggucuuauuguggauggcaucgguagaaccacacuggauagcugccaguauaauacuagaauuuuuccuaaugguauuguugauaccagaaccggaucgacaaaggaccccgcaagauaaucaacucgcguauguuguuauaggacuuuuauuuaugauauugacaguugccgcaaaugaaauggggcugcuagaaaccacuaagaaagacuuagggauaggucacguagcaguagaaaaucaccaccacgcuacgaugcucgauguugaucugcauccagcuucugcauggacgcuauaugcaguugcaacuacuauaauaacuccaaugaugaggcacacaauagagaacacuaccgcgaauauaucccuaacugccaucgcaaaucaagccgcaauucuaaugggucuggacaaaggcuggcccauuagcaaaauggauauaggcguaccacuauuggcucuaggaugcuauucacaaguaaauccacuaacacugacugccgccguuuuaaugcuuguagcccauuaugcaauaauaggaccaggacugcaagcuaaagcuaccagagaagcucagaaaagaacugcagccgggauuaugaaaaauccgaccguagaugguauaguagcaauugaucuagauccaguaguauacgaugcaaaguucgagaaacaauuaggacaaauaaugcucuugauacuaugcacaagucagauauuacuaaugcgcacuacaugggcacuuugugaguccauuacucuugcgacugggcccuuaacaacauuaugggagggaucgccagggaaguucuggaacacuacgauagcaguaaguauggcuaauauuuuccgagguuccuauuuagcgggagcagggcuugcuuucucacuuaugaaauccuuaggcggcgggagacguggaacuggugcucaaggagaaacacugggugagaaauggaagcgucaacugaaucaacuaucuaaaagugaguuuaacauuuacaaacguagcggaauaauggaaguagaucgaucagaggcuaaagaagguuuaaaaagaggagaaacuacacgacaugcaguaucgcgugguacugcuaagcuaagaugguuugucgagagaaaccuaguuaaaccugaggguaaaguaauagaccuuggcuguggacgaggagguuggagcuauuauugugcaggucuuaagaaaguaacggaagugaaagguuauacaaagggugguccuggucaugaggaaccaauaccaauggcaacauacgguuggaaccuagugaagcuacacagugguaaagauguauucuuuacuccucccgaaaaaugugauacucugcuuugugacauaggagaaagcagcccaaacccaacuaucgaggagggccgaacucuccgagucuuaaaaaugguugaaccaugguugcgcgggaaucaauuuuguauaaaaauacuuaacccauacaugccgaguguaguagagacauuagagcaaaugcaaagaaagcauggaggcauguuaguacguaaucccuuaagcagaaauucuacacaugagauguauuggguuaguuguggaacgggaaacauuguuucagcaguaaacaugacaaguagaauguuauugaaccgauuuacaauggcacauagaaaaccaacauacgagcgagauguagaccucggagcagggacuagacauguugcgguugaaccagaaguagcgaaucuggauauuauaggucaaaggauugaaaauauuaaacaugaacauaaaagcaccuggcauuaugacgaagauaacccauauaaaacuugggcguaucaugguucauacgaaguuaagccaagugggagugccucaucaauggugaauggcgucguaaaacuucuuacuaaaccgugggacguaauaccaaugguuacacaaauugccaugacagauacgacuccguuugggcaacaacgcgucuuuaaagaaaaaguugauacuagaacaccaaaagcgaagagagggaccgcucaaauuauggaaguaaccgccagaugguuauggggauuucuaucgcggaauaagaaaccgaggauauguacuagggaagaguucacacgcaaggugagaaguaaugcagcaauuggcgcagucuucguugacgaaaaucaauggaacucagcgaaagaagcaguagaagaugaacgauuuugggauuuaguacaaaaagaaagagagcuccauaaacagggaaaaugcgcaacuuguguguauaauaugaugggcaaaagagagaaaaaguuaggagaauuugggaaagcaaaaggcucuagagcgauaugguacauguggcuuggagcucgauuccuugaguucgaggcuuugggcuucaugaaugaggaucauugguucucacgcgagaacaguuuaucagguguugagggcgaagggcuucacaaguuaggauauauauuaagggauauaagcaaaauucccggaggcaauauguaugcugaugauacggccggaugggauacaagaaucacugaagacgacuuacaaaacgaagcuaagauaacagauauuauggaacccgagcacgcacuacucgcgacgucaauauucaaacuaacauaccaaaacaaaguagucagaguccaaagaccagcuaaaaacggaacaguaauggauguuauaaguagacgagaccaaagggguaguggucaaguggggacauauggucugaauacauucacaaacauggaggcacaguuaauuaggcaaauggaaucugaaggcauauuccuaccaagugaauuggaaacaccaaauuuagcugagagggucuuggauugguuggagaaauauggaguagaaagacuuaaaaggauggcgauaaguggcgacgacugcguaguaaagccuauagaugaccgguucgcaacagcucuuacagcguuaaacgacaugggaaaagugagaaaagauauuccucaaugggagccaaguaaaggauggaaugauuggcagcaaguucccuuuugcucacaccauuuucaucaauuaaucaugaaagacggcagagaaauaguugugccgugucgaaaccaagaugagcuagucggcagagcaagagugagccaaggagccggauggagucuaagggaaacagcauguuuaggaaaauccuaugcucaaauguggcaacugauguauuuccauagaagggaucuucgacuggcggcgaaugcaauauguagugcuguaccaguagacuggguaccaacuagccggacaaccuggucgauucaugcgcaucaccaauggaugaccacagaagauauguuaaguguauggaauaggguuuggaucgaagaaaacccauggauggaagauaagacccauguaucaagcuggggugauguacccuaucucgguaagagagaggaccaauggugcggaaguuuaauuggucuaacggcccgagcaaccugggcaaguaacauacagguagcuauuaaucaaguacgacguuugauaggaaaugagaauuauuuagacuauaugacaagcaugaaaagguucaaaaaugagggagaucccgaaggcgcauugugguaa

SEQ ID NO: 21770 - RNA, 9879 nt, Artificial Sequence
  derived and/or modified CDS sequence (opt6) from DENV-1__JF937599__SS-prME
agcguuaccauguugcucaugcuaaugcccacugcccuggcuuuucacuuaacggcaagagggggugaaccacauaugauaguuagcaaacaagaaagaggaaaaucguuauuauucaaaacuucggccgguguuaauauguguacgcugauagcaauggauuuaggcgaauuuugugaagauacgaugacauauaaaugcccuagaauuaccgaagcugaacccgacgauguggacugcuggugcaaugcaacagauacauggguuaccuaugggacaugcucgcaaacaggagaacaucgacgcgacaaacggagcguugcgcuggcaccccauguaggauugggcuuggaaaccagaacugaaacauggaugaguagcgaaggugcauggaaacagauucaacguguagaaacuugggcacuucgacauccuggguucaccgugauugcgcucuuuuuagcacacgccauugggacaucaauaacacaaaaagguauuauuuucauauuacugauguuagucacuccuucuauggcaaugagauguguugggauaggaagccgugauuuuguugaaggauugagcggagcaacauggguagacguaguccucgaacauggaucaugcguaacaaccauggcuaaagauaaacccacacuugacauagaacuguugaaaaccgaagucacaaauccagccguccuccgcaaauuauguauagaagcuaaaauuucuaauacaacaacagacucuagaugcccgacucaaggagaagcaacauuaguggaggaacaggaugccaacuuuguaugucgaagaacguuuguagauaggggaugggguaauggcuguggucuuuuuggaaaagguagcuuaauuacuugcgcuaaauuuaaaugcguaacaaaacuggaggggaaaauagugcaauacgaaaaccugaaauauucaguuauagugacagugcauacaggcgaucaacaucagguggguaaugaaucaacagagcauggcacaacagcuacaaucacgccucaagcaccaucgacagaaauucaacuuacugacuauggagcacuaacucuugauuguaguccacgaaccgguuuggauuuuaaugaaaugguccuucuaacgaugaaggagaaaaguugguuagugcauaagcagugguuucuagacuugccauuaccauggacgucuggugcaagcacaucgcaagaaaccuggaaccgucaagauuugcucguaaccuuuaaaacugcacaugcaaagaaacaagaaguagucguucuuggaucacaagaaggagcgaugcacacugcauuaacaggagcgacggaggugcaaacaagcggaaccacuacgauauuugcugggcaccuuaaaugucgauugaaaauggacaaauugacucuaaaagguauguccuaugugauguguacugguucauuuaaacuugaaaaagaaguugccgaaacucaacauggaaccguguugguccaaaucaaguaugaaggaaccgacgcaccauguaaaauaccuuuuaguacccaagacgaaaaagguguuacccaaaacggucgguuaauaacagccaauccgauaguuacggacaaagaaaaacccguaaauauagaagcagaaccgccuuuuggggagucuuauauugucauuggagcaggagaaaaggcuuugaaguugucuugguucaagaaagggucuucaauuggaaaaauguuugaggccacugcgagaggggcacgaagaauggcgauccucggugacacggcuugggauuucggaagcauuggaggcguuuucacaucugucgggaaguuagugcaccaaauauucgggacggcauauggagugcuauuuucgggaguuuccuggacaaugaaaauagguauugggguguuauugacaugguuggguuuaaauaguagaucaacaucacugucuaugacuuguauugcagucggccucguaacucuauaccuaggaguuauggugcaagccgauaguggcugcguuauaaauuggaaagguagggagcuaaaauguggcuccggaauauucgucacaaaugaagugcacacuuggacugaacaauauaaauuucaagcggacucgccaaaaaggcuaucugcagcgauaggaaaagcaugggaagaagggguuuguggaaucagaagcgcuacgcgucucgagaauauaauguggaaacagauaagcaaugaacuaaaucacauacugcuagaaaaugacaugaagcuaacagucguuguuggagauguagcgggcauacuggcacaaggcaagaaaaugauaagaccacaaccuauggaauacaaauacaguuggaaaagcuggggcaaagcaaagauuauaggagcugacguacaaaauacaacuuucauaauagauggucccaauacaccagaaugcccggaugaccaacgugcauggaauauaugggaaguugaggacuaugguuuugggaucuuuacaacaaacauuuggcuaaaauugagagacucauauacacaaguaugugaucaucggcugaugucugcugcgauaaaagauucaaaggcgguccaugcagauaugggauauuggauugagagcgaaaagaaugaaacauggaaacuagcucgugcaucuuuuauagaggucaagacgugcauauggccuaaaucgcacacccucuggagcaacggugugcuagagucagaaaugauaauuccuaaaauuuauggaggaccaauaagccaacauaacuacagaccaggcuauuucacacagacagccggaccauggcauuugggaaaauuagaacuagacuuugaccuaugugaaggaacuacuguagugguagaugaacacugugguaaucgcggacccucguuacgaacuacuaccguaacaggcaaaaucauacacgaaugguguugccggaguugcacacugccuccacuaagguucaaaggagaagacggauguugguacggaauggaaauaagaccugucaaggaaaaggaagaaaauuuagucaaaagcaugguuagcgcagguaguggugaagucgacaguuucagccuaggguuacuuuguauaaguauaaugaucgaggaaguaaugcggagucgguggaguagaaaaauguuaaugaccgggacacuagcuguauuuuucuuguugauaaugggacaacuaaccuggaaugauuugauccgcuuaugcauaauggugggugcaaaugcaagugauaggaugggaauggggacuacauauuuagcccuuauggcuacauucaaaaugagacccauguuugcuguuggguuacuauuuagaagguuaaccucaagagaaguuuuacuccuuacgauagggcucagucuaguggcgaguguugaguugccaaauucucuugaagaauuaggugauggacuugcuaugggaaucaugauauuaaagcuauuaacugacuuccaaucacaucaacuaugggcaacgcuucucucauuaacauucauaagaacuaccuuuagcuuacacuaugcuuggaaaacaauggcuaugguacuaagcauaguaucacuuuuccccuuaugccuauccacgaccucucagaaaacgacauggcuuccaguucucuuaggaagucugggauguaagccuuugacaauguuccugauugcugaaaacaaaauuugggggcgaaagagcuggccauugaacgaaggaauuauggcaguaggaaucgugaguauacuuuugucuucuuuguuaaagaacgauguaccccuugcuggcccuuuaaucgcaggaggaaugcuaauagcauguuaugucauuagugguucgucugcugacuugagcuuggagaaggcggcagaaguaaguugggaggaagaggcggagcauucuggugccagucacaacaucuuaguagaggugcaagaugacggaacuaugaaaauuaaagaugaagaacgcgacgauacauuaacuauauuauuaaaagcaacccuguuagcgguaucggguguauacccacuaucaaucccagcuacguuauuugucugguacuuuuggcagaagaagaaacaacggaguggcguuuuaugggauacaccuucaccucccgagguggagagagcaguacuugacgacggcauuuacagaauuaugcaaagggguuuauuaggccgaagucaaguuggugucggaguuuuucaggagaaugucuuccauacaauguggcacgucaccagaggagcggucuuaauguaucaaggaaagcgauuggaaccuucaugggcuucaguuaagaaagacuugauaaguuauggcggugguuggagauuacaaggaucguggaauacaggugaagaaguacaaguuauagcagucgaacccggaaagaauccgaaaaauguccaaacggcgccaggaaccuuuaagacaagcgaaggagaggucggagccaucgcuuuggauuucaagccgggaacaagugggagcccuauaguuaaucgagaagggaagaucguuggcuuauacgguaauggaguaguaacgacaucaggaacuuacgucagcgcaauagcacaagcaaaagccucucaagagggaccacuaccugagauagaagaugagguuuucaggaaaagaaaucuuacaauuauggaccuacauccgggaucgggcaaaacccgucgcuaucuuccagccauuguuagagaagcuaucaaaagaagacucagaacucuuaucuuagccccaacaagaguugucgcgucggagauggcagaagcauugaaaggaaugccaauuagauaccaaacaacggcggucaaaucugaacacacaggaaaagaaauagucgauuuaaugugucaugcaaccuuuacaaugcgguuguugucaccuguucgggucccuaauuauaacaugauaaucauggacgaagcgcacuuuacugacccgaguuccaucgcagccagagguuacauuuccacgaggguugggaugggcgaagcagccgcuaucuucaugacagccaccccaccgggauccguagaagcauucccacaauccaacgcaguuauacaggacgaagaaagagauauaccagaacguucguggaacucuggcuacgaauggauaacugauuuccccggaaaaacuguaugguuuguccccucgauaaagucagggaacgauauagccaauugcuugaggaaaaacgggaaaagaguuauacaguuaucacguaagacuuuugacaccgaguaucaaaagacgaaaaacaacgacugggauuauguuguaaccacugacauaagcgaaaugggagcuaacuuuagagccgauagagucaucgacccuagacgaugucuuaaaccuguaauuuuaaaagauggccccgagagaguuauuuuagccggaccaaugcccguaacaguugcaagugcugcgcaaagaagaggaagaaucggacguaaccacaacaaggaaggugaccaauauauauauaugggccagccacuaaacaaugacgaagaucaugcccauuggacggaagcuaaaaugcuacuggacaauaucaauacuccggaaggaauuauaccagcacucuucgagccugaaagggagaagagugcagccauugauggugaauaucgacugagaggggaagccagaaaaaccuuugucgaguuaaugcgacguggugaccuaccgguuugguugaguuauaaagucgcaagugagggauuucaauacuccgaccggagaugguguuuugacggagaacguaacaaccaaguuuuagaagagaacauggacguagaaauauggacuaaagaaggggaacgaaagaaacucaggccaagaugguuggaugcaagaaccuacucagauccauuagcacuccgugaauuuaaggaguucgcagcuggaagacguucaguaaguggggacuuaauuuuagaaauagguaaauugccccagcauuuaacccaaagggcacagaaugcauuggauaaucuugugaugcuacacaauagugaacaaggagguagagcauaucgccaugcaauggaagaguugccagauacaauugagacacuaaugcuauuagcacuuauugcuguucuaacaggaggggugacuuuauuuuucuuauccggaaggggauuaggaaaaacauccauuggucuacuaugcgucauggcaagcaguguuuuauuauggauggccucugucgagccacacuggauugccgcaucgauaauucucgaguucuuucuuaugguccuacugauuccggaaccagaucgacaaaggaccccgcaagauaaccaauuagccuauguaguaauaggcuuauuguucaugauauugacaguagcggcaaaugaaaugggacuuuuggaaaccaccaagaaagacuuaggcaucggccacguagcaguagaaaaucaucaucaugcugcaaugcuugacgucgaccuacacccugcaucagcuuggacacuuuaugcuguagcuacuacaaucauaacgccaaugaugagacauacaauugaaaauaccaccgccaauauaagucuuaccgccauugcaaaucaagcggcuaucuugauggguuuagauaaaggcuggccaaucucgaaaauggacauuggcguaccguuacuugccuugggcuguuacucacaagucaauccccuaaccuugacagcggcugugcuaaugcuagucgcacauuaugcgauuauagggccuggacuccaagcuaaggccacucgagaagcucaaaaacgaacugcugcaggaaucaugaaaaaucccacagucgauggaauuguggcuauagauuuagauccaguuguauacgacgcaaaauuugaaaaacaguuagggcaaaucauguugcuaauauuauguacuagccagauauuacuaaugagaacgacaugggcacuaugcgaaucaaucacuuuagcuaccgguccuuuaacuacucucugggaaggcucgccggggaaguucuggaauacgacaauagcugucucaauggcuaauauauucagggggucauauuuagcaggagccggauuagcuuuuucccuaaugaaaaguuuaggagggggcagaagaggaacaggugcacaaggggagacuuuaggugaaaaauggaaacgacaacucaaucaauuauccaaaccugaguuuaacacauauaaaaggagcggaauaauggaaguugaucguagugaagccaaggaaggcuuaaaacguggugaaacaaccaaacacgcgguaucuagagguacagcuaaacugcggugguucguagagcggaacuugguaaagccugagggaaaagucauagauuuggguugcggucgggguggcuggagcuauuacugugcuggacuaaagaaaguaacggaaguuaaaggguacaccaaaggaggucccggccacgaggaaccaauuccaauggccacuuauggauggaaccuaguaaaacuacacucuggaaaagacguauuuuucauaccgccagagaaaugugauacguugcuuugugauauuggagagagcagcccuaauccaacgauugaagaggggcguacuuugaggguacugaagaugguagaaccaugguuaagggguaaucaauuuuguauuaaaauuuuaaaucccuacaugccaucaguuguggaaacucuggaacaaaugcagagaaaacacggaggcaugcuaguaagaaauccacuaucacguaacucaacacacgagauguauuggguaucuuguggaacagguaauauaguauccgcugucaauaugacgagucggaugcuacuaaacagguucacaauggcucaccgcaaacccacguaugaaagggacguugaucuaggagcuggaacacgucacguugcaguagaacccgaaguagcaaauuuagauauaauaggacagcgcaucgaaaauauuaaacacgaacacaagucaacuuggcacuacgaugaggauaacccauacaaaacaugggcuuaucaugggucuuaugagguuaaaccuaguggaagcgcgaguucuaugguuaacggaguaguuaaacuacucacaaaaccuugggauguaauaccuauggugacucaaauagcuaugacugacacaacaccuuucggacaacaaagaguauucaaagaaaaaguugacacaagaacuccuaaagcaaaaagggguacagcucagauaauggaagugacagcuaaaugguuauggggauuuuuaaguagaaacaagaaaccacgcauauguacacgcgaagaguucacaagaaaaguacgcagcaacgcggcgauaggggcuguauuuguagaugaaaaccaguggaacucagcaaaggaagcgguugaagaugaacgcuucugggaccuaguacauagagaacgugaauugcacaagcaaggaaaaugcgcuacauguguauacaacaugaugggaaagagggagaagaaacuuggggaauuugggaaagcuaaaggcucaagagcgauuugguauauguggcucggcgcaagauuuuuagaauuugaagcucuaggcuuuaugaaugaagaccauugguucucccgugaaaacucgcucuccgguguagaaggagagggguuacacaaauuggguuacauccuacgugacaucucaaaaauuccagguggaaauauguaugccgacgacacagcugggugggacacgaggauaacugaagaugaucugcagaaugaggccaaaauaacugauauaauggagccagaacacgcuuuacuugccaagaguauauucaaguuaacauaccaaaauaaaguuguaagaguucagcgcccugccaaaaauggaacgguaauggacguuauaucacggagggaccaaaggggaucuggacaaguaggcacuuauggauuaaauacuuuuacaaauauggaagcucaacuaauaaggcagauggaaucagaaggaauauuuucaccaagcgaauuggaaacgccaaauuuagcggggagaguacuagauuggcuagaaaaacacggcgucgaacgacuuaagaggauggcuauaagcggcgaugauugcguaguuaagccaauagacgauagguucgcaacagcgcugacggcccugaacgacaugggcaaaguaaggaaagacauaccgcaaugggaaccaucaaaaggcuggaacgacuggcaacagguaccauuuuguucacaccacuuucaucaacugauuaugaaagacgguagagaaauuguuguaccuugcaggaaucaagacgaauuaguaggacgggcacgggugucucaaggcgcaggguggagucuacgugagacggcgugcuuggguaaaucauaugcucaaauguggcaauugauguacuuccaucgucgagauuuacggcucgcugcaaaugcaaucuguagugccgucccuguagauuggguaccuacaucaagaacaacgugguccauccaugcacaucaucaguggaugacaacugaggauauguuauccguauggaacagaguauggauagaagaaaaucccuggauggaggacaaaacucauguaaguagcuggggcgacguaccuuaucugggaaaacgagaggaucaauggugcgguagucuuaucgguuuaacugcgcgcgcaacaugggcuacuaacauccaaguagcuauuaaucagguucgaagauuacuuggaaaugaaaauuauuuagacuauaugacuuccaugaaaagauuuaaaaacgaaagcgauccggaaggcgcucuaugguag

SEQ ID NO: 21771 - RNA, 9879 nt, Artificial Sequence
  derived and/or modified CDS sequence (opt6) from DENV-1__FJ898431__SS-prME
ucaguaacaauguuauuaauguuaaugccaacggcauuagcguuccaucuaacgaccaggggaggagaaccucacaugauuguaaguaaacaagaaagggguaaaucgcuacucuucaaaacaagugcaggcguaaauauguguacauugauugccauggaucuaggugaguucugugaagacacuaugacuuauaaaugucccagaauaacggaagcggaaccggaugauguagacugcuggugcaaugcuacagacacaugggugaccuauggaaccuguagccaaaccggggaacacaggagagacaaacggucaguggcguuagcaccucacgucggccuaggauuagaaacacguacagaaacauggauguccagugaaggagcuuggaaacaaauacaaaggguggaaacaugggccuuacgccauccgggcuucacaguaauagcacuauuuuuagcucacgcaauagggacgucgauaacccagaaggguauaaucuuuauacuauuaauguuaguaacccccucaauggcuaugagaugcguagguauuggaaguagagauuuuguagaaggucugaguggggcgacauggguggacgucgugcuagaacacggaagcuguguuaccaccauggcaaaagacaaaccaacauuagauauugaacuuuuaaaaacugaagugacaaaucccgcaguauuaaggaaacuuugcauagaagcaaaaauauccaauaccacgacagauucaagauguccaacucaaggagaagcgacuuuggucgaagaacaagaugcgaauuuuguaugccgaagaacauucguugacagggguuggggaaauggaugcggucucuuuggaaagggaucucuaauuacuugcgcaaaauuuaaaugcgugacaaagcuggaaggaaaaacaguacaauaugagaaucuaaaauauaguguaauaguuacagugcacaccggagaccaacaucaaguggggaaugagucaacagagcacgguacuacugcgacgauaacaccacaggcccccaguacagaaauucaauugacugacuacggugcgcuaacacuagacuguucuccgcgaaccggccuggauuuuaacgaaaugguguuauuaacuaugaaggaaaaaucauggcucguacacaaacaaugguuccuugacuuaccguuaccauggacuucgggagcaucaacaucacaagaaacauggaauagaaaggaucuucuuguaacauucaaaacugcacaugcgaaaaagcaagaagucgugguuuuagguucacaagaaggggcaaugcacacagcauuaacaggugcaacugaaauacaaacuucuggaacuaccacuauauuugcggggcaucugaaauguagacuuaaaauggacaaauuaacauuaaaaggaaugucuuacgugaugugcacgggcaguuuuaaauuagagaaagaaguagcggagacucaacaugguaccgugcuugugcaaauaaaguaugaaggaacggacgccccuugcaaaauaccuuucuccacgcaagaugaaaaagguguaacacaaaacgggcgauuaaucacagccaacccuauaguuacagauaaagagaagccaguuaauauugaagcggaaccuccauucggcgagaguuauaucguuauaggagccggugaaaaagcucuuaaauugucaugguucaagaaaggaagcaguauagggaaaauguuugaggcaacugcaagaggagcgaggagaauggcaauuuuaggagacacugcaugggauuuuggcagcauagggggcguguuuaccucaguaggaaaauuaguucaucaaaucuuuggaaccgccuacggugugcuguucucugguguaaguuggacuaugaagauuggaauagggguauuacuaacaugguuaggacuaaauucgaggucaaccagccucuccaugacauguauagcagucggauuaguaacucuguaucuaggggugaugguacaagcagacucaggguguguaauuaauuggaaaggaagagaauuaaaaugcgggucaggaauauucgucacuaaugagguucauaccuggacagagcaguauaaguuucaagcggauagucccaaaagacuaucagcagcgauugguaaggcuugggaagagggggucugcgguaucaggucggcgacacgcuuagaaaauaucauguggaaacaaauaagcaacgagcucaaucacauauuauuagaaaacgauaugaaauuuacuguggucguaggcgacgucgcuggaauauuagcucaaggcaagaaaaugauaaggccacaaccuauggaauauaaguauagcuggaaaaguuggggaaaagcaaaaaucauuggcgcagaugugcaaaacacaacguuuauaaucgauggcccuaacacgccagaauguccagacgaccaaagggcuuggaauauaugggaaguagaagauuaugguuucggcauuuuuacgacaaauauuugguuaaagcuaagggauucauacacacaaguaugcgaucacaggcuaaugagugccgcaauaaaagauagcaaagcaguucaugcagacauggguuacuggaucgaaagugagaaaaacgaaacuuggaaacucgcaagggcgucauuuauagagguaaagacaugcauauggccaaagagucauacucucuggucuaauggcguuuuagaaagugaaaugaucauaccaaaaauuuauggagguccaauaucacaacauaauuacagaccaggauauuucacccaaacagcagggccauggcacuugggcaaauuggaacuugauuucgaucuaugcgaagguacaacuguaguaguggacgaacauugcggaaaccguggacccagcuugagaacgacaacaguaacaggaaaaaucauucacgaauggugcugccgaucuuguaccuuaccaccuuuaagguucaagggggaggaugguuguugguaugguauggagauuagaccuguuaaggaaaaagaggaaaaucuuguaaaauccaugguaagugcgggcaguggagaagucgacucuuucagccucgguuuauuaugcauaaguauuaugaucgaagaaguuaugcgauccagauggagccgcaaaauguuaaugacagguacucuagcugucuuauuucuauuaauaauggggcagcuuacguggaacgauuuaauuaggcucugcauuauggucggagcgaacgccucagaccggauggguauggggacaaccuacuuagcguuaauggcaacuuuuaagaugaggccaauguuugcggugggguugcuauuuaggcgucuaacuucacgagaggucuuauuauugacaauuggccucaguuuaguggcaagugucgaauugccuaacucgcuagaagaauugggugauggguuagccauggguauaaugauucuuaaacuacucaccgauuuccagucacaccaauugugggcaacauuauuaucauuaacauuuauaaagaccacauucucacuccacuaugcuuggaaaaccauggccauggugcucucgaucguuagucuguuuccacucugucuaucaacuacaagucaaaagacuacuuggcuccccguacuauuagguaguuuaggauguaaaccccuaacgauguuuuuaauagcagaaaauaaaaucuggggucgaaaaaguuggccuuuaaacgaaggaauaauggcuguaggcauaguauccauuuuacuuucaagucuacuuaaaaaugacgugccauuagccggaccccuuauagcuggugggauguugauagcaugcuauguaauuucagggagcucggcggacuuaagucuagagaaagccgcggaaguuuccugggaagaggaagcagaacacaguggcgcuagucauaacaucuugguagaaguacaagaugacggaacaaugaaaauaaaagaugaagagagagaugauaccuuaacuauucuacuaaaagccacccuccuggcgguaaguggaguauauccacuauccauaccugccacuuuguucgugugguauuucuggcagaaaaagaaacaaagaagcggaguguuaugggauacacccagcccaccggaaguugaaagggcaguauuagacgauggaauauaccgcauaaugcaaagaggccuacuaggaagaagucaagugggaguaggaguuuuccaagaaaacguauuucauaccauguggcacgugacuagaggagccgucuuaauguaccaggguaagcgacuagaaccgucgugggcaagugugaagaaagacuugauauccuacggugguggauggagauuacagggaucauggaacacaggagaggaaguccaaguaauagcagucgagccaggcaagaacccuaagaauguacagacagccccugguacauuuaaaacaagcgaaggggaaguuggcgcgaucgcacucgauuuuaaaccgggaacaagcggaucuccuauaguaaaccgugaggguaaaauuguuggauuauauggaaacggcgugguaacaaccucaggaacguacguaagugcgauagcacaggccaaggcaagucaagagggaccguuaccagaaauagaggaugaagucuucaggaagagaaauuuaaccauuauggauuuacacccugguaguggcaaaacgagacgauauuuacccgcaauaguaagagaagcaaucaaaagaaaauugcgaacacugauacuagcaccgacgagagucguggcaagugaaauggcugaagcauuaaaaggaaugccuauacgauaccaaacaacagccgugaaaucagagcacacggggaaggaaaucguagaccuuaugugucaugccacuuuuaccaugcgucuuuugucaccaguccgagugccuaauuacaauaugauaauaauggacgaggcacauuucacagauccuucgaguaucgcugcgcgugguuacauuucuacaagaguaggcaugggagaagcagccgcaauuuuuaugacggcgacuccaccugguucuguagaagccuuuccucagucaaacgcggugauacaagaugaagagagagacauaccagaacgaaguuggaacuccgguuacgaauggauaacugacuucccaggcaaaacagugugguuuguaccaaguauaaaauccggaaaugauauugccaauugccugcgcaaaaacgguaagcgagucauccaacuuaguagaaaaacuuuugacacugaauaccagaaaaccaaaaauaaugauugggauuauguuguuacaacagauauuagcgaaaugggagcuaacuuuagagccgaccgugucauagacccuaggaggugcuugaaaccaguaaucuuaaaagauggaccggaaagaguuauauuagcugggcccaugccugugacaguggcaagugcagcacaacgacguggacguauagggcguaaccauaacaaggaaggagaucaauacauauacauggggcaaccacugaacaaugaugaggaccacgcucauuggacugaggcaaaaauguuacuagauaacauuaauacaccagaagguaucauaccugccuuauuugaaccagagagagagaaaucagcagcaauagacggcgaguauagauuaagaggggaagcacgaaaaacauuuguagaauugaugagaagaggcgaucuuccuguguggcuuaguuacaaaguugcgagugaaggguuucaauauucagacagaagguggugcuuugacggggagaggaauaaccaagucuuagaagaaaauauggauguagaaauauggacaaaagaaggagagcgcaagaaauuacggccacguuggcucgacgcaaggacauacucggauccguuagcauuaagagaauuuaaagaauuugcggccggaagacgaaguguuaguggugaccuaaucuuggaaauaggaaaacuuccucaacaucuaacgcaaagggcucaaaacgcauuggacaaucucgugaugcuucauaacagcgagcaaggcggcagagcuuaucgccacgccauggaagaguugccugauacuauagaaacacucaugcuccuagcacuaauagcaguacucacaggggguguaacacuauucuuccuuagugguagaggcuuagggaaaacguccauugguuuacuuugugucauggcaucaucaguacuguuauggauggcaucaguugagccccauuggaucgcagcaagcauuauucuggaauuuuucuugaugguuuuguuaauaccagaaccagauaggcaaagaacgccccaagacaaucaauuagcuuacgugguuauaggauuauuauuuaugauauuaacaguagccgcaaacgaaaugggguuauuagaaacaacgaagaaagacuugggcauaggccauguggcaguggagaaucaucaucaugcugcaauguuagacguagaccuccauccggcaucggcguggacacuauacgcaguagcaaccacaauuauaacaccaaugaugaggcauaccauagagaauacgacagccaacauuagucuuacggcaauugcaaaucaagcagcaauacugaugggacuagacaaaggcuggccaauaucgaagauggauauaggagucccacuucuggcacugggauguuacucacaagucaauccauuaacacuuacagcagccguucugauguuggucgcccacuacgcuauaauugggccaggauuacaagcaaaggcgacccgggaggcucaaaagaggacagcagcgggcaucaugaagaauccaacgguugacggaaucgucgcaauagauuuagauccagugguauacgacgcaaaauuugaaaaacaauuaggacaaauuauguugcuuaucuugugcacaagccagaucuuacugaugcguacaacaugggcuuuaugcgaaucuaucacguuggccacagguccccuuaccacacucugggaagggucaccgggcaaauuuuggaacacuacaauagcaguaaguauggcaaauauauuucgagguucuuaccuugcaggagccggauuagccuuuaguuuaaugaaaucauuaggcggagggagaaggggaacaggugcucaaggggaaacccucggagagaaguggaagcggcaacuuaaucaauuguccaaaagugaguucaacacauauaaaaggucugggaucauggaaguugacagaagugaagcaaaagaagggcuuaaaagaggggaaacgaccaaacaugcagucagcagagggacagcuaaacugcguugguuuguggaacgaaauuugguaaaacccgaaggaaaagugauagauuuagguugugggagaggaggguggagcuauuauugcgccggacuaaagaaagucaccgaggucaagggauacacgaaagguggaccgggacaugaagaaccaauaccaauggcuacguacggauggaauuugguuaaauuacauagcgguaaggacguuuucuucauaccaccggaaaagugugauacguugcuuugcgauauaggagaauccucucccaaccccacaaucgaagagggaagaacguugagggugcuuaagaugguagaaccaugguuacggggaaaccaauuuugcauaaaaauacugaacccguacaugccuagcguuguugaaacucuagaacagaugcaacguaagcauggugguauguuagucagaaauccccugagucgaaacuccacacaugaaauguauuggguuaguugcgggacagguaacauuguaucggcagucaauaugacgucgcguaugcugcuuaauagauucacuauggcucauagaaaaccuacuuaugaaagagauguagacuuaggcgcaggaacccgucacgucgcuguagaaccagagguugcuaauuuagauauaauaggacaacgcauagaaaauauaaagcaugaacauaaauccacguggcacuaugacgaagacaauccauacaaaacaugggccuaccaugggagcuacgaaguaaaaccaagcgguagcgccucuaguaugguuaacgggguaguuaaacuauuaaccaaacccugggacgugauucccaugguaacacaaaucgccaugacggauacaacuccauuuggccagcaaaggguguuuaaagaaaagguagauacgagaacuccaaaagccaaaagagguacugcucaaauaauggaagucacggccaaauggcuauggggauuucuaucuaggaacaagaaaccuagaauauguacucgggaagaguuuacacgaaaagucagaaguaaugcugcuauuggugcugucuuugucgaugaaaaucaauggaauagcgcuaaagaggcgguagaggaugaacgguuuugggaucugguccauagggaaagggaacugcacaaacaaggaaaaugcgcgacaugcguuuacaauaugaugggcaaaagggagaagaaauugggugaguucgggaaagcaaaaggcaguagagcaauuugguacaugugguuaggagccagauuucucgaguucgaggcacuuggcuuuaugaacgaagaucauugguuuucgcgggaaaacucgcuuuccggaguugaaggcgaaggucuacauaaacucggguauauauugagagacaucagcaaaauaccaggcggcaacauguacgcagacgacacagcagggugggauaccaggauuacggaagacgaucuccagaaugaagcuaaaauaacagauauaauggaaccugagcaugcauuacuagcuaaaucuauuuuuaaacuaacuuaucagaauaaaguuguccguguacaaagaccggccaaaaacggcacaguaauggacgugauuucaagaagagaucaacgagggucuggucaaguugguaccuauggacuaaauacauuuacuaauauggaagcgcaacugaucaggcaaauggagagcgaggguauauucucuccauccgaacuugaaacgccaaauuuagcaggaagaguccucgauugguuagaaaagcacggagucgagaggcuuaagagaauggcgauuaguggcgaugacugcguagucaaaccaauagaugacagauucgccacagcucuaacugcucuaaaugauaugggaaaaguacggaaagacauaccgcaaugggaaccguccaaagguuggaaugauuggcagcaagugccauucuguagucaucauuuccaccaacugaucaugaaagacgggcgugaaauugugguaccuuguaggaaucaggaugagcuagucggccgagcacgagugucccaaggggcgggcuggaguuuaagagaaacagcgugucuugggaaaagcuacgcgcaaauguggcaauuaauguauuuucauagaagagaucuaagauuggcagcuaacgcuauaugcucagcuguucccguagauuggguaccaacaaguaggacaacauggucuauacaugcucaccaucaauggaugacuaccgaagacaugcucagcguguggaauaggguuuggauagaagagaauccauggauggaggacaaaacacauaucaguucguggggagacguaccuuaccucgguaaacgagaagaucaauggugugguagucuuauuggccucacggcacgggcuacuugggcaaccaacauucaagucgcaauaaaucaaguaagacgucuuauagguaacgagaacuaucuagacuacaugacaaguaugaaaagauucaagaaugaaucagaucccgaaggcgcguuaugguaa

SEQ ID NO: 21772 - RNA, 9879 nt, Artificial Sequence
  derived and/or modified CDS sequence (opt6) from DENV-1__GU131678__SS-prME
ucaguaaccaugcuucucaugcuuaugccaacagcauuagcauuucacuuaaccacucgcggaggugaaccucacaugauaguuuccaaacaagaaagagggaaaucacugcuuuuuaaaacgucagcaggaguaaauaugugcaccuugauagcgauggaccucggagaacuuugugaagauacgaugacauauaaauguccuaggauuacugaagcagaaccagaugauguugacugcugguguaaugcaacagauacuuggguuacuuacggaacaugcucucaaacuggcgaacauagaagggagaaaagaagcguugcucuagcgccucauguuggauuaggauuagaaacuagaaccgaaacauggaugaguucggaaggggcauggaaacaaauacagcguguagaaacgugggcccuaaggcaccccggauuuacaguuaucgcacuuuuucucgcacaugcuaucgggacgucuauuacucaaaaaggaaucauauucaucuuauuaaugcuuguuacaccaucuauggcuaugagauguguuggaauugguucaagagacuucguggaaggguuauccggagcaacuuggguagauguaguccuugaacacggcaguugcguuacuacaauggcuaaagauaagccaacacuagauauagaacuauuaaaaaccgaagugacuaauccagcgguucuuagaaaauuauguauagaagcaaaaauuagcaauacuacuacagacucuagauguccuacgcaaggagaagcgacauugguggaagaacaggaugcaaauuucgucugucgaagaacuuuuguugauaggggauggggcaauggguguggucuauucggaaaaggcucucugcugacaugcgcgaaauuuaagugcaugaccaaauuagaaggcaagaucguccaguaugaaaaccuuaaauacucaguaauuguaacuguacacacgggcgaccagcaucaagucgggaaugaaaguacagaacauggcacaacagcuacaauuacaccccaggcgccaacuacagaaauucaguugacagauuauggggccuuaacccucgauugcuccccaagaacgggacuagacuuuaacgaaaugguacuauuaacuaugaaagaaaagaguuggcuuguacacaaacaaugguuucuagauuuaccucuacccuggacaagcggcgcaucaacuagccaggaaacauggaaccgccaagacuuauuagucacuuuuaaaacagcccacgccaagaaacaggaaguuguaguucuagggucacaggaaggagcuaugcauaccgcgcucacuggagcaacagaaauccaaacaucagguaccacuacaauuuuugccggacauuuaaaguguagacuuaaaauggauaaacugacacucaaagggauguccuacguuauguguacaggaucauuuaaauuggaaaaagaaguagccgaaacgcagcauggaacaguucuaguacaaaucaaguacgagggcacugacgcaccauguaaaauaccguuuaguacacaagaugaaaaaggaguuacccagaauggcagguuaauaaccgcuaacccuauagugacagacaaagaaaaaccagucaacauagaagccgaaccuccauucggugagaguuauauuguaauuggagccggugaaaaagcguuaaaacuaagcugguucaagaaaggaaguucuauugggaaaauguuuaaagcaacugcccguggggccagaaggauggcaauacuaggugauacagcuugggacuucggcaguaucgggggcguauucacguccguagguaaauugguccaucaaauauucgguacagcauauggaguucuauuuucggguguaucguggacaaugaagauugguauaggaguucuacuuacuuggcuuggcuuaaauucccgaucuaccagucuuucaaugaccugcauugccguaggguuaguaacacuauaucuaggaguuaugguacaagcagauuccgggugcgucauaaacuggaaaggcagagaacuaaaaugcggcucuggaaucuuuguaacaaacgaggugcacacuuggacagaacaauacaaauuccaagcugacagcccaaaacguuuaagcgcggcgauaggaaaagcaugggaagagggugucugcgggauacgauccgcgacgagguuagaaaacaucauguggaaacaaaucucaaacgaguugaaucacauuuuguuagaaaacgacaugaaauucaccgucguaguaggagauguugcuggcauauugguccaaggaaagaaaaugauccgaccucagccaauggaguauaaauauaguuggaaaagcuggggaaaagcuaagauuauuggagcagauguacaaaauaguaccuuuaucauagaugguccaaacacaccugaauguccugaugaucaacgagcauggaacauuugggaagucgaagauuacggauuugggauuuucaccacuaauauauggcuuaaacuaagagacucguauacucagguuugugaucaucgccugaugagcgccgcgauaaaggauaguaaagcaguucacgcggauaugggguacuggaucgaaagugaaaagaaugaaacauggaaauuggcacgggcaaguuucauagagguuaaaaccugcauauggccaaaaagucacacacuauggucaaaugggguguuagaaucggaaaugauaauuccaaagauacaugggggaccgauuagucagcauaacuauagaccugguuauuuuacacaaacggcgggcccauggcauuuaggaaaacuagaauuagauuuugaucuaugugagggaacuacaguaguaguugaugaacacugugggaacagggguccaucgcugagaaccacgacuguuacugggaaaauuauccaugaaugguguugucguucaugcacgcuaccaccccuacgauucaggggugaggacgguugcugguacgggauggaaauuagaccggucaaagaaaaagaagaaaacuuaguuaaaucuaugguuucagcuggcuccggagaaguagauaguuuucuacucgguuugcuaugcauaucaaucaugauugaagaaguaaugaggagucgcuggucgagaaagaugcuaaugacagguacauuagcgguauuuuucuugcucauuauggggcaauugacguggaaugauuugauuagacuauguauuauggucggugcgaacgcgucggaucgaauggggauggguacgacauacuuggcacucauggcaacuuuuaaaaugcgccccauguuugcgguuggacuccuauuuagacgacugacuuccagagaaguuuuguuauugacaauagguuuaucgcuaguugcuucuguggaacuaccaaauucacucgaggaguuaggcgauggccuagcuaugggaauaaugauuuugaaacuucugacagacuuucaaucauaucaauugugggcaacauuacugucgcugacuuuuaucaaaacuacuuucucacuccacuacgcauggaaaacuauggcaaugguauuaucaauuguaagccuuuuuccuuugugccuauccacuacaucgcagaaaacgacauggcuaccaguauugcuaggcagucuuggaugcaaaccauugacaauguuccucauugcagagaauaaaauuuggggcagaaaaucuuggccacuaaacgaagggaucauggccguaggaauagucucgauauuauugagcucauuacuuaaaaaugacguaccauuagcuggcccucuaauagcugggggcauguugauagccuguuacguaauuagugguucaucggcugaccuaagccucgaaaaagcagcggaaguaaguugggaagaagaggcggagcacagcggggcgagucacaacauuuuagucgaaguacaggacgaugggacuaugaaaauuaaggaugaagaaagagacgauacacuuacaauacuacuaaaagccacauugcuagcaguaucuggaguauacccucuuucgauaccagcaacuuuauucguuuggcacuucuggcaaaagaaaaagcaaaggaguggaguauuaugggauacaccaagcccaccagaaguugagagagcaguacuagaugacggcauauaccggaucaugcaacguggauuguuagguagaucucagguugguguaggaguauuucaagaaaauguauuucauacuauguggcacguaaccagaggagcagucuugauguaucaggggaaacgguuagaaccaagcugggcaagugucaagaaagaccucauuucuuaugguggcgguuggcgauuucagggcaguuggaacacaggagaggaaguacagguaauugcgguugaaccaggcaaaaaccccaaaaaugugcaaacggcgcccgguacuuucaagaccccagaaggggagguaggagcaauagcgcuagacuuuaaaccagguacuucaggcucgccaauuguaaauagagaaggaaagauaguaggauuguacggaaacggaguaguaacuaccuccggcaccuacguaucggcgauagcacaggccaaggcuucgcaagagggccccuugccagagauugaagaugagguuuucagaaaaaggaaccuuaccauuauggauuuacaccccggaucaggaaaaacucgcagauaccuaccggccauaguuagggaagcuauuaaaaggaaauuaagaacuuuaauauuagcaccaacacgaguaguugcaucggaaauggcugaagcccuaaaagggaugccuauacguuaccaaacaacagcagugaagucggaacacacaggaaaagaaauaguugaccugaugugucacgcgaccuuuacuaugcgguuacuaaguccaguccguguuccgaauuauaauaugauaauaauggacgaagcucacuucacagauccgagcucuauagcggcgagaggauauauuucuacucgggucggaaugggggaggcagcugcgauauucaugacagccacaccgccaggcucaauggaagcauucccucaaagcaaugccgugauccaggacgaagaaagagauauuccagaaaggucauggaauaguggauacgaauggauaacggacuuuccagggaagacaguuugguuugucccauccauaaaagcaggaaaugacauagcaaauuguuuaaggaaaaauggaaaaagagucauucaauuaagccggaaaacauucgauaccgaauaucagaaaacgaaaaauaacgauugggauuacguaguaacaacggauauaagcgaaaugggggcgaauuuuagggcggacaggguuauagacccucguagaugucuaaaaccaguaaucuuaaaagauggucccgagcgugugauacuggcugguccaaugccgguaacuguggccucggcagcacaacgaagagggcgaauaggucguaauccuaauaaagaaggcgaucaauauaucuauaugggacaaccacuaaauaaugaugaagaccaugcacacuggacagaagcuaaaauguuacuagauaauauaaauacaccagaagguauaauaccggcauuauuugaaccggaaagagagaaaagugcagcaauagauggugaauacagguuacgcggugaagcacgcaagacuuucgucgaauuaaugagaagaggagacuugcccguuugguugaguuacaaaguugcuucagagggauuccaauauagcgacaggcgauggugcuucgccggagaacgaaauaaccaaguauuagaagaaaacauggauguagaaauauggaccaaagagggagaacguaagaaacuucugccacgauggcuagaugcuagaaccuacuccgauccguuagcgcuaagagaguucaaggaguucgcagcgggaagacgaaguguauccggugacuugauccuagaaauaggaaaguuaccacagcaccucacucaaagagcacaaaaugcguuggacaacuuaguaaugcuacacaauucggaacaaggcggcagagcauaccggcaugcaauggaagaguuaccagauaccauagaaacucucaugcuuuuagccuuaauagcaguccugacaggaggaguuaccuuguucuuuuuaucagguaaaggacugggcaagaccagcauuggccuguuaugcguaauggcgucaaguguacuauuguggauggggucaguagagccccauuggauagcggccucaauaauauuagaguucuuccucauggugcugcuaauaccggaacccgaccgccaacgaacuccgcaggacaaccaacucgcauauguaguuauaggccucuuguuuaugauauuaacugucgcggcaaacgaaaugggauuauuagaaacaacuaagaaagauuuaggcauaggucauguugcaguagaaaaccaucaucaugcagcgaugcuagacguagaucugcauccugcuucagcuuggacacuauacgcugucgcaacaacgauaauaacuccaaugaugcgucacacaaucgaaaauaccacggcuaauaucagccuuacugcgaucgcgaaucaggcagcuauacuaaugggccucgcuaagggauggcccauaucuaaaauggauauaggcgugccacuauuggcacucggaugcuacucccagguaaauccauugacacuaacagcugcuguauuaauguuaguagcccauuacgcgauuaucggaccaggauuacaggcgaaggcaacaagagaagcacaaaagagaacagcugccggcaucaugaaaaacccgacuauagacggaauaguugccauugaucuugauccagucguauacgacgcaaaguuugagaaacaguuaggccaaauuaugcuacuaauacuuugcacaucccaaauucuucuuaugaggacuacaugggcuuuaugcgaauccauaacuuuagccacaggucccuuaacaacacuuugggaaggcucaccagguaaguuuuggaacaccaccaucgcaguuagcauggcuaauaucuuuagagggucuuacuuagcuggagcaggauuagccuuuucauuaaugaaaucuuuaggggguggucggcggggaacgggcgcccaaggugaaacacuaggcgaaaaauggaagcgacaauugaaucaguuaaguaagagcgaguuuaacacauauaagaggucuggaaucauggaaguggaucgaagcgaagcuaaagaagguuugaagagaggcgaaacuacuaaacaugcaguuaguagaggcccagcaaaauuacguugguucguagagcgaacacucguuaauccagagggcaaggucauagcauuagguuguggucgaggagcgugguccuauuauugcgcgggguugaagaaaggaacagaaguuaaagguuauacgaaaggaggaccuggacacgaagaaccuauaccaauggcaaccuacggcugggaucugguaaaacuacacucagguaaggauguguucuuuauuccgccagaaaaaugugacacgcuauuaugugacauuggcgaaaguucucccaauccuacgauagaagaaggacgcacacuuagaguuuugaaaaugguugaacccugguuaagaggaaaucaauucugcaucaagauuuuaaauccguauaugccauccgucguagaaacguuagaacaaaugcagagaaagcauggaggcaugcucguccgaaacccccuaucucgcaacuccacgcaugagauguauuggguaaguuguggcaccggaaauaucguaagugcgguaaauaugacuucuaggauguuacuaaauagguuuacaauggcgcauagaaaaccuacauaugaaagggauguugacuuaggggcggggacaagacauguagcaguagauccugaaguggcaaaucucgauauaaucggccaaagaauagaaaauauuaagcacgaacacaaaucaaccuggcauuacgaugaagacaauccauauaaaacuugggcuuaucacggaagcuacgaaguuaaaccaucaggaagugcaagcaguaugguuaauggaguagugaaauuacuuacuaaaccaugggacguaauaccaaugguaacucaaauagcuaugacugauacgacuccauuugggcaacaaagaguauuuaaagagaaaguugauacaagaacaccgaaagcuaaaaggggaacugcucaaaucauggaggugacugcaaggugguuauggggguuuuugucacgcaauaaaaagccaagaauuugcacuagagaagaguucacuagaaaggucagaucuaacgcugcgauaggcgcagucuucguagacgaaaaucaauggaauagugcuaaagaggcaguugaagaugaucgguucugggaccuaguacauagagaacgcgaacuacacaagcaaggaaagugcccaacgugcguguauaauaugaugggaaaacgagagaagaaauugggcgaguuugguaaagcaaaaggaucaagacccaucugguauaugugguugggagcgcguuuucuggaguucgaggcuuuggguuuuaugaacgaggaucauugguuuaguagagaaaacucauuaucagguguagaaggugaagcucuccacaaacuagguuauauucuuagagauauaaguaaaauaccgggugggaauauguaugcugacgauaccgcagggugggauacuaggauuaccgaagacgaucuucaaaacgaaggaaaaauaacugacauaauggaacccgaacaugcacuccuagcgaaaucuauauucaaacuuacuuaucaaaauaaaguggugagggugcagcggccagcuaagaauggcaccguaauggacgucauuagccgaagagaucaaagaggaucaggacagguagguacauauggccuaaacaccuucacaaacauggaagcccagcucaucagacaaauggaaucugaagguaucuuccucccaaaugaauuggaaacaccuaaccuggcaggaagagugcuagauugguuagaaaaauacggcguugaacgauuaaaacgaauggcgauaucaggggaugauugcguaguaaaaccaaucgacgacagauucgcaacagcguuaacagcacucaacgauaugggcaaagugaggaaagacaucccucaaugggaacccaguaagggauggaaugauuggcagcaaguucccuuuuguagccaccacuuucaucaauuaauaaugaaggacgguagggaaauugucgucccuugucggaaccaagaugaacuuguaggaagggcccgugucagccaaggagcagguuggacauugcgugaaacagcaugccuugguaaaucauaugcucaaauguggcagcuaauguacuuuccacggcgugcacuucgcuuagcggccaaugccauauguagugcaguaccuguagauuggguccccacgaguagaacgacguggucuauucacgcacaucaucaauggaugaccacugaagauaugcuaucaguauggaacagagucuggauagaggaaaaccccuggauggaggacaagacaagaauuucgaguugggaagacguaccauauuuaggaaaacgagaggaucaauggugcgguucguuaauagguuuaacacccagagcgaccuggccuacuaauauacagguagcaauaaaucaagugcggaggcuuauuggaaaugaaaacuauagcgauuauaugacaucuaugaagagauucaaaaacgagagugaaccugaaggagcacuuugguaa

SEQ ID NO: 21773 - RNA, 9879 nt, Artificial Sequence
  derived and/or modified CDS sequence (opt6) from DENV-1__GU131679__SS-prME
agcgugacaaugcuguugauguugaugcccacagcguuggcauuucauuuaacgacgagggguggggaaccgcauaugauaguuagcaaacaagaaagggggaaaucuuuacuauuuaaaacauccgcagggguuaacaugugcacucugauagccauggacuuaggagaauuuugugaagauacaaugacuuauaaauguccaagaauaacggaagcggaaccggacgauguagauugcugguguaacgcaacagauacauggguuacauauggaacaugcagucaaacuggcgaacaucgacgggacaaacgaagcgucgcacuagcgccacacguuggucucggauuagaaacgcgcacagaaacauggaugucgucagaaggagcauggaaacaaauucagcggguagaaaccugggcuuugcgacacccagguuuuacaguaauugcauuauucuuagcccacgcgaucggcaccagcaucacgcaaaaagguaucauauuuauccuuuuaauguugguuacgccgagcauggcaaugagguguguugguauagggucucgcgacuucgucgaagguuuauccggggcuacauggguagacguagugcuagagcacgguucuuguguaacuacgauggcgaaagacaaaccaacauuggauauagaacuacucaagacagagguaacuaacccugccguacuaagaaaacuuuguauagaagcgaagaucagcaacacaacaacagauaguagguguccuacgcaaggugaagccacccuaguggaagaacaagaugcuaauuuugucuguagacguacuuucguagaucgcggauggggaaauggauguggucuguucggaaaaggaagccucauaacaugugcaaaauucaaauguguuacaaaacucgaagggaaaacaguacaauaugaaaacuugaaauacaguguuauuguuaccguucauacaggagaucaacaucaaguagguaacgaaagcaccgaacacggaacuaccgcaacgauaacaccacaagcaccuagcacggaaauccaacuuacagacuauggagcuuugacuuuagauugcagcccaaggacuggauuagauuuuaacgaaaugguccuauuaacaaugaaggagaaggcuuggcuaguucauaaacaaugguucuuagaucucccucuaccauggaccucuggugcaagcacaucacaagagaccuggaaccgaaaagaccuauuaguuacuuuuaaaacagcccaugccaagaaacaagaaguaguaguacuaggcagucaggaaggagcaaugcacacggcauuaacaggagcaacagaaauacaaacaucuggaacaacuacuauauucgcaggacauuuaaaaugcagacuuaagauggauaaacugacauuaaaaggaaugucuuacguaaugugcaccggcaguuucaaauuagaaaaagagguagcugaaacccaacauggcaccguauugguucagauaaaguaugaagggacggaugcaccuugcaaaauaccauuuaguacacaggacgagaaaggcguuacccaaaauggacgauuaauuacagcaaacccaauaguaacggacaaagaaaaaccaguuaacauagaggccgaaccaccauuuggugaauccuauaucguaauaggggcgggcgaaaaggcacuaaaauuaucgugguuuaagaaaggaucguccauugguaaaauguuugaagcuacggcuagaggagcaagaagaauggcaauuuuaggagacacggcaugggacuuuggaucaauuggaggugucuuuacuucaguaggcaaguugguacaccagauauucgguaccgcuuacgguguucuuuucucaggugucucuuggaccaugaagaucggaauaggcguccuacuaacauggcucggccuuaacagucguucaacaucgcuuaguaugaccugcauugcagugggguuaguaacacucuaucuugguguuaugguucaggcagacaguggaugugugauaaacuggaaaggaagggaguugaagugcggaagcgggauauucgugacaaacgaaguacacacguggacagaacaguacaaauuccaagcagauucuccaaaacgcuuguccgcugcaauaggaaaggcuugggaagaaggaguaugcggaauccgcucagcaacucgacucgaaaacauaauguggaaacaaauaucaaaugaauuaaaucauauccuauuagagaacgacaugaaauuuacaguagugguuggugauguugcaggcauacuggcccagggcaagaaaaugauaagaccgcaaccuauggaguauaaauauaguuggaaaagcuggggaaaggcaaaaauuauaggcgcagauguacaaaaugcuacauucauaauugacggaccaaauacaccugaauguccggacgaccaaagagcauggaacauuugggaaguagaagauuacggcuuuggaaucuucaccacaaauauaugguuaaaacugagagauucauacacucaaguaugugaucauagacuaaugucagcggcuaucaaagauucuaaggcaguacaugcggauaugggauauuggauagaaucagagaagaaugagaccuggaaauuggcucgagccucuuuuauugaaguaaagacuuguauauggccaaagagucauacacucuggucgaauggaguacucgaaucugaaaugauaauuccaaaaauuuacggcgggccaauuucacaacacaacuauagaccggguuauuuuacacaaacugcagggccauggcaccuggguaaauuagagcuggauuuugauuuaugugaagggacgacugucgucguagaugagcauuguggcaaucguggaccgucuuuacgaacgacgacgguaacuggcaaaauaauucacgaauggugcugucggucaugcacacuuccaccguuaagguuuaagggagaggaugguugcugguaugguauggaaauuaggccuguaaaggagaaagaagaaaaccuuguaaagaguauggucucugcuggcucgggagaggucgauaguuuuucccuuggauuauuauguauaucaauuaugauugaagaaguuaugcguucccgcuggaguaggaagauguuaaugacugggacacuagcuguauucuuuuuacuaauaaugggacaguugacauggaacgaucuaauuagauuauguaucauggucggagccaacgccucagauaggaugggcauggggacaacuuacuuagcauuaauggcaacauucaaaaugagaccaauguuugcaguaggcuuacuauuucguagauuaacuucgagagaaguucuauuacuuacaauaggacugagccuuguggcgagugucgaacuuccaaauaguuuggaagaacucggagacgguuuagccaugggaauaaugauuuuaaaguuauugaccgacuuucagucucaccaauugugggcaacauuauuaucguuaacauucauuaaaaccacauuuagccuucauuaugcauggaaaacaauggcuaugguacuuagcauaguuucauuguucccgcucugccugaguacgacuucacagaaaacuaccugguuaccagugcuacuagggucauuagguuguaaaccacuaacaauguuucuaauugcugaaaauaagauauggggccgaaagagcuggcccuuaaacgagggcauaauggcaguugguauagucucuauacuacugucaaguuuauugaaaaaugacgugcccuuagccgguccacucaucgcgggaggaaugcugauugcguguuacguuauaucugguucaucagccgaccuaucccuagaaaaagcagcggaagucucuugggaagaggaagcagaacacucgggagccagucauaacauuuuaguugagguacaagaugauggaaccaugaaaauuaaagacgaagaacgagacgacaugcuuacaauacucuuaaaggcaacauuacuagcugucaguggaguauauccauuaucuauaccagcgacucuuuucguuugguauuuuuggcagaagaagaaacaaagaagcggcguauugugggauacacccucgccaccagagguggaaagagcuguacuugacgauggaaucuaccggauuaugcagcgaggauuguuaggaaggucucaggucggagugggcguauuccaagaaaauguuuuccauaccauguggcacguaacaagaggggcuguuuuaauguaucagggcaaaagacucgaaccuucgugggcuuccgucaagaaagaucuaauaucuuaugguggcgguuggcgucuccaagguucuuggaauaccggagaagaaguucaaguuaucgcuguugaaccaggcaaaaauccuaaaaauguacagacggcucccggaacauuuaaaacgucagaaggagaagucggagcaauagcuuuagauuuuaaaccagggacuucagggucuccgauaguaaauagagagggaaagauaguaggacuauauggaaaugggguaguuacuacgucaggcaccuauguauccgcaaucgcacaggcuaaggccagucaagaaggcccgcuuccagaaauagaggaugaaguauuucggaaaagaaaucugacgauaauggaucugcaucccgggucgggcaaaacaaggagguacuugccagcuauuguucgggaagcaauaaagcgaaaacugcgcacauuaauacuagcaccaacaagggugguugcgagugaaauggcggaagcauugaaagguaugccaauaagguaucaaacaaccgcaguuaagagcgaacacaccgggaaggaaauaguggaucucaugugucacgcaacauuuacgaugaggcuauuaagcccgguaagaguaccaaacuacaacaugauaaucauggacgaggcucacuuuacagauccgaguucuauugcagccaggggauacauaucuacaaggguagguaugggagaagcagcggcaauauucaugacugcgaccccaccaggcaguguggaagccuucccccaaucaaacgcggucauacaagaugaagaacgcgauauacccgaaagaucguggaacucaggauacgaauggauaacugauuucccugguaaaacaguuugguucgugccgucaauaaaaagcggcaacgauauagcaaacugucuacgaaagaauggcaaacguguuauacaacuaucuagaaaaaccuucgacacggaauaucaaaagaccaaaaauaacgacugggacuauguagucacaacagauaucagcgaaaugggcgcaaacuuuagagccgauagaguaaucgauccaagaaggugccuaaaaccuguuauauuaaaagacgguccggagagggucauucuagcaggucccaugccgguaaccgucgcaucugcagcucaacgcaggggacgaauaggaagaaaucauaacaaagaaggcgaccaguauauauauaugggucaaccucuaaauaaugacgaagaucaugcucauuggacagaggcaaaaauguuauuagacaacauaaacacuccugaggggauaaucccagcauuauuugaaccagaaagagaaaaaucagcugcaauagauggggaguauaggcuuaggggugaagcacgaaaaacauuuguggaauuaaugagacggggugauuuaccagucugguugucauauaaaguugcuucagaaggauuucaguacagcgaccgacgaugguguuucgauggugagaggaauaaccaagucuuagaagaaaauauggacguagaaauauggacgaaagaaggugaacgaaagaaacuuagaccuaggugguuagaugcacgcacuuacagugauccuuuggcauuaagagaauuuaaagaguucgcagcaggaaggagaagcgugucaggcgacuuaauucuggaaauagggaaacuuccacagcauuuaacacagagagcucaaaacgccuuagauaauuuagucaugcuucauaacucugaacaaggcggacgagcuuauagacaugcaauggaggaauuaccagauaccauugagacucuaaugcuacuugcucuuauagcaguuuugacugggggaguaacucuuuucuuccuuagcggacgaggacuaggaaaaacaucgauaggcuuacuuugcguuauggcgucuucuguacuacucuggauggcaagcguagaaccacauuggauagcggcuucuaucaucuuagaguucuuucucaugguauugcuaaucccagaacccgaucgacagcggacuccacaggauaaccaacuugcguaugucguaauaggccuauuguucaugaucuuaacagucgcugcaaaugaaaugggguuacuagaaaccacaaagaaagacuuaggcauuggacauguugcgguagaaaaccaccaccaugcugcgaugcuggaugucgauuugcacccggcuagugcauggaccuuauacgcaguagcaacaacuauaauaacaccaaugaugagacauacaauagaaaacacaacagcaaacauaucacuaacugccaucgcgaaucaagccgcaauuuugauggguuuggacaaaggauggccaauaucuaaaauggauauuggaguuccacuacuggcauuagggugcuauucccagguuaacccguuaacauugacggccgcaguauuaauguuaguggcacacuaugcuauuauaggaccagggcuccaagcuaaagcaacaagggaggcacagaaacgaacagcugcuggaauaaugaaaaaucccacuguagaugguauaguggccauagaauuagauccugucguauacgacacaaaguuugaaaaacaauuaggacagauaauguuguugauuuuauguaccagccaaauuuuauuaaugaggacgaccugggcucugugugaaaguauaacacuagcgacgggaccauuaacuacucucugggaaggaucacccgggaaguuuuggaauacuacaauagcaguaucuauggcgaacauuuuccgagguagcuaucuugcgggcgcagguuuagcuuucucacuaaugaaaaguuuagguggggguagaagaggcacgggagcacagggugagacauuaggagaaaaauggaagagacaacuaaaccaacucaguaaaucagaauuuaacacuuauaaaaggucagggauaauggaaguggauagaucggaagcaaaagaaggucuaaaaaggggugaaacgacgaaacacgcuguuagccgggguacggcaaaauuacgaugguucguagagagaaauuuagugaagccggaaggaaaaguaaucgaucugggcugugguagaggcggauggucguauuacugugcugguuugaagaaaguaaccgaagucaaaggguauacaaaaggagggccgggccacgaggaaccuauaccaauggccacauacgguuggaaucugguaaaauuacauagugguaaagaugucuucuucauaccuccggaaaaaugcgauacccugcuaugugacauaggagaaucgaguccaaacccuacgauagaggaaggccgaacgcugagaguucuaaaaaugguagaaccaugguuacgggguaaccaauuuuguaucaaaauacuaaaccccuacaugccuagugugguagagacauuagaacagaugcaacgcaaacauggaggaauguuagugagaaauccgcuaagcagaaacagcacgcacgagauguacuggguaucguguggaacuggaaauauagucagcgcuguuaauaugacuucgcgaaugcugcuaaacagguuuaccauggcacaccggaaaccaacuuaugagcgugacguagaucucggagcggggacuagacacguagcuguagaaccagaaguagcuaaucuagauaucauagggcagcgaauugaaaacauaaaacaugaacauaagucuacuuggcauuaugaugaagauaauccuuacaagacaugggcauaucaugguaguuacgaaguaaaacccagcggcucagccagcagcaugguaaaugguguagucaaguuguuaacuaagccgugggacgugauaccaaugguaacccagauugcgaugacagacacaacccccuuuggccagcaaagaguauucaaagaaaaaguggauaccagaacaccuaaggcaaaacguggcacagcgcaaaucauggaaguaacagcaaaaugguuaugggguuucuuaucaagaaacaagaaaccucgcauaugcacacgugaggaguucaccagaaaagugagaagcaacgcggcuauuggagccguauuuguagacgagaaucaauggaauagugcaaaggaagcgguggaggacgaaagauucugggacuuaguccauagagaacgagaacugcacaaacagggaaagugugccacauguguuuacaacaugauggguaaaagagagaagaaacuuggagaguucggaaaagcuaaaggcagcagagcuauaugguacaugugguuaggagcccgcuuccucgaauuugaagcacugggauucaugaaugaagaucauugguuuagccgcgaaaacucacuaaguggaguagaaggcgaaggauuacauaaauuagguuacauauuacgugacauuuccaaaauuccggguggcaauauguaugcugaugacacugcagggugggacacccggauaacugaagacgacuuacaaaaugaagcgaaaaucaccgacauuauggagccagaacacgcacuucucgcaaagucaauuuuuaaguuaacauaucaaaauaaaguuguaagggugcagaggccagcuaaaaaugggacggugauggauguaauaucaaggagagaucaaagaggcuccggccagguaggaaccuauggucugaacacauuuacgaacauggaagcccaacuuauaagacagauggaguccgaaggaaucuucaguccgucagaguuggaaaccccaaaucucgccggaagaguguuagacuggcucgagaaacacgggguagaacguuugaagcggauggccauuucaggcgacgacuguguagucaaaccuauagaugaucgguucgccacggcccuuacagcccuaaacgauauggggaaaguaaggaaagauauuccgcaaugggaacccucaaaaggauggaacgauuggcaacaggucccuuuuuguagccaccacuuccaucaguuaaucaugaaggacggacgcgaaauuguagugccuugcaggaaucaagacgagcuaguuggacgagcacgugucagccaaggagcuggcuggucucuacgagaaaccgcgugccugggaaagucguaugcccaaauguggcagcuaauguauuuucaucguagagaccuaagacuggccgcgaacgcuauauguucggcaguccccguagauuggguuccaacaagccgaacuacguggucaauacacgcacaucaucaauggaugacaacggaagauaugcuaagcguauggaauaggguguggauagaagaaaauccuuggauggaagacaaaacacauaucucaagcuggggcgaugugccauacuuagggaaaagagaagaccaaugguguggcagucuaauaggacucacagcacgggcaacaugggcaacgaauauacaaguagcaaucaaucaaguaagaagacuuaucgguaaugagaacuauuuagacuacaugacaagcaugaaaagauucaaaaaugaaauagauccagaaggagcuuugugguga

SEQ ID NO: 21774 - RNA, 9879 nt, Artificial Sequence
  derived and/or modified CDS sequence (opt6) from DENV-1__GU131680__SS-prME
aguguuacuaugcuauuaaugcuuaugccaaccgcgcuggcuuuucauuuaaccacuagagggggagaaccucauaugguaguauccaaacaagaaagaggcaaaucauuauuauuuaaaacuuccgcaggaguuaauauguguacgcuuauagcuauggaucuuggugagcuaugcgaagauacgaugaccuauaaaugcccacguaucacagaagccgaaccggacgacguggauugcugguguaaugcgacagacacauggguaacuuaugguacaugcagucagacuggagagcauagaagagagaaacgaagcguagcauuagcuccucauguaggacugggccuagaaaccagaacugaaacuuggaugaguucagagggggccuggaaacaaauacagcguguggaaaccugggcauuaagacacccaggauucacagucauugcucuguuccucgcgcacgcgauagguaccaguauuacacaaaagggaaucauauuuauacuccucaugcuugugacuccgaguauggcaaugcgauguguaggaauaggaagcagagauuuuguugaaggguuaaguggagccaccuggguagacguaguauuggagcauggauccuguguuaccacgauggcuaaggauaaaccaacccuagauauugaacuacuaaagacggaaguaacuaauccagcuguccuacgaaaauuaugcauugaggcaaaaauaucaaauacaacaaccgacuccaggugucccacucagggcgaagcaaccuuggucgaagaacaagaugcaaauuuuguuugucgaagaacauuuguagauaggggaugggggaaugguugcggccucuucggcaaaggcucgcuacuaaccugugcaaaauucaaaugcguuacgaaauuagaagguaaaauuguccaauacgagaaccugaaguauucuguaaucgucacaguucauaccggagaucaacaucaaguagggaaugagucuacugaacaugggacaacagccaccauaaccccacaagccccuacaacagaaauacaauuaacagauuacggugcacuuacacuagauuguagcccuagaacaggucuagauuuuaaugaaaugguacucuugaccaugaaagaaaaaucaugguuggugcauaagcagugguuuuuagaccugccacuaccuuggacaaguggggcgucaacaagucaagagacauggaauagacaagaucuccuagucacuuuuaaaaccgcgcaugccaagaaacaagaagucguggucuuaggaucucaagaaggugcuaugcauacugcguuaacaggugcaacagagauucaaacuucaggaacgacaacaauuuucgcuggacauuuaaaauguagacuaaagauggacaaacuuacucuaaaggguaugagcuauguuaugugcacggguuccuuuaaacuagaaaaagaaguagcugaaacgcaacacggaacaguguuaguucaaauuaaauaugagggaaccgaugcacccugcaaaauaccauucagcacacaagacgaaaagggaguaacgcaaaauggcagguugauaacagccaauccgauaguaacugacaaggaaaaacccgucaacauagaagccgagcccccuuuuggagaaucauauaucguuauaggagcgggagaaaaggcauuaaaauuaaguugguucaaaaagggauccucgauuggaaagauguuugaagcaacugcacgcggugcgagacggauggccauucucggagacacagcuugggauuucgguucaauuggagguguauuuacgagcguuggcaaguuaguacaccagauauucggcacggcuuacgggguuuuauucucaggagugucuuggacuaugaaaauaggaauugguguacuauuaacauggcuugggcuuaauaguaggaguacaucucuuucaaugaccugcaucgcuguuggauugguaacucuauauuuaggcguaaugguacaagcagauucggguugcguuauaaauuggaaaggucgugaguuaaaaugugguucaggaauauucguaacuaacgaaguucauaccuggacggagcaauauaaauuccaagcagauucuccuaaaagauuaucagcagccauagguaaggcaugggaagaaggagucugcggaauaaggucggcaacucgauuggaaaauauuauguggaaacagaucucuaaugaauuaaaucauauucugcuagaaaaugacaugaaauucacuguaguagugggcgaugucgcgggcauccuaguacaggggaagaaaaugauaagaccccagccgauggaguauaaauacuccuggaaaucguggggaaaagcgaaaauaauuggagcagauguacaaaauucaacuuuuauaauagauggacccaacacaccagaauguccagacgaucaacgcgcauggaauauuugggaaguugaagacuauggauucggcaucuuuacgacgaauauuugguuaaaacuucgagauucauauacucagguuugugaucauagauuaaugagugccgcuauaaaggauucuaaagccguucaugcagacaugggguauuggauugaaagcgagaagaacgaaacuuggaaacuggcacgcgcaucauuuauugaagugaaaacauguauuuggccaaaaucgcacacauuauggagcaaugggguucuugaaucugagaugauaauaccaaaaauacaugggggaccgaucucucaacauaauuaucguccaggauauuucacucaaacugcugggccuuggcaucuagggaagcucgaauuggacuuugacuuaugcgaaggcacaacugugguggucgacgaacauuguggcaaccgagggccuucuuuacgaaccacuacuguaacuggcaaaauaauacacgaauggugcuguaggucuuguacauuaccaccacuacgcuuuagaggggaagaugguuguugguauggaauggaaauuaggccuguaaaggagaaagaagagaaucucguaaagaguaugguaucagcgggaaguggugaagucgauuccuuuucauuaggcuuacuguguauaucuauaaugaucgaagaggucaugagaaguagauggucuaggaaaauguugaugaccgggacgcuugcugucuucuuuuuacugaucauggggcaacuaacauggaaugaccugauaagauuguguaucaugguuggagcgaaugcauccgaccgcaugggaaugggcacuacauauuuagcacugauggcuacguucaagaugagaccgauguucgcagugggauuauuguuucgccgacuaaccagucgagagguucuccuucuaaccauuggauuaagccuaguagcuagcguagaauugcccaacucauuggaagaacuaggagauggauuggcaaugggaauuaugauacuuaaacuucuaacagauuuucaauccuaccaacuuugggcgacacuacugucgcugaccuuuauaaagacgaccuuuucccuucacuacgcauggaaaacgauggcaaugguuuuaagcauaguaucuuuauucccauugugucugucaacaacgagccagaaaacuacaugguuaccgguacuacuagguaguuuaggauguaagccacugacuauguuuuuaauugcugagaauaagauaugggguaggaaaucauggccucuaaaugagggaauaauggcaguaggcauaguaagcaucuugcuaucaagucuacuuaaaaacgauguaccucuagcagggccucuaauugcuggaggaaugcuaauagcuugcuauguaaucuccggaucauccgcagaucugaguuuggaaaaagcagcagaaguuaguugggaagaggaggcagaacauuccggugcaucucauaauaucuuaguggaagugcaagacgauggaacaaugaagaucaaggaugaagaacgugacgauacuuuaacaauauuauuaaaggcaacauuauuggcagucucagguguuuauccauugucaauaccugcaacucuauuuguauggcacuuuuggcaaaagaaaaagcaacggucaggaguucugugggacacacccucucccccggagguagaaagagcaguauuagacgauggaauauauagaauuaugcagcggggauuacuuggaagaagccaaguaggagucggcguauuccaagaaaacguauuccauacgauguggcaugucacacgaggagcaguacugauguaucaaggaaagaggcucgaaccaaguugggcaucagucaagaaagacuugaucagcuauggcggaggguggcgcuuucagggcucauggaauacuggagaagaaguccaaguaaucgcgguugaaccaggcaaaaauccuaaaaauguacaaacugcaccugguacuuuuaaaacaccagaaggcgaaguaggcgcaauagcguuagacuucaaaccagggacaucggguagcccuauuguaaacagagaagguaagaucguuggccuauacgguaauggcguaguuacuacaucaggaacguaugugucggcaaucgcucaggcgaaagccucacaagaaggaccucucccugaaauagaagacgaaguauuuaggaaacgcaauuuaacuauaauggaucuacauccugguagugguaagacaagacgauaccucccagcgauuguucgugaagccauaaaaagaaaauuaaggacauuaaucuuggcgccuacuagaguagucgcuucggaaauggcugaagcauuaaaagguaugccgauuagauaccaaacgacagcgguuaaaagugaacacacaggaaaagaaauaguggacuuaaugugucacgccacauuuaccaugagauuauuaaguccaguuaggguaccuaauuauaauaugauuauaauggacgaagcacacuuuacagauccuucaagcauugcugcccgaggauauauaucaacucgcguaggaaugggagaagccgcggcuaucuucaugacugcuacaccgccgggauccauggaggcuuuuccucaaagcaaugccguaauccaggaugaggaaagagauaucccagaacgaaguuggaacucagguuacgaauggauaacagauuucccuggcaaaacagucugguuugucccgucgaucaaagcagguaacgauauugcuaauugccucagaaagaaugggaaacgaguaauccaauugucaagaaagacauucgauacugaguaccagaaaacuaaaaauaacgauugggauuacguagucaccacugauauaagugaaaugggagcgaauuucagagcagaucgcgugauugacccacgcagaugucuuaaaccaguaauauugaaagauggaccugagaggguaauccuugcugguccuaugcccguaaccguggccucugcagcacaacgcagaggucguauaggacguaaucauaacaaagaaggagaucaauacauauauaugggacaaccguuaaauaaugaugaggaucaugcacacuggacggaagcgaaaauguuacucgauaacauuaauacaccagagggcauaauaccggcacucuuugaaccugaaagagagaaaagugcagccauugauggagaguaucgucuuaggggugaagccaggaaaacguuuguugaacuuaugagaaggggagaucuacccguuugguugaguuacaagguugcuucagaaggcuuccaauacagugacaggagaugguguuucgauggggaacgaaauaaccaagugcuugaggaaaacauggauguagagauuuggacgaaggaaggggagcguaagaaacuaagaccacgguggcucgacgcaagaacauacuccgauccucuagcucugagagaauuuaaagaguucgccgcuggacgacguucagugucuggugauuuaauacuagaaauagggaaacuuccacaacauuuaacacaaagagcacaaaaugcccuagacaaucuuguaaugcuacauaauucagaacagggcgggagggcauaccgacaugcaauggaagaauuaccagacacuauagagacguugaugcugcuugcgcucaucgcaguacuaacuggcggugucacacucuucuuucuauccgggaaagguuuagggaaaacgaguauaggauuguuaugugugauggcaaguagcguauuacuguggauggcuucaguagagccacacuggaucgcugcuucaauuauauuggaguucuuucuuaugguacuauuaauacccgaaccagaucgucaacguacaccacaagacaaccaauuagcauacguaguuauuggcuuacuauuuaugauucuuacuguugcugcuaaugaaaugggauuacuugaaacaacuaagaaagaucuagggauaggacacguugcaguagaaaaucaccaucacgcagcgaugcuagacgucgaccuucacccggcaagcgcauggacccucuacgcgguggcuacgacuaucauaacaccuaugaugcgucauacuauagagaacacuacagcaaauauaucacuuacugccauagccaaccaggcagcaauucugauggguuuagacaaaggguggccuauaucaaaaauggacauugguguaccccuucuagcguugggcuguuauagccaaguaaacccauuaaccuugacagcugcuguccuaauguugguggcacauuacgcuauuauaggaccaggauugcaggcaaaagcaacuagggaagcucaaaagaggaccgccgcaggaauuaugaaaaaccccacgauagacggaauugucgcaauugaccuugauccuguaguuuaugacgcaaaauuugagaagcaacuaggacagauaaugcuacucauauuauguacaagucagauacuuuuaaugaggacaaccugggcgcuuugcgagucaauaacccuugcaacaggaccacuaaccacucucugggaagguaguccgggaaaguucuggaauacuacaauagcuguguccauggcaaacauauuuagaggaucauauuuagccggugcagguuuggcauuuagucuuaugaaaucacuagggggaggcagaagaggaacaggagcacagggugaaacauuaggugaaaaguggaagagacaauuaaaccaacucagcaaaagugaguuuaacaccuauaaaaggucaggaauaauggaaguugauaggagcgaagcuaaagaaggacuuaagagaggggaaacaacgaaacacgccgucucgagaggaacagcuaaauuaagaugguucguagagaggaaucuuguaaagccagaaggcaaaguaauugaucugggcugcgguagaggagguuggaguuauuauugugccggacucaagaaaguuacugaaguuaaaggcuauacuaaaggagggccaggacaugaagaaccgauucccauggcgacguacggguggaacuuggucaagcuccauagcggcaaagauguauucuuuauaccacccgaaaaaugugauaccuuacuaugcgacauaggagaaagcaguccaaauccaacaaucgaagaaggacggacacuucguguucuuaaaaugguagaaccgugguugcgaggaaaccaguuuuguauuaaaauacuaaaucccuauaugccgagcguaguugaaaccuuggaacaaaugcaacggaaacacggcggcauguuggugagaaauccacuaucaagaaacucaacucaugagauguauuggguaaguugcggaaccggaaacauaguuucagcagucaauaugacaaguagaaugcuccuaaaccgcuuuaccauggcacauagaaaaccgacuuaugaaagggauguggauuuaggggcggggacaaggcacguggcaguugaaccggaaguagcgaauuuggauauaaucggacaaagaaucgaaaacauaaagcaugagcacaaaucaaccuggcauuacgacgaagacaauccuuauaagacaugggcauaucaugggagcuaugagguaaaaccgucuggcagcgcaucuagcaugguuaauggcguaguaaaacuuuugacaaagccaugggauguuaucccuaugguuacgcaaaucgcgaugacagacacuacaccauuuggacaacaaagagucuuuaaagaaaaaguugacacacguacaccaaaggcgaaaagagguacugcacaaauaauggaaguuacugcucgcuggcuguggggauuuuugagcagaaauaagaaaccgagaauuugcacuagagaggaauuuacucgaaaaguaagaagcaacgcagcaauaggggccguguuugucgaugaaaaccaauggaacucugcuaaagaagcgguugaggacgaccgcuucugggacuugguucacagagaaagggaacugcauaaacaggggaagugcgcaaccuguguguauaauaugauggggaaacgagagaagaaacugggcgaguuugguaaagcuaaaggaaguagagcaauaugguacaugugguuaggugcacguuuucucgaauuugaagccuuagguuucaugaacgaggaccacugguucaguagagaaaacucccuaucaggagucgaaggagaaggauugcauaaacuuggauauauccuaagagauauaucuaagauuccaggcggaaauauguaugcggaugacacggcuggaugggauaccaggauaacagaagaugaucuccaaaaugaagcuaaaauaacagauauuauggaaccagagcaugcauuauuggccaaaucuauuuuuaagcuaacguaucaaaauaaaguuguacgaguucaacgaccugcuaagaauggaacaguuauggacgugauaucgagaagggaucaaagaggaucaggacagguuggaacauacggacuaaacacauuuaccaacauggaagcacaauuaauaaggcagauggaaucagaaggcauuuuucuaccuaaugaacuagaaacuccaaaccuagccggucgagucuuagauugguuagagaaauacggggucgaaagguuaaaacguauggcaaucuccggagacgauugcgugguaaaacccauugaugaucgauucgcuacugcacucacugccuugaacgacauggguaaaguacgaaaagacaucccucagugggaaccuucuaagggauggaaugauuggcaacaaguaccuuuuuguagccaucauuuucaucagcuaaucaugaaagacgguagagaaauuguuguucccugcagaaaucaggaugaguuagugggcagagcaagaguaucucaaggcgcaggcuggagcuuacgggaaacagcaugucuugggaaaucuuaugcucagauguggcaacucauguauuuucacaggagggaccugagacuagcugcaaaugcaauuuguagugccguaccgguggauugggucccaaccucgcggacaacgugguccauucaugcacaccaccaguggaugaccacggaagauaugcugucugucuggaaucggguguggauugaagagaauccauggauggaggacaaaacgcgcauuucaucaugggaagaugucccauaccuaggcaaacgagaggaccaguggugugggucucugauagguuuaacggccagagcuacaugggcuaccaacauacaaguugccaucaaucaaguaagacgucuuaucgggaacgaaaacuauagugacuauaugacaaguaugaaaagauucaaaaaugaaagcgaaccagaaggagccuuaugguaa

SEQ ID NO: 21775 - RNA, 9879 nt, Artificial Sequence
  derived and/or modified CDS sequence (opt6) from DENV-1__GU131681__SS-prME
ucggugacaauguuacucauguuaaugccuacagcauuagcuuuucaccuuaccacaagagggggagaaccacacaugauagucacaaaacaagaacgaggaaaaaguuuacucuuuaaaaccagugcuggugugaauauguguacacuuauugcaauggaucuaggcgaauuaugugaagauacaaugacuuacaaauguccgagaauaacugaagcagaaccagaugauguugauuguugguguaaugcaacagauacaugggugacguauggaaccugcucacaaacaggagaacaucgaagagauaaaaggucaguugcauuggcaccucauguaggauuaggacuagaaacacggaccgaaacguggauguccucagaaggugcauggaaacaaauucaacgaguugagaccugggcucugcgacauccggguuuuacaguaauagcacuauuuuuagcgcacgcaauuggaacgucaauuacucaaaaaggcauuauauucauucuccuuaugcuugucacuccgagcauggcgaugagauguguugggauugguucacgagacuucguagaaggucuuaguggggcaacuuggguagacgugguguuagagcauggaucuuguguaacaacuauggcaaaagacaaaccgacacuugauauugagcuccuaaaaaccgaaguaacaaaucccgcgguauuaagaaaacuaugcauagaggcuaaaauaucaaauacaacaacagauucacguugcccaacacaaggcgaagccacucugauggaagaacaagaugcaaacuucguguguagacguacuuuuguugauagagguuggggaaauggauguggauuguucgguaaaggaagucuaauaacaugcgcaaaauucaaauguguaaccaaauuagaagguaaaauaguacaauacgaaaaccuaaaauauuccguaaucguuacaguccacacuggcgaucaacaccaaguuggaaaugaaagcaccgaacauggaaccacugcaacaauaacgccacaggcuccgacaagugagauacaacuaacugauuacggugcacuaacguuagauuguagcccucguaccgggcuugauuuuaaugaaaugguucugcuaacaaugaaagagaaaucuuggcuaguucacaaacaaugguuucuugaccuaccucuuccguggacaucaggcgcauccacaagucaagaaaccuggaacagacaagaucuauuaguuacauucaaaaccgcccacgccaagaaacaggaggucguuguuuuaggaucgcaagagggugcuaugcacacagcacugaccggggcaaccgaaauacaaacaucaggaacaacaaccauauuugcaggacauuugaaaugccgauuaaaaauggauaaauuaacacuuaaagguauguccuacguuauguguacuggaucguuuaaacuagagaaagaagucgcugaaacgcaacaugggacuguuuuaguucaaauaaaauacgaaggaacugaugcgccuugcaaaauaccauuuucaacccaggacgagaaagggguuacucaaaaugguagacucauaacagcuaaucccaucgugacugacaaagaaaaacccgugaauauagaagcagagccuccguuuggagaaagcuacauuguuauaggggcgggggagaaggcuuuaaaacuaucaugguucaagaaaggaagcaguauaggaaaaauguucgaagcuacagcacguggagcuagaaggauggcaauauuaggugauaccgcuugggauuuuggcucaauuggggguguuuucacgaguguugggaaacugguacaccagauuuucggaacugcguauggcguucuauucagugguguaagcuggacaaugaagauagggaucggcguacuguuaacauggcuaggguuaaacucaagaagcacuagcuuaaguaugaccuguauagcagugggacuugucacuuuguacuuggggguuaugguccaagcugauuccgguuguguuauuaauuggaaagggagagaacuaaaaugugggucugguauuuucguaacuaaugaaguacacacauggacugaacaauacaaauuccaagcggauucucccaaaagauuaucggcggcaauuggcaaagcaugggaagaaggagucugcgguauccgauccgcuacacgacuagaaaacauaauguggaaacaaaucagcaacgaacugaaucacauauuauuagagaacgacaugaaguucacuguagugguaggugaugucguggguauacuagcacaaggcaagaaaaugauacgaccucagcccauggaacauaaauauaguuggaaaucauggggaaaagccaaaauaauuggagcugacguucagaacacaacauuuaucauagaugggccgaauacuccggaauguccagaugaucaaagagcauggaacauaugggaaguagaagauuauggguucgguauauuuacuacaaacauauggcucaaacuaagagauagcuacacucaaguuugugaucauagauuaaugagugcggcgauaaaagauaguaaagcaguucaugccgauaugggcuacuggaucgaaagcgagaaaaaugaaacauggaaacucgcacgggcauccuuuauugaaguuaagacauguaucuggccaaaaucacacacuuuguggucaaauggaguuuuggagucagagaugaucauccccaaaaucuauggcgguccaauaucacaacauaauuaucggccagguuauuuuacacagacugcaggaccguggcacuuagguaaauuagaauuagauuuugacuugugcgagggcacaacaguaguagucgacgaacauugugguaaucgcggcccaucuuuacgcacaacgacaguaaccggcaaaauaauucacgaaugguguugcaggaguuguacucuaccaccucuaagauucaaaggagaagauggauguugguauggaauggaaauucgaccggucaaagagaaagaagaaaaccugguaaaaucaaugguaucggcggguuccggagaaguagacaguuucucccuuggucuuuuauguaucucuauaaugauugaagaaguuaugcgaucaagguggucuagaaaaguccuaaugaccgggacgcuggcggucuuuuuauuauuaauuauggggcagcuuacauggaaugaucuaauuagauuauguaucaugguaggugcaaacgcaucugauaggaugggaaugggaacuacguaucucgcacuaauggcaacguucaaaaugaggcccauguuugcuguggguuugcucuuuaggagauuaacgucuagggaaguuuugcuacuaacaauaggacuaagucuuguagcaaguguagagcuuccaaauagcuuagaagaacucggugaugguuuggcuaugggcauaaugauacuaaagcuauugacagauuuccagucccaccaauuaugggcaacauuguuaucacuuacauucauaaaaacuacacuaucguuacacuaugcauggaagacaauggccaugguucuaucuauaguaucauuauucccacuuugcuugaguaccacaucucagaaaacaaccuggcuuccaguccuguuggguucacuaggauguaaaccguugacuauguuucucauugccgaaaauaaaauauggggaagaaaaaguuggccacuuaaugaaggaauaauggccgugggcguaguaaguauucuacuaagcagucucuugaaaaaugacguucccuuagcagggccuuuaauagcuggaggaaugcuuauagcuuguuauguaauuaguggaucaucggcggaccuaucauuagaaaaagccgcagaagucucgugggaggaagaagcagaacauucuggugcuagucacaauauacuugucgaggugcaagacgacgguacuaugaaaaucaaagacgaagaaagagacgacacuuugacgauauuacuaaaagcaacucuguuagcuguaagcggaguuuacccauuaagcaucccagcaacauuguucguuugguacuucuggcagaagaagaaacagagaaguggaguguuaugggauacuccaucaccgccagaaguagagcgagcggugcuagaugauggaauauaucggauuaugcaacgugguuugcuuggaagaucucaagugggcguaggcguuuuccaagaaaauguauuucauacuauguggcaugugacucguggagcuguucuaauguaucaagggaaacgucuagaaccuucuugggcaucagugaagaaagaccucaucaguuauggaggcggauggcgauuacaggguucuuggaauacaggugaagaaguucagguaauugcaguagagccuggcaaaaaucccaaaaacguccaaaccgcuccugggacauuuaagacacccgaaggagaagugggugcuaucgccuuagauuucaaacccggaacgagcgggucuccaaucguaaaccgagagggaaagaucguagguuuauacggcaacgggguaguuacuacaaguggcacguauguuagcgcaauugcucaagccaaagcaucacaagagggaccucuaccugaaauugaagaugagguuuuucgaaaaagaaaccuaacaauaauggaucuccauccaggguccggaaagacgcggcguuaucuaccggccauuguacgagaagcaauuaaaaggaaacuccguacacugauccuagcucccaccagagucguggcaagugagauggcugaggcacugaaaggaaugccaauucgcuaucaaacaaccgcuguaaaaagcgagcauacaggaaaagaaauaguugaccucaugugccacgccacguucacaaugagacuguugucuccuguuagaguacccaauuauaauaugaucauaauggaugaagcucacuuuacagaucccucuaguauugcagccagagguuacauuucgacgcgaguuggaaugggagaagccgccgcgauuuucaugacagcuacgcccccaggaagcguggaagccuucccacaaucuaacgcaguuauacaagacgaggaacgagacauaccagagagaagcuggaacucaggauaugaauggauaacggauuucccuggaaaaaccguaugguucguaccaagcauuaaaagugguaaugauauagcuaacugcuugaggaaaaauggaaaacgcguaauacagcuuagcagaaaaacguuugauacggaauaucagaaaacuaagaauaaugacugggacuacguugugacaaccgauauaagcgagaugggagcaaauuucagggccgaucgaguaauagauccgcgacgguguuuaaagccaguuauccuuaaagacggaccugagagaguuaucuuggccgggccuaugccuguaacaguagcaucggcugcacaaagaaggggacgcauagguaggaaccauaauaaggagggggaucaauacauauauauggggcaaccacucaauaaugaugaagaucaugcacauuggacagaggcaaaaaugcuuuuagauaacaucaauacgccagagggaauuauuccagcacuguuugaacccgaaagagaaaaaucagcugcaauagacggugaauaucguuuacgaggagaagcacguaaaacuuuuguggaauuaaugcgaagaggagaccuaccuguauggcuaucauauaagguggcaagcgaaggauuccaauauuccgauaggcguugguguuuugauggugaaagaaauaaucaagugcucgaagaaaacauggacgucgagauuuggacaaaagagggagaacguaaaaagcuacggccaagaugguuagaugcacgaacauacucggauccgcuagcauuaagagaguuuaaagaguuugcagccgggagaagaagugugagcggagacuuaauccuugagauuggaaaacugccacaacaucuaacacaacgagcacaaaaugcacucgauaaccucgucauguuacacaauucugagcaagguggaagggccuaccgccaugcaauggaggaauugccugauacaaucgagacuuuaaugcuauuagcgcucauagcuguccuaacaggcggaguaacauuguuuuuccuaucagguagaggacuaggcaaaacgucaauaggauuauugugugucauggcaucaucagugcuguuauggauggcuagcgucgaaccacauuggauagcugcuucaaucauacuugaguucuuucuaaugguauuauuaauuccagaaccagacaggcaaagaacaccacaagauaaucaacuagcauacgugguaauugguuuacuauuuaugauacucacaguggcagcgaacgaaauggggcuucuagaaacaaccaagaaagaucuuggaauuggccacguagcuguagaaaaccaccaccaugcuacuauguuggacguagacuugcauccagcauccgcauggacguuguaugccguagcaacaaccauuauaacuccuaugaugcgccauacaaucgagaauacuacggcaaauauaucguuaacugcuauugccaaucaagccgcgauacugauggggcuagauaaaggcuggccgauaaguaaaauggacauaggaguuccacugcuugcauuaggcuguuauagucaaguaaauccacuaacucucacggcugcgguccuuauguuaguagcucauuacgcaaucauaggcccuggacugcaagcuaaggcuaccagagaagcacagaaacggacagcagcaggaaucaugaaaaauccaacagucgacggaauaguagccauugacuuagacccaguuguauaugacgccaaauuugaaaaacaacugggucaaauaauguuacuuauauugugcacgagccaaauacuucugaugagaacaacuugggcccuaugcgaaucaauaacacuugcaacuggaccacuaacuacgcuuugggaaggcucuccagggaaauuuuggaacacgacgauugcagugagcauggcaaacauauuuaggggaagcuauuuagccggagccggacuagcauucagccugaugaagucacuuggaggaggucggcggggaacgggggcacaaggagagacuuugggagaaaaauggaagagacaauuaaaucagcuaagcaagucugaauuuaauauuuauaagcguagcggaauuauggaaguugacaggucugaagcaaaagagggccucaaaagaggggaaacuacaagacaugcugucucucggggaacugcaaagcucaggugguuuguagaaaggaaucuugugaaaccagaaggcaaggucauagacuuaggaugugggcgaggaggcuggagcuauuauugcgccggccuuaaaaagguaacagaaguuaaaggauauacuaaaggcggacccggucacgaagaaccuaucccaauggcuacauacggauggaaucuagucaaauuacauagcgggaaagauguauucuuuacaccaccagagaaaugugacacccucuuaugcgauaucggcgaaucuucaccaaacccaaccauagaagaaggcaggacauuaagggucuuaaaaaugguagagccaugguuaagaggcaaucaauuuuguaucaaaauacugaaucccuacaugccaaguguugucgaaacacuagaacaaaugcaacguaaacacggggguaugcuaguaaggaacccgcuaucucguaacucaacacaugaaauguauuggguaaguugcggaacaggaaacauagugucggccguaaauaugaccucaagaaugcugcuuaaccgcuucacgauggcacacagaaaaccuaccuacgaacgugacgucgaccugggagcagguacuagacauguugccguagaaccugaggucgccaaccucgacauuauuggccaacgaauugaaaauauaaagcaugagcacaaaucaacuuggcacuaugaugaagacaauccguauaaaaccugggccuaccauggaaguuacgaaguaaagccuuccgguuccgcuucaucgauggucaacgguguaguaaaguugcucaccaagccaugggacgucauacccaugguaacacaaauugcuaugacggacacaacaccuuucggucaacaaagaguauucaaagaaaagguugauaccagaaccccgaaagcuaagcggggaacagcgcaaaucauggaaguuacagcgcgauggcuauggggauuccuaucucgcaauaagaaaccccguaucuguaccagagaagaguucacacgaaaaguaagaaguaacgcagcaauaggagcugucuucguagacgaaaaccaauggaacucggcuaaagaggcuguagaagaugaacgcuucugggacuuaguucaaaaagaaagagagcuacacaaacaagggaaaugugcgacgugcguguauaacaugaugggaaaaagggagaagaaacuaggugaauuugggaaagcaaaaggcucccgggcgauuugguauaugugguuaggcgcuagauuucuagaauuugaagcacucggauucaugaaugaagaccauugguuuucucgagaaaauucacuaaguggagucgaaggugaaggccuucauaaauuaggguacauacucagagauauauccaaaauaccuggcggaaacauguaugccgacgacacggcaggaugggauacaaggauaacagaggaugaucuucagaacgaagccaaaaucacagauauaauggaaccagagcaugcacuguuagcuaccaguauauuuaaauugacauaucagaauaaaguugugaggguacagcgaccugccaaaaauggaaccgugauggacguaauaucaaggagagaccaacgaggaucgggacaagucggaacauaugguuuaaauacuuuuacaaauaugggagcacaacuuauacgacaaauggaauccgaggguauauucagcccuucagaacuagagaucccaaauuuagccgaaagaguccuggauugguuggaaaaauacggcgucgaaagacuaaaacggauggccauaaguggggacgauugcgucgugaagccaauagaugaucgauuugcuacggcuuuaacagcacucaacgauauggguaagguaagaaaggauguuccgcaaugggagccaucaaaaggcuggaaugauuggcaacaggucccauuuuguagucaucauuuccaccaauuaauaaugaaggauggcagggaaauaguaguacccugcaggaaccaagacgagcuagucggacgugcgcgaguaucacagggagccgggugguccuuacgagagacagcaugucuagggaaaucauacgcacaaauguggcaauuaauguacuuccauagaagagacuuaagacucgcggcaaaugcaauauguucggcaguucccguagauuggguaccuacuucucgaacgacauggucaauccaugcacaccaucaauggaugacgacugaggauaugcuaagcguuuggaauaggguuuggauagaagaaaacccauggauggaagauaaaacucauguuagcucauggggagaugucccauacuuagguaaacgagaagaucaauggugcggcucuuugauuggauuaacugcgagggcaacaugggcuucuaauauucaaguugcaauuaaucaagugcguagguuaauagggaaugaaaauuaucucgauuauaugaccucgaugaaacguuuuaaaaacgaaggcgacccggaaggggcauuaugguaa

SEQ ID NO: 21776 - RNA, 9879 nt, Artificial Sequence
  derived and/or modified CDS sequence (opt6) from DENV-1__GU131682__SS-prME
ucuguaacaaugcuucuaaugcucaugccaacugcucuggcuuuucauuuaacaacgagaggaggagaaccacacaugauuguaucgaaacaagaacggggaaaaucauugcuguuuaaaacgucugcuggcguuaacauguguacacucaucgcaauggaucuaggagaacuuugcgaagacaccaugacuuauaaaugcccucguauuacagaaacggaacccgacgacguagacuguuggugcaacgcuacugacacauggguuaccuacggcacaugcagucaaacuggugaacauagaagagauaaacguaguguagcauuagcaccacauguagguuuaggcuuggaaacuagaacggaaacguggauguccucagaaggugcuuggaaacaaauucaaaggguugaaacaugggcuuuaaggcacccaggguuuacggucauagcauuauucuuggcacaugugaucgguaccuccauuacucaaaaagggauaaucuuuauuuuauuaaugcuggucacaccaucgauggcaaugagaugcguuggaauugguuccagggauuuuguggaagggcuuucuggagcuaccuggguugauguaguauuggaacaugguuccugcguaacaacaauggcaaaagauaaaccgacacuugauauugaacuccuaaaaacugaaguaacuaauccagcaguccuaagaaaauuguguauugaggcaaaaauaucuaacacaacaacagauuccagaugccccacacaaggggaagcgacauugguugaagaacaagacgcaaacuucguaugccggcgaacuuuuguagauagaggauggggcaauggaugugguuuguuugggaaagggucauuaauuacuugugcuaaauuuaaaugugucacuaaacuagaaggaaaaauaguucaauaugagaauuuaaaauauucugugauaguuaccguucauacaggugaucaacaccaggucggaaaugaaucaacagaacaugggaccacagcuacaauaacgccgcaggcgccaacaaccgaaauccaauuaacagauuauggugcauuaacucuggacuguucaccaaggacagguuuagacuuuaacgagaugguauuauugacaaugaaagaaaaauccuggcuagugcauaaacaaugguuuuuagauuuaccacuuccuuggacaagcggagcauccaccagucaggagacauggaaucggcaggacuuauuaguaacuuucaaaaccgcacaugccaagaaacaagaggucguuguuuuagguagucaagaaggugccaugcauacugcauuaaccggagcuacagaaauacagacuagcggcacuaccacuaucuuugcaggucacuuaaaauguagauugaaaauggacaaauuaacacuuaaagguaugucauaugucaugugcacaggaucguuuaaacuagaaaaagaaguagcugagacacaacacgguacaguccuugugcaaauaaaauaugagggaacggaugcacccuguaaaauuccauuuucaacccaagacgaaaaggguguaacccaaaauggaaggcuaaucacugccaauccaauugucacagauaaagaaaaaccaguuaauauagaggcagagccgccauuuggugaaaguuauauaaucauuggagccggagaaaaagccuugaaauuaucaugguuuaagaaagggagcuccauaggaaaaauguuugaagcaaccgccagaggggcaagaagaauggcuauucuaggugacacggcaugggauuucggaaguauaggcggggucuucacauccguaggaaaauuaguacaucaaauuuucggaacugcuuaugggguccuauuuucaggagucuccuggacuaugaagauaggcaucggagucuuauuaacauggcuagguuuaaacucuagaagcacaucuuuauccaugacuugcauagccguuggccuaguaacauuauaccugggaguuaugguacaagcagacucagguuguguuauaaauuggaaaggacgagaauuaaaauguggaucuggaauauuuguuaccaaugaaguccauacauggacggagcaauacaaauuucaagccgauuccccaaaaagguuaucugcugcgauaggaaaggcaugggaggaggguguauguggaauacgguccgcuacucgcuuagagaauauuauguggaagcaaauaucgaaugaauugaaucauauacuacuugaaaaugauaugaaauucacuguaguuguaggagacgucgccggcauccucgcgcaggggaagaaaaugauacgcccacaaccaauggagcauaaguacucauggaaaucgugggguaaagcuaaaauaauuggcgcggaugugcaaaauacaacauuuauaauagaugguccuaauacacccgaguguccagaugaccaaagggcauggaacauuugggaaguagaagauuauggauucggaauauuuacuaccaacauauggcuaaaacuacgcgauuccuauacacaaguaugugaucacagauuaaugucugcagcgauuaaagacaguaaagcaguacacgcugacaugggcuauuggaucgagucagaaaagaacgagacauggaaacucgcaagagcgucauuuauagaaguuaagacuuguauauggccaaaaucucauacucuauggaguaauggcguguuagagucggaaaugauuauaccaaaaauauaugguggcccuauuagucaacacaauuaccggccagguuacuucacgcagaccgcugguccauggcaucuaggaaaacuagaauuggauuuugaucuuugcgaggguacuacgguaguaguggacgagcauuguggaaaccgggggcccucuuuacgcaccacuacaguaacggguaagaucauucaugaaugguguugccgcaguugcaccuuaccuccauuacgcuuucguggagaagauggaugcugguauggaauggaaauaaggccaguaaaagagaaagaggagaaucucguaaaaagcaugguaucagcaggcucuggcgaaguagacucauuuagcuugggauugcuaugcaucucaauuaugauagaagaaguaaugcggucgagguggucccgcaaaauguugaugacagggacucuggcaguauucuuuuuauuaaucaugggccaauugacauggaaugacuuaauuagguuaugcauuauggugggggcaaacgccagugacagaauggguaugggaacaacauacuuagcacuaauggccacauucaaaaugaggccuauguuugcaguagguuugcucuuuaggcgacuaaccucaagagaggugcuccuauuaacaaucggacuuagcuuaguggcuucuguggaguuaccaaacagccuagaagaauugggagaugggcuugcgauggguaucaugauucuaaaacuacuuaccgauuuccaaucucaccaacucugggccacacuccugagucuuaccuucauuaaaacuacauuuuccuuacauuaugccuggaaaacgauggcaaugguuuuauccauagugagucuuuuccccuuguguuuaaguacaacaagccagaaaacuacuugguuaccagucuuacuagguucccuuggcugcaaaccguuaacuauguuucugauagcagagaauaaaauaugggguagaagaagcuggccacuaaaugaaggaauaauggccguuggaauaguaagcauuuuacucagcucguuauuaaagaaugacguuccacuagcugguccacucauugcugguggaaugcuuauagcguguuauguaauuucagguucgagugcagaccucagcuuagaaaaggccgcagaaguuucaugggaggaagaagcagaacauucaggcgcaucacacaauauacucguugaaguacaagacgacgggacuaugaaaauuaaagacgaggagcgagacgauacauuaacaauauuacugaaagcgacuuuauuagccguaucggggguguacccucuaaguauuccagcaacgcucuuuguaugguacuuuuggcaaaagaagaaacaacggagcggugucuuaugggauacaccaucgccuccagaaguggaaagggcagugcuagaugauggaauauacaggauuaugcaaagagguuuguugggaaggucacaagugggaguagggguauuccaagaaaauguauuccauacaauguggcacguuacacgaggggcugugcuuauguaucaaggaaaaagauuagaaccaucuugggccucugucaagaaagauuugauaucauacgguggaggauggcgcuuacaggggagcuggaacacuggugaggaaguccaaguaauugcugucgagccuggcaaaaaucccaaaaaugugcagacggcgccaggaacuuucaagacacccgaaggggaggugggcgcuauugcacuagauuuuaaaccugguacaagugggaguccgauuguuaauagggaaggaaaaaucgugggacuguacggaaacgguguaguaaccaccucgggaacuuauguaagugcaauugcucaagcaaaagcaagucaagaaggaccgcuaccugaaauugaggacgaaguguuucggaaaagaaaucuuacaauaauggauuuacacccaggaucaggcaagacucgccgauauuuaccggcaauuguacgugaagcuauaaaacguaagcugcguacauuaaucuuagcgccaacaaggguaguagcgucugaaauggcagaagcccucaaaggaaugccgauacgauaucaaacgacagccguuaaaucagagcacaccgggaaagaaaucguagauuugaugugccaugccacauuuacaaugcguuuacuaucaccaguaaggguaccuaacuauaauaugauaauuauggaugaagcacacuucacagacccuaguucaauagcagcaaggggcuacauuaguacuagaguuggaaugggagaggcugccgcuaucuucaugacugcaacuccaccaggaucgguagaggcuuuuccacaaaguaaugcgguuauucaagaugaggaacgugacauaccagaacgaucauggaacucaggauacgaauggauaacugauuuuccuggaaaaacaguaugguuuguucccuccaucaaaucuggaaaugacauugcgaauugcuuaagaaagaaugggaaacgaguuauucaauuaucaagaaaaacauucgacacugaguaucagaaaaccaaaaauaacgauugggacuauguagugacaacugauauuucggagaugggagcuaauuuuagggcagauagagugaucgauccacgaaggugucugaagccaguaauuuugaaggauggaccagaacgagucauauuggcuggcccuaugccuguuaccguugccagugcagcacaacgaagaggaagaaucgggagaaaccacaacaaagaaggcgaucaauauauuuacaugggacaaccuuugaacaaugacgaagaucaugcacauuggaccgaggccaagaugcuauuagauaacauuaauacgccagaaggaauuauccccgccuuauucgaaccagaaagagagaaaagcgcugcaaucgauggcgaauacagauuacgcggugaggcucguaaaacuuucgucgaauuaaugagacguggggaucucccagucuggcuaucuuacaagguagcuucugagggauuucaauacucugacaggagaugguguuucgauggcgaacgcaauaaccaagugcuagaggaaaacauggaugucgaaauauggacgaaggaaggcgagcgaaagaaacuucguccucgauggcuugaugcuagaaccuauagcgauccauuggcauugcgagaauuuaaggaguucgcagcuggucgucguaguguuucaggcgaccuaaucuuagagauugggaaauugccacaacacuugacgcaacgagcgcagaacgcucuagauaauuuagugaugcuccacaacucugaacaaggagggagagcuuauagacacgccauggaggaauuaccagacacgauugagacccuaaugcuauuagcgcuuauugcaguacucacuggcggaguuacuuuauucuuuuuaucagguagagguuuagggaagacaaguaucggacuuuuauguguuauggcuucaucuguucuucuguggauggcuucugucgaaccgcacuggaucgcagcaaguauuauauuagaauuuuuccuuaugguauugcuuauccccgaacccgaucgacaaaggacaccucaggauaaucaacucgcuuauguuguaaucggguugcucuuuaugauucuaaccguggcagccaacgaaaugggauugcucgaaacuacaaagaaagauuuaggaaucggucacgucgcaguagagaaccaccaucaugcagcuaugcuagaugucgacuuacauccagccagugcuuggacacuuuacgcggucgcaacgacaauaauaacuccaaugaugcgucauacgauagagaauacgaccgcgaacauuagucugaccgcaauagcaaaucaggcagcuauuuuaauggguuuagauaaaggcuggccaauaaguaaaauggauaucggggucccacuacucgccuugggcuguuacucacaaguaaacccuuuaacacugacagcagcaguacuaaugcugguugcacauuacgcgauaauugggccaggacuacaagcuaaagcaacgcgugaagcccagaaaagaacagccgcaggaaucaugaaaaauccgacagucgauggaauaguagcaauagauuuagacccgguaguauacgaugcuaaauucgaaaaacaauuaggacagaucaugcuucucauuuuguguacaucccagauacucuuaaugagaacgacuugggcucuuugcgaaaguauuacccuugcaacagguccucuaacgacucuaugggaagggucuccagguaaauucuggaacacuaccauagcagugaguauggcuaauauauuuagggguucuuaucuugccggugcuggacuagcauucucucuuaugaaaaguuuaggagguggccguagaggaaccggcgcacaaggugaaacauuaggcgaaaaauggaaaagacagcuaaaccaauugagcaagagugaguuuaauacauacaaacgaaguggaauuauggaggucgaucgcucagaagccaaagaagguuuaaaaagaggagaaacuacgaagcacgccguuagcagaggaacggcgaaacuuagaugguucguggagagaaaccuaguuaagcccgaaggcaagguuauagacuuagguuguggucgaggcgggugguccuacuauugcgcaggguugaagaaaguaacagaagucaaaggauacacaaaaggcggcccgggacaugaagaaccuauuccuauggcgacuuacggauggaaccuggugaaauuacauaguggaaaggaugucuucuucauaccaccugaaaaaugcgacacccuuuuaugugacaucggagaaaguagcccuaauccaacaauagaagaaggucgaacgcuaagaguacuaaaaaugguggagccauggcuacgcgggaaccaauuuuguaucaagaucuugaauccuuauaugccaucagucguggaaacgcucgaacaaaugcaacgaaaacauggaggaauguugguacgaaauccgcugagccguaauagcacucacgaaauguacuggguaucaugcgggacgggcaacauagugucugcaguaaacaugacaucaaggaugcuuuuaaauagauuuaccauggcacaccgaaagccaacuuaugaaagggauguugaucuaggugcuggcaccaggcacguagcuguagaaccagaaguugcaaauuuagauauuauaggacaaagaauagaaaauauuaaacaugaacacaaaucuacuuggcacuaugaugaagauaacccguauaagacaugggcauaucauggaucauaugaaguuaaaccauccgguagcgccucaaguaugguaaaugguguaguaaaacugcuaacaaaacccugggauguaauaccuauggugacucaaauugcuaugacugacacaacuccauucggccaacaacguguauucaaggaaaaaguggauacuagaacaccuaaagccaaaagaggaacagcucaaaucauggaggugacagcgaaauggcuauggggauuucuaucaaggaauaagaaaccaagaauauguacacgcgaagaguucacaagaaaagucaggaguaacgcagcaauuggagccguuuucguagacgaaaaucaauggaacucugcuaaggaagccguagaggacgaacguuucugggacuuaguccaccgugaaagagagcuacacaagcaaggaaaaugugcaacuuguguuuauaacaugaugggcaaacgggagaagaaacugggugaauuugguaaagccaaaggcagcagggcgauaugguauauguggcugggugccagauuccuagaauuugaagcucuaggauucaugaaugaagaucauugguuuagcagagaaaauucacuaaguggagucgaaggggaagggcuucauaaguuggguuacauacugcgagauauuucgaaaauucccggaggcaacauguacgcggacgauacagcugguugggauacacguaucaccgaagacgaccuacagaacgaagcacgaauuacagacauaauggagccagaacacgcguuacucgcuaaaagcaucuuuaagcuaacauaccaaaauaaaguagugaggguacaacgaccagcgaaaaacgguacaguaauggauguaaucagcagacgcgaucaaagaggaucaggccaagugggaacauacgguuuaaauacauucaccaauauggaagcacaguuaauaagacaaauggaaucugagggaauauuuaguccuucugaauuagaaaccccaaacuuagcagaacgaguccuggauuggcuugaaaaauauggaguugagagacuuaagcgcauggcaauaucgggagacgauugcguggugaaaccuauagaugauagauuugccacagcgcuaacagcucucaacgauaugggaaagguaagaaaagauauuccgcagugggaaccuucaaaaggauggaaugacuggcagcaaguucccuucuguagccaucacuuucaccaauugaucaugaaagauggaagagaaauaguaguucccugcagaaaccaagaugaguuggugggucgagcacggguaucucaaggugcuggauggagucuuagagagacugcauguuuggggaaaaguuaugcccagauguggcaacuuauguauuuucaucgacgugaucuccgcuuagcagccaacgcaauuugcucagcaguaccaguagauuggaucccaacgucgagaaccaccuggaguauacacgcgcaucaccaauggaugaccacagaagauauguugagcguuuggaaucgaguauggauagaggagaaccccuggauggaagauaaaacacauauaaguagcuggggagauguucccuauuugggaaaacgcgaggaccaaugguguggaucauuaauaggucucaccgcgcgggcgacaugggcgaccaacauacaaguugcaauaaaucaaguaagaagacuaauagguaaugaaaacuacuuagacuacaugacuucaaugaaacgauucaaaaacgagucagaucccgaaggcgcccuuugguaa

SEQ ID NO: 21777 - RNA, 9879 nt, Artificial Sequence
  derived and/or modified CDS sequence (opt6) from DENV-1__GU131683__SS-prME
ucagugacuauguuguugaugcuuaugccgacugcacuagccuuucauuuaacuacaagagggggugaaccccauaugauugugucaaaacaagaacgugggaaauccuuacuguucaaaacucccgcgggcgugaacauguguacacuaauugcuauggacuuaggugagcuaugcgaagauacuaugacauacaaaugcccaaggauuaccgaaaccgaaccggaugacguugauugcugguguaacgcaacagacacauggguuacauauggaaccugcucacaaaccggagagcaccgacgagauaaaagauccguagcacucgccccacauguuggucuuggucuugaaacgagaacagaaacguggaugucuagugaaggggcuuggaaacaaauacaaagaguugagacaugggcuuugagacauccaggcuuuacuguaauugcguuauuucucgcccacgcaauagggacgucgauaacucaaaagggaauaauauuuauauugcugaugcucguuacuccgaguauggcgaugagauguguaggaauagggucacgagauuuugucgaagggcuaaguggagcgacauggguugauguaguccuggagcauggaaguuguguaacaacaauggcaaaagauaagcccacacucgauaucgaauuacuuaaaacggaaguaacaaacccugccguucuacggaaacuuuguauagaagcuaaaaucuccaacacaacgacugauucaagauguccuacucaaggugaagcaaccuugguggaagaacaagacgcaaauuuuguaugcagaagaacauuuguagaccguggguggggaaacggguguggacuauuuggcaagggcagccuaauaacuugcgcaaaauuuaaguguguaaccaaauuagaaggaaaaauaguacaauaugagaaucuuaaauauagugucauaguaacaguacacacgggagaccaacaucaaguaggaaaugaaucaacagaacaugguacaaccgcgaccauaacaccgcaagcacccaccacagaaauucaacuuacagauuacggugcgcuaacuuuagauugcaguccgcgaacaggauuggacuuuaacgagauggugcuauuaacaaugaaagaaaaaucuugguuggcgcauaaacaaugguuuuuagacuuaccucuuccuuggacaucaggagcaagcacgucccaagaaacguggaacaggcaggaucuuuuaguuaccuucaagacggcucaugcuaagaagcaagaaguagugguauuaggaagucaagaaggggcuaugcauacagcccuaacuggugccacagaaauccaaacuuccggaacaacuacaaucuuugcaggucaccugaaaugcagacuuaaaauggauaaauuaacccugaaaggaaugaguuauguaaugugcacaggaucauucaaacuggaaaaagaacuggcugaaacacaacacggaacaguccuuguacagauaaaguaugaaggaacagaugcaccuuguaaaauacccuuuaguacacaagaugaaaaaggagugacacaaaacgggcggcuuauuaccgcuaauccuauagugacagauaaagaaaaaccugucaauauugaagccgaaccaccauuuggagaaucauacaucguuauaggcgccggugaaaaagcucuuaaguuaucuugguucaagaaaggaucgucaauuggaaaaauguucgaggccacagcacggggcgcuaggaggauggcaauauuaggagauacugcuugggauuuugguucuauuggagguguguucacuucggcagguaaauuaguacaucaaauuuuuggaacagccuaugggguucuauucuccggugugucauggaccaugaaaaucggcauaggagucuuauuaacgugguuaggacugaacucaaggucaacaucauuauccaugacuuguauagcaguuggauugguuacccuuuaucuaggugucaugguccaagcugacuccggaugcgugauuaacuggaaaggaagggagcuaaaaugcgggucuggaaucuucguuacaaaugaaguucacacuuggacagaacaauauaaauuccaagcagauagucccaagcgccuuucagccgcaauaggaaaagcaugggaagaggguguaugugguaucaggucugcaacacgucuagaaaacauaauguggaaacaaauuaguaacgaauuaaaccauauauuacuugaaaaugacaugaaauucacuguuguuguuggcgauguagccggcauucuugcucaaggcaagaaaaugauacgaccccagccaauggaauacaaauacucguggaaaucauggggaaaagcuaaaauaauuggggcugacguucaaaauacaacauuuauuaucgacggcccaaauacuccggaauguccugaugaccaaagggccuggaauaucugggaaguggaagacuacggauuuggaaucuucacaacgaauauauggcuaaagcucagagauagcuacacacaaguuugugaucacagacuuaugucggcugcaauuaaagacaguaaagcagugcacgcagauaugggauacuggaucgagucggagaaaaaugaaacuuggaaguuagccagggccuucuuuauagaagugaaaacauguauauggccuaaaucacauacucuguggaguaauggaguuuuagaaucagagaugauuauaccaaaaauauacgguggcccaauuagccaacacaauuacagaccggguuauuuuacucagacugccggaccguggcaucucggaaaguuagaauuagauuucgaucucugugaggggacaacaguaguaguagaugaacacuguggaaauagggggccaucauuaagaacuacaacaguaacaggaaaaauaauacacgaauggugcugucggucuugcacauuaccaccauuaagauuucguggcgaagauggaugcugguauggaauggaaauucgaccagugaaagaaaaagaagaaaacuugguuaaguccaugguaucggcaggaagcggugagguugauucuuuuucauuaggacuccucugcauaagcauaaugaucgaagaagugaugagguccagauggagucguaaaaugcuaaugaccggaacccucgcaguauucuuucucuuaauaauggggcaacuaacguggaacgaucuuauacgcuuaugcauuaugguaggggcuaaugcaucggaccgaauggggauggguacuacauauuuagcccuaauggcaacuuuuaaaaugaggccaauguuugcuguggggcuucuauucagacgacugacgagcagggaggucuugcuauuaacaauaggucuuagccuagucgcgagugucgagcuaccuaacucuuuggaagaacuaggagacgggcuugcgauggguauuaugauacuuaaguuauuaaccgauuuccaaucacaccaacuuugggcaacacuuuugagcuuaacauuuauuaaaacaacauucucgcuacauuacgccuggaaaacuauggccaugguccugaguaucgucucuuuguuuccuuuauguuuaucuacuacaagucagaaaacuacuuggcuaccaguccuauuaggaucacuuggauguaagccccuuacaauguuucuaauugcagagaacaaaauaugggguagaagaucauggccccuaaaugaagggaucauggccgucgguauuguaucgauauuauuaaguucacuuuugaaaaacgacgucccgcuggcaggcccuuuaauagcuggaggcauguuaauugcgugcuacguaauuucugguucauccgcagauuuaucauuagaaaaagcagcugaaguaaguugggaagaagaagcagagcauucuggggcgucccauaacauccucgucgaaguucaagaugaugguaccaugaaaauaaaagaugaagagagagaugauacccucacgauacuauugaaagcaacauuguuggcgguuuccggaguuuauccguuguccauuccagcaacuuuguucguuugguacuucuggcaaaagaagaaacaaagauccgguguuuuaugggacaccccuaguccacccgaaguagagagagccguacuugaugacgggauauacaggauaaugcaaagaggacuucuagggcguucccaaguagguguuggugucuuucaagaaaauguauuccacacuauguggcauguuacucggggugcuguccuaauguaccaagguaaacgacuggaaccaaguugggcaaguguaaagaaagauuugauuucauauggaggaggguggagauuacagggaucauggaacacgggcgaagaggugcaaguaauugcaguugaaccagguaagaauccaaagaauguacaaacugcuccaggcacauucaaaaccccagaaggagaaguaggagcuauagcgcuagacuucaaaccuggaacgaguggcucgcccauuguuaaucgugaaggaaaaauuguaggauuguacgggaauggaguuguaacuacaucggggacauaugugagugccauugcgcaagcgaaagccagccaggaaggaccauuaccagagaucgaagaugaagucuuuagaaaaagaaacuugacaauuauggauuuacauccaggaagugguaagacccgcagauaucugccugcaauaguaagggaagccauaaaaaggaaacugagaacuuuaaucuuggcucccacccgaguagucgcauccgaaauggcagaagcccucaaagguaugcccauccguuaccaaacuacagcagucaaaagcgaacacacuggcaaagaaauuguagauuuaaugugucaugcuaccuuuacgaugcgguuauuaucuccugucaggguaccaaauuauaauaugauaauaauggaugaggcacauuuuacagaucccuccaguauagcugcccgaggauacauaucuacgagaguaggaaugggagaagcggcugccauauuuaugacagccacuccuccaggcucaguugaagccuuuccucagagcaaugcgguuauucaagaugaagagagggauauuccugagcggucauggaauagcggauaugaauggauaacagauuuucccgguaaaacuguaugguuugucccaagcauuaaaucaggaaacgacauagccaacugccuaagaaagaaugguaaaagggucauucagcuaucaaggaaaacauuugacacugaauaccagaaaacaaagaacaaugacugggauuacgucgucacuacugauauuucggagaugggcgcgaacuuuagagccgauaggguaauagauccacggagaugcuuaaaaccagugauacuuaaagacgguccugaacguguaauauuagcggguccaaugcccgugacgguagcuagugcagcacagcgccgaggccgaauagguagaaaccauaauaaagaaggcgaucaguauaucuauaugggccaaccacuaaauaaugaugaagaucaugcccauuggacagaagcgaaaauguuacuagacaauauaaauacaccugaaggaauuauuccagcccucuuugaaccugaacgagagaagucagcugcaauagacggugaauauagacuacgcggugaagcacggaaaacuuuuguugaauuaaugcgacgcggagaccuuccaguaugguuaucauacaaaguugcauccgaggguuuucaauauucugauagaagaugguguuucgauggcgaaaggaauaaucaaguacucgaagaaaacauggauguagaaaucuggacgaaagaaggcgaacgcaagaaauuacguccuagaugguuggaugcaaggaccuacagugacccauuagcgcuuagggaauuuaaagaauuugcagccggaaggcgguccguuaguggagaccuaauacuugaaauuggcaaacugccacaacaucuuacucagcgcgcucagaaugcacuugacaauuuagucauguuacauaacagugaacaaggaggacgggcauauagacaugcuauggaagaauuaccagacacgauugaaacuuuaaugcuauuggcuuuaauugcaguauuaacaggaggaguaacauuauucuuucuuucagguagaggccuagguaaaacgucuauuggucuacuuugcguuauggcaaguagcguccuucucuggauggcuucaguugagccacauuggaucgcggcaagcauaauauuagaguucuuucuaaugguacugcugauaccugaaccugacaggcaaagaaccccacaggacaaccaacuagcuuacguugucaucgggcuacuguuuaugaucuuaacagucgcagccaaugaaaugggcuuauuggaaaccacaaagaaagauuuaggcauuggacauguagcggucgaaaaccaucaucaugccgcaauguuagauguagacuuacacccagcuucagcauggacgcuuuaugcaguugcuacgacuauaauuacgcccaugaugagacacacuaucgaaaauacgaccgccaacauaucgcucacugcaauagcaaaccaagcggcaauacucauggguuuagauaaaggguggccaauaucuaaaauggacauuggcguaccucuauuggcucuuggauguuauagucaaguaaacccuuuaacccuaacagcagcggucuuaaugcucgucgcccauuaugcaauaaucgguccuggauuacaagccaaagcgacuagggaagcacaaaaacggacagcagcggggauuaugaaaaauccaacuguagauggaauaguugcuauagaccuugacccaguuguauaugacgccaaauucgaaaagcaauuaggccaaauaaugcuguuaauacugugcacgagucagauauuguuaaugcguacaacgugggcacucugugagucuauaacccuugccacugguccacuaacuacgcucugggaaggaagucccgggaaauuuuggaauacuacaauagcagucagcauggcaaauauauucagggggaguuaucuagcgggugcgggucuggcauuuagcuuaaugaagucauuaggaggagguaggaggggaacaggcgcacaaggugaaacauuaggagaaaaauggaaacgucaguugaaucaacucuccaagucagaauuuaauacguauaaaaggucagggaucauggagguagacagaagugaagcaaaggaagggcugaaacgcggugaaacgacuaaacaugcagugagucgcggaacggccaaacuacgaugguuuguggagcgcaauuuaguaaaaccugagggcaaaguuauugauuuaggaugcggacguggaggguggucguacuauugugcaggacugaagaaaguuacagaagugaagggauauacuaaggguggcccgggucacgaagaaccaauaccaauggcaacauauggcuggaaccuuguuaaacuucauucgggcaaagauguauuuuucaucccaccagaaaaaugcgacacucugcuaugugauauuggagaaucaucuccaaauccaaccaucgaggaagguaggacauuaaggguauuaaaaauggucgaaccaugguuacgaggaaaucaguuuuguauaaaaauucuaaauccuuacaugccaaguguuguagagacccuugagcaaaugcaaaggaaacacggaggaaugcuuguaaggaacccauugucacguaacagcacucaugaaauguauuggguguccugcggaacgggcaacauaguaucugcgguuaacaugaccucgcgaauguugcuaaacagguucacaauggcucacagaaaaccaaccuaugaaagagacgucgaucuaggggcugggaccaggcauguggcaguagaacccgaagucgccaauuuagacaucauugggcaacguauagaaaacaucaagcacgaacauaaaaguacauggcacuaugacgaggauaauccuuauaagacaugggcauaccaugguagcuacgagguuaaaccaagugguucagccucuucaaugguuaaugggguaguuaaauuauuaacaaaaccuugggacguuauaccuaugguaacccaaauagcaaugacugauacuacaccuuuuggccaacagaggguuuuuaaagaaaaaguugacacaagaacccccaaagcgaaacgagguacagcccaaaucauggagguuacagcuaaauggcugugggguuuucugaguagaaauaagaaaccacggaucuguacaagagaggaauuuacacgaaagguuagaagcaacgccgcuauaggagcaguguucgucgaugaaaaccaguggaacuccgccaaggaagcaguugaagaugagagguucugggacuuaguacaccgagaaagagaacuacacaaacaaggcaaaugugccacuuguguuuacaauaugaugggaaaacgugagaagaaauugggagaguucgguaaagcaaaaggauccagggccauaugguacauguggcuuggcgcucgcuuuuuagaauuugaagcauuaggguuuaugaaugaagaucacugguucucaagggaaaauucacugucaggugucgagggcgaagggcuacauaaacuuggauacauauuaagggauauuucgaaaaucccuggaggcaauauguaugccgacgauacugcugguugggauacacgaaucacugaggaugacuuacaaaaugaagcaaggauuacagauauaauggagccagaacaugcuuuacuagcaaagucuauuuuuaaacuuacuuaccaaaauaagguagucagggugcagagacccgcuaaaaacggaacaguaauggacgugauauccagacgugaucaaagggguuccggucaaguaggaacuuauggguuaaauacuuuuacuaauauggaagcucaguuaaucagacaaauggaauccgaggguaucuuuaguccaucugagcuagagacgccaaacuuggcugaaagaguucuagacugguuggaaaaguauggcgucgagagauugaaaagaauggccauaaguggcgaugacugugucguuaaaccaauugacgacagauucgcaacggcauugacugcccucaaugauaugggaaaaguccgcaaagauauaccucagugggaaccaucuaaagguuggaacgauuggcagcaaguuccuuucuguagucaucauuuccaucaacuaauaaugaaagacggacgugagauagugguuccguguagaaaucaagaugaauuaguugguagagcuagaguaucgcaaggcgcaggcuggucuuuaagagagacagccugccucggaaagucauaugcucaaauguggcaacuaauguauuuccauagacgugaccuucggcucgcagcaaacgccauaugcagcgcugugccugucgacuggauaccgacaagccguacuacauggucaauucaugcucaucaucaauggaugacuacggaagacauguugucaguguggaaccgugucuggaucgaagaaaacccauggauggaagauaaaacgcauauuucaaguuggggagauguucccuaucuuggaaagcgagaagaucaguggugugguucuuuaaucggauuaacagcucgagcaacuugggcgaccaauauacagguugcuauuaaucaaguuagacggcuaauaggcaacgaaaacuaucuggacuacaugacaaguaugaagagauucaagaaugaaagugauccagagggagcauuaugguaa

SEQ ID NO: 21778 - RNA, 9879 nt, Artificial Sequence
  derived and/or modified CDS sequence (opt6) from DENV-1__GU131684__SS-prME
aguguaacuaugcuauugaugcucaugccuacugcuuuagcuuuccaccuaacgacucguggaggagaaccgcacaugauagugucuaaacaagaaagaggaaaauccuuacuuuuuaaaacgucagcugguguaaacauguguacguuaauagcaauggaucuaggagaguucugugaagacacgaugacuuacaaauguccuaggaucacugaagcagaaccagaugauguagacuguuggugcaaugcuacugacaccuggguaaccuauggaacgugcucccaaacgggcgaacacagacgcgacaaacggaguguagcguuagcaccacaugucggacuagggcucgaaacaagaacggaaacguggaugagcucagaaggagcuuggaaacagauucaacgagucgaaacuugggcacuucgccauccaggauuuaccgucaucgcccuuuuucucgcucacgcaauaggaacaagcauaacacagaaaggaauaauuuuuauauuacuaaugcuagugacaccuucgauggcuaugcggugcgugggaauagguucucgagauuuugucgaagggcuuaguggugcgacauggguagacguagucuuggaacauggaaguugugucacaaccauggccaaagacaaaccuacccuagauaucgaacuacucaaaacggaagucacaaaccccgccguguuaagaaaacuauguauagaagcuaaaauaucuaacacuacgacugauagucggugccccacccaaggagaagcuacccuaguugaagaacaggaugcuaauuucguaugucgaagaacguuuguugauagaggcuggggcaauggauguggucucuucggaaaaggaucgcuuauaaccugcgcuaaauucaaaugugucacaaaauuggaaggaaaaauaguacaguaugaaaaucuaaaauacucaguaauuguuacuguacacacuggggaucaacaccaaguagguaacgaaucaacagaacacgggacgacagcaacaauuacaccccaagccccgagcacagaaauacaacuaacagacuacggggcauuaacgcuugacuguagcccacguacgggacuagacuuuaaugaaaugguauuguugaccaugaaggaaaaaucauggcuaguucacaagcaaugguucuuagauuuaccccugccguggacaaguggcgccucaacuucacaagaaacauggaaucgucaagaucugcuggucacauuuaagacugcgcaugccaagaaacaagaaguagucguccuagggucccaagaaggugcuaugcauacagccuuaacuggugcgacagaaauucaaacaucaggaacuacaacuauuuucgccggucaucuaaaaugcaggcuuaaaauggacaaauuaacacucaaaggaaugaguuacguuaugugcacggggucguuuaaacuagaaaaggaaguagcugaaacucaacacggaacaguccuaguacagauaaaauaugaagguacagaugcaccuuguaaaauacccuuuaguacacaagaugaaaaagguguaacucagaacggaagguugauuaccgcuaacccuauaguaacggauaaagaaaaaccaguaaauauagaggcagagccaccauuuggugagaguuacauaguaauaggagccggugaaaaagcguuaaaauuaucuugguuuaagaaaggguccaguauagguaagauguuugaagccacagcuaggggagcuagacguauggcaaucuuaggugacacagcaugggacuucgguaguauuggaggaguuuucacaaguguagguaaauuaguacaccaaauauuuggaacagccuaugggguacuauuuucaggagucuccuggacaaugaaaauagguauaggaguuuuacugacaugguugggcuuaaauucuaggagcacaagucuaaguaugacaugcauagcggugggacucguuacgcuuuaccucgggguaaugguacaagcagauaguggcugcguuauaaacuggaaaggucgagaacugaaaugugggucaggaauauuuguaacaaaugagguacauacguggacagaacaauacaaauuucaagccgacucgccgaaacgcuuaucggcugcgauugguaaagcaugggaggaagggguaugcggaauaagauccgccacuagacuagagaacauuauguggaaacaaauuagcaacgaacuaaaccauauacuucuagaaaaugauaugaagcugacaguuguaguaggcgacgucgcuggaauauuggcccagggcaagaaaaugauucgaccgcaaccuauggaguauaaauauaguuggaaaucgugggggaaagccaaaauuaucggugcggauguacaaaauacaacauuuauaauagacggaccgaauacaccugaauguccugaugaucaacgcgccuggaauauaugggaaguagaagacuacggauucgguauuuucacgaccaauauuugguuaaaguuacgcgauucuuauacacaagugugcgaucaccgucuuauguccgcggcuauaaaagacucuaaagcagugcaugcagacaugggauacuggauagaaucagagaaaaaugaaacauggaaauuagcccgugcaaguuucauagagguaaagacguguauauggccaaaaucucacaccuuauggucuaaugggguacuagaaucagaaaugauaauuccaaagaucuacggaggaccgaucucucaacauaacuaccgaccugguuauuuuacacaaaccgcaggaccguggcauuuagggaaguuagaguuagacuuugaccuuugcgaaggaacaacaguagucguagaugaacacugcgguaauagagggcccaguuuaaggacgacgacgguuacaggaaaaauuauacaugaguggugcugucguuccuguaccuuaccuccauugagauucaaaggugaagauggauguugguacggcauggaaauuagaccuguaaaggaaaaagaagaaaaucuaguaaagucaaaaguuagcgcuggcagcggagaaguugacuccuuuagccucggcuuacuuuguauaucaauuaugauugaagaaguaaugagaaguagauggaguaggaaaaugcuaaugacaggaacuuuagcuguguucuucuugcuaauuaugggacaacugaccuggaacgaccuaaucagauuauguauuauggugggagcuaacgcaagugauaggaugggcaugggaacaacuuauuuagcauuaauggccacauuuaaaaugcguccuauguuugcggugggucuacuauuucgucgacuuacaaguagggaaguccuccugcuuacaauaggauuaucccuggucgcaucggucgaguuaccuaauucucuagaggagcuaggcgauggcuuagcaauggggauaaugauauuaaagcucuuaacugacuuucaaagccaucagcuuugggcaaccuuauuaucacugacguuuauacgaacuacauucucucuucacuaugcuuggaaaacuauggcuaugguccucucgaucguaucucuauuuccauuaugcuuaucaacuacuucacagaaaaccacaugguuaccuguacuauuaggcucgcuaggaugcaaaccguugacaauguuuuuaauugccgaaaacaaaauauggggacgaaagaguuggccccucaacgaaggcauuauggccguugguauagugucuauauuacuaucaucgcuuuuaaagaaugaugugccucuagcaggaccucucauagcgggugguauguuaauagcauguuauguaauuagcgggucaagugcagaucuaaguuuagaaaaggcagcagucguuaguugggaagaggaggcugagcacaguggagcgucucacaacauccuaguugagguacaagacgacgggacaaugaaaauaaaagacgaagaacgagacgacacguuaacuauacuacuuaaggcuacgcuacuagcaguuaguggaguauacccgcuaucgauacccgcuacguuauuuguuugguauuucuggcagaagaagaaacaaagaucaggggugcuuugggacacuccuucgccaccugaggucgagagagcgguucuagaugauggcauauaccgaaucaugcaaagaggauuacucgggagaucccaaguggguguggggguuuuucaggagaauguguuccacacuauguggcauguaacgagaggcgcuguccugauguaccaaggaaagaggcuggaaccaucuugggcuagugucaaaaaggauuuaaucaguuaugguggaggauggagacuacaagguucauggaauacuggggaggaaguacaaguuaucgcaguagaaccgggcaaaaacccuaaaaacguccaaacugcgccuggaaccuuuaagaccagcgaaggugaaguaggagcgauugcuuuagauuucaagccuggcacuagcggcagcccuauuguuaacagagaagguaagaucguaggacuguauggaaauggagucguuacuacaucuggaacauaugugucggcuauugcacaggcgaaagcgagucaagaaggcccacucccugagauagaagaugaaguauuccguaagagaaaucuaaccauaauggaucuacacccggggaguggcaaaacaagaagauaucugccagcaauaguaagagaagcuauaaagagaaaauuaaggacacucauccuggccccuacaagagucguggcuucagaaauggcggaagcguuaaaagguaugccgaucagauaucagacaacagcaguaaaaucugaacauaccgggaaagaaaucguggauuugaugugucaugccacguucacaaugaggcuacuaucaccugucagaguaccaaacuacaauaugauaauuauggacgaagcgcacuucacugauccaagcucaauugcagcuagagguuacauuaguacaaggguggggaugggagaagcagcugccaucuuuaugaccgcuacaccgccaggcucaguagaggcuuuuccacaaucaaaugcuguaauucaagaugaagaaagagauauucccgagaggagcuggaacucaggguaugaguggauuacggacuuuccuggcaaaacagucugguucguaccuaguauaaaauccggaaaugauauugcuaauugucuacguaaaaauggcaagagaguaauacaacugucuagaaagacuuuugauacugaauaccaaaagacuaaaaauaacgauugggacuacgugguaacuacagacauaucggaaaugggggcuaauuuccgugcagauagaguaauagacccacgcagaugucugaagccagucauacugaaagacggcccagaacgaguuauucuggcagguccuaugccagucacuguagcaucagcagcacaacgaagagguagaauaggacgcaaucacaacaaagaaggcgaucaauacauuuacaugggucaaccacuuaacaaugacgaagaucaugcacacuggacagaggcaaagaugcuacuagacaacauuaacacgccugaagguauaauaccugccuuauucgaacccgaacgggaaaagagcgcagccauagacggagaauaccggcuaagaggggaagcaagaaaaacauuugucgaacugaugcgacggggcgacuugccaguaugguuaucuuauaagguugcaucagagggauuucaauauucugaucggcgaugguguuucgacggagaaaggaacaaucaaguacuugaagagaacauggacguggagauuuggacaaaggaaggagaacgaaagaaauugagaccaagaugguuagaugcacgaacauauucagacccacuagcacuucgugaguucaaagaguuugcagcggggcgaaggucggugaguggagaccuaauauuagagauaggaaaauuaccucaacacuuaacacaacgugcgcaaaacgcucuugacaauuugguaaugcuucauaauucugaacagggaggucgagccuaccgccaugcaauggaagaacuaccugacacaaucgagacguuaaugcugcucgcauuaauagcgguauugacaggggguguuacgcuuuucuuucuaagcggaagaggacucggaaaaacuucaauugguuuauuauguguaauggcgagcucuguacucuuauggauggcaucaguagaaccgcauuggauagccgcuucaaucauucuugaguucuucuugaugguuuuacuaauaccagaaccggaucgucaacgaacuccgcaggauaaucagcuagccuauguugucauuggacuauuauucaugauacuaacagucgccgcgaaugaaaugggacucuuagaaacuaccaagaaagaccuaggaauaggucauguugcaguagaaaaccaucaccaugcugccauguuggacguugauuugcacccagcaucagcauggacguuguaugcaguagcuaccacaauuaucacuccgaugaugagacauacgauugagaacacuacggcgaacauuucguugacagcuauagcuaaucaagcagcuaucuugaugggucuagacaaagguuggccaaucaguaaaauggacauaggugugccguugcuugcacuuggauguuauagucaaguuaauccguugacacuuacagcagcagucuuaauguuagucgcucauuaugcgauaauaggacccggacugcaagcgaaggcaacgagggaagcacaaaagagaacggcugcaggaauaaugaaaaacccgacuguagacggaaucguagcaaucgauuuagacccaguuguuuacgaugcgaaauucgaaaaacaauuaggucaaauaauguuacuaauauuaugcacgucacagauauuauuaaugaggacaacgugggcuuuaugcgaaucaauaacccuugcaacugguccauuaacaacucucugggaagguaguccuggaaaauuuuggaacacaacaaucgccguuagcauggcaaacauauuucgcggaucuuaucuagcaggcgcuggauuggcauucucauugaugaaaagucuuggaggagggagaagagguaccggggcacaaggagaaacacuuggcgaaaaauggaaaagacaauugaaucagcugagcaaguccgaguucaauacuuacaaaaggucaggaauuauggaaguagacaggucugaggcgaaagaaggguuaaaacgaggagaaacuacaaaacacgcggucucuagaggaacagcaaaacuaagaugguuuguagaaaggaaccuagugaagccugaaggaaagguaauagacuuaggaugugguagagggggaugguccuauuauugugcaggacucaagaaaguaaccgagguaaagggguacacaaaaggaggaccaggucaugaggaaccgauaccuauggcaacauauggcuggaaucuaguuaaacuucauucugggaaagacguauuuuucaucccuccagaaaaaugcgauacacuuuuaugugauauaggcgagucauccccaaacccuaccauugaagagggaaggacacucagaguacucaaaaugguggagccaugguugaggggaaaccaauucugcaucaaaauucuuaauccauauaugcccaguguuguugaaacucuagaacagaugcaaagaaaacacgggggaauguuagucagaaacccauuaagucgaaacagcacgcaugagauguauuggguuagcuguggaacaggcaacauagugucagcgguuaauaugacaucgagaaugcuccuuaacagauucacuauggcucauagaaaaccaacauacgaaagagauguagauuugggggcugguacucgacauguugcagucgaaccugaaguagcaaaccucgacaucauaggccaaagaauagagaauauaaaacaugaacauaaaagcacuuggcacuaugaugaggacaaccccuacaaaacuugggcguaccauggaucuuaugaagucaagcccaguggcucugcaucauccaugguaaacggcgugguuaagcuacucacaaagccaugggacguuauuccaauggugacccaaauugccaugacugauacaaccccauuuggccagcaacgaguguucaaagagaaaguagacacucguaccccaaaagcaaaacgaggaaccgcgcaaauuauggaaguaacugcaaaauggcuauggggauuuuuaagcagaaacaagaaaccuagaaucugcacaagagaagaguuuacgcgaaaagucagaagcaaugccgcaaucggcgccguuuucguugaugaaaaccaguggaacagugcuaaagaagcaguagaagaugaaagauucugggauuuaguacacagggagagagagcuacacaaacaagggaagugugcaacgugugucuacaacaugauggguaaaagagagaagaaauuaggugaguucggaaaagcaaaaggaucaagagcuauuugguauaugugguuaggugcgcguuucuuagaauuugaagcacuaggguucaugaacgaagaccauugguucaguagagaaaauucuuugaguggaguugaaggggaaggacuccauaaauugggauacaucuugcgugauauaagcaagaucccaggcgguaauauguaugcugacgauacagcgggaugggacacucgaauaaccgaggaugaucuucaaaacgaagcuaagauuacugacauuauggaaccugaacaugcacuucuagccaaaucaauauuuaagcucacauaccaaaacaaagucgugagggugcaacgaccagcaaagaacggaacaguaauggacgucauaaguagacgugaucaacgcgggucaggucaggucggcacguacggauuaaauaccuucaccaacauggaagcgcagcucauuaggcaaauggaaagugagggaauauuuaguccaucggagcuagaaacgccaaauuuagcgggcagaguuuuagacugguuagaaaaacacgggguagagagacuaaaaagaauggcgauaaguggggaugauuguguaguuaagccgauugaugaccguuuugcuacagcgcuaaccgcuuuaaacgauauggguaaaguccgaaaagacaucccucagugggaacccagcaagggcuggaaugacuggcaacaaguaccuuuuuguucccaccauuuccaccaacuaauaaugaaagacgguagagaaauagucguuccauguagaaaccaagaugaacugguaggucgcgcaaggguuucacagggggccggauggagcuuaagggaaacggcaugccuuggaaaaucauacgcgcaaauguggcaacuaauguauuuccaucgaagagauuuacgucuggcagcaaacgcaauaugcucagcaguuccaguagauuggguuccuacaucaaggacuacauggaguauccaugcccaucaucaauggaugacaacugaagauaugcuaucugucuggaaccguguauggauagaggagaauccuuggauggaggauaagacucauaucaguucguggggcgacguuccguauuugggaaaacgugaagaucaauggugcggcucauuaauuggguuaacugcucgagcuaccugggcuacaaacauacagguagcgauuaaucaaguucgucgucuucucggcaacgaaaauuaucuagacuauaugacaucaaugaaacgcuuuaaaaacgaaagugacccugaaggagcucugugguaa

SEQ ID NO: 21779 - RNA, 9879 nt, Artificial Sequence
  derived and/or modified CDS sequence (opt6) from DENV-1__GU131685__SS-prME
ucugugacaaugcucuugaugcuaaugccaacugcacucgcuuuccauuuaacaacacgaggaggugaaccucauaugauaguuaguaaacaagaaagaggaaaaucucuguuauuuaaaaccucagcaggcguaaacauguguaccuuaauagcuauggaucucggagaacugugugaagauacaaugacauacaaauguccaagaaucacagaaacagagccagaugacguagauuguuggugcaaugcuacagacacuuggguuacguaugggacgugcucgcaaaccggcgaacacagaagagauaaaagaucuguagcacuagcaccacauguaggccuuggacuagagacucgaacagagacuuggauguccucagaaggcgcguggaaacaaauucagagaguugaaacgugggcguugagacaccccggauucacaguaauugcgcuuuucuuagcccacgcuauugguacauccauuacacaaaaagguauaauuuuuauauuacuaauguuggugacuccguccauggccaugaggugcguaggaaucgguuccagagauuuuguggaaggacuaucgggugccacguggguagauguuguacuggaacauggaucuugcguaacaacaauggcaaaagauaaaccuacacuugacauagaacuauuaaaaacagagguaacaaauccagcagugcugcgaaaauuauguauugaagcaaaaauaagcaauacgacaaccgauaguagaugcccuacacaaggcgaagcgacucuaguugaggaacaagaugcuaauuuuguuuguagaaggacauucguagauagagguuggggaaaugguugcggucuuuucgggaaagggucccuaaucaccugugccaaauuuaaauguguaacaaaacucgaagguaaaauaguccaguacgagaauuuaaaauauagcgugauaguaacuguacacacaggagaccaacaccagguuggaaacgaaagcaccgaacaugggaccacugcaacuauuacaccacaagcaccuaccacagagauccaacuuaccgauuauggagccuuaacuuuggauugcucuccccgcacaggucuagauuuuaacgaaaugguauuauuaaccaugaaagaaaaaucaugguuaguccauaaacaaugguucuuggauuuaccauugccguggaccucaggcgcaucaacaucacaagaaacauggaacagacaagacuuacuggucacguucaaaacagcucacgccaagaaacaagaaguuguaguucuggguucacaagaaggagcaaugcacacagcuuuaaccggggcuaccgaaauacagaccucgggaacaaccacaaucuuugccggacaucuuaaaugucgccucaaaauggaaaaauugacacuaaaaggaaugucuuacguuaugugcacuggaucauucaaacuugaaaaagagguugcagaaacacagcauggaacgguccuuguucaaaucaaauaugaaggaacggacgcuccuugcaaaauacccuuuagcacccaggaugaaaaagguguaacacaaaacgggagauugauaaccgcaaacccaaucguaacagauaaagagaaaccugucaacauugaggcagaaccuccauuuggcgaaaguuacauagugauaggagccggugaaaaagcauugaaauugaguugguuuaagaaaggaucguccauuggcaaaauguucgaagcuacugcucgaggagcaaggagaauggcuauuuuaggggauacugcaugggauuucgguucaauuggugggguguucacaaguguuggaaaacuuauacaccagauauucggaaccgcguacggaguacuauuuucagggguaucuuggacaaugaaaauagggaucggaguucuacucacaugguuggggcuaaacaguaggaguacaagccucucaaugacauguauagcgguaggauugguuacccuauaccuuggcguaaugguccaagcugauaguggauguguaaucaauuggaaagguagagagcuaaaaugcgguuccggaaucuucguaacgaaugaaguacauacuuggaccgaacaauauaaauuccaagcagauagcccuaaacgauugagcgcagcuauugguaaagcgugggaggaaggaguuuguggaauaagguccgcuacacgcuuagaaaauaucauguggaagcaaauaagcaacgaacuuaaucauauauuguuagaaaacggaaugaaguucacagugguaguaggugauguagccggaaucuuagcccagggcaaaaagaugauaaggccacaacccauggaguauaaguacuccuggaaaucguggggaaaagcaaaaauuauuggagcggauguacaaaauaccaccuuuaucauagacggaccuaauaccccagaauguccagaugaucaaagggcauggaacaucugggagguagaggacuauggauuugggauauuuacuacaaacaucuggcuaaaauuacgcgauucuuacacucaagugugcgaucacagguuaaugucagccgcuauuaaagauucaaaggcuguccaugccgauaugggauauuggaucgaaagcgaaaagaaugaaacauggaaauuagcgcgagcgaguuuuauagagguaaagacauguauuuggccaaaaagucauacacucuggagcaauggcguauuggagucagaaaugauaauuccaaagaucuacgguggacccaucagucaacacaauuaucgcccuggguauuucacacaaacagccgggccuuggcauuuaggcaaauuagaauuagauuuugaccuaugugaaggaacaacagugguaguagaugaacauugugguaauagaggaccaucccugagaacgacuacgguaacggguaagauaauccacgaaugguguugccggucauguacguuacccccauuaagauucagaggagaagaugguuguugguauggaauggaaauuagaccaguuaaagagaaagaagaaaaucuuguaaaaaguauggucucugcagguaguggugaaguagacucauuuaguuuagguuuguuaugcauuuccauuaugauagaagaaguaaugagaucgagguggucacgcaagaugcuaaugacugguacgcuagcagucuuuuuccuauugauuaugggccaacuuaccuggaaugauuuaauucgguuguguaucauggucggagcaaaugcuagcgaccggaugggcauggggacaacuuauuuggcgcuaauggccacauuuaaaaugcgaccaauguucgcuguaggacuacuauuuagacgccuuaccucuagggaaguauuacuacuuacaauugguuugagccuaguagcgagcguagaauuaccaaauagccucgaagaauuaggggauggucuggcgauggguaucaugauauuaaaauuacuaacugacuuucaaagucaucaacuuugggcuacucuauuaaguuugacuuuuauaaaaacaacuuucagcuuacauuacgccuggaagacaauggcgaugguacuaagcauagugucacuauuuccacugugcuuaaguaccaccagucaaaagaccacauggcugccgguuuuauuagguagucucggcugcaaaccacugacaauguucuuaauagcagagaauaaaauuugggguaggaggucauggccuuuaaaugagggaaucauggcugucggaauugucucaauauuguuauccucuuugcuuaaaaaugacguuccuuuagccgggccgcucaucgccggagggauguugauugcauguuauguuauaagugguagcucagcugaccucucguuagagaaagcugcagaagucucaugggaggaagaagcugaacacucaggagccagccauaacauacuuguugagguacaagaugauggaacuaugaaaaucaaagacgaagaacgagaugauacgcuuacgauauuacuuaaagcaacacuacuugcgguaaguggaguuuauccauuaagcaucccugcuacacuuuucguaugguacuucuggcaaaagaaaaagcaacggucaggggugcucugggauaccccaaguccaccagagguagaacgggcaguacuggacgacggaauauaucgcauaaugcaacguggacuauuaggacguagucaagugggagucgggguguuucaagaaaacguauuucauacuauguggcaugugacgagaggggcuguuuuaauguaucaaggaaaaagacuagaaccuucgugggcaaguguuaaaaaggaccuuauaucguaugguggaggauggagacuccaagguucauggaauacaggcgaagaggugcagguaauagcuguggaaccggguaaaaaccccaaaaauguucaaacagcuccuggcacguuuaaaacuccggaaggggaaguaggagccauagcucuagauuuuaaaccagguacgagcggaaguccaauuguaaaucgugaaggaaaaauaguuggcuuauauggaaacggagucgugacaaccucaggaaccuaugucucagcaauagcacaggcuaaagccucccaagagggcccauuacccgagaucgaagaugaaguguucaggaaacguaacuugacaauuauggauuuacauccuggcagugguaagacaaggcgauacuuaccagcuaucgugagagaggccauaaagagaaagcugcguacacuaauacuagcuccaacaagagucguugcuagugaaauggcagaggcacuaaagggaaugccgauccgauaucaaacaacggcuguaaaaucagagcauacagguaaagaaauaguagaucugaugugccacgcaacuuucaccaugagauuacuaucaccuguuagaguuccaaauuauaacaugauaaucauggacgaggcucauuuuacggauccuaguagcauagcagcuagagguuauaucucaacccggguaggcaugggagaagcagcugccauauuuaugaccgccaccccaccuggcaguguugaagcguucccacaaucuaaugcuguaauucaagaugaagaaagggauauaccugaaagaucauggaauagcggauacgaguggauuacggauuuuccggguaagacagucugguuuguccccuccauaaaaagcggcaaugacauagcaaauuguuugaggaaaaaugguaaaaggguuauacaauuaaguagaaaaaccuuugauacagaauaucagaaaaccaaaaacaacgauugggacuauguagugacaaccgacauaagugaaaugggugcaaacuuuagagcugaccgcgucaucgauccacguagauguuuaaaaccaguaauacugaaagaugggcccgaaagaguaauuuuagccggaccaaugccuguaaccguugcguccgcugcacaaagaagggguagaaucggaagaaaucacaacaaagagggugaccaauauauuuauauggggcaaccacucaacaacgaugaagaccaugcacauuggacagaagcaaaaaugcuucuggacaacauuaacaccccagaaggaauuaucccagcucuauuugaaccagaacgagagaaaagugcagcaauagacggcgaauacagauugcguggcgaggcaagaaagaccuuuguggagcuaaugagaagaggugaccuuccggucugguuaagcuacaagguugcaagcgaaggauuccaauauagcgauagacgaugguguuuugauggagaacgaaauaaccaaguccuagaagagaacauggauguagaaauuuggacaaaggaaggagagagaaagaaauuaagaccgagauggcuagacgcgcgaacuuacagugauccguuagcucuuagagaauuuaaagaguucgcggcuggaaggcgauccguaucaggagaucucauacuagaaauagggaaacuuccacaacaucuaacgcaacgggcgcaaaaugcccuugauaaucuugucauguuacacaacucugaacaagggggacgagcauaccgucacgcaauggaagaacuaccagauacaauagagacucuuauguuguuagcucuaauagccguccugacuggaggaguuacacuguucuuuuuaucuggcagaggauuagggaagacaucaauaggguuauuauguguuauggcgaguucuguuuuguuauggauggccucuguagaaccacacuggauagcagcaaguauaauccucgaauuuuucuuaaugguacuauuaauccccgaacccgauaggcaacguacgccgcaagacaaccaauuagcguaugugguuauaggccuucuguuuaugauucuaacggucgcagcaaacgaaaugggcuuacucgaaacaaccaagaaagaucuugguauaggccacguugcggucgaaaaccaucaucacgcugcuaugcucgauguagacuugcacccagcaucggccuggacccuauaugcaguagcuacgacaauuauaacgccuaugaugcgacacacuaucgaaaauacaacagcgaauaucucucucacagccauagcaaaccaggccgcuauuuuaaugggucuagacaaaggauggccaauuagcaagauggauauaggaguuccuuuguuagcuuuaggauguuauagccaggugaacccacuuacacuuacugcggcuguauuaauguuggucgcucacuacgcaauuaucggcccagguuuacaagcuaaagcgacucgagaagcccagaagagaaccgccgccgguauaaugaaaaauccgacgguagaugggauaguagccaucgauuuggacccuguaguguacgacgcaaaguuugagaagcaacuaggucaaauaauguuauuaauauuauguaccagccaaauacuccuaaugagaacuacgugggcauuaugcgaaucaauaaccuuagccacaggcccacuaacgacuuugugggaagggucacccggaaaguuuuggaauacgacuauugcgguuucuauggccaacauauuuaggggaagcuauuuagcaggggcuggucucgcuuuuagcuuaaugaaaucacucggagguggcagacgugggacuggagcgcaaggggaaaccuuaggcgaaaaauggaaaaggcaguuaaaccaacugucgaaauccgaguucaauacauauaagcgaagcgggauuauggaaguagaccguucugaagccaaggaaggacuaaaacguggugaaacaacaaaacacgcagugucgcgugguaccgcuaaacucagaugguuuguagagcguaaccugguuaagccugaagguaaagucauugacuuagguugugggagaggagguuggaguuauuacugugccggucugaagaaaguuaccgaaguaaaagguuacacgaaagggggcccgggacaugaagaaccaauuccaauggccacauaugguuggaauuuaguuaaguuacacucaggaaaagacguuuucuuuauuccacccgagaaaugugacacacuucuuugugacauuggggaaucuucaccaaacccaacuauugaagaaggccgaacacuaagaguacucaaaaugguagaaccguggcuccgcggcaaucaauucuguauuaagaucuuaaauccauacaugccgucaguuguggaaacucuagaacaaaugcaacgaaaacauggcggcaugcucguuaggaauccgcuaaguagaaauucuacacacgaaauguacugggucucaugcgguacagguaacauagucuccgcaguaaacaugacguccaggauguuacucaacagguuuacaauggcacaccguaagccuacauaugagagagacguugacuuaggggcagguacaaggcauguggcuguugagccugaaguagcuaacuuagacauuauuggucaaagaauagaaaauauuaaacacgaacauaagucgacguggcacuacgacgaggauaauccauauaaaacaugggcguaucauggaagcuaugaggugaagccaucuggauccgcaagcucuauggugaauggcgucgugaaauugcuuacgaagccaugggacguaaucccaaugguaacacagaucgcaaugacggauacaacaccauuuggacaacaaaggguauucaaagagaaaguggauacccguacuccaaaagcgaaacgcggcacggcucaaauaauggaggucacagcaaaaugguuauggggauuccuaagcaggaauaagaaaccacguauauguacuagggaagaauuuacgcgcaagguacgaucuaaugcggcaauaggagcaguuuuuguagaugaaaaucaguggaacagcgcaaaagaagcuguugaagacgagagauuuugggauuuaguacaucgagaacgcgaacuucauaaacaaggcaaaugcgccaccuguguguacaauaugauggguaaacgcgagaagaaauuaggagaguucgguaaggcaaagggauccagagcgauaugguacaugugguugggagcgcguuucuuggaguuugaagcguuagguuuuaugaacgaagaucacugguuuucgagagaaaauucgcuaucagguguagaaggugaaggacuucacaaauuaggauacauauuacgagauauuucgaaaauaccuggaggcaauauguaugcggacgauacugccggcugggauacuaggauaacugaagaugaucuacaaaaugaagcgagaauaacugauaucauggaaccggaacacgcauuacuugcucgaagcaucuucaaacuuacauaucaaaauaaagugguacgcguacaaagaccagcuaaaaauggaacgguaauggauguaaucucuaggcgcgaucaacgggguucuggccaggugggaacauauggauuaaacaccuucacaaauauggaagcccaacuuauucgacaaauggaauccgaaggcauauuuagccccagugaacuagaaacccccaaucuagccgaaaggguucuggauuggcuagaaaaguaugguguagaacgcuuaaaacgaauggccauaaguggggacgacugugugguuaaaccuaucgaugauagguuugcaacggcucuuacagcauugaacgacauggguaaaguuagaaaggacauaccgcaaugggaaccaaguaaaggauggaacgacuggcagcaggucccauucugcucucaucauuuccaucaauuaaucaugaaagacggucgagaaauaguaguuccgugucgaaaccaggaugaauuaguaggcagagcuaggguuucccaaggugcugguuggucauuacgugaaacagcaugcuuagggaaaucauacgcgcagauguggcaacuaauguauuuccacaggagggaucuuagacuugcagcaaaugcuauauguagugcuguaccaguagacuggaucccaacaagcaggacaaccuggucuauacacgcacaucaccaauggaugacaacugaggauauguuaucgguuuggaacagaguauggauagaggagaauccauggauggaagacaagacacauauaucuucguggggcgacguucccuacuuaggaaagcgcgaagaucagugguguggcucucucauuggauugacagcacgagcuacgugggcuacaaauauacagguagcaauaaaucaagucagacgccugaucgguaaugaaaauuaucuugauuacaugacuucaaugaaacgcuuuaagaaugaaucggacccggaaggugcucuuugguaa

SEQ ID NO: 21780 - RNA, 9879 nt, Artificial Sequence
  derived and/or modified CDS sequence (opt6) from DENV-1__GQ868614__SS-prME
aguguaaccaugcuuuuaauguuaaugccuacagcguuagcauuccaccucacaacacgcggcggagaaccacauaugaucguaacuaaacaagaaagaggaaaaucauuauuguuuaaaacaucugcaggagucaauaugugcacgcugauagcgauggaucuaggugaacuuugugaagauacuaugacauacaaaugucccagaauuacugaagcagaaccagacgacgucgauuguuggugcaaugcaacggacacuuggguaacguaugguacuugcucgcaaacgggggaacauagaagagauaaaagauccgucgcgcuagcgccccauguuggauuaggauuagaaacgagaacggaaacuuggaugucaucugaaggugcguggaaacaaauacaacgaguugaaacaugggcauugcgacauccaggcuuuacuguuaucgccuuguuucuagcacaugcaauuggaacaaguauaacacaaaaaggcauaauauuuauuuugcucauguuggugacucccucuauggcaaugcgaugugucggaaucgguagucgggacuuuguagaagggcuaaguggcgcgaccuggguagauguuguccuggaacauggaagcuguguuacaacaauggcuaaagauaaaccuacgcuagacauagaauuauugaaaacugaaguuaccaacccagccguacuacguaaauuaugcauagaagcaaaaauuagcaauacaacgacagauucgcgauguccgacacaaggagaagcuacgcuaauggaagaacaagacgcaaauuucguauguagacgaacuuuuguugacagggguuggggaaaugggugugggcucuuuggaaaaggaagccugauaacaugugcaaaauucaaauguguaacuaaacuggaagguaaaauaguccaauaugaaaaucugaaauauaguguuauaguaacaguucacacuggugaucaacaccaaguagguaacgaaagcacugaacauggcacaacugcuacuauaacaccacaagcaccaacaucggaaauacagcugaccgauuauggagcucuaacacuagacuguucaccaagaacgggcuuggauuuuaaugaaauggucuuauugacaaugaaggagaaaaguuggcuuguccacaaacaaugguuuuuggaucuuccucuaccuuggaccagcggagcguccacuucacaagaaacguggaauagacaagaucucuuaguaacauuuaaaacugcucaugcuaagaagcaagaaguggucguauugggaucacaagaaggagcaaugcacacagcguuaacaggcgccacagagauucagaccagcggaacaacuaccauuuucgccggacaccucaaaugucgccuuaagauggauaaauuaaccuuaaaggguaugucauauguaauguguacugguccauuuaaauuagagaaagaaguagccgaaacacaacacgggacuguccugguccagauaaaauacgaaggaaccgacgcgccgugcaaaauacccuucucaacgcaggaugaaaaagguguaauccaaaauggcagauugaucacugcgaacccaauuguaacggacaaagagaagccgguaaacauugaagcugagccaccauuuggggaaucuuauauaguaaucggaguaggagaaaaggcuuuaaaauuaucuugguuuaagaaagguagcaguauagguaagauguuugaagccacugcccgaggggcucgaagaauggcaauuuuaggagauaccgcaugggacuuuggaagcauugggggaguauucacuucugucggcaaacuugugcaccagauauucggugcugccuaugguguauuauuuucggguguaucuuggacaaugaaaauaggaauaggaguccuauuaaccugguugggucucaacagucguagcacgucgcuaucgaugacgugcaucgcagugggucuggucacucucuaccugggcguaauggugcaggcagacagcggguguguaauaaacuggaaaggacgugaacuaaagugcggaaguggaaucuuuguaacgaaugaaguccacacuuggacagaacaauacaaauuccaggcagauagccccaaaagacucagcgcggcuauugguaaggccugggaggaaggaguaugcgggauacguaguguaacacgacuggagaauaucauguggaagcaaaucucaaacgaacucaaucacauauuauuagagaaugauaugaaguuuacagucgucguaggagacguaguuggaauccuugcacagggaaagaaaaugaucagaccccagccuauggaacauaaauauaguuggaaaucuuggggaaaagcaaaaauuauaggcgcagauguucaaaacacaacguucauuauugauggucccaacacacccgaguguccagacgaccaacgagcuuggaacaucugggagguagaagacuacggguuuggaaucuuuacgacaaacauuuggcuaaaacuucgugauucauauacgcaggcuugugaucacagauuaaugucugcagcgauaaaagauucuaaagcaguacaugcugauaugggauauuggauagagucagagaaaaaugaaacauggaaguuagcacgggcgucauucauagaaguaaagacauguauauggccaaaaagucauacacuauggaguaauggagugcuagaaagcgaaaugguuauuccuaagaucuacgguggaccaauaucacaacauaauuacagacccgguuauuucacgcagacggcugggccauggcaucuggggaaauuggaacucgacuuugauuuaugugagggaacuacuguaguuguagacgaacauugugguaauagaggcccaagucuccgcacgaccacuguaacgggcaaaauuauacaugagugguguugucgcucaugcacuuugccuccguugagauuuaagggagaagauggguguugguacgggauggaaauaagaccgguuaaagagaaagaagaaaacuuaguaaagaguaugguauccgcuggcucgggagaggucgauaguuuuuccuuaggccuguuauguauaaguauaaugaucgaagaagugaugagaagucgcuggagcaggaaaaugcugaugaccggaacacuggcuguauuccucuuacuaaucaugggucaauuaacauggaaugaccuaauuagauuguguauaauggucggagcuaaugcaagcgaucgaauggguaugggaacaacauaccucgcauugauggcuaccuucaaaaugcguccgauguucgcuguaggauuacuguuuaggcgauuaacaucacgugaagugcuauugcuaacaauaggacuuagucucgucgcgucuguugaauugccaaauucacuagaggagcugggugacggucuagcgaugggaauaaugauucucaaacuccucaccgacuuucagucacaccaacuuugggccacucuauuaucccugacuuucauaaaaacuacgcuaucuuuacauuacgcguggaaaacaauggcuaugguccucucgauugugucccuuuuuccucuuugccuuaguacaacuucgcagaaaacuaccuggcuccccguccuguuaggcucgcuaggguguaaaccgcuaacaauguuucucauugcugaaaauaaaaucuggggcaggaaauccuggccgcuaaacgaagguaucauggcaguaggagugguuucuauccucuuaucaagccuucucaaaaaugauguaccacuagccggaccguugaucgcuggaggaaugcuaauagcuuguuauguuaucucuggaucgucggcggacuuaucacuugagaaggcagcagagguuucaugggaggaggaagcagaacacaguggagcaagccauaauauauugguugaaguacaagaugauggaacaaugaagauaaaggaugaagaaagggacgauacgcucacgauacuucucaaggcuacauuacuagcuguaucaggugucuauccgcuuuccauaccugcaacucuauuuguuugguauuucuggcaaaagaagaaacaaagaagugggguuuuaugggauacaccauccccgcccgaagucgaaagggcgguccuagacgaugguauauauagaauaaugcaaagaggacuuuuaggcaggagccagguaggcguggguguauuucaagaaaacguauuucauacuauguggcacguaaccaggggugcaguacugauguaccaagguaaaagauuagaaccuucgugggcuaguguaaagaaagacuuaauaagcuaugguggaggauggagauuacaggguagcuggaacacaggagaggaaguucaaguuauugcuguagagccggggaagaaucccaaaaacgugcaaacggcaccaggaacauuuaaaacuccugaaggcgagguaggagcgauagccuuagauuucaaaccuggcaccucagggucaccaauaguaaauagagaggguaaaauaguuggucuauacggaaaugguguaguaacaacuucuggaacguacgucagcgcuauugcccaagcaaaggcuucucaagaaggcccauugccagagauagaggacgagguguuucgaaagcgcaaucuaacaaucauggaccugcauccagggucugggaaaacacgucguuaccucccagcaauugucagagaggccaucaaaagaaaacuuagaacucucauccuugcuccaacaagagugguggcaagcgaaauggccgaagcauuaaaggguaugccaauaagauaucaaacuacagcaguuaaaucggaacacacagguaaagaaauuguagauuuaaugugucacgcaaccuuuaccaugagauuacuuucgccgguacggguucccaauuauaacaugauuauaauggaugaagcccauuucaccgauccguccucaauugcggcacgaggauacauaaguacacgugucggaaugggagaagccgcagcaauauuuaugacagcaacaccaccgggaucgguggaggcuuuuccccaaucgaaugcaguaauccaggaugaagaaagggauauaccagaaagguccuggaacuccggguaugaauggauaacugauuuuccaggaaaaacaguaugguucguccccucuauaaaaucagggaacgauaucgcaaauuguuugcgaaagaaugggaaaagaguaauacagcucagccgaaaaacuuucgauacugaauaccagaaaaccaaaaauaaugauugggauuauguugucacuacugauauuucggaaaugggugcuaauuuuagggcugaucgaguuauagauccgagaagaugcuugaaaccuguaauacugaaagauggacccgaacgaguaauacuugcagguccuaugccuguuacgguagcaagcgcagcacaaagacgaggcaggauagggcguaaccacaacaaagaaggagaccaauacauuuauaugggacagcccuuaaacaaugaugaagaccaugcucauuggacagaagccaagaugcuacuggacaacauaaacacucccgagggaauuauaccagcucuuuuugagccagagagggaaaagucggcagcaauugauggugaguauaggcuccgaggcgaagcaagaaaaacauucguagaacucaugcgaaggggcgaucuuccaguaugguuaucauauaagguagccagugaaggauuccaauacucggauagaagaugguguuucgauggagagagaaauaaucaaguucuagaagaaaauauggacguagaaauauggacgaaagaaggugaacggaagaaauuaaggccucguugguuggaugcaagaacauacucugauccacuugcuuuaagagaguucaaagaauuugcagcuggucgacgaaguguuucaggggaucucauuuuagaaauaggaaaguuaccacaacaccuaacgcagcgggcucagaacgcacuagauaaucuuguaauguuacauaauagcgaacaaggaggccgagcguauagacacgcgauggaagaauuacccgauacaauugaaacauuaaugcuacucgccuuaauugcaguguuaacgggugguguuacgcucuuuuucuugagcggcagagguuuagguaaaaccagcauaggacuacucugugugauggcaagcagcguauuauuauggauggcgucaguugagccucauuggaucgccgcuagcauuauccuggaguucuuucuaaugguauuacuuauuccagaaccugacagacagagaacuccacaggauaaccaauuagccuacguuguaauaggucugcuauuuaugauacugacuguggcagccaaugaaaugggguuacuagaaaccaccaagaaagaucugggaauaggacacguagcuguggaaaaccaccaccaugcaacaauguuagacguggaucuacaccccgcaucagcuuggacucuauaugcaguugcaacaacgauaauuacaccaaugaugaggcacacaauugaaaauacaaccgcaaacauuucucucacagcuauugcgaaucaggcagcgauacucaugggauuagauaagggauggcccauaucuaaaauggauaucgggguuccguuacuagcuuuagggugcuauagucaaguaaacccauugacacuaacugcugcaguauugaugcuuguagcucauuacgcaaucaucgggcccggauugcaagcaaaagcaacucgcgaagcacagaaaagaacugcagcuggcauuaugaaaaacccuacagucgacggaauuguagcuauagaccuugauccugucguuuaugaugcaaaguucgaaaaacaacuaggacaaaucaugcuacuuauuuuauguacaagucagauuuuauuaaugcgaacaacaugggcuuuaugcgaaucaauaacauuggcuaccggaccgcuuacuacauugugggaaggcucaccaggaaaauucuggaacacaacgaucgcugucaguauggcuaauauuuucagggguucuuaccucgcaggagcaggacuagcuuuuucgcucaugaaguccuuagggggaggaagacgugggaccggagcacagggugaaacccuaggagaaaaauggaaaagacaauuaaaccaauugagcaaguccgaauuuaauauauauaaaagaaguggaauuauggaaguugaccgaucagaagcuaaggagggucuaaagagaggugaaaccacuagacacgcggucuccagaggaacugccaaacuaagaugguuugucgaaaggaaucucguuaaaccagaagguaaaguaauugacuugggcuguggacgcggaggguggucuuauuauugugccgggcucaagaaagugacugaggucaaagguuacacaaaagggggaccagggcacgaggaaccuauaccaauggcuacauauggauggaaccuuguaaaacuccacucuggcaaagauguguucuuuacacccccggagaaaugcgacacucuacucugcgauauuggagaaucaucuccaaauccaaccauagaagaagggagaacucuucgagucuuaaagaugguggagccaugguuacgugguaaucaguuuuguauuaaaauucuuaauccuuacaugccaagcguggucgagacuuuagaacaaaugcaacguaaacaugggggaauguuagugcgaaauccuuugucucggaauagcacgcaugagauguauugggucucgugugguacgggaaauauaguaagugcagugaauaugaccucaagaauguuacuuaauagauuuacaauggcacaccgcaaaccaaccuaugagcgagacguagaucugggcgcugguacucgccauguggcaguugaaccagagguagcuaacuuagacauuauaggacaaagaauugagaacauuaagcaugaacauaaaagcacauggcacuacgaugaagauaauccuuauaagacaugggcguaucauggaagcuaugaagucaaaccuucuggaagugcuucuaguaugguaaauggcguaguaaaacuuuuaacaaagcccugggacgucauaccaauggugacacaaauugcaaugacugauacgacaccuuuuggacaacagaggguguucaaagaaaaagucgacacaagaacaccaaaagcuaagcgcgguacagcccaaaucauggaagucacugccagaugguuguggggauucuugucuagaaacaaaaagccgagaauuuguacaagagaagaguucacccgaaaagucagaucuaaugcagcaauuggcgcgguguuuguagacgaaaaucaauggaauagcgcuaaagaagccguugaagacgaacgauucugggauuuaguccaaaaagaacgcgaacuucacaagcaggguaagugcgcaacaugcguguacaacaugauggguaagcgagagaagaaacuaggcgaauuuggcaaggcuaaaggaucuagagcgauaugguauaugugguuaggugccagauuuuuggaauuugaagcacucggauuuaugaaugaagaucauugguucucacgugaaaauucccuguccgggguagaaggagaagguuugcacaaacucggauacauccuacgggauauaagcaaaaucccuggaggaaacauguaugcggaugauacagcugguugggacacuagaauaacggaagacgacuuacaaaaugaagcgaaaauuacagauauaauggaaccagaacaugcauuauuagcaacauccauuuucaaauuaacauaucaaaacaaggugguccgugugcaaaggccagcuaaaaaugggacuguaauggauguuauauccagacgugaccaacgagguagugggcaaguaggcacuuauggcuuaaacacguucacgaacauggaagcgcaacugauaagacagauggaaagugaagguauauuucucccauccgaauuagaaaccccuaaccuagcugaaagagucuuagacugguuagaaaaacauggcguggaacgccuuaaacgcauggcgauuuccggugacgacuguguagugaaaccaauagacgaucgauucgccacagcguuaaccgcucuuaacgacaugggaaagguuagaaaagacauaccccaaugggagccaaguaagggauggaaugacuggcagcaagucccauuuuguucgcaucauuuucaucagcuuauaaugaaagauggaagagaaauuguaguaccuuguaggaaccaagacgaacuuguugggagagccagaguaagccaaggugccggauggaguuuaagggaaacggcuuguuuaggaaagucauaugcgcaaauguggcaauuaauguauuuucacaggagagaccuucgauuagcagcuaacgcuauaugcucagcagucccaguugacuggguaccaacaucucguacaacauggaguauacacgcacaccaccaauggaugacaacagaggacauguugucggucuggaauaggguauggauagaagaaaauccauggauggaagacaagacucaugucucuucauggggagacguuccguauuuaggaaaaagagaagaucaauggugcggaagucuuauuggccugacagcucgggcgacaugggcaucuaauauucagguagcgauuaaccaaguacgaagacuaauaggcaaugaaaauuauuuagauuacaugacaaguaugaaaagguuuaaaaaugaaggggauccagaaggugcgcuuugguag

SEQ ID NO: 21781 - RNA, 9879 nt, Artificial Sequence
  derived and/or modified CDS sequence (opt6) from DENV-1__GU131688__SS-prME
ucaguuacuaugcuguuaauguuaaugccaaccgcuuuggcuuuccauuuaacgaccagaggaggggaaccucacaugauagucaguaaacaagaaagagggaaaucacuauuguuuaaaacaucugcaggaguaaacauguguacgcuaauagccauggaucucggagaauuuugugaggauaccaugacauacaagugcccgagaauuaccgaagcugaaccugaugauguagauuguugguguaacgcaacugauacuuggguaaccuacgguaccuguucacaaacaggggaacauagacgcgauaaaagaucaguugcguuagcuccacauguaggucuagggcuagaaaccagaacugaaacuuggaugucaagcgaaggugcauggaaacaaauacaaagagucgaaaccugggccuuaaggcauccuggauuuacugucauagcccuauuucuggcgcaugccauaggaacauccauaacccaaaaaggcaucauuuucauuuuguuaauguuaguuacaccuuccauggcaaugcguuguguaggaauuggaaguagagauuuuguagaagguuuaagcggagcuaccuggguugaugucgucuuggaacaugguagcugugugacuacaauggcaaaagacaaaccaacguuagauauagaauuguuaaaaacugaaguaacggauccagcaguacuuagaaaacuuuguauagaagcaaaaauaucaaauaccacaacggauagucgcuguccaacccaaggcgaagccacccuagucgaagaacaagacgcuaauuucgucugcagaaggacuuuuguggaucgagguugggguaauggguguggauuauucgggaaaggaagccuaaugacgugugccaaauuuaaaugugugacgaaacuggaagguaaaauuguucaauacgaaaaucuaaaauauucaguaauagugacuguacacaccggugaucaacaucaagucgggaaugaaagcacggaacaugguacaacggcuacaauuacaccacaagcaccuaguacagaaauucagcuaaccgauuacggagcauuaaccuuagacugcucaccacggacgggcuuagauuucaaugaaauggugcuacuuacaaugaaagaaaaaucauggcuaguccacaagcagugguuccuagaucuuccauuacccuggacaucuggagccucgacgucacaagaaacguggaacaggaaagaccugcuugucacauuuaaaacugcacacgccaagaaacaagagguaguugucuuaggaucucaagaaggcgcaaugcauacugcccuuacuggagcaacggaaauucagacuucagggacaacuacaauauuugcgggacaucuaaaauguaggcuaaaaauggauaaauuaacgcuuaaggguauguccuauguaaugugcacuggaaguuucaaacuagaaaaagaaguagcggaaacacaacacggaaccguauugguacaaauuaaauacgaagguacagacgcuccuuguaagauuccauucuccacccaagaugaaaaaggcguuacccaaaacggacgacuaauaacggccaaccccauaguaaccgauaaagaaaaaccuguuaacauugaggcggaaccuccguucggugaaaguuauauugucauuggagcuggggaaaaggcuuugaaacuuaguugguuuaaaaagggauccucgauaggcaaaauguucgaagcuacagcacguggggcacggaggauggcaauccugggagacaccgcuugggauuuugguucaauaggagguguauuuacaucugucgguaaauuagugcaccaaauauucggcacagcauacggaguauuguuuucagguguaucauggaccaugaaaauaggaauuggaguauuacuaacuuggcuaggauuaaauucgagaucgaccucacuaucaaugacgugcauagcagucggucugguaacauuauaucuuggaguuaugguucaagcagauagcgguugugucauaaacuggaagggccgcgagcuaaaauguggaucuggaauuuucguuacuaaugaaguucauacauggacugaacaauauaaauuccaagcugacucaccaaaacgauugagugccgcgaucggaaaggcuugggaggaaggaguauguggaauaagaucugccaccagacucgaaaauauaauguggaaacaaauaagcaaugagcuuaaucauauucuucucgaaaacgauaugaaauuuaccguaguuguaggggauguugcagguauccuugcccaaggcaagaaaaugauaagaccucaaccuauggaauauaaauauuccuggaaauccuggggcaaagccaaaauaauaggagcggaugugcaaaauacaacuuucauuauugacggaccaaacacaccugaaugcccggacgaucagagagcauggaauauuugggaaguagaagacuauggauuuggaaucuucacuacaaacaucuggcucaaacuuagagacucauacacccaaguuugugaucaucguuuaauguccgcagcuauaaaggauuccaaagcaguacaugcagacaugggauacuggauagaaucagagaaaaacgaaacauggaaacuugcacgcgcaaguuucauugaaguuaaaacguguaucuggccaaagucccacaccuuguggagcaacggaguauuagagucggagaugauaauuccgaagauuuauggcggacccaucucucaacacaauuaucgaccuggcuacuuuacucaaacugcagguccuuggcaccuuggaaaacuagaauuagauuuugaucuaugugaaggaaccacugugguggucgaugaacacugcggaaacaggggcccgagucuuagaacuacaacaguaacaggaaaaauaauacacgaaugguguuguagaucuuguacacucccaccacuaagauucaaaggcgaagaugguuguugguauggaauggagaucagaccgguaaaggaaaaagaagaaaauuugguaaagucuaugguuagugcggguagcggagagguggauucauuuagccuaggacuacuuuguauuaguaucaugauugaagaaguuaugcgcucuagguggagcagaaaaaugcuaaugacuggcacccuugcaguauuuuucuuacugauaaugggucagcuaacuuggaacgaccucauacgacuauguauaaugguuggugcgaaugcuagugacaggaugggaaugggaacuacauaccuggcucugauggcaacauuuaaaaugcgaccaauguuugcagugggauuauuauuuagacgucucaccucaagagaaguauuauuauuaacuauugguuugucacuuguugcuuccguagaauuaccuaauuccuuggaagaauugggcgaugguuuagcuaugggaauaaugauuuuaaaacugcuuacagauuuccagagccaccaacuaugggccacauuacugucgcuaaccuuuauuaagacuacauuuagucuacauuaugccuggaaaacaauggcgaugguucucaguauugucucucuauucccguugugccuuucgacgacaagucagaaaaccacaugguugccgguauuacuuggaagucuaggaugcaagccguuaacuauguuccuuauagcggaaaauaaaauauggggaagaaaaucauggccacuaaaugagggaauaauggcaguuggaauugugucuauuuuguugucagcguuacucaaaaaugacguuccacuagcggggccuuuaauugccggaggaauguuaauugcauguuauguaauaucaggaucaagcgcggaucucagcuuagaaaaagccgcggaggucaguugggaagaagaagccgagcauaguggugcaucucauaauauauugguugaaguucaagaugaugguacuaugaaaauuaaagaugaagaacgggaugacacuuuaacuauauuguuaaaagcuaccuuguuagccguaagugggguguacccacugaguauacccgccacauuguuugugugguauuuuuggcagaagaagaaacagcguaguggaguuuuaugggauacgccuagcccaccugaaguugagcgagcuguacuagacgacgggauuuauagaauaaugcaacggggacuuuuaggucgaucucaaguuggugugggagucuuucaagaaaacguauuccauacgauguggcaugugacacguggagccguacuaauguaucaagguaagagguuggagccaucaugggccucaguuaagaaagaucuuauaucauauggcgggggauggagguugcaaggaucauggaacaccggugaagaaguacaaguuauagcugucgaaccuggcaagaauccuaaaaauguacagacagcccccggaacuuucaagacuucagagggagaaguaggugcgauagcuuuagauuucaagccaggaacauccgggucaccaauuguaaacagagaaggaaagauaguuggucuuuaugggaacggagucgugacaacuucagguacauauguaucagcuauugcgcaagcaaaagccucccaggaaggaccucugccagaaaucgaagaugaaguuuuucgcaaaagaaauuuaacgauaauggauuuacaccccgguucgggaaaaacgagaagauauuugccugcaauugucagagaagcgauuaaacgaaaauuaaggacucugauacuggcuccaacucgugugguagcgucugagauggcagaagccuuaaaaggcaugccuauaagguaucaaacuacagcaguaaaaucugagcauacaggaaaagagauaguagauuuaaugugccacgcaaccuucacgaugagacuacuaucaccggugagagugccgaacuauaacaugaucauaauggacgaagcacauuucacagacccaucgaguauugccgcccgagguuauauuagcacaagaguuggcaugggugaagcugcagcaauauuuaugaccgcaacgcccccaggcucagucgaagcauuuccacagagcaaugcuguuauccaagacgaggaaagagauauaccagaaagaucauggaacagugguuaugaguggauuacagauuuucccggaaagaccguuugguucgucccuucaauaaaaucgggcaaugauauugcgaauugucuccgcaaaaaugguaaacgugugauacaauugucacgaaagacguuugacaccgaauaucagaaaacuaagaauaaugauugggacuacguugugacuacugauauaagcgaaaugggagcgaauuucagagcggacagagugauugauccaagacgauguuuaaaaccaguaauccuuaaagaugguccggaacguguaauauuggccggcccaaugccuguaacaguagcuucagcugcgcaaagaagaggaaggauaggaaggaaucauaauaaagaaggagaucaauacauuuauaugggacaaccccucaacaacgaugaggaucaugcccauuggacggaagcaaaaauguuacuggauaacauuaauacaccggaaggcauuauaccugcacucuuugaaccugaaagagaaaaaucugcugcaauagauggggaauacaggcugcgaggcgaggcgcgcaaaacuuucguugaacuaaugagacgcggagauuuaccuguaugguugucuuauaaaguagcauccgagggauuucaauacucggacagaagauggugcuuugauggagagagaaauaaucaaguguuagaagaaaacauggauguugaaauauggacaaaagaaggagagcguaagaaauuacgucccagaugguuagaugcccgaacauauucugauccauuggcacuuagagaauuuaaggaguuugccgcuggccgucgguccguuaguggagaccuuauacuagaaauuggaaaauugccucaacaucuaacacagagggcgcaaaaugcacuugacaaucucgugauguuacacaacucagagcaaggaggaagggcuuauagacaugcaauggaagaauuaccggacacaauagaaacauugaugcuguuagcccuaauagcaguucugacaggggguguaacucuuuucuuccucagugggcguggacuaggcaaaacaucgaucgggcuauuaugcguuauggcgucgucagucuuguuauggauggcgucaguagaaccacacuggauagcugcaucuauuauauuagaguucuucuugaugguauuguuaaucccugaaccagauaggcaacgaacaccccaggauaaccagcuagcguauguaguuauagggcuucuauuuaugauauuaacaguagccgcuaaugaaaugggacuacucgagacaacaaagaaagaucucgggauaggacacguagccguagaaaaucaucaucacgcagcaaugcuagaugucgaccuucauccagcuucagcauggacgcucuaugcaguugcuacgacgauuauaaccccuaugaugagacauacuaucgagaauacuacagcgaauauaucgcugacggcuaucgcgaaccaagcagcuauucuaaugggcuuagacaaaggauggccaauaucuaagauggauauuggaguuccucuacuugccuuaggguguuacucucaaguaaaucccuuaacucuaacagccgcuguguugauguuaguagcccacuaugcaaucauaggacccggauuacaggcgaaagccacgagagaagcucagaaacgaacggccgccgggauuaugaaaaauccuacaguagauggcauuguggcgaucgaucuagauccaguuguguaugacgcaaaauuugaaaaacaauugggccaaauaaugcuacucauacuuuguacaucgcagauauugcuaaugcgaacaacgugggcucuaugugaaucaauaacguuagccacgggaccccugacuacauuaugggaggggagcccuggaaaauuuuggaauacgacaauugcaguaaguauggcaaacauauucagggguucguacuuggcgggugcgggacuagcauucucguuaaugaagucucucgguggagggagaagagguacaggagcccaaggagagacuuuaggcgaaaaguggaaaaggcaacuaaaccagcuaucuaaaucugaauuuaauacauauaaaagaucgggcauaauggaagucgaucgaucggaagcaaaagaagggcuuaaaaggggugaaacaacgaaacaugcaguuucucgugguacagccaaauuaaggugguucguugaaagaaaccuuguaaaaccagaaggaaaaguaauagacuuaggcuguggaaggggaggauggucguauuacugugcaggucuuaagaaaguuacagaaguaaaaggauauacaaagggcggaccugggcaugaagaaccaauuccaauggcuacguauggauggaauuugguaaaauuacauucugggaaagaugucuucuucaucccuccagaaaaaugugacacacuccugugugauaucggugaaaguaguccgaacccuacaauugaagagggacgcacauuaagagucuuaaaaaugguagaacccuggcuucguggaaaccaauucuguauaaaaauauuaaauccuuacaugccgagcguaguagaaacccucgaacagaugcagagaaagcacggcggaauguugguaagaaacccacuaucgcgaaauucaacacacgagauguauuggguaucuugugguacaggaaauaucgucucggcagugaacaugacgucacgaaugcuauuaaacagauucacgauggcacauagaaagccgaccuacgaaagagacguugaccuaggagcagguacucgacacguugccguagaaccggaaguagcaaacuuagauaucauaggucaaagaauugaaaauauuaaacacgagcauaaaagcacauggcauuaugacgaggacaaucccuacaagacaugggcguaucaugguaguuacgaagugaaaccaucaggaucugcaucaucaauggucaacgggguaguaaagcuacuaacuaagccuugggacgucauaccgauggugacccagauugcuaugaccgacaccacuccauucggacaacagagaguguucaaagaaaaaguggauacaagaacacccaaagcuaaaagggguacagcacaaauaauggaaguaacugcaaaguggcuaugggguuuucuuucuagaaacaagaaaccucguaucuguacacgugaagaauuuacacgaaaaguacgaucaaacgcagccaucggugccguauuuguugaugaaaaccaauggaauagugcaaaggaagcggucgaagacgaaagauuuugggacuuaguucaucgggagagagaauuacacaaacagggaaagugcgcgacguguguauauaauaugauggguaaacgagagaagaaauuaggggaauuuggaaaagcuaaaggcuccagagcaauaugguacaugugguuaggagcaagguuucuagaauuugaagcacuuggauuuaugaaugaggaucacugguuuucucgcgagaacaguuuguccggaguugaaggagaaggguugcacaaauuaggauacaucuuaagagauauaucaaagauuccaggagggaauauguaugcagacgauacagcaggaugggacacgagaauaacagaggacgauuuacaaaacgaagccaaaauaacggacauuauggaaccugagcaugcauuauuggcgaaaagcauuuuuaagcugacauaucaaaacaagguuguuaggguucaacgaccagccaaaaaugggacagucauggauguuauaucgcgccgggaccaacgaggauccggacaaguaggcacuuauggacugaauacauucacuaauauggaagcccaacucauacgacaaauggaaagugaaggaauauuuaguccgucagaacuggaaacuccuaauuuggcaggucgaguacuugacuggcuugagaagcacgguguagagcgccuaaagagaauggccauaagcggugaugauuguguaguaaagccuauagacgaucgguuugcagcagcccuaaccgcgcucaacgauaugggcaaggugaggaaagauauaccacagugggaaccuucuaaggguuggaaugauuggcaacaaguuccauucugcucacaucauuuucaucaacuaauaaugaaagacgguagagaaauuguuguaccaugcaggaaccaggacgagcuaguagggagggcccgaguaucccaaggugcuggguggucgcuacgugaaacugcgugucuaggcaaaucuuacgcccaaauguggcaacuaauguacuuucauagacgagaccuacgauuagcagcaaaugcgauauguagcgcaguuccuguggacuggguuccgacaucacgaaccacuuggaguauacaugcucaccaucaguggaugacaacggaggauaugcucagugucuggaauaggguauggaucgaggaaaaucccuggauggaagauaaaacccacaucuccucauggggcgauguuccguauuugggcaaaagagaggaucaauggugcggaaguuugauaggacuuacagcacgggcaaccugggcuacaaauauacaaguggcgaucaaucaaguacggagacuaaucggaaacgagaacuacuuggauuauaugacuagcaugaaacgcuucaaaaacgaaagcgaccccgaaggagcacuaugguga

SEQ ID NO: 21782 - RNA, 9879 nt, Artificial Sequence
  derived and/or modified CDS sequence (opt6) from DENV-1__GU131689__SS-prME
aguguuacuauguuuuugauguuaaugccaacugcccucgccuuucaucuaacuacacgagggggugaaccucauaugauuguaagcaaacaagaacgagggaaaagucugcucuuuaaaacaucagcggggguuaauauguguacuuuaauagcaauggacuuaggugaauuuugugaagauacaaugacauacaaaugcccacgaauaacagaagcagaacccgaugacguagacuguugguguaaugcgacagacacaugggucacauaugguacaugcucccaaacaggggaacacaggcgugauaaaagaaguguagcacuugcgccacacguaggauuaggacucgagacacguacugaaacguggaugucgucagaaggggcauggaaacagauucaaagggucgagacuugggcacuaagacaucccggauuuacagucauagcauuauucuuagcacaugcaauaggaacauccauuacacaaaaaggaauuauuuucauacucuuaaugcuuguuaccccuaguauggcuaugcgcuguguggggauagguucgcgagauuuuguggaaggguuaagcggagcaaccugggucgacguaguguuagaacauggaucguguguaacgacaauggccaaagauaaaccgaccuuagauauagaacuacuuaaaacagagguaaccaacccagcaguacuacguaaacuguguauagaggcaaaaauaucgaacacuacgacggauucucgcugcccgacucaaggagaggccaccuuaguagaagaacaggacgcuaauuuuguguguaggaggacguucguagaucgaggauggggaaauggaugcggccucuuugggaaaggaaguuugauuaccugcgcuaaauuuaaauguguaacuaaacuugaggggaaaauaguacaauaugaaaaucuuaaauacucggucauuguaaccguacacacuggagaccaacaucaaguuggaaaugaaucuacggagcauggaacgacggcuacuauaacaccgcaagcgccaucuacugagauacaacuaacagacuauggcgcauugacucuugacuguucuccucguacugggcuagauuucaaugaaaugguauuauuaacaaugaaagagaaaaguuggcucguacauaaacaaugguuucuugaccugccgcuccccuggaccagcggagcaagcacaagucaagaaaccuggaaucgacaagaucugcucguuacguucaaaacagcucaugcgaagaaacaagaaguaguuguccuaggaucacaggaaggugcuaugcacacagcuuugaccggugcaacagaaauccagacaaguggcacaacaaccauauuugcuggucaccugaaaugccggcuaaaaauggauaaauuaacauuaaaaggaaugaguuacguaaugugcacaggaaguuuuaaauuagaaaaagagguagcagaaacucaacacggaacaguucugguacaaauaaaauaugaaggcacugacgcaccuuguaaaauaccauucuccacccaagacgaaaaaggagugacgcaaaacgguagacucauuaccgcaaacccgauuguaacggauaaagagaagccggugaauauugaagcagaaccgccauuuggagagagcuauauuguaauuggugcgggugaaaaggcuuugaaacucuccugguuuaagaaagguaguaguauagggaaaauguuugaggcgacagcuagaggggcuagaagaauggccauauuaggagauaccgccugggacuuugguucgaucgguggagucuuuacaucagucggcaagcuaguucaccaaaucuuuggaacugccuauggcgucuuauucaguggagucagcuggacaaugaaaaucggaauuggaguacuacuaacauggcucggucucaacagcagauccacaaguuuaaguaugacaugcauagcagugggccuagucacccuuuaccuuggagucaugguucaagcugauagcgggugcguuaucaauuggaaaggacgugagcuaaaauguggaagcgguauauucgucaccaacgaaguacauacauggacagaacaauauaaguuucaagcugacucuccaaaacgguugucggcagcgauagggaaagcaugggaagaaggaguuugugguauacgaagcgcaacacgauuagaaaauauaauguggaaacaaauuagcaacgaauuaaaucauauuuuguuagaaaaugauaugaaacuaacaguuguugucggcgauguagcaggcauauuagcacaaggaaagaagaugauccgaccacagccuauggaauacaaauauucauggaagucauggggaaaagccaaaauuauaggcgcagacguccagaacacaacguucauaaucgaugguccuaauaccccagaauguccggaugaccagagggcauggaauauuugggaaguagaagauuacggcuucggaauauucaccacaaauauaugguuaaaacucagggauucauauacacaagucugcgaccaucgacuaaugagugcggcaaucaaggauucaaaggcuguacaugcugacaugggguauuggauagagucagaaaagaaugaaacuuggaaauuagcacgagcgucguuuauugagguaaaaaccugcguuuggccgaaaagccacacucuguggucuaaugggguuuuggaaucagaaaugauaauuccuaaaauauauggagggcccauaucccaacauaauuacagaccuggcuauuucacacagacagcuggcccauggcaucucggaaaauuagaauuagauuuugaucuuugugaaggcaccaccguggucgucgacgagcauugcggcaauaggggaccaagccuaagaacgaccaccguaaccggaaaaaucauccacgaaugguguugcagaagcuguacacuaccuccucuuagauuuaaaggcgaagauggaugcugguaugggauggaaauucgaccagugaaagaaaaagaagaaaaccuggugaaaucaaugguaagugcaggaaguggagaaguagauaguuuuagccugggacuacuaugcauaaguaucaugauugaagaagugaugcgaagucgguggaguagaaaaaugcuaaugaccggaaccuuagcggucuucuuucuacugauuauggggcaacuuacuuggaaugacuuaauucgucucuguauuauggucggagcuaaugcuucagaucgaauggggaugggaacuaccuaccuagcacuaauggcaacauuuaaaaugagaccaauguucgcagucggccuuuuguuucgaagacuuacaucaagggagguucuguuacuuacaauagguuuaucacugguugcaucaguagaacuuccuaacaguuuagaagaacuuggggauggauuggcaaugggcauuaugauacuuaaauugcuaacggauuuucagagucaccaacugugggccacacuuuuguccuuaacguuuauccgcacaacauuuagcuugcacuacgcauggaaaacaauggccaugguucucucuauaguuagcuuauuuccacuuuguuugaguacaacaagucaaaagaccacgugguuaccuguucuucugggaucacuuggaugcaaaccuuugacuauguuucuaauagcugagaauaaaaucugggguagaaaaaguuggccauuaaacgaaggaauuauggcaguuggaauaguuucgauacuccugagcucacuuuuaaagaaugacguaccucuagcagggccguugaucgcaggaggaauguuaaucgcuuguuaugugauaucaggaucaucggcugacuuaucacuagaaaaagcagcugaagucucuugggaagaagaagcagaacauagcggagcuagucacaacauauugguagaaguacaagaugauggaacaaugaaaauaaaggaugaagaacgcgaugauacgcuuacaauucugcuuaaagcuacauuacuagccguuucgggcguauauccucucaguaucccggcaacgcucuuugucugguacuucuggcagaaaaagaaacagcggucaggaguccuuugggauaccccuucgcccccugaaguagaacgagcuguuuuggaugacggcauauauagaauaaugcaaaggggguuauuagggcgaucacaaguuggagucggggucuuucaagagaacgucuuucauacaauguggcacguaacaagaggcgccguacucauguaucaaggcaagcguuuagaacccucaugggcaucugugaagaaggauuuaauuucauaugggggaggauggcgauuacaaggaucauggaauaccggcgaagaaguacagguuauugcaguagagccagguaaaaaucccaaaaauguacaaacggcaccuggaacauucaaaaccuccgaaggcgaagugggggcaaucgcacucgacuuuaaacccggaacauccgggagcccaauaguaaacagagagggaaaaauaguuggccuuuauggcaacgguguuguuacgaccaguggaacuuauguaagcgccaucgcucaagcuaaagcuagccaggaaggaccgcuuccagaaauugaggaugaaguuuuucggaaaagaaaucugaccaucauggaucuacacccuggcagcggaaaaacgagaagauacuugccugcgauaguucgagaagccaugaaacgaagguugcguacguuaauacuagcaccuacaagaguaguugcuagugaaauggcugaggcuuuaaaaggaaugccaauccgauaucaaaccacagccguaaaaagcgaacauacggggaaggaaauugucgaccuaaugugucacgcuacauuuacuaugcggcuacuuagcccagugaggguuccaaauuacaacaugauuauaauggacgaggcccauuuuacugauccauccagcauugcggcaagaggauauauuucuaccagagucggcaugggggaggcugcggcuaucuuuaugacagcgacaccgccagggucuguggaagcauucccccaaagcaacgcgguuauacaagaugaagaaagggacauaccugaacgaagcuggaacaguggauacgaauggauaacugacuuuccagguaaaacagucugguuuguaccuucuauuaaaucgggcaacgauauagccaacugucuaaggaaaaacggcaaaagaguaauucaacugagucggaaaacauuugacacugaauaucaaaagacuaaaaauaacgauugggauuauguuguaacaacugacauaagcgaaaugggagcaaacuuccgagcggaucgaguaauagauccacggcgguguuuaaaaccaguuauauuaaaagauggaccugaacgcgucauccuugcagguccaaugccagugaccguggcuagugcagcacaacguagagguagaauaggacggaaucauaauaaagaaggugaucaguacauauauaugggacaaccgcuaaauaacgacgaagaucaugcacacuggaccgaagcaaaaaugcuauuggacaauaucaacacaccugaagguauuauaccggcucucuuugaaccggaaagggaaaagucagcagcaauugauggagaauacagacuuagaggcgaagcaagaaaaacguucgucgaauugaugcgaagaggcgauuuaccaguuugguuaaguuauaaaguagcaagugaaggcuuccaauacagugaccgcagaugguguuuugauggggaaagaaacaaucaaguacuugaagaaaacauggauguugaaauauggaccaaagaaggagaaagaaagaaauuacggccaagauggcuugacgcucgcacuuacucugauccccuagcauuaagagaauuuaaagaauuugccgcagguagaaggucuguaucaggugaucuaauuuuagaaauugggaaguuaccucaacaucuaacacagagagcacagaacgcacuugauaacuuggucaugcuccacaauucagaacaaggaggucgggccuaucgacaugcuauggaagaauuaccagacacuaucgagacucuaaugcuacuagccuuaauugcuguauuaacuggagguguuacacuauucuuuuuaucaggacgggguuuagguaaaacaucaaucggacuauuaugcguaauggcaucaucuguacuguuauggauggcaucaguagaaccccauuggauugcagccucgauuauacucgaguucuucuuaaugguacuguuaauacccgaaccagaccgucaaagaaccccacaagacaaucaguuggcguauguaguaaucggauuacuauucaugauuuuaaccguagcugcgaaugagauggggcuacuugaaaccacuaagaaagaucuaggaauaggucacguugcuguugagaaucaucaucaugccgcuaugcuagauguagacuuacacccugcaagcgcauggacauuguacgcaguagccacgacaauaauaacaccaaugaugaggcauacgauagaaaacacuacugcaaauauaagccuaacagcaaucgcgaaucaggccgcaauacugaugggccuggauaaaggauggccaauaaguaaaauggauauagguguaccacugcuugcccuugguugcuauucacaggucaauccacuaacauuaacagcagcaguuuuaaugcuuguagcacauuacgcaauuauugguccaggguuacaagcaaaagcuacacgggaggcacaaaaacggacagcagcaggaauuaugaaaaacccaacgguagauggcaucguugccauugaucuagauccgguaguuuaugaugcgaaauuugaaaaacaauuaggacaaauaaugcuacuuauacuaugcacgucacagauacugcuuaugcgaacuacuugggcccuuugcgagucgauaacguuggcgacaggaccgcugacaacacuuugggaggggaguccaggaaaauuuuggaacacgacaauugcggugaguauggcaaauaucuuuaggggaucuuacuuagcuggugcagggcuugcguuuucacugaugaaaucgcuaggagguggucgacgaggcacaggggcacaaggugaaacacuaggagagaaauggaaacgacaacucaaucaacugagcaaaucagaauuuaauacauauaaaagaagugguauaauggaggucgauaggagcgaggcaaaagaaggacuaaaacguggcgaaacaacaaagcaugcugucucacgggguacugcaaaauuaagaugguuuguugaaagaaaucuuguuaaaccggaggguaaaguaaucgacuuaggcuguggacgggguggcugguccuacuacugcgcuggacuuaaaaaggucaccgaaguuaaaggauacaccaagggaggaccaggccaugaagaaccgaucccaauggcaaccuauggauggaaccuagugaaauugcacucaggaaaagauguauuuuucauaccaccggaaaagugugauacacuccuuugcgacaucggcgaaagcucaccaaacccaacuauagaggagggaagaacauuacgaguauuaaaaaugguugagccaugguuacggggcaaccaguucuguauuaaaauuuuaaauccuuauaugccuucgguuguagaaacucuagaacaaaugcagcguaagcacggugguaugcugguucgaaacccucugucaagaaauucaacacacgaaauguacuggguaagcuguggcacuggaaauauuguuucugcagucaauaugacaagucgcaugcugcuuaacagauuuacaauggcgcaucggaaaccgacauacgaaagggacgucgauuuaggcgcuggaacuagacacguugcugucgaaccagaagaggcuaaucuagauaucauaggacagaggauagagaauaucaagcacgaacauaaaucaaccuggcauuacgaugaagauaacccuuacaaaacuugggcauaucauggauccuaugagguaaagccaaguggaagcgcaucaucaauggucaauggcguagugaaauuacucacuaagccgugggauguuauaccuaugguaacucaaauugcaaugacugauaccacaccuuucggacagcaaagaguauucaaggaaaagguagauacuagaacgccgaaagcuaaacgaggcaccgcacagauaauggaaguuacagcaaaauggcuuugggguuuccuuucacgcaauaaaaagccaaggaucuguacgagggaagaguucacuaggaaggucaggucaaaugcagccaucggggcaguuuuuguugacgaaaaccaauggaauagcgcaaaagaggcuguugaagaugagcgauuuugggacuuaguucaucgugaacgagaauugcauaaacaagggaaaugcgcgaccugcguauauaacaugaugggcaaacgagaaaagaagcugggcgaauuuggcaaagccaaaggaaguagagcuaucugguacauguggcucggggccagauuccuagaauuugaagcauuaggguucaugaacgaagaucauugguucucaagggaaaauagccuuaguggcguggaaggugaaggauuacacaagcucgguuacauucucagagauaucuccaaaauuccuggugguaauauguacgcagacgacaccgcggguugggacacacgaauaaccgaagaugacuugcaaaacgaggcuaaaauaaccgacauuauggaaccagagcacgccuugcuugccaaaagcauauuuaagcuaaccuaucaaaauaaggugguucguguacaaaggccagcuaaaaaugguacaguuauggacgugauuagccggagggaucaaagaggauccggacagguaggaacguacggacugaauacauucacaaauauggaagcgcaauuaauccgucaaauggagucugagggaauuuucaguccuucugaauuggaaacacccaauuuagcugggcgcgugcuagacugguuagaaaaacaugguguagaacgacucaaaagaauggcgauauccggugaugauugcgucguuaaacccauagacgaccgauucgcaaccgcucuuacugcccuaaaugauaugggaaaagugcguaaagacauaccacaaugggaaccaucuaaagguuggaaugauuggcaacagguaccauucugcucacaucauuuucaucaacuaauaaugaaagacggaagagaaauuguaguaccuugcagaaaucaggaugagcuaguggguagagcacgggugucacaaggagccggguggucgcuuagggaaacagcaugccuggggaaaagcuaugcucaaauguggcaacuuauguauuuucacagacgcgaccugcgccucgcagcuaaugcuauaugcagugcaguccccgucgauuggguccccacaagccguacaacaugguccauacacgcucaucaccaauggaugacuaccgaagacauguuauccguauggaauagaguuuggauagaagaaaacccauggauggaagauaagacacauguaagcucauggggagacguuccauaccuagggaaaagagaagaccaaugguguggcucccucauuggauuaacugcgcgagcaacaugggcaacaaauauacaaguggcgauaaaccagguaagacggcuucuggguaaugaaaauuauuuagauuauaugacuucuaugaaaagauuuaaaaacgaguccgauccggagggcgcacuuugguaa

SEQ ID NO: 21783 - RNA, 9879 nt, Artificial Sequence
  derived and/or modified CDS sequence (opt6) from DENV-1__GU131690__SS-prME
agcguuacuauguuauuaauguugaugccaacugcacucgccuuucaucuaacaacaagggguggagaaccgcauaugauagucucaaaacaagaaagggguaaaagccuccuuuucaaaacaucagcgggagucaacaugugcacccucauagccauggauuuaggugaacuaugcgaagauacaaugaccuauaaauguccucgaaucaccgaaacagagccagacgacguagacugcugguguaacgccaccgauacauggguaacauacggaacauguucucaaacaggggagcaucggagggauaaaaggucuguggcccucgcaccgcauguaggacuaggauuagaaacgcguacggaaacguggaugucaucugaaggcgcguggaaacaaauacaaaggguggaaacgugggcacuacgccacccagguuuuaccgugauagcauuguuuuuggcacaugcaauagggacaaguauaacucaaaaaggaauaauauuuauacuuuuaaugcuagugacaccuaguauggcgaugcgaugcguagguauaggaucuagagacuucguugaaggccuaagcggagcaaccuggguagacguggucuuagagcaugguagcuguguaacgaccauggcaaaagacaaaccaacuuuagauauugaguuguuaaaaacagagguuacaaacccugcaguauuaagaaaauuauguauagaggcgaaaauaagcaacaccacgacagacaguaggugcccaacucaaggagaagccacauuaguugaagaacaagacgcgaauuucguaugcagacgaaccuuuguagaccggggaugggggaaugguuguggauuauucggaaaaggcucuuuaauaacaugcgcgaaauucaaauguguuacuaaacuagaaggaaaaauaguucaauacgaaaaucuuaaauacagcgucauuguuacagugcauacaggggaccaacaucaaguaggaaaugaaucuacugaacauggcacuacagcaaccauuaccccucaagcucccacuacugaaauacaauuaacagauuauggggccuugacccuugauugcucaccgcgaacuggauuagauuuuaacgaaaugguucucuuaacgaugaaagaaaaaucauggcucguacacaaacaaugguuuuuagaucucccgcuaccguggacgaguggugccucuacaagccaggaaacauggaauagacaagaucuuuuaguuacauuuaaaacagcucaugccaagaaacaagagguaguuguguugggcucgcaggaaggagcuaugcauacugccuuaacuggagcgaccgaaauacagacaucaggaaccaccacaauauuugcuggacaucuaaaaugucgcuuaaaaauggauaaauuaacuuuaaaagggauguccuauguaaugugcacaggcaguuucaaacuggaaaaagaauuagcugaaacgcaacacgggacagucuuaguacagauaaaauacgaaggaacagacgcaccuugcaaaauaccuuuuaguacacaagaugagaaaggaguuacacaaaacggacgacugauuacagccaauccuauugugacggacaaggaaaaaccgguaaauauugaagccgaaccgccauucggugaaagcuauauaguuauaggugccggagagaaagcccugaaguuaagcugguuuaagaaaggaucaagcauugggaaaauguuugaagccacugcuagaggagcaagacggauggcaauucuaggagauacggcuugggauuucggaagcauuggcgggguauuuacaucugucggcaagcugguccaucagauauuuggcaccgcauaugguguauuauucaguggagugagcuggaccaugaaaauagguauaggaguuuuauuaacaugguugggucuaaauucaagaucuacuagcuuaucuaugacgugcaucgcaguuggccuaguuacacuguaucuggggguuaugguucaagcggauucagguuguguuauuaacuggaaagggcgcgaacuaaaauguggaucagguauauuugucacaaaugaggugcacacguggacggaacaguauaaauuccaagcugauaguccgaaaagacuuuccgcagcgaucgggaaggcaugggaagaaggcguaugcggaauuagauccgucacacgacuagagaauauuauguggaaacaaauuucaaaugaacuaaaccauauacuucuagaaaaugauaugaaauuuacaguagucgugggagauguggcuggaauuuuagcacagggaaagaagaugauacgcccucaacccauggaacauaaauauucuuggaaaucguggggaaaggcaaagauuaucggagcugauguacaaaauacaacuuucauaauugacggaccaaacaccccugaaugccccgaugaucagagagcuuggaauauaugggaggucgaagacuauggauucggaauauucacuacgaauaucugguuaaaguugagagauagcuauacucagguaugcgaucaucgucuaaugagugcagcuauaaaagauucaaaagcgguucacgcugacaugggauauuggauugaaagugaaaagaacgaaaccuggaaacuugcacgugcgaguuuuauugaagucaagacauguauauggcccaaaucucacacguuaugguccaaugguguuuuggagagcgaaaugaucauaccuaaaauauacgggggucccauuucacaacacaauuauaggccuggauauuucacccaaacggcagguccguggcaccucgguaaacuagaacucgacuucgacuugugugaagggacaacaguuguaguagaugaacacugugguaauaggggaccgagucuucgaaccaccacaguuacaggaaaaauaauacaugaauggugcugccggucuuguacgcuuccaccuuuacguuuucgaggagaagaugguuguugguaugguauggagauacggccggucaaagaaaaagaagagaaucuggucaaguccaugguuucagcuggaucaggagagguagacuccuucucauuaggacuucuauguauaaguauuaugauagaggaggugaugaggucgcgguggagucguaagauguuaaugacuggaacauuggcgguauucuuucucuuaaucguuggccaauuaacguggaaugauuuaauaagguuguguauuauggugggggcuaacgcuucagaccgcaugggcauggguacuacguaccucgcacugauggccacuuuuaaaaugaggccuauguuugcuguaggacuacuauuucgccgauuaacaucacgcgaaguacuucuauuaaccauaggacuuucucuuguagcgucggucgaauugccaaauucuuuagaggagcuaggagacggacuagcaaugggcauuaugauccuuaaauuacuaacagauuuccagagucaccagcugugggcuacgcuucugagccugacauucauaaaaaccaccuuuagccuccacuacgcauggaagacuauggcgaugguacuaucagucguaucccuauuuccacucugccuguccacgacuagccagaaaacgacgugguuaccugugcuuuugggaagucuagguuguaagccuuuaacaauguuccuaauagcagaaaacaaaaucuggggaagacgaucauggccauuaaacgaagggaucauggcaguaggaauaguaaguauucuauugaguagucuauugaagaacgauguaccucuugccgguccccuaauagcagggggcauguuaaucgcuuguuauguuauaagcgguucuuccgcugauuugucucuggagaaagcugccgaagucaguugggaggaagaagcugaacacucaggggcaucccauaacauauuggucgaaguucaagaugacggcaccaugaaaauuaaagaugaagaaagggaugauacacuaacgauccuucugaaggcuacacuguuagccguaagugguguuuauccauugucaauuccugcaacguuguuuguaugguacuuuuggcaaaagaagaaacaaagguccggaguucuaugggauacaccuaguccuccagaaguggagcgagccguguuagaugauggaauauaccgaauuaugcagcggggguuacuugguagaucccaaguaggaguagggguauuucaagaaaauguguuccacacaauguggcacgugaccagaggggcugugcuuauguaucaggguaagagacucgagccaucaugggccagugucaagaaagaucuuauuaguuauggcggaggguggcguuugcaaggaagcuggaacaccggagaagagguucagguaauugccguagaaccuggcaaaaaucccaaaaauguucaaaccgcaccuggaacguucaaaaccccugaaggugaaguaggcgcaaucgcguuagauuuuaaaccaggaacuucggguucaccuauuguaaaucgugaaggaaagauaguugguuuauauggcaauggaguaguaaccacaucggguacauacguuagugcaauagcacaagcaaaagcuagucaagaaggcccauuaccggaaaucgaggaugagguauuuaggaaaagaaauuugacgauaauggauuugcauccugggaguggaaagacacgaagauaucuuccggcgauuguacgagaggcaauaaagcgcaaauuaaggacguuaauacuagcaccuacaagaguugucgcgagugaaauggcagaggcuuuaaaagggaugccuauucgauaucaaacgacugcaguuaaguccgaacauacgggaaaggaaauuguggaucuaaugugccaugccacguuuaccaugagacuccuuucucccguaagagugccuaauuauaauaugaucauuauggacgaagcacauuuuacugauccaaguucaaucgcggcaaggggauacauaagcacacgugucggaaugggagaagcagcugcgauuuuuaugacagcuacaccucccgguucugucgaagccuuuccacaaucaaacgcugugauacaagaugaggagcgugacaucccagaaagaucuuggaauagcgguuacgaguggauuacugacuuuccuggaaaaacaguaugguuuguaccaagcaucaagagcggcaaugacauugcuaacugcuuaaggaagaaugguaaaaggguaauacaauuaagucgcaaaacauucgacacagaauaccagaaaaccaaaaacaacgacugggacuacguaguaacaacagauauaucugagaugggagcaaacuuucgcgcugauagaguuauagacccccgaagaugcuuaaaaccgguuaucuuaaaggacggaccagaaagaguaauacuugcuggaccaaugccugugacaguggcuagugcagcccaacgacggggucgaauaggcagaaaucauaacaaagaaggagaucaguacauuuacaugggacaacccuuaaacaacgaugaagaucacgcacacuggaccgaagcaaaaauguuguuagauaauauuaauacuccugaaggaauaauuccugccuuauucgagccagaaagggaaaaaucagcugccauagacggggaauaccgucugaggggagaagcacgaaagacguuugucgaauuaaugagaagaggggaccuuccgguauggcuaagcuauaagguagccagcgaaggguuucaauauuccgauaggcguugguguuuugacggugaaagaaauaaccaggugcuugaggaaaauauggacguagagauauggacuaaggaaggugaacguaagaaauugagaccaagauggcuggacgcgagaacauacucugauccucuggcacuuagagaguuuaaagaguucgcugccggucgaagaucaguaucgggagauuugauucuugaaauugggaaacuaccacaacaucuaacucaaagagcacaaaaugcucuugacaaccucguaaugcuucauaauagugaacagggcgguagagcguacaggcaugcaauggaggagcuaccugacaccauagagacucuaauguuguuagcccuaauugcuguauuaaccggugguguuaccuuguucuuuuuauccgguaggggcuugggaaaaacuagcaucggccuauuauguguaauggccucauccguccuucucuggauggcguccguagaaccacauuggauagcggcaucuauuauauuagaguucuuccuaaugguccuacugauucccgaaccagauaggcaaagaacuccgcaggauaaucagcucgcauacgucguuauaggacucuuguuuaugauacuaacuguagcagcaaacgaaaugggcuuguuagagacuacuaagaaagaucucggaauugggcauguugcaguggaaaaucaucaccaugcugcaauguuagauguagaccuucacccggcaagugcuuggacauuauacgcgguagcaacgacaaucauuacuccuaugaugcgucacacuauugaaaacacgacagcgaauaucagcuuaacugccauagcaaaucaagcagcaauucuuaugggacucgauaaaggcuggccaauaucaaaaauggauauaggagucccacucuuagcucuaggcuguuacucccaagugaacccauuaacgcuuacagccgcuguucuuauguuaguugcccacuacgcaauaauaggaccuggccuccaagcuaaagcgacaagagaagcacagaaaagaacagcggccgggauuaugaaaaauccaacugucgacgggaucguugcuauagaccuugacccaguaguguaugacgcuaaauucgagaaacaguuaggacaaauuauguugcuaaucuuauguacuagccaaauauuguuaaugagaaccacgugggcguuaugugagaguauuacguuagcuacuggaccauuaacaacauuaugggaaggaucuccuggaaaauuuuggaauacgacuaucgccguuucuauggcuaacauuuuuaggggaucguacuuagcuggagccggccuugcuuucagucugaugaaaagucucggaggaggaaggcgcgguacuggugcacagggggaaacgcuuggcgagaaauggaagagacagcuaaaucagcugucaaaaucagaguucaauacuuacaaaagaagugggauaauggagguagaccguagcgaagcaaaagaaggacuaaaacgaggugaaacgacaaagcaugccguuuccagggguacggcaaaacuacgcugguucgucgaaaggaauuugguaaagcccgaaggaaagguaauagacuuaggauguggaagaggcggauggucuuauuauugcgcuggucuaaagaaagugacagaaguaaaagguuacacuaaaggaggccccgggcaugaggaaccaauaccgauggcgacauaugguuggaacuuaguaaaacuacacaguggaaaagacgucuucuuuauaccaccugaaaaaugcgauacuuuacuuugugacauaggggagaguucuccaaaccccacuauugaggagggcaggacccuuagaguacuuaaaaugguggaaccuugguuacggggcaaccaauuuuguauaaaaauacugaacccauacaugccaucggugguagaaacacucgaacaaaugcaaaggaaacaugguggaaugcuuguccguaauccguuaucaagaaauucuacucaugaaauguauugggucucgugcggaacggguaauauagucuccgcgguuaauaugacaagcagaauguuacuaaaucguuuuacaauggcacauagaaaaccgaccuaugagagagacguagacuuaggugccgguacuagacacguggcaguugagccagaaguagcuaaccuagacauuauaggacaacguauagaaaauauuaaacaugaacauaaaucaaccuggcacuaugaugaggauaacccauacaaaacaugggccuaucacggguccuacgaaguaaaaccgucaggauccgcaaguucuaugguaaacggaguugugaaauuauuaacaaaacccugggauguaaucccgaugguuacacaaauugccaugacagacacgacaccauuugggcaacaaaggguauuuaaggaaaagguugacacaagaacuccaaaggccaaaaggggaacugcccaaaucauggaagugacugcaaaaugguuauggggcuuuuuaucucggaauaagaagccgagaaucuguacaagagaagaauuuacccggaagguaaggucaaacgcugccauaggugcaguauuuguagaugaaaaccaauggaauagugcaaaggaagccguagaagaugaaagauuuugggauuuaguacacagggaaagagaacuccauaagcaaggcaagugugcaacuugcguguacaacaugaugggcaaaagagagaagaaauuaggugaguucggaaaggccaaagguagccgagcuauaugguauauguggcuaggugcaagauucuuagaguucgaagcacuagguuuuaugaacgaagaccauugguuuagccgagaaaauagucuuucuggaguugaaggagaaggguuacauaaauugggauauauucugcgcgauauaucaaagauaccaggaggaaacauguaugcugaugacacagcugguugggauacaagaauaacagaagacgauuuacaaaacgaggcccggauaacugauauaauggaaccagagcaugcuuuauuagcuaaaaguauuuucaaauuaacauaucaaaacaaaguuguuagagugcaacgcccagccaagaauggcacugucauggauguaauaucaaggagggaucagagagguaguggccaaguggggacuuacggauuaaauacguuuacgaauauggaagcccaauugaucagacaaauggaaucugaagguauauucucuccuagugaacuagaaacaccaaaucuugccgaaagaguacuagauuggcuagaaaaauacggaguggaacgacucaaacgcauggcaauuuccggagaugauuguguagucaaaccaauagaugaucgguucgcuacugcacuaacagccuuaaaugauauggguaaggucagaaaagacauuccacagugggaaccaaguaaaggcuggaaugauuggcaacaaguaccauuuugcucacaucacuuccaucaauuaauaaugaaggacggacgcgagauaguaguuccuugccgaaaucaggaugagcuaguuggccgugcucgcgugucucaaggagcaggauggaguuuaagagaaaccgcuuguuuagguaaaucauacgcccaaauguggcaguuaauguauuuucacagaagggaccuacgguuggcagcaaacgcuaucugcagugcaguuccggucgauuggaucccgacgucaaggacaacauggucgauucacgcccaucaccaguggaugacaacagaagauaugcugucuguguggaauagaguauggauagaagaaaauccauggauggaggauaaaacacauauaucaaguuggggugauguuccuuacuuggguaaaagggaagaucaaugguguggaucauuaauaggacuaacagcaagagcuacaugggcgacgaacauacaaguagcgaucaaucaagugagaagguugauaggaaaugaaaacuaucucgauuauaugacuagcaugaagcguuuuaagaaugaaagcgauccugaaggagcgcuuugguaa

SEQ ID NO: 21784 - RNA, 9879 nt, Artificial Sequence
  derived and/or modified CDS sequence (opt6) from DENV-1__GU131695__SS-prME
ucaguaacaauguuacuaaugcuaaugccaaccgcgcuagcauuucauuuaaccacgagggggggagaaccgcacaugauuguaagcaaacaggaaagggguaaaagccuacuuuuuaaaacaucggcaggcguaaacauguguacguuaauagcaauggaccuuggagaacugugugaagacacuaugacauauaaauguccacgaaucacugaaacagaaccagacgaugucgauugcugguguaaugcaacugauacauggguuaccuaugggacuuguagucaaacuggcgaacaucgacgugauaaacgaucaguagcguuagcuccacauguagguuuaggacuggaaacuaggacagaaacuuggaugucuagcgaaggcgcauggaaacagauucaacgcguagaaacgugggcauuaaggcaucccggcuuuacaguaauugcauuauuccuggcucacgccaucggcaccucuauaacgcagaaaggaaucaucuucauccugcuuaugcuugucacacccuccauggcaaugagaugugucggaauaggaaguagagacuucguagaaggauuaucgggagcuacuuggguagauguugucuuggagcaugguucuuguguaacaaccauggcaaaagauaaaccuacauuagauaucgaauuauuaaaaacugaagugacgaauccugcgguauugaggaagcuauguauagaagcaaagauuaguaauacuacuacagacagcagaugcccaacgcaaggcgaagcaacauuaguugaagaacaagaugccaauuucguauguaggaggacguuuguagaccgagguuggggaaacggauguggacuuuucgguaaagguaguuuaauuaccugcgcaaaguucaaaugugugacaaaguuagagggcaaaauaguacaguacgaaaaucucaaguacucggugauuguuacaguacauaccggcgaucagcaucaaguugguaacgaaagcacagagcaugguacgacagcaaccauuacaccccaggcuccaaccacugaaauccaauugacugacuauggcgcacuaacguuagauugcucgccacgaacuggacuugauuuuaaugaaaugguacuguuaacgaugaaagagaaaucauggcuaguacacaaacaaugguuuuuagaccucccacugcccuggaccagcggagcaagcacgagucaagagacauggaaccgucaagaucuacuaguaaccuucaagacggcgcacgcaaagaaacaagaggugguuguacuaggaagccaagagggugcaaugcauacagcucuuacaggugcaacagaaauucaaacgucuggaaccacaacuauauuugcaggccacuuaaaaugcagguuaaaaauggacaagcuuacauugaaagguaugucauauguaauguguaccggaaguuucaaauuagaaaaagagguagcagaaacgcaacauggaacaguauuaguucaaauaaaguaugaagguacggaugcaccauguaaaauaccuuuuucgacucaagaugagaagggugucacacagaacggccgguuaauuacagcuaauccaaucguaacugacaaggaaaagccaguuaauauagaagcggaaccuccauuuggagaaucauauauuguuauaggggcaggugaaaaggcucucaaguugucaugguuuaaaaaagggaguucgauagggaaaauguucgaggcaacugcgagaggagccagaagaauggcuauuuuaggcgacacagccugggacuucgggucaauaggagguguauucacaaguguagguaaacuuguccaccaaauauuugguacagcuuacgguguauuauucucugguguuaguuggacgaugaaaauaggaauagggguguuacuaacuuggcuaggucugaauucucguucuacaagccucagcaugacaugcauagcaguaggguuggucacucuauaccucggaguuaugguccaagcugacucaggcugcgugauuaauuggaaaggaagggagcuuaaaugcggaucaggcauuuuuguuacuaaugaaguacauacauggacugagcaauauaaguuccaagcagacucuccuaaacgucuaagugcugcuauaggcaaagcgugggaagagggaguaugcgguauacgcucagcaacacgucuggaaaauauaauguggaaacaaauuucuaacgaauugaaucacauacuacuugaaaacggaaugaaauuuaccguugugguaggagauguugcagguauauuagcccaaggaaaaaaaaugauacgaccacaaccaauggaguauaaauauaguuggaaaaguuggggaaaagcaaagauaauaggugcugauguucaaaacacaaccuucauaauagauggucccaauaccccggaaugcccugaugaucagcgagcauggaauauaugggaagucgaagacuauggauucggcauauucacuacuaacauauggcugaagcuacgggauucauacacacagguaugcgaucauagauuaaugagugcugcaaucaaagauucaaaggcaguucaugcagauaugggauacuggauugaguccgaaaaaaaugaaacguggaaguuagcuagagcguccuuuauagaagucaagaccugcauuuggccaaaaucacauacacuauggaguaacggaguccucgaguccgagaugauaauaccgaaaauauauggaggaccuauaagucagcacaauuauagaccaggguauuucacacaaacggcagggccauggcacuuagggaaacuggaacuagacuuugaucuaugugaagggacaacuguaguaguagaugaacacugcggcaaccguggucccucccuuagaacaacaacugugacuggaaaaauuauacaugagugguguuguaggaccuguacgcuacccccucuccguuuuagaggggaagauggaugcugguaugggauggagauuagacccgugaaagaaaaagaggagaacuuagucaaaucuauggugagugccggaucaggagaagucgauagcuucaguuuaggguuacuaugcauuuccauuaugauugaagaaguuaugagaucaagauggucaagaaaaauguugaugacaggcacucuugccguuuucuuccuacugauuaugggccaacuaacauggaacgaucuuauaagacuuuguauaauggugggagcaaacgcaucagacagaaugggaauggguacuacauacuuagcacuaauggcgaccuucaaaaugagacccauguuugccguaggacucuuauuccgaaggcucacaagucgagaaguacucuuguugacgauagguuuauccuuaguugcaucgguagagcuuccaaauaguuuagaagaauuaggugauggacuggcgaugggaauaaugauucugaaacuccuaacagacuuccaaucccaucaacuaugggcgacauuacuaucuuuaacuuuuauuaagacaacuuucucucuacacuacgcauggaagacaauggcaauggugcuuagcauuguaucccuauucccucucuguuugucaacgacgucacagaaaacuacauggcugccgguacuauugggcaguuuaggaugcaaaccuuuaacaauguuucuuauagcagaaaacaaaauaugggguaggaggagcuggccacuuaacgagggaaucauggcaguagguaucguaucuauauuauuaagcuccuuauuaaagaacgaugugcccuuagcagguccucuuauagcagggggaauguuaauugcuuguuauguaaucucgggcaguucagcugauuugagucuagaaaaagcugccgaggugucuugggaagaagaagcagagcacagcggcgcuagccauaacauuuuaguugagguucaggacgauggaacaaugaaaauaaaagaugaagaaagagaugacacacuaacuauccuguugaaagcaacacuuuuagcaguaagugguguauauccccugucgauuccugcuacauuguucgucugguauuucuggcaaaagaagaaacaaagaucaggaguacuaugggacacccccucuccuccagaagucgagcgagccguucuagacgauggaauauacaggauuaugcaacguggacucuuaggaaggagucaagugggugucgggguauuucaggaaaaugucuuccacacuauguggcauguaacaagaggagcuguauuaauguaucaggguaaacgucuagaaccaaguugggcauccguuaaaaaagaucuaauuaguuacggaggaggauggagacuacaaggaagcuggaauacuggagaggaaguucaggucauagcgguugaaccaggaaaaaauccaaagaauguacagaccgcuccaggaaccuucaaaacgccagaaggugaaguuggugcaauagcguuagacuuuaaaccagguacaagcggcagcccaauaguaaaccgcgaagguaagaucguuggacuauacggcaauggaguugugaccacaucagguacauacguuucagcuauagcucaagcuaaagccagucaagaagggccauugcccgaaauugaagacgaaguguuuaggaagcgaaaucugacuauuauggauuuacauccgggauccggcaaaacucgccguuacuuaccagcgaucgugagagaagcaauuaaacgaaaauuacgcacauugauauuagcaccaacaagagugguagcaucggaaauggcagaagcacugaaaggcaugcccauaagauaccagacuacggcagucaaauccgagcacacggguaaggaaauuguugaucuuaugugucaugccacguucacuaugcgccuccucucaccggucagaguaccaaacuauaauaugauaauuauggacgaggcacauuucacagauccaucuucaaucgcugcccgggguuauaucucuacgagaguuggaaugggggaagcagccgccaucuuuaugacagccacaccccccggaucaguagaagcauuuccccaaagcaaugcggugauucaggaugaggaacgggauauacccgaaaggucguggaauaguggauacgaauggauuacugauuuuccagguaaaaccguaugguuuguaccaagcauaaaaucugguaaugauauagcaaauuguuuaaggaaaaauggaaagagagugauacaauuaucaaggaaaacauucgauacagaauaccagaaaacaaaaaauaaugacugggauuauguggucacaacugauauaucagaaaugggcgcgaacuucagagccgauaggguaauugauccaagaagaugucuaaagccaguuauccuaaaagacggccccgagcguguaauauuggcagggccuaugccgguaaccguugccagcgccgcacagagaagagggcgaauaggaagaaaucacaacaaagaaggagaucaauauaucuacaugggacagccccuuaacaaugaugaagaccacgcucacuggacagaagcaaagaugcuucuugauaacauuaauacacccgaaggaauaauaccagcauuauuugaaccugagcgugaaaagagugcagcaauugauggagaauaccgguuacgcggugaagcgagaaaaacuuuuguggaauugaugcgaagaggugaucuaccggucugguuaagcuacaagguugcuucagagggauuucaauauagugaccgacggugguguuucgacggggagcgaaauaaucaggucuuagaagaaaacauggacgucgagauauggaccaaggaaggagaacgaaagaaacuacgaccuagauggcucgaugcgagaacuuacucugauccacucgccuuacgcgaauucaaagaauuugcugccggccguagaagcguaucaggugauuuaauacuggaaauugguaaacugccgcagcauuugacccaaagagcgcaaaaugcacuggauaauuuaguaaugcugcauaauucugagcagggaggcagggcuuaccgacacgcuauggaggaguugccagauacgauugagacauugaugcuucuagcucucaucgcaguucuaacagggggcguaacauuauuuuucuugucuggccgcgggcuggggaaaacaucuauaggucuucugugugucauggccucaagcgucuuauuguggauggcauccguagagccucacuggauugcagccucgauuauuuuagaauucuuccuuaugguuuuacuaaucccagagccagacaggcaacgcacaccacaagacaaccagcuagccuacguagugauaggauuacuguucaugauacuaacaguagcggcaaacgagaugggcuuacuugaaacaacuaagaaagaccuaggaauaggacacguagcuguugagaaucaucaccacgcagcuauguuagauguugacuuacacccagccagugcuuggacacuauacgcaguggcaacuacgauaauaaccccuaugaugcgacacacuaucgaaaauacuacagcuaacauaucgcuaacugcgauagccaaucaagcagccauuuugaugggcuuagacaaggguuggccaauuucaaaaauggauauaggcguuccccuacucgcacuugguugcuauucacaagugaauccccugaccuuaacugcggcgguccuaaugcuugucgcucacuacgcgauuauagguccaggcuuacaggcuaaagcaacaagggaagcccagaagcguacugcagccgguauaaugaaaaauccaacagucgaugguauaguggcgauagauuuagacccuguaguauacgaugccaaguuugaaaaacaacucggccaaaucaugcucuuaauacuaugcacgagucaaauacuauuaaugagaacaaccugggcucucugcgaaucaauuacuuuagcaacuggaccgcuaacuacuuuaugggaagguucaccgggaaaauuuuggaacaccacgauugcuguaucgauggcuaauauuuuccgaggaagcuauuuagcuggcgcuggacuggcauuuucguuaaugaagaguuuagguggcggaagaagggggacuggcgcgcaaggggaaacgcuaggcgaaaaguggaaaaggcaacugaaucaguuaucuaagagcgaauucaauaccuauaagagaucuggcauaauggagguggaucguucagaagcgaaagaaggucuuaaacggggggaaaccaccaaacaugcagucagucgggguacagcaaaacugagaugguuuguggaaaggaaucuaguaaagccugaggguaaagugauagaccuggguugcgguagaggaggauggucuuacuauugugcuggucuaaagaaaguaacggagguaaaggguuauacaaaagguggccccggccacgaagaaccaauucccauggccacuuacgguuggaaucucguuaaacuccacaguggaaaagauguuuuuuucauuccccccgagaagugcgauacacuucuaugugacaucggagagaguucaccuaauccaacaauugaagagggacguacccuaagaguauugaaaauggucgaaccguggcuaagaggcaaccaguucugcauaaaaauucuaaauccuuauaugccauccguaguugaaacacuugaacagaugcaacgaaaacauggcggaaugcuaguacgaaauccacuguccagaaauaguacacaugagauguauuggguuuccuguggaaccggaaauauaguuucugccguaaauaugacgucaagaaugcugcucaauagauuuacaauggcccauaggaaaccuacguaugagagagauguagauuuaggggcaggaacucgccacguagcuguagaaccugaggucgcaaaccuugauauaaucggccaaaggauagagaauauuaaacacgaacauaaaagcacauggcauuacgaugaagauaaucccuauaagacgugggcguaccauggaucauaugaggucaaacccucagggucagccucaucaauggucaacggcguaguaaaacuauuaacgaaaccuugggacguuauaccaaugguaacgcaaaucgccaugacggauacaacaccauucggucaacaaagaguauuuaaagaaaaaguagacacuagaacuccuaaggcaaaacgagguacagcacaaauaauggaagugacagcuaaaugguuaugggguuucuuaaguagaaauaaaaaaccaagaaucuguaccagagaagaguucacucgaaaaguuaggaguaacgccgccauaggagccguauuugucgaugagaaccaauggaacagugcuaaggaagcaguagaagaugaacguuuuugggaucuaguacacagagaaagagaauuacauaaacaagggaagugcgcuaccuguguuuauaauaugauggguaaacgagagaagaaacuaggagaguucggaaaagcaaaaggaagucgugcgauuugguauaugugguuaggcgcacguuuuuuggaauuugaagcccuagguuuuaugaaugaagaccacugguucucucgugaaaacucguuaagugggguggaaggugaaggacuacauaagcucggcuacauuuuacgugacauuaguaaaauaccugguggcaauauguaugcagacgacaccgcaggaugggacacaagaauaacagaagaugaucuacaaaaugaagcacggauuacggacauuauggaaccagagcaugcccuuuuagcacgcucaauauucaaacugacauaccaaaacaagguaguucguguucagcgcccggcaaagaacgguacggucauggauguuauaagucgacgagaccaacgaggguccggacaaguagguaccuauggucuaaauacuuucacaaauauggaagcacaacugauuagacaaauggaaucugagggaaucuuuucaccauccgaauuagaaacaccaaacuuagccgaaaggguguuggauuggcuugaaaaauauggcguagagagacucaaaagaauggccauaaguggagaugacuguguugugaaaccaauagaugauagauuugcaacagcacuaacagcccugaacgauauggguaaaguacgaaaagauauaccacagugggagcccucgaaagguuggaaugauuggcagcaaguucccuuuuguagucaccauuuccaucaauugaucaugaaagauggcagagagauaguggugcccugccgcaaucaagaugaacuuguaggaagggcacgagugagucaaggugcaggauggucguugagagaaacagcaugccuugggaaaucauaugcucaaauguggcaauugauguacuuccauaggcgagacuugagacuagcagcuaaugcaauuugcagugcugucccaguugacuggauuccuacaaguaggacaacauggucuauacacgcccaccaucaauggaugaccacggaagauaugcucagcguuuggaauagaguauggauugaagaaaauccauggauggaagauaaaacgcacauaucuagcuggggagauguaccuuauuuaggaaaaagagaagaccaauggugugggucacugauaggauuaacugcacgagcaacuugggcgacaaacauccaaguagcaauuaaucaaguccgacgauuaauuggaaacgaaaacuaccuggacuauaugacauccaugaaacgguuuaaaaaugagucagacccugaaggagccuuaugguag

SEQ ID NO: 21785 - RNA, 9879 nt, Artificial Sequence
  derived and/or modified CDS sequence (opt6) from DENV-1__GU131697__SS-prME
ucaguuacaauguuauuaauguuaaugcccacugcguuagccuuucauuugacuacgcgcggaggugaaccacacaugaucguuaguaaacaggaacgggguaaaucuuugcuauuuaaaacaucagccgguguaaacauguguacacuaaucgccauggaccuuggugaauuaugugaagacaccaugacauacaaauguccacguauaaccgaagcggaacccgacgauguugauuguugguguaacgcaacugauacguggguuaccuacggaaccugcucgcaaacgggugaacaccggcgggacaaaagaaguguggcacuggcaccacauguaggacuaggguuagaaaccagaacugaaaccuggaugucaagugaaggugccuggaaacaaauucaacgaguagaaacuugggcguuaagacauccgggcuucacgguaauugcauuauuucuugcucaugcaaucgggacaucaauaacccaaaaagggauaauauucaucuuguuaauguuaguuacaccgucaauggccaugagaugcguugguauaggaaguagagacuucguagaaggacuaucaggagcaaccuggguagauguaguauuagaacaugguucgugcguuacgaccauggcaaaagauaaaccaacacuagacauagaacuucucaaaacugaagugacaaauccagcaguauuaaggaaauuauguauagaagcaaaaauuucaaacacuacgaccgauagcagaugcccuacgcaaggagaagcuacgcugguagaagaacaagacgcgaacuuuguaugucgaaggacguucgucgauagaggauggggaaacggaugcggucucuuugggaaaggcucguuaauaacaugugcaaaauucaaaugcgugacaaaauuggaaggaaaaauuguucaguacgaaaaccuaaaauacucaguaaucgugaccguccacacaggcgaucaauaccaggucgggaaugaaucgacggagcacgggacuaccgcaaccaucaccccacaggcaccaacuacagaaauacaacucacagacuauggugcucugacccuugacugcucaccaagaacggggcuagacuucaaugaaaugguacuucugacuaugaaagagaaaaguuggcucguacauaaacagugguuuuuagauuuaccacuuccuuggacaucgggagcaucaacaucacaagaaaccuggaauaaacaagaccucuuaguaacuuucaagaccgcgcacgcgaagaaacaggaagucguaguacugggcagucaagaaggagcuaugcacaccgcucugaccggcgcaaccgaaauacaaacgaguggaaccacaacaauauuugccggacaccuaaaauguaggcuuaaaauggauaaacuuacguuaaaaggaaugaguuauguaaugugcacugguagcuuuaaacuagagaaagaaguagcggagacucaacauggaacuguauuaguucaaauuaaauacgagggcacagaugcaccauguaagaucccuuuuaguacacaagaugaaaaaggaguuacacaaaauggaagacuaaucacagcaaauccaauugugacugacaaggagaaacccguuaacauagaagcagaaccaccguucggagaaagcuacauaguaauuggagccggugaaaaagcccuaaaguuaucaugguucaaaaagggaucaaguauagguaaaauguuugaggcuacugcccguggagcaaggagaauggcuauuuuaggggauacugccugggauuucgguuccauagguggcgucuuuacgucaguagggaaacuaauacaucagauauucggaacugcuuaugguguauuauuuucagguguaucuuggacaaugaaaauuggaaucgguguacuucuuacuuggcuugguuugaauagucgcuccacaucccuguccaugacauguauagccguuggcuuggucaccuuauaccucggcguaauggugcaagcagacaguggaugcguaaucaacuggaagggaagggaauuaaaauguggcucuggaauuuucgugaccaacgaaguccacacauggacugaacaauauaaauuucaagcugacucuccaaagagauuauccgcagcaauagggaaggcuugggaggaaggagucugcgggauaaggucugcaacuagauuagaaaauauuauguggaaacaaauauccaaugaauuaaaccauauccuuuuggaaaacgauaugaaacuaacaguaguuguuggcgacguugccggcauacugggccagggaaagaaaaugauaaggccgcaaccaauggaguauaaauauucauggaagucguggggaaaggcgaaaauaauaggugcggaugcccagaacacaacuuucauaauagaugguccaaauacgccugaguguccagaugaccaacgagcuuggaacauaugggagguagaagacuauggauucgguauauucacgacaaauauaugguuaaaguuaagggauucguacacccaggugugugaccauagacuuaugucggcagcaauaaaggauucaaaggcuguacaugcugacaugggcuauuggauagaaagcgagaaaaaugaaaccuggaaacuugcaagggcaucauuuauagaaguuaaaacaugcauauggcccaagagccacaccuuguggucaaacggaguuuuagagagugaaaugaucauccccaaaaucuaugggggucccaucagucaacauaacuauagaccaggguacuucacacagacagcaggacccuggcauuuagguaaacuagaauuagauuuugaucugugcgaaggaacaacugucguaguugacgaacauugugggaacagagguccaagucuaaggacuacuacagugacagguaaaauuauacacgagugguguugucgaucuugcacgcuucccccacuacgcuuuaggggagaagacggauguugguaugggauggagauaagaccaguaaaagaaaaggaggagaaucucgugaagucaauggucucugcuggcuccggugaagucgauaguuuuaguuuggggcucuugugcauuagcauaaugauugaagaagugaugagaucucgauggucgagaaaaaugcuuaugacaggaacccuugcuguauucuuuuuacucaucaugggacaacuaaccuggaacgaccuaauaagacucuguauaauggugggugcaaaugcuuucgacagaaugggaauggggacgacauaucuagcccuuauggcaacuuuuaaaaugaggccaauguucgcaguuggccuucuguuccgaagacucaccucaagagaaguucuacuacucacaauaggucucucucuuguugcaaguguugaacuaccaaauucguuagaagaauugggugacggccucgcaauggguauaaugauauugaaauuauuaacagacuuccaaucacaucaacucugggccacguuguuaucguugaccuucauuaaaacaacauuuagccuacauuaugcuuggaaaacaauggcuaugguacuaucgauaguaagucuuuucccguuauguuugaguacaacaagucagaaaaccacauggcugccaguauuauuagguagcuuaggguguaaaccgcuuacaauguuucuaaucgcagagaauaaaaucuggggccguaaaucuuggccccucaaugagggcauaauggcggucgguauuguaucuauacugcugaguucucuacuuaaaaaugauguuccuuuagcgggcccccuaauugcggguggaauguugauagcauguuaugucauaucuggcagcucagcagacuuaucccuggaaaaggcagcugaagucucaugggaagaagaagcagaacauagcggagcuagccauaauauauuaguugaaguucaagacgacgguacaaugaaaauuaaggaugaagaaagagaugauacuuuaaccauauuacugaaagcgacacucuuagcuguaucaggcguauauccuuugagcauaccugcuacguuauucguuugguauuucuggcaaaagaagaaacaacgaucagggguguugugggacacaccaucuccacccgagguagaaagggcgguguuagaugacggaauuuauagaauaaugcaaagaggauuacuaggaaggagucaagucggcguuggaguuuuccaagagaauguauuccauacaauguggcacgucacgcgaggagcgguuuugauguaucaagguaaacgacucgaaccaucaugggcaagcgucaaaaaggaccuaauuucauauggaggaggcuggcgacuacgcggaucguggaacaccggcgaggaaguacaggucaucgcaguugaaccgggcaaaaauccgaaaaacguacaaacugcaccaggaacuuuuaaaacgccagaaggggaaguuggagccauagcauuagacuucaaaccggguacaagcggauccccgauaguaaauagggaggggaaaaucguggggcucuaugggaauggaguaguuacuaccaguggaacauaugugagugccauagcacaagcgaaggcuucacaagaaggcccauugccagagauugaagaugaaguauucagaaagaggaaccuuacaaucauggaccuacaccccggaucaggcaaaacacggagguaucuuccugcuauaguaagagaagcuauaaaaaggaaacuaagaacccuaauacucgcgccaaccagaguaguagcuucagaaauggcagaagcucucaaaggaaugccuauuagauaucagacgacggcaguaaaauccgaacacacgggcaaagagauaguagauuuaaugugucaugcgaccuuuacuaugagacuguugagcccgguacguguaccuaacuauaauaugauaauaauggacgaagcucacuuuacagacccaaguucgaucgcggccagagguuauaucagcacaagaguaggcaugggagaagcagcagccaucuucaugacagcgacaccaccaggaucagucgaagcauucccucaaaguaaugccgugauucaagacgaagaaagagauaucccagaacguucuuggaacuccggacaugaguggauuacggacuuuccaggaaaaacaguaugguuuguuccaucaauaaaaucaggcaaugacauugcuaacuguuuaaggaaaaaugguaagagagucauccaguuaagcagaaaaacauucgauaccgaauaccagaagacaaagaacaaugacugggauuauguagucacuacugauauaucagaaaugggggcuaacuuuagagcagaucgaguuauugauccaaggcgaugccuuaaacccguaauuuuaaaggauggaccagaaagaguaauuuuggcaggcccgaugcccgugacaguggcaagugccgcacaaagacgaggacgaauaggccgaaaucacaauaaagagggcgaccaguacauauauauggggcaaccacuaaauaacgaugaagaccacgcgcauuggacagaggcgaaaaugcuucucgacaacauaaauacaccggaaggaauaaucccagcuuuguucgaaccugaacgcgagaaaagcgccgcgguugacggugaauacagacuuagaggagaagcaagaaaaacguuuguagaacucaugcggcgaggagacuuaccgguuugguuaaguuauaagguugcaucugaaggauuucaguacagcgaucgacguuggugcuucgacggggagcguaacaaucaagugcuugaagagaacauggacguggaaauuuggacgaaagagggggaaaggaagaaauugaggccaagauggcucgaugcuaggacauauucagauccuuuagcacuacgugaguuuaaagaauuugcagcugguagacgcucaguuucgggggaccucauacuagaaauuggaaaauuaccacaacaucucacgcagagggcucaaaacgcacuggauaaucucguaaugcuucacaacucagaacaaggggguagagccuaccgucacgcuauggaagaacugccagacacaauagaaacucuaauguuacucgcucuuauugccgucuugacaggugguguuacuuuauucuuucuaagcggacgugguuugggaaaaacaucaauaggucuccuaugcguaauggcuucgagcguauuacuguggauggcaaguguugaaccacacuggauagccgcgucaauaauuuuagaauuuuuccuuaugguccuuuugaucccagaaccggaucgucaaagaacaccccaagacaaccagcuagcauaugucguaauuggucuuuuauuuaugauacuaaccguggccgcgaaugaaaugggacuauuagaaaccacaaagaaagaccuuggaauaggacacguagcaguggagaaccaccaccaugcugcaaugcucgauguggauuuacaucccgcuuccgccuggacccuguaugcaguagcgaccacaauaaucacuccaaugaugcgucacacgauagaaaauacaacggcuaauauuucauugacagcaauugccaaccaagcagcuauauuaaugggacuagacaaaggguggccuauaucaaaaauggauauaggaguuccauuacuugccuugggauguuauucacaaguuaacccauugacucuuacugcggcuguuuugauguuagucgcucacuaugcuauaauaggcccuggguuacaagcuaaagcuacaagagaagcacaaaaacggaccgcugcuggaauuaugaaaaauccuacuguggauggcauaguagcaauugaucuggauccaguggucuacgaugccaaguuugagaaacaacuggggcagauaaugcuauuaaucuuauguacaucccagauauuguuaaugagaacuacgugggcucuaugugagaguauaacucuugcaacuggaccguugacaacucuaugggaagguaguccagggaaauuuuggaacacuacuauagcgguaucgauggcaaauaucuucagaggaucuuaucuagcgggugccgggcuagcauuuucguugaugaagucacugggaggagggcgcaggggaacaggagcucaaggagaaacauuaggugaaaaauggaaaaggcaacucaaucaauuauccaaaagcgaauuuaacaccuacaagcgaaguggaauaauggaaguagauagaucagaggcgaaagagggacuuaaacgaggcgaaacaacaaaacacgccgugagcagagguacugccaaguugagaugguucgucgagcgaaacuuaguuaaaccggaagguaaaguuaucgaccuagggugcgggagaggaggauggaguuauuacugugccgggcuaaagaaaguaacugaaguuaagggcuauacuaaagguggcccuggccacgaagaaccaauacccauggcgacauacggcuggaaucuaguaaaauuacacuccggaaaagaugucuucuuuauaccuccugaaaaaugcgacacguuacuuugcgacauuggagaaaguaguccuaaucccacgauagaagaagggcguacauugagagugcuaaaaaugguggaaccuuggcucagagguaaucaauucuguauaaaaauauuaaacccguauaugcccucuguaguagaaacauuggagcagaugcagagaaaacauggaggaaugcuaguuagaaauccccuaucacgaaauucaacacaugaaauguauuggguuuccuguggaacaggcaacaucgugucggcaguuaauaugaccaguagaaugcuucuaaauagauucacuauggcucaccggaaaccuacauacgaaagagacguugacuugggaaccggaacacgucauguagcuguugaacccgagguagcgaaccuagauauaauaggccaacgaaucgaaaacauaaaacacgaacacaagucaacuuggcauuacgaugaagauaauccuuauaagacuugggcuuaccauggaucauaugaaguaaaaccauccggcagugcuuccuccauggugaacggaguugugaaacuauuaacgaaaccaugggaugugauaccaaugguuacacaaauugcaaugacggauacgacuccauuuggucaacaaagaguuuucaaggagaagguugauacaagaacaccgaaagcaaaaagagguacagcucaaauaauggagguuacagcacgaugguuauggggauuuuuauccagaaauaaaaagccuaggauaugcacaagagaagaguucacgcgaaaaguaagaagcaaugcugcaauaggcgcuguguucguagaugaaaaccaauggaacucagccaaggaggcuguagaggacgaacgauuuugggaucuaguacaccgagaacgagaguuacacaaacaaggaaaaugugccacuugcguuuacaacaugaugggaaaacgagagaagaaauuaggcgaguucggcaaggcaaaaggaucacgugcaauuugguauauguggcuuggcgcuagauuucuagaguucgaagcucugggcuuuaugaacgaagaccacugguuuucgagggaaaauucucuaucagguguagaaggagaaggauuacacaaacucggauacauauuaagagauauaaguaaaaucccaggcgguaacauguacgcagacgauaccgcugguugggauacuagaauuacugaagacgacuuacaaaaugaagcuaaaauuaccgacauaauggaacccgaacaugcccuucuagcuaaagccauauuuaaauuaacauaucaaaauaaagugguucgcguacaaaggccagcaaagaacggaaccguuauggaugucauaucgagaagagaucagagagguaguggacaaguaggcacuuauggacucaacacauuuacaaauauggaagcccagcugauacggcagauggaaucggaggguaucuuuuccccaucugaacuugaaaccccaaauuuagccgaaagagcccuugauugguuagaaaaauauggcguugaaagauuaaaaaggauggcaauuucaggagaugacugcguagugaaaccuauugacgacagguuugcaacagccuuaacggcacugaaugacauggguaagguuagaaaagacauaccccagugggaaccaaguaagggguggaacgacuggcagcaaguuccuuuuuguucucaucauuuucaccaguuaauaaugaaggaugggagagagauaguaguaccauguagaaaucaagaugaauuagugggaagggcccgcguaagccaaggcgcaggauggucucuucgagaaacugcauguuuaggaaagucauaugcucagauguggcagcuaauguacuuccacagacgcgauuugagacuagcugccaacgcaauuugcucugcuguaccuguugauuggguaccgacaucaagaacgacauggagcauucacgcacaucaucaauggaugacuaccgaagacauguugaguguauggaaccguguauggauagaggagaauccauggauggaagacaaaacgcacaucucuaguugggaagaugugccguaccuuggaaaaagagaggaucaaugguguggaucccugauaggucucaccgcaagagcgacgugggcuacaaauauccaagucgccauaaaccaaguccgacgacugauagggaaugaaaauuaucuagauuauaugacaagcaugaaaagauuuaaaaaugagagugacccagaaggugcauuaugguag

SEQ ID NO: 21786 - RNA, 9879 nt, Artificial Sequence
  derived and/or modified CDS sequence (opt6) from DENV-1__GU131700__SS-prME
ucaguuacaaugcucuuaauguuaaugccuacggcauuagcuuuucaccugaccacuagagguggugaaccgcauaugauaguaagcaaacaagaaagggguaaaagucuacuguucaaaacgagugcuggaguaaauauguguacauugaucgcaauggaucucggagaauuuugugaagacacgaugacuuacaaauguccucgcauaacagaagcugaaccagaugacguugauuguuggugcaacgcaacggauaccuggguaacauacgggacaugcucccagaccggugaacacagacgagacaaacguucagucgcccuagccccacacguuggacucggucuagaaacgaggacugaaacauggaugagcagcgaaggugcauggaaacaaauucaacgcgucgagacuugggcauuacgacauccuggguucacagucaucgcacucuuucucgcucaugcuauagggacaagcauaacccaaaaagguauuauauucaucuuguuaaugcuaguaacuccuucuauggccaugagauguguuggcauugggagcagagauuuuguggaagguuugagcggagcuacauggguagaugucgucuuggaacacgguucuugcgugacuacaauggcaaaagauaaacccacucuugacauugaacuucuaaaaacugaagugacuaauccggcgguauugcggaaacucuguauugaagccaaaaucaguaacacaacaacugauucucgaugucccacucaaggagaagcuacacugguagaagaacaagaugccaauuucguaugucgcagaacuuucguggacagaggauggggaaacggcugugguuuauuuggaaaagggucguuaaucacaugugccaaauucaaauguguaaccaaauuagaaggaaagacaguacaauaugaaaaucucaaauacuccguaauugucacuguacacaccggagaccaacaucaagucgguaacgaaagcacagaacacggaacaacagcgacgaucacaccucaggcaccgucaaccgagauacagcuaaccgauuacggggcccuuaccuuggacuguagcccacgaacuggauuagacuucaacgaaaugguauuauuaacaaugaaagagaaaaguuggcuaguacacaagcaaugguuuuuagauuuaccucuaccguggacaucaggggcguccacaucgcaagagaccuggaaccgaaaagacuuauuagugacauuuaaaacugcacaugccaagaaacaagaaguaguagugcugggaucacaagagggcgccaugcauaccgcuuuaacaggagcaacggaaauucaaacgucaggaacaacuacaaucuuugcaggccaucuaaaguguagacuaaaaauggauaaacuaacucucaaaggaaugucuuaugucauguguaccggaucauuuaaacuagaaaaagaggucgcagaaacgcaacacgggaccguacucguucaaauaaaauaugaggggacagacgcaccuuguaagauuccguucaguacacaagacgaaaagggagucacacaaaacggcagacucaucaccgcaaauccaauuguuaccgauaaagagaaaccgguaaauauagaagcagagccaccauucggugaaaguuacauaguaauaggagcaggcgaaaaagcucucaaauuaagcugguuuaaaaagggcucaaguaucgguaaaauguuugaggccacagcaagaggggcucguagaauggcuauauuaggagauacggcuugggacuucgggucuauaggugggguauuuaccucuguaggcaaauuaguucaccagauuuuugguacagcguauggaguauuauuuuccggagucagcuggacgaugaaaauaggcauugguguuuuauuaacguggcuaggacuaaauucaagaucaacuagcuuaucgaugaccuguauugcagucggauuagugacuuuauaucuaggaguuaugguucaagcugacucagguugcguaauaaacuggaaagguagggaauuaaaaugcggaucgggaauauucguuacuaaugaaguacauacauggacugagcaauauaaguuucaggccgauaguccaaaaaggcucagugcagcgauaggcaaggcuugggaagaagguguaugcgguauuagaagcgcaacaaggcucgaaaacauaauguggaaacaaauuaguaaugaacuuaaucacaucuuauuagaaaacgauaugaaauuuacuguaguaguaggugacguagcaggaaucuuagcgcagggaaagaaaaugauucgcccccaaccgauggaauauaaauacaguuggaaaucguggggcaaagcgaaaaucauaggugcagacguacaaaauacaacauuuauaauagacgguccgaacacaccggaauguccagacgaccaaagagcauggaacauuugggaaguugaagauuaugguuuuggcauauucaccacaaauauauggcuuaaacuacgugauucacacacccaagucugugaucauagacuuaugagugcagcgaucaaagauuccaaagcgguacacgcugauauggguuauuggauagaaucggagaaaaaugaaacguggaaacuggcaagagcaucauuuauugagguaaaaacguguauuuggccaaaaagucauacgcuuuggucaaauggcguacucgaaucugaaaugaucauaccgaaaaucuauggggguccgaucagucaacauaauuacaggcccgguuacuuuacccagacugccgguccuuggcauuuagguaaacuugaguuggacuucgacuuaugugaagggacaacuguuguaguggaugaacauugcggaaacagggguccgucacuuagaacaaccaccgugacaggaaaaauuauccaugaaugguguugcaggucguguaccuuaccaccuuuacgauucaagggcgaagauggcuguugguacgguauggaaauccgaccuguaaaggaaaaagaagaaaacuugguuaaaaguaugguuucagcagguucuggagaaguagacucuuuuucacuaggacuacuaugcauuucuaucaugauagaagaaguaaugcgauccagguggucaagaaaaauguuaaugacaggaacucuggcaguauuuuucuuacuaauuaugggucaacuuacauggaacgaucuuauacguuuguguauaaugguaggagcuaaugcaagugaucggaugggaauggguacaacuuaucuagcacuaauggccacauucaaaaugcgaccgauguuugccgugggauuacuauuuagacgacuaaccucaagagaaguucuguuauuaacaauuggcuuguccuuaguagccucaguagaauuacccaacaguuuagaagaacucggugauggauuagcaauggguaucaugauacuuaaauuauuaacagacuuccagagucaccaauuaugggcaacguuauuaagucuaacguuuauaaaaacaacuuucucacuucauuaugcuuggaagacaauggcgaugguauuaagcauaguaaguuuguucccauuauguuugucaacuacuucccagaaaacaacauggcuuccuguuuuauuaggaucacugggcugcaaaccuuuaacgauguuucuaaucgcggaaaauaagaucuggggacguaagaguuggccacucaaugaaggaauaauggccgugggaaucguuucgaucuuacuaucaucgcuucuaaagaacgacgugccauuagcuggaccauuaauagcaggaggaauguuaaucgcuuguuaugugauuagugguucuagcgccgacuuaucucuagaaaaagcagcagaaguaagcugggaagaagaagccgagcauaguggagcuagccacaauauauuaguagagguacaagaugacggaacuaugaaaauaaaagaugaggaacgugaugacacuuuaacgauuuuauuaaaagcuacgcuuuuaacaguaucaggaguauauccccuaucuauuccagccacacuauuuguuugguacuucuggcagaagaagaaacaaagaagcggaguacuaugggacaccccaucaccuccaaaaguagaaagagcgguucuugacgacggcauauauaggauuaugcagcggggcuuauugggaaggucucaaguaggcguuggcguauuccaagaaaaugucuuccacacuauguggcacgucacaagaggagccgucuuaauguaucaaggcaaaagauuagagccuucgugggcuaguguuaagaaagauuugauuucauacggagguggguggcgcuuacaagguuccuggaauacgggagaagaagugcaaguaauugcuguugaacccgggaagaacccgaaaaacguacaaacugccccagguacuuucaagacaagugaaggugagguuggagcgaucgcacuggauuucaaaccuggcacaucgggguccccuaucgugaaucgggaaggaaagauuguuggacuuuacgguaacgguguggugacuacaaguggaacauaugucucugcaauagcccaagcaaaagccucucaagaagguccuuugcccgaaauagaagacgagguguucagaaaaagaaauuuaacaauuauggaccuccaccccgguucuggcaaaacacgaagauaccuuccugcgauaguacgggaggcaauaaagcgaaaguuaagaacauuaauacuggcaccgacccgcguaguugcaucugaaauggcagaagcacuaaaagggaugccuauucgguaccaaacuacggcaguaaagagcgagcauacaggcaaggagaucguagaccugaugugccacgccacguucacuaugcguuuacuaaguccgguacgcguccccaauuacaauaugauaaucauggaugaagcucauuuuacggauccgucaucaauagcagcgcgaggguauaucaguacgcggguaggaaugggugaagcagcugcuauuuuuaugacugcuacgccgccaggaucaguagaggcauucccccaaucgaaugcaguuauccaagaugaggagcgugauauacccgaacggucguggaacucaggauaugaauggaucacggauuucccagguaaaacaguaugguucguuccgaguauaaagucggguaaugauauugcuaacugucuacggaaaaauggaaaaagaguaauucaauugucuaggaaaacuuucgacacggaauaucagaaaacgaaaaacaaugauugggauuacgucguaacuacggauauuagugagaugggugcuaauuucagagcagauagagucauagaccccaggagaugccugaaaccaguuauauugaaggacggcccagaaagaguuauacuugccgguccaaugccuguaacuguggcaucugcggcgcaaagaagaggacgaaucggccgaaaucauaauaaagaaggagaucaauauauuuauauggggcaaccguuaaauaaugaugaagaccaugcgcauuggacagaagccaagaugcugcuugacaauauaaauacccccgaagguauaauuccagcccuuuuugaaccggaaagagaaaaaucugcugcuauagauggagaauauagacugcgcggcgaggcuagaaagaccuuuguggaacuaaugagaagaggagaucuaccaguauggcuaagcuacaagguagcaucagaaggcuuucaguacucagacaggagaugguguuuugauggggagagaaauaaccaaguucuagaggaaaacauggacguugaaauauggacgaaggaaggugaacgcaaaaagcuacguccaagaugguuagaugcaaggacauauucugacccacucgcacuucgugaauuuaaagaguuugcagcaggucguagaagcguguccggugauuuaauuuuagaaaucgggaaacuuccacagcaccugacacaaagagcucaaaacgcucuugacaaucucgucaugcuacauaauucagagcaagguggacgggcauaucgccaugcaauggaagaauuacccgauacgauagaaacaaugaugcuccuugcacuaauagcgguucuuacgggcggaguaacauuauucuuucuaagugggagaggucuagguaaaacuucgaucggacuccuaugcgugauggcaucauccguauuacuauggauggcaucaguagaaccccauuggauugcagccucaauuauuuuagaguucuuucuuaugguccugcucauaccugaaccagaucgacaacggacgccgcaggauaaucaacuggcuuacgucguuauuggauuauuauuuaugauauuaacaguugcagcuaacgaaaugggauuacuagaaaccacaaagaaggaccugggcauagggcacguagcaguugaaaaucaucaccaugcagcuaugcuugauguagaccuucaucccgccuccgcauggacucuauaugcugucgcuacuacaauaauaacgccuaugaugcgucacacgauagaaaacacgacagcaaacauaagccuuacugcuauugcaaaucaagccgccauuuugaugggucuagauaaaggauggcccauuagcaaaauggauauaggaguaccuuuacuggcguugggguguuauucucaggugaacccucuuacgcuaacggcggcaguguuaaugcuaguagcucacuacgccauuauaggaccaggauuacaagcgaaagccacgcgcgaagcacagaaacggaccgcagcgggaauaaugaaaaacccaacuguggauggaauaguagcuauagaccuagacccuguuguauaugaugcuaaguuugaaaagcagcuugggcaaaucaugcuucucauucucugcacaagucaaauacugcuaaugagaacaacaugggcuuuaugugaaaguauuacauuagcgacagguccucucacaacacuuugggaggguaguccagggaaauucuggaauacuacaaucgcaguaaguauggcaaauaucuuuagaggaucauaucuugcuggugcaggcuuagcauuuucguugaugaaaucccuaggcgguggcaggagagguacaggagcucaaggagaaacacuaggugaaaaauggaaaagacaauuaaaucaauuaagcaaguccgaguuuaauacuuauaagagaaguggaaucauggagguugaccgaagugaagcaaaagaaggauuaaagagaggggaaaccaccaaacacgcgguuucuagaggcacugcgaaauugcgaugguucguugaaaggaacuuaguuaaaccagagggaaaaguuauugaucugggaugcggaagagguggauggucauacuauugugcuggacugaagaaagucacagaaguuaaaggauauaccaaaggaggccccggacacgaagaaccgauuccaauggcaacguauggauggaaccugguuaaacuucauagcggcaaagacguguucuuuauaccuccagaaaagugugauacuuuacuuugugauauuggagaauccucaccuaauccgaccauagaagaaggaagaacccuacgagucuugaaaaugguagaaccguggcuaaggggaaaucaauucuguauaaaaauacuuaacccauacaugccgagcguuguagaaacucuggagcaaaugcagcguaagcaugggggaaugcuaguacguaaccccuuaucacggaauagcacccacgaaauguauuggguaaguugugguacgggaaauauuguaagugcaguuaauaugacuucaagaauguuacucaauagauuuacaauggcgcacagaaaacccacguaugagcgcgauguugaucucggugcaggaacuagacacgucgcaguugaaccagaaguagcuaacuuagacauaauaggacaaaggauagaaaacaucaagcaugaacacaaaaguacuuggcauuaugaugaagacaaucccuauaaaacaugggcauaucaugggagcuaugaaguaaaaccuucugguuccgcuagcucaauggugaaugggguaguuaaacuacuuacgaagccuugggacguuaucccaaugguaacccaaauugcgaugacggauacgacuccauuugggcaacaaagagucuuuaaagaaaaaguagacacaagaaccccuaaagcaaaacguggaaccgcucaaauaauggaaguaacugccaagugguuauggggauuucuaucacgcaacaagaaaccucgaauauguacucgugaagaauuuaccaggaagguacguucuaacgcugcaauaggcgcuguauuugucgaugaaaaucaauggaacagugcgaaggaagccgucgaagacgaacgauuuugggauuuggugcauagggaaagagagcuucauaagcaggggaaaugugcaaccugcguguauaacaugaugggcaagagggagaagaaauugggagaauuugggaaagcaaaaggcucgcgagccauaugguacaugugguugggcgcucguuucuuggaauuugaagcucuuggauucaugaacgaagaucacugguuuucccgagagaacucccuaucagguguagaaggugaaggacugcauaaacuuggcuauauauuaagagacaucucaaaaaucccagggggaaacauguacgcggaugauacagcuggaugggauacuagaaucaccgaagacgacuuacaaaaugaagcaaagauaacggauaucauggagcccgaacacgcucugcucgcgaagaguauuuuuaaacuaacuuaccaaaauaagguuguacguguucaaagaccagccaagaacggaacugucauggacgugaucucacgaagagaucagcguggaagcgggcaaguugggacuuauggacucaauacauuuacuaauauggaagcccaauuaauuagacagauggaaucugaggguauauuuagucccucugagcucgaaacccccaauuuggcacgcagaguauuagacuggcuagaaaaacauggcgucgaaagauugaaaaggauggcaaucucuggcgaugauugcguagucaagccaaucgaugauagauuugcaaccgcuuugacagcauugaacgauauggggaaaguuaggaaggacauaccacaaugggaacccagcaaaggauggaacgacuggcaacaaguaccguucuguagucaucauuuucaccaauuaaucaugaaagauggaagggaaauuguagucccgugucgcaaucaagacgaauuggugggcagagcgcgaguuucacaaggagcaggguggucucuucgagaaacugcuugucugggaaaaucauaugcccaaauguggcagcucauguauuuccauagaagagauuuacgucuugcugcaaacgcgauauguagugcagucccgguugacuggguuccaacaucaagaacgacgugguccauacaugcacaccaucaauggaugacaacugaagauauguuaagugucuggaaccggguauggauagaagaaaauccuuggauggaagacaagacucauauaucauccuggggugacgucccuuauuugggaaaaagagaggaucaauggugcgggucucuuauuggcuugacggccagagcuacuugggccacaaauauucagguagcgauaaaucaaguacggagguugauuggcaaugaaaacuaucuagacuacaugacaucuaugaaacguuucaaaaacgaaucagauccagaaggugcauuaugguaa

SEQ ID NO: 21787 - RNA, 9879 nt, Artificial Sequence
  derived and/or modified CDS sequence (opt6) from DENV-1__GU131701__SS-prME
agugucacuauguuauugauguuaaugccaacugcauuagcguuucauuuaacaacucgaggcggagaaccucacaugauagucuccaaacaagagaggggcaaaucuuuacuuuuuaaaacaagugcuggaguuaacaugugcacguuaauagcgauggaccuuggagaacuuugcgaagauaccaugaccuauaaaugcccacguauaacagaaacagaaccggacgauguggacugcugguguaaugcuaccgacacuuggguaacauacggcacauguagucaaacgggugaacacaggagagacaagcguucuguugcuuuagcaccacaugugggauuagggcuagaaaccagaaccgagacguggaugucuagugaaggagccuggaagcaaauccaaagaguagaaaccugggcucuuagacaucccgguuuuacuguaacugcucuuuuucuagcacauguaauaggaacgucuauaacucaaaaagggauaauauuuaucuuacuaaugcuaguaacgcccaguauggcuaugagguguguuggaauaggaucaagggauuuugucgagggucuaucuggggcuacauggguagacgugguguuagagcauggaucuugcguaacaacaauggcaaaagacaaaccuacgcucgauauagaauuauugaaaacagaagucacgaauccggcuguacuacgaaaauuguguaucgaagccaaaauuucuaauaccaccaccgauucgagauguccuacucaaggggaggccacauuaguggaagaacaagaugcaaauuuuguuugccgaagaacuuuuguugaucguggauggggcaaugguuguggccuuuuugguaaaggaucucucauaaccugugcaaaauucaaauguguaacuaaauuggaagguaaaaucguucaauaugaaaaccuaaaguacucuguuaucgucacaguacauacgggggaccaacaucaaguugguaacgaaaguacagagcauggaaccacagcaacaauaacaccacaagccccuacaacagaaauacaauuaaccgacuauggagcuuuaacccuugauugcucuccacgaacagguuuagacuucaaugagaugguacuccuuacaaugaaagagaaaagcuggcuuguacauaagcaaugguuuuuagacuuaccacugccauggacaucaggagcaucaacaagucaagaaacguggaaccgucaagaucugcugguuacauuuaaaacugcgcacgccaagaaacaagaagugguuguacuagguucucaggaaggugcaaugcacacugcacugacuggcgcaacggaaauccaaacaaguggaacgacuacuauauuugcaggacacuuaaaaugucgcuuaaagauggauaaacuaacauuaaagggcaugucauacgucaugugcaccgguuccuuuaaacuagaaaaagagguugcagagacccaacauggaacaguacuuguacaaauaaaauacgaaggaacggacgcaccuuguaaaaucccuuuuuccacacaggaugaaaaaggaguuacucaaaacggacgucuuauaacugcuaacccuacaguaacagacaaagaaaaaccaguuaauauagaagcugaaccaccauuuggugaaucuuacauaauaauaggagcuggagaaaaggcauugaaacuaagcugguuuaaaaaggggaguucaauuggaaaaauguuugaagcaacagcgagaggcgcaaggcguauggcaauucuuggggauacagcuugggauuuugggagcauagggggcguuuucacaagcgugggaaaguuaguucaccaaauauucgggacagcauacggcguacuauucucaggaguuagcuggacgaugaaaauugggauaggggucuuauuaacgugguuaggacugaacucacgcuccacaucauuaucaaugacauguauagcgguagggcuugugacuuuauacuugggaguaaugguccaggcugauuccggaugcguuauaaauuggaagggcagagaauuaaaguguggcagcgguauauuuguuacuaaugaaguacauacuuggacggaacaguauaaauuucaagccgauucucccaaacgucuaagcgcugccauaggaaaagccugggaagaggguguaugugggauucguagcgcuacucgacuagagaauauaauguggaaacaaauaucaaacgagcucaaccauauccuauuggagaaugauaugaaguucacggucguuguuggagaugucgcggguauacuagcccaaggcaagaagaugauuagaccgcaaccuauggaguacaaauacuccuggaaaaguuggggcaaggcaaaaauaauuggagcugacguacaaaacacaacuuuuauaauugacggaccaaauacaccggaguguccagaugaucaaagagcuuggaauauuugggaaguagaagauuaugguuuuggaauuuuuacuacuaacauaugguuaaaauuaagagauucauacacucaggucugcgaccauaggcuaaugucggcagccauaaaagauaguaaagcaguacacgccgauaugggcuauuggaucgaaagugagaaaaaugaaacauggaaacuggcgcgagcgucguuuauugaaguaaaaaccugcauuuggccaaaaucacauacucuauggaguaacgguguguuagagucugaaaugaucaucccaaaaauuuacggagggccgauuucccaacacaaucaucgcccagguuauuuuacucaaacagcaggcccauggcacuugggcaaacuggaguuagacuucgaucuuugcgaagggacuacaguaguagucgacgaacauugugguaauagaggaccuucuuuaagaaccaccacaguuacagguaagauuauucacgaaugguguugucggaguuguacucuuccuccacuaagguucagaggagaggauggcugcugguacggcauggagauaagaccaguuaaggaaaaggaagaaaaucuaguuaaaucaaugguuucagcgggaaguggugagguagauucauucucucugggcuugcuauguauuaguauaaugauagaagaaguuaugcgaucccgauggucaagaaagaugcuaaugacaggcacucucgcagucuucuucuuauuaauuauggggcaauuaacuuggaacgaccuaauuagacuauguauaauggucggcgcuaaugcauccgaccgcauggguauggguaccacauaccuagcccugauggcuacuuuuaagaugagaccaauguuugccguuggacuauuauuucgucgauuaacaucccgugaagucuuauuguugacgaucggauuaucucuuguggcaucuguggaacuaccaaacucauuagaggaguugggggauggauuagcaaugggaauuaugauacuaaaauuacuaacagauuuccagccucaucaauuaugggcaaccuugcucagcuugaccuuuauaaagacaacuuuuaguuuacauuaugcuuggaaaaccauggccaugguucuaagcauagucuccuuauuuccgcucuguuuauccacaacuucccagaaaacaacaugguuaccgguuuuauugggauccuugggauguaagccauuaaccauguuucuaauagcagaaaacaaaauauggggcagaagaucuuggccccuaaaugagggaaucauggcgguuggaaucguaucaauacuauugucaucauugcuuaaaaaugaugucccuuuagcuggcccauuaaucgcuggaggaaugcucauugcaugcuacguuauuagcggcucgagcgcggauuuaucacuugagaaagcagcggaaguauccugggaagaggaagcggaacauucaggagcgucucacaacauauuaguagaaguacaggaugauggaacuaugaagauaaaggacgaggagagagacgauacucuaacaauacuacuaaaggcaacccuucucgcgguaucugguguauauccauuaucaaucccggcgacccuguuugugugguacuucuggcagaagaagaaacagagaagcggaguauuaugggacacaccaucgcccccagagguagaacgagcuguacucgaugaugguauauauagaauuaugcaaaggggguuacuggguagaagccaaguaggcguuggaguuuuccaagagaacguuuuccauacaauguggcacguaacaagaggagcgguacuuauguaccaggggaaaaggcuagaaccuagcugggcaagcgugaagaaagaucuaauaucauacggagguggguggcgcuuacaagggucauggaauacaggcgaagaaguccaagugauagcaguagaacccgguaaaaacccuaaaaauguccaaacugcgccagguaccuucaaaacaccagaaggggagguaggcgcaauagcguuagauuuuaagccaggcaccucugguucaccuaucguaaaucgagagggaaaaauaguaggguuauaugggaaugguguagugacgacaagcggcacauauguuagugcuauagcgcaagcaaaagcaucacaagagggaccccucccagaaauagaagaugaaguauuuagaaaaaggaaccuaacgauaauggaucuacacccagguaguggcaagacacgacgauacuuaccagcaauuguaagagaagcaaucaaacggaaacuuagaacacuaaucuuggcaccuacaagaguaguagcaagugaaauggcagaagccuuaaaaggaaugccuauucgauaccaaacaaccgcgguaaaauccgaacauaccggaaaagaaauaguagaucuuaugugccaugccacauuuacaaugcgguuguuaagcccaguucgaguuccuaacuauaacaugauaauuauggaugaagcucauuuuacggauccaucauccaucgcugcaagaggguacauuagcacaaggguuggaaugggggaagcugcugcaauauuuaugacugccacaccgccuggaagcguagaagcauuuccacaaucuaacgcuguaauacaagaugaagagagggacaucccagaacgaucauggaacaguggcuaugaauggauaacagacuuuccagguaaaaccgucugguuuguaccauccauuaaaagugguaaugauauagcgaacuguuugagaaagaaugguaaacgagugauacaacucuccagaaagaccuuugauacggaauaucagaaaaccaaaaacaaugacugggauuacguaguaacuacugauauuucugagaugggagcuaauuuuagagccgacagaguaauagauccaagacgaugucuuaaaccaguaaucuuaaaagauggaccggagcgcguaauucuagcaggaccaaugcccguaacaguagcaagcgccgcacaaagaagaggacggauaggacguaaucacaauaaggagggugaucaauauauauauaugggacagccacucaauaaugacgaagaccacgcgcauuggaccgaagcuaagauguuauuagacaacaucaauacacccgaaggaauuauuccagcauuauuugagccggaacgcgagaaaagugcggcaauagauggagaauaucgauuacgaggagaggcgcggaaaaccuucguagaguugaugaggagaggugaccugccgguuuggcuuucauauaagguagcaucagaaggauuucaauacucggauagacgcugguguuucgacggagaaaggaauaaucaagugcuagaagaaaacauggauguugaaauauggacaaaagaaggcgaacguaagaaauuacguccuagauggcuggacgcgagaaccuauucugauccguuggcacucagagaguuuaaagaguuugcagcggggagaagaucaguuaguggagauuuaauacuagaaaucgggaaacuaccacagcacuugacccaacgugcucaaaacgcccuagauaauuuaguaauguuacauaauucggaacaaggagggagagcauacagacaugcgauggaagaguuaccagacacgaucgaaacacuaaugcuacucgcgcugauagccguccuuaccggcgguguaacucuauuuuuccuuagcggacgaggucuuggaaagacuuccauuggacuauuaugcguaauggcaucaucuguccuucucuggauggcaagcguagaaccucauuggauagcagccucaauaauauuagaguucuuucuaaugguucuacuuaucccagaaccggacaggcagaggacgccucaagacaaucaacuagcuuauguaguaauugggcuacuuuuuaugauuuuaacgguagcagcuaacgaaauggggcuacuagagacgacuaagaaagacuugggcaucggacauguggcagucgaaaaucaccaccaugccgcaauguuagauguagaucuucauccagccucugccuggacacuauaugcaguugcgacaacgauuauuacaccgaugaugcgacacacgaucgaaaacacgacagcaaauauaucguuaacagcuauagcuaaccaggcagcaauucuaaugggauuagacaaagguuggcccaucagcaaaauggauauugggguaccauuguuagcccuaggcuguuauagccaaguuaacccgcuaacccugacugcggccguuuuaauguuaguagcgcauuacgccauaauaggacccggucuucaagccaaagcaacacgagaagcccaaaagagaacagcagcugguaucaugaaaaauccuaccguagacgguaucguagcuauugauuuagauccagucgucuaugaugcuaaguucgaaaaacaauuagggcaaauuaugcuacugauauuauguacaucccagauccuacugaugcgaacuaccugggcacugugcgaaucaauaacccuagcaacagguccacucacaacuuuaugggaaggaucaccuggaaaauucuggaacacaaccauagcgguaaguauggccaacauauucaggggaucauaccuugcuggagccggauuggcuuuuagucuaaugaagucauuaggaggaggaagacgugggaccggagcacaaggagaaacacuaggggaaaaguggaaaagacaauuaaaucaauuaagcaaaucagaauuuaauacuuauaaacgaaguggaauaauggagguagacagauccgaagcuaaagaagguuugaagagaggugaaacaacgaagcaugccguaucucguggaacagcaaaacuccgaugguuuguagaaaggaauuugguaaaacccgagggaaaagugauagaucuaggaugcgguagaggcggguggucauacuacugugcaggguuaaagaaagugacagaggugaaaggguauacuaaagguggaccaggacaugaagaaccuauaccgauggcaaccuacgguuggaaucuggugaaacugcacucagggaaagacgcauucuuuauuccaccagagaaaugugacacguuacugugugacauaggagaaucaagcccgaaucccacaaucgaggagggccgaacauuacgaguucuuaagaugguugaacccuggcuucguggaaaucaauuuuguauuaaaauucuuaauccauacaugccaucuguaguggaaaccuuagagcagaugcaacguaaacauggcggaauguuaguuagaaauccgcucagccggaacucgacgcaugaaauguauugggucaguugugggacaggcaauauuguaucagcgaucaacaugacaucccgcaugcuguuaaaucgauuuacaauggcacaccgcaaaccuaccuaugaaagggauguagaucugggggcuggaacaaggcacguugcaguagaaccagaaguagccaaucuagauauaauaggucaaagaauagaaaauauaaagcacgagcauaaaaguacauggcacuaugacgaggauaauccauacaaaacaugggcuuaucacggaucauaugaagucaagcccucagguagugcaagcucaauggucaacggagugguaaaauugcuaacuaagccaugggacguuaucccuauggugacacagauagcaaugacagacacgacgccauucgggcaacaaagaguauuuaaagaaaaaguagauacuagaacaccaaaagccaaaagagguacggcacaaauaauggaaguaacagcaaaauggcuaugggguuuucuaaguaggaauaagaaaccgagaauuugcacucgggaagaguuuacuagaaaggucagaucuaaugcggcaauaggcgccguuuucguagacgaaaaccaauggaacucagcuaaagaggcaguugaggaugaaagauucugggacuuaguacacagagaaagggaacuccauaaacaaggaaaaugcgcaacguguguuuacaauaugaugggaaaacgggagaagaaauuaggagaguucgguaaagccaaagguucacgagcaaucugguacauguggcuaggagcacgauuucuggaauuugaagcgcuugguuuuaugaaugaagaucacugguuuucgcgugaaaauaguuuaagcggcguagagggugaggguuuacauagguuaggcuacauuuuacgcgacauuaguaaaauaccaggaggcaauauguacgcggaugacacugcggggugggauacacguauuacugaagacgaccuacaaaacgaggcucgaauaacugacauaauggagccagagcacgccuuacucgcaaaaucaauuuucaaacuaacauaccaaaauaaaguaguaagagugcaaagaccagggaagaauggaacagucauggacguaauuagccgaagagaccagagggguuccggacaaguaggcaccuauggacuuaauacuuuuacuaacauggaagcucaauuaauccgacagauggaaucagaggguauauuuucgccaagcgaauuagaaacgccaaacuuagccgaacggguauuagacuggcuugaaaaauauggaguagagagacuuaaaagaauggccauauccggugaugauuguguagugaaacccauugaugaucgauucgcaaccgcucugaccgcacucaacgacaugggcaaaguacggaaagauauaccgcagugggaaccgucaaaaggauggaacgacuggcaacaggugccauucugcucccaccauuuucaccaauuaauaaugaaggacggacgugagauugucgucccaugcagaaaucaagacgaacucguggguagggcucggguuucgcaaggugccgguuggucauuaagggagacagccuguuugggcaaaucuuacgcccaaauguggcaauugauguauuuucaucguagagaucugagauuagcugcaaacgcuauaugcucugcugucccuguagauuggaucccaacaucucggacaacuugguccauacaugcccaucaccaguggaugacuaccgaagacauguuaucugucuggaauagaguauggauagaagagaaucccuggauggaagacaaaacgcauauaaguucauggggagauguaccuuaucuggggaagcgcgaagaucagugguguggaucauuaauuggccuaaccgcccgagcuaccugggccacaaauauccaaguggcaaucaaucaagugagaaggcugauugggaaugaaaauuaccuagacuacaugacaagcaugaaacgcuuuaaaaaugaaagcgaucccgagggagcauuaugguaa

SEQ ID NO: 21788 - RNA, 9879 nt, Artificial Sequence
  derived and/or modified CDS sequence (opt6) from DENV-1__GU131703__SS-prME
ucuguaacgaugcuguuaauguuaaugccgacagcacuggccuuucacuuaacaacgagaggcggggaaccacauaugauugucucaaaacaagaaagggggaaaucguuacuuuuuaaaacuagcgccggaguuaauauguguacucuaaucgccauggaucuaggugaacugugcgaagauacaaugacauauaaaugcccgcgcauaacggaaacugaaccugaugauguugauugcugguguaaugcaacugacacguggguaacuuauggaacaugcagccaaacaggcgaacacagaagagauaaaagaagugucgcacucgcgccccaugucggcuuaggguuagaaacucguacggaaaccuggaugagcucagaaggugcuuggaaacaaauacaacgaguggaaaccugggcuuuacgucauccgggauuuacggucaucgcccuauuucuagcacacgcaauugguacaaguauaacacaaaaaggaauaauauuuauacuauuaauguuaguuacuccaucuauggcaaugcgcugugucgggaucggaucgagggacuuuguugaaggguuaucuggugcaacuuggguagauguuguacuagagcaugguucgugugucacaaccauggcaaaagauaaaccgacauuagacauugaguuauuaaaaacugaaguuacuaauccugcaauccuaagaaaauuaugcaucgaagcaaaaaucucgaauacgacaacagauagucgcugcccaacucaaggugaggcuacucuuguugaagaacaagacgcuaauuucguuugcagacguacuuuuguagacagaggauggggaaauggauguggucuauucggcaaagguucguugaucacuugugcaaaauuuaaaugcguuacaaaacuugaaggaaaaauaguucaguaugaaaaccuuaaauacucagugaucguaacgguucauaccggugaccaacaccaaguugggaacgagucaacagagcauggaaccacugcaacuauaacaccacaagcacccacgacugaaauacagcugacagauuauggagcgcuuacucucgauuguucgccuagaacagguuuagauuuuaacgaaaugguauuguuaaccaugaaagaaaaaucguggcucguccauaaacaaugguuucuagauuugccucugccuuggacgucaggagcgucuacaucacaggaaacuuggaaccgccaagaccuauuagugacauuuaaaacagcacaugccaagaaacaagagguaguaguacuaggaagccaagaaggagcuaugcacaccgcuuugaccggagcaacugaaauucaaacaagcgggacgaccacuauuuucgcugggcaccuaaaaugccgauuaaaaauggacaaacuaacucugaaaggaaugaguuauguaaugugcacgggauccuuuaaauuagaaaaagaaguagcagaaacacagcacgggacuguuuuagugcaaaucaaguaugaaggaacggaugcacccugcaagauaccguucucaacgcaagacgaaaaaggaguaacccaaaauggacggcugauuacggcaaaccccauaguuacggauaaagaaaaaccaguuaauauagaagcagagccaccauucggagaauccuauauuguaauaggugcaggggaaaaggcauugaaacuguccugguuuaagaaaggaucuucgaucgguaagauguuugaagcuacugcucguggagcaaggagaauggcgauacugggugauacggcaugggauuucgggaguaucggagguguuuuuacaucaguuggcaagcucguacaccagauauucggcacagcuuacggcguacuauuuuccggagucucauggacaaugaaaauaggcauaggcguacuguuaacaugguugggauugaauagucgaagcacaagucucucaaugacuugcaucgcuguaggauuggugacucucuaccugggaguaaugguacaggccgauucgggaugcguaaucaacuggaaaggaagggaacuuaaaugugguucgggaaucuuugucaccaaugaaguacauacauggacagaacaguauaaauuucaagcugauagucccaaaagacuaucugccgccauaggaaaggcaugggaagaaggcguaugugguauaagaucagccacucgucuugaaaauauaauguggaagcaaauuuccaaugaacuaaaucauaucuuacuugaaaaugauaugaaauucacgguaguaguaggagauguagcaggcauucuggcacaagguaagaaaaugauuagaccucaaccaauggaauauaaguauucauggaagaguugggguaaagcaaaaauaauuggagccgacguucaaaacaccacauuuauaauagaugguccuaauacuccagaaugucccgaugaccaaagagccuggaauaucugggaagucgaggauuaugguuuuggaaucuuuacuacaaauauauggcucaaacuucgagacucuuacacacagguuugugaucacagauuaaugucugcggcaaucaaagauaguaaagcuguacacgcggacauggguuauuggauugaauccgagaaaaacgaaacuuggaaacuagcgcgagcaaguuuuauugaaguaaaaacauguauuuggccgaaaagucauacauuauggaguaacggaguacuggagucagaaaugauuauaccaaagauauauggaggcccaauaucgcaacacaauuaucggcccggguauuuuacacagacagcagguccuuggcaccucggaaagcuagaauuagauuucgaucugugugaaggcacuacaguagugguagaugaacacuguggcaaccgcgguccuagccuuagaacaacaacggucaccgguaagauaauacacgaguggugcugcagaucuugcaccuuaccuccccuaagguucagaggagaagauggauguugguaugggauggaaaucaggccagucaaggaaaaggaagaaaaucuaguaaaaagcaugguaucugcugguucaggagaaguugauuccuuuucauugggauuauuauguauuucaauaaugauagaagaaguaaugagaucacguuggagcagaaaaaugcuaaugacuggcacauuagcaguguuucuccuacuuauaaugggccaauuaacauggaaugauuuaaucagacuguguauuauggugggagcgaaugccagugaucgaaugggcaugggaacgacuuaucuugcccuuauggcaacauuuaaaaugcgacccauguuugcaguaggacuucuauuucggcgucugacaagcagggaagugcuauuacuuacgauagguuuaucuuugguagcaaguguggaauugccaaauucuuuagaagaguuaggagacgguuuggccaugggaaucaugauacuaaaacuucucacagauuuucaaagucaucagcucugggcaacucuucuuucuuugaccuuuauaaagaccacuuuuagccuccacuaugcauggaagacaauggcgauggugcuaucaauaguuagucuuuuuccccuuugccugagcacaacuagccagaaaacuacauggcugccuguauuauuaggauccuuaggauguaaaccuuuaaccauguuucuuaucgcugaaaauaaaauauggggacgaaggucauggccauuaaacgaagguauaauggccgucggcauaguaucaauacuuuuaucaucauugcucaaaaacgauguuccauuagcaggucccuuaauugccgggggcaugcucauagccugcuacgucaucagugguaguucggcagacuuaucccucgagaaagcagcagaagucucaugggaagaggaagcagaacacucgggugcaagucauaacauucuaguagaaguacaagaugaugguacgaugaaaauaaaagaugaggaacgcgacgauacccuuacaauucucuuaaaagcaacauuacuagcagucuccgguguauacccccucucaauuccugcuacccuauuuguuugguauuuuuggcaaaagaagaaacagagauccggagugcuaugggacacaccauccccaccggaaguagaacgggcuguccuagaugacggaauauaucggauuaugcaaagaggauugcuuggaagaucccaaguuggagucgguguauuccaagaaaacgucuuucauacuauguggcauguaacgagaggagccguacuaauguaccaaggaaagcgacuagaaccaucaugggcaucagucaaaaaggaccuaauaucauacggugggggauggcgacuccaaggcucuuggaacacgggcgaagaaguucagguaauagcaguggaaccuggaaagaaccccaaaaacguccagacaacgccagguacauuuaaaaccccagaaggggaaguaggagcgauagcacuugacuuuaagccaggcacaagcgguucucccauuguuaauagagaaggaaaaaucguaggauuauauggaaacggcgucguaacuacaucuggcaccuaugucagugcuauagcucaggcaaaggcuucucaagaggguccguugccugagauagaagaugaaguauucaggaaacgaaacuuaacaauuauggauuuacacccagguagugggaaaacgagaagguaccuacccgcaauuguacgagaagccauaaaaagaaaacuuaggaccuugauauuagcuccuacccgggugguagcaucggaaauggcagaggcuuuaaagggcaugcccauacgauaccaaacuacagccguaaaaucggaacacacaggaaaagaaauagucgauuuaaugugccacgcuaccuuuacaaugagauuauuaaguccaguuagggugcccaauuauaauaugaucauaauggaugaagcccacuuuacagacccuucaagcaucgcugcuagaggcuauauauccacucgagucgguaugggagaagcggcagcaauuuucaugacugcgacaccaccuggauccguagaagcauuuccgcaaucuaacgcaguaauacaggaugaagaacgugacaucccagaacguucauggaacucgggguaugaguggaucacugauuucccuggcaaaacuguuugguucguuccaagcaucaaaucaggaaacgauauagcgaauuguuuaaggaaaaaugguaaaaggguaauacagcucaguagaaaaacguuugauacagaauaccagaaaaccaaaaacaaugacugggauuauguaguuaccacugacauauccgaaaugggagcuaauuuuagagcagacagaguuauugauccaaggagaugcuugaaaccagucauuuuaaaagauggccccgaaagggugauuuuggcaggaccaaugcccgucacuguugcaucugccgcccaaagaagagguagaauaggaagaaaccauaacaaagaaggugaccaauauauauacaugggucagccacuaaacaacgaugaggaccaugcacacuggaccgaagcuaaaaugcuauuggauaauauaaauacgccggagggcaucauaccugcauuauuugaaccagagcgcgagaaaagugcagccaucgauggagaauaucgcuugcggggugaagcacgaaaaacguuuguggaguuaaugaggcguggcgauuugccaguuuggcucuccuacaaaguugcaagugaaggguuucaguauagcgaucgaagauggugcuucgauggggaaaggaacaaccaaguauuggaggaaaacauggacguagagaucuggacuaaagaaggagagcgcaagaaguugaggccuagguggcuagaugcuaggacguauucagauccgcuagcacuucgcgaauuuaaagaauuugcugcuggaagacgaucuguguccggggaucuaauuuuagaaauagguaaacucccacaacaccugacccagagagcgcaaaacgcucucgacaauuuagugauguugcauaacagugagcaaggagguagagcuuauagacacgcuauggaagaacuaccagauaccauagaaacucuuaugcuacuagcacuaauugcaguacucacuggugguguaacucuauuuuuccuuagcgggagaggccuugguaaaacuucuauugggcuauuauguguuauggcaaguucgguucucuuauggauggcauccguagaaccucacuggaucgccgccucuauuauacuugaguucuuucuaaugguuuuauugauaccggagcccgaucggcaaaggacuccacaagauaaccaguuagccuacguaguaaucggcuuauuguucaugauuuugacagucgcugcaaaugaaaugggguuauuagaaacuaccaagaaagauuuaggaauuggacauguagcuguuggaaaucaccaccaugcugcgauguuagacguugaucugcauccggccucagcauggacacucuaugcaguagcgacaaccauaauuacucccaugaugaggcacacuauagaaaacacaacggcuaauaucaguuugacagcgauagcaaaucaagcugccauauuaauggguuuagacaagggauggccaauaucaaaaauggauauugggguccccuuacuagcacucggauguuacucgcagguuaacccauuaacccucacggcugcugucuugauguugguagcacauuacgccauaauaggcccaggacuacaagccaaagcaacgagggaggcgcagaaaagaacagcugccggaaucaugaagaaccccacaguagacggaaucguggccauagaucucgacccugucguuuaugacgcaaaauucgaaaagcaguugggacaaauaaugcuauuaauucuuugcaccagccagauauugcugaugcggacaacaugggcauuaugcgaaagcauaacacuagcuacgggcccguuaacgacgcuaugggaagguaguccgggcaaauuuuggaauacaacuaucgccguaagcauggcaaacauauuccgugggagcuauuuggcaggcgcgggacucgcguuuucauuaaugaaaucguuaggagggggacggcgaggaaccggugcacaaggggaaacuuuaggugaaaaguggaagagacaacuaaaucaauuaucaaaaagugaauuuaauacauauaaacggagugggauaauggaaguagaccgauccgaagcgaaagagggacuuaaacgcggugaaaccacaaaacacgcugucucaagaggcacagcgaagcugcggugguucguagagcguaaucuuguuaaaccggaaggaaaagucauagaccuagguugcgguaggggcggaugguccuauuacugcgcuggacuaaagaaagugacugaaguaaaaggguauaccaaaggcggaccuggucacgaagaaccgauaccaauggcaaccuacggguggaaucuagucaaauugcauagugguaaggacguauucuuuauuccaccagaaaagugugacacgcuguuaugcgauauuggagaaucaagcccaaauccaacgauagaagaaggucgaacauugcggguauuaaaaaugguggagccuugguuaaggggaaaccaauucuguauaaagauauuaaauccauauaugcccagcguaguagaaacgcuugagcaaaugcaaagaaaacauggagggaugcucguacgcaacccacuuaguagaaauagcacucaugagauguauuggguauccuguggaaccggaaacaucguaagugcaguaaauaugacaagucgaauguuacugaauagauuuacaauggcucaucguaagcccacuuacgaacgcgauguugaccuaggagcugguacgagacacguugcaguugagccugaggucgcaaaucuggauaucaucggucaaagaauugaaaacauaaaacacgaacacaaaaguacauggcacuaugacgaggauaauccauauaaaacaugggcauaccacggaucauaugaagucaagccuucaggcagugcaucguccaugguaaaugguguagugaaauuauugaccaaaccgugggaugucauucccaugguaacacaaaucgcaaugacugauaccacgccauuugggcaacaacgaguuuuuaaagaaaagguagauacacggacuccaaaagccaaaagaggcacagcacaaauaauggaaguuacagcaaagugguuauggggcuuucuuucgcgaaauaagaagccgcgaauaugcacgagggaagaauuuacaaggaaaguuaggaguaacgccgcaauaggggcgguauucgucgacgaaaaucaauggaauagugcaaaggaagcuguugaggaugaacgauucugggacuugguacauagagagcgcgagcuucacaaacaagguaaaugcgcgacgugcguuuacaauaugauggguaagcgagagaagaaacuaggagaauuugguaaggcaaaagguagucgcgcgauuugguacauguggcuaggggcuagauucuuagaguuugaagcgcugggauuuaugaacgaggaccauugguuuucccgcgaaaauucucuaucaggaguugaaggugaaggauuacacaaacugggauauauacuaagagauauaaguaagaucccggguggaaauauguaugcagaugauacggcagggugggacacucggauaacugaagaugaccuucagaacgaagcgcggauuaccgacauaauggaaccugaacacgcuuuauuagcuaaaucuaucuucaaauuaaccuaccaaaacaagguuguccggguucagaggcccgcuaaaaacggaacaguaauggauguuaucagucgccgugaucagcgugguaguggacaagucgggacuuauggauuaaacacuuucacuaauauggaagcucaacucauaaggcagauggaaagugaagggauauuuagcccgucggaacucgagacaccaaaucucgcagaaagaguccuagauuggcucgaaaaguacggcguggaaagacuuaaaagaauggcaauaaguggugaugacugcgucguaaagccuauagacgaucgauuugccaccgcacuuacagcuuuaaacgauaugggcaaaguacgaaaggauauuccacaaugggaaccaaguaagggauggaaugacuggcaacaaguccccuucugcucgcaucauuuucaccaacugauuaugaaagacgguagagaaaucguggugccuugcagaaaucaagaugaacuuguaggacgagcacggguuucacaaggcgccggauggucauugcgagaaacagcaugucuaggaaagucuuaugcucaaauguggcaauuaauguacuuccauaggcgggacuuacgacuagccgcgaaugcaauauguagcgcuguaccuguugauuggauaccaacuagcaggacaacauggaguauacacgcccaucaucaauggaugacgacggaggacaugcuuucgguauggaauagaguuuggauagaagagaacccuuggauggaagacaagacccacauaaguagcuggggagauguaccauaucuggguaaaagggaggaucaguggugugguagucuaauugguuuaaccgcgagagcaacaugggccacuaauauacaaguagcaaucaaucaaguacgacgucuuauuggaaaugagaauuauuuggauuauaugacaucuaugaaacguuucaaaaacgagagcgacccagaaggugcauuaugguaa

SEQ ID NO: 21789 - RNA, 9879 nt, Artificial Sequence
  derived and/or modified CDS sequence (opt6) from DENV-1__GU131706__SS-prME
ucaguuacuauguuacuaauguugaugcccaccgcacuggcguuccaucuaaccacucguggaggggaaccucacaugauaguuaguaaacaagaacgcggaaaaucauuacuauucaaaacaagugcuggagucaacauguguacuuuaauugcuauggaccuuggagaacugugugaggauacuaugacuuauaaaugcccgagaauaacggaaacagaaccggaugauguugauuguuggugcaacgcaacggauacuuggguuacguaugguaccuguucacaaacaggugaacacagacgugauaaaagaaguguugcacuagcuccacauguagguuuagguuuagagacgcggacagaaaccuggaugucgagcgaaggugccuggaaacaaauacaaagaguagaaaccugggcauugagacaucccggcuuuacaguuauagcacuguuuuuagcacaugccaucgguacgagcaucacacaaaaggguauaaucuuuauucuccuaauguuagugacucccucuauggcaaugagauguguagggauaggaagcagagauuuuguugaaggguuaagcggagcaacaugggucgauguuguccuagaacacgguagcugcguaacuacaauggccaaagacaagccaacucuugacauugaacugcugaaaacagaaguuacgaacccugcuguucuacgaaaauuauguauagaagccaaaaucucaaacacaaccacggauuccaggugcccgacccaaggugaggcaacacuuguggaggagcaggaugcgaauuucgucugcagaagaacuuuuguagacagagguugggguaacggguguggccuuuucgguaaagguagucuuauaaccugugcaaaauuuaagugcguaacuaaacuggaagggaaaauaguucaauaugagaaccuaaaauauagcgugauuguuacaguucauacaggagaccaacaccaaguuggcaaugaaucaacggagcacggaacgacggccaccauaacgccacaggcaccuaccacagaaauccaauuaacggauuauggggcguuaacacuagacuguaguccgagaacugguuuagauuucaacgaaaugguucucuugacuaugaaagaaaagucaugguuaguucacaaacaaugguucuuagaucuaccuuugccuuggacaaguggagcaucgacaucacaagagacguggaaucggcaagauuuauuggucacauuuaaaacggcgcacgccaagaaacaagaagucgugguacuagggagccaagaaggugcuaugcacacugcuuuaacgggagccacagaaauacaaaccucuggaaccacuacuauuuucgcaggacaucucaaaugcagacuaaaaauggauaaacucacacuaaaggguaugucguacgugauguguacugggaguuuuaaacuagaaaaagaaguggccgaaacucaacaugguacuguucuugugcagaucaaauacgaagggacagacgcacccuguaaaauaccauuuuccacacaagacgaaaaaggagucacgcaaaauggaaggcugauaacggcgaacccuauugugaccgacaaagagaaaccagugaauauagaagccgaaccgccuuuuggugaaaguuauaucguaauaggagcaggggagaaagcucuuaaguuaagcugguuuaggaaagguagcagcauaggaaaaauguucgaagcaacugcaagaggagcgcgcagaauggcgauacuaggggauacagcaugggacuuuggcagcauaggagggguauuuacgucuguagggaaguuaguucaucagauauuuggaacagcguacggcguacuauuuucaggagugaguuggacaaugaaaauaggaaucgguguccuccuuacauggcuaggacuuaacucacgaagcacaagccuaaguaugaccuguaucgcaguugguuuaguuacgcuauaucuuggaguaaugguacaggccgauagcggaugcguaauuaacuggaaagguagagaguugaaauguggcuccgggauuuucgugaccaaugaggugcacacauggacggaacaguauaaguuccaagccgauucgccaaaacgauuaagcgcagcuauaggaaaagcaugggaagagggaguuuguggaaucagaagugcgacuagauuagaaaauauuauguggaaacaaauaucuaaugaguugaaccauauauuauuagaaaacgacaugaaauuuacuguaguagugggugacguugcgggaauauuagcacaggggaagaaaaugauuaggccgcaaccaauggaguacaaauacucauggaaauccuggggcaaagccaaaaucauaggagcugauguccagaauacaacguuuauaauugacggaccuaacacaccggaaugcccagaugaucagagagcguggaauaucugggaaguagaagacuacggauuuggaauuuuuacgacgaauauauggcuaaaacuucgugauucauauacccaagucugugaucauagauuaauguccgcagcaauuaaagauaguaaggcaguccacgcggacaugggcuauuggauagaaucagaaaagaacgaaacuuggaaauuagcaagagccagcuuuauugaaguuaaaacuuguauauggcccaaaagucauaccuuguggucaaauggaguccuggagucagaaaugauuauacccaaaauuuaugguggaccuauaucacaacacaacuauagaccaggauauuuuacacaaacggccggcccuuggcaccuaggcaaacuugaacuagacuucgaucuuugugaggguacaacagugguuguagacgaacacugcggcaaucgagguccaucucuaaggacaacuaccguaacagggaagaucauccaugaaugguguugucgauccugcacacugccgccauuacgauuuagaggugaggaugguuguugguacgguauggaaaucagaccaguuaaagagaaggaggagaaucucgugaaaagcaugguuagugcaggauccggagagguagauucauucucccucggacuucuuugcauaagcauaaugauagaagaaguaaugagaucacgauggagccgaaagauguuaaugaccggcacauuggcagucuucuucuuguuaauaaugggacaacuaacguggaaugaucuuauacgacuauguauaauggucggagcaaaugccuccgaucgaaugggaaugggcaugacauauuuagcauuaauggcgacuuucaaaaugagaccaauguucgcuguaggcuuauuauuuaggagguugacuucucgugaaguauuauuguugaccauagggcuuucauuaguagcgucagucgaauuaccuaacucgcuagaagaacuuggugacggacuugcaaugggaauaaugauauugaaacuacuaacagacuuccagucucaucaauuaugggcaacauuauuaaguuuaacauuuauaaaaaccacauuuucacugcacuacgccuggaaaacuauggcaaugguauuaucaauaguuuccuuauucccauuauguuugucaacuacaagccagaagacuacuugguuaccuguacuauuaggcucguuaggcugcaagccauugacuauguuucugauagcugaaaacaaaauuugggggagacgguccuggccccuaaaugagggaauuauggcaguaggaauaguaucgaucuuauugucaucguuacugaaaaaugaugucccucuagcagguccacucauagcaggaggaaugcugauugcauguuacgugauuucaggaaguucugcugaucuaucacuugaaaaagccgcagaagucucuugggaggaagaggcagaacacucaggggcaucacauaauauccuagucgagguacaggacgacgguacuaugaaaaucaaagaugaagaaagagacgauaccuuaacuauacugcuaaaggccacccuauuagcaguuagugguguuuacccauuaaguauaccugccacccuuuucgucugguauuuuuggcagaaaaagaaacaaaggagcggaguccuaugggacacgccgucuccucccgaaguagagcgggcaguguuggaugacgguauuuaccgaauaaugcagaggggauuacucggccguucucaaguuggcguaggcguauuucaagaaaauguauuucacacaauguggcauguaacaaggggagcaguuuuaauguaccaagguaaacgacuagaacccuccugggccagcgucaagaaagaccuuaucuccuauggagguggauggcgauuacaaggaucguggaauacuggagaagaaguacaagugauagcaguagaaccaggcaaaaauccuaaaaauguccaaacugcuccaggaacauucaaaacgccugaaggugagguaggagcgauagcauuggauuuuaaaccaggcacuagcggaagcccaaucgucaacagagaaggcaaaaucguaggguuguaugguaaugguguaguuacgacgucuggcacguacguaucagcuaucgcacaagcuaaagcaucacaggaggggccucuucccgaaauugaagacgagguuuuuagaaaaaggaaucuaacuauaauggacuuacacccuggaagcgguaaaacuagacgcuaccugccagccauugugagagaagcuauaaaaagaaaacuacgaacacuuaucuuagcuccaacucguguuguugcauccgaaauggccgaagcguuaaaggggaugccuauacgauaccaaacgacugcagucaaaucggaacacacaggaaaagaaauaguggaucuuaugugucaugcaacauucacuaugcguuugcugucaccaguacgaguaccuaauuacaacaugauaaucauggaugaagcacauuucacagaucccucaucaauagcagcgcgaggauauauaagcaccagaguaggcaugggggaagcugcugcaauauuuaugacugccacaccaccuggcagugucgaagcguuuccccaaaguaaugcuguuauacaagacgaagagagggauauaccggaacgaaguuggaauaguggcuacgaauggauuacagauuucccuggaaaaacuguuugguuuguaccaucgauaaaaagcggaaacgacauagccaauugucuaaggaaaaauggaaaaagagucauacaacuuucgagaaaaaccuuugauacugaguaccagaaaacgaagaacaacgacugggacuaugucgugacuacagauauaagugaaaugggcgcgaauuuuagagcagacagaguaauagacccgcguaggugucuaaaaccagucauucuuaaagacgguccugagcgagucauacuagcaggaccaaugccaguaaccguugcuagugccgcucaacguagaggcaggauugguagaaaucauaauaaagaaggagaccaauauauauauaugggacaaccgcugaauaacgacgaagaccaugcgcacuggacagaagcaaaaaugcucuuagauaacaucaauacccccgaaggaauaauacccgcacuguucgaaccagagagagaaaaaucagccgcuaucgacggcgaauacagacugagaggcgaagcacguaaaacauuuguugaacuaaugagacgaggugacuugccggucuggcucagcuauaaaguagcgagugagggauuucaauacucggacagaagaugguguuuugauggcgaaaggaauaaucaggugcuugaagaaaacauggauguugagauauggacaaaagaaggugaacguaagaaacuacgaccgagaugguuagacgcgcggacauauagugaucccuuagcacuucgagaguucaaggaauuugcugcggggcggcgaucuguuucaggagacuuaauacuugaaauagguaaguugccacaacaucuaacacaaagagcucaaaacgcuuuagauaaucucguaauguuacacaacucagaacaaggaggucgcgcuuaucgccaugcgauggaagaauuacccgauaccauagaaacuuuaaugcuguuagcacucauagcaguuuuaacuggagguguuacccuauucuuccuaucaggacguggacucggcaaaacguccauuggucucuugugcguuauggcgucaucugucuuauuauggauggcuagcguugaaccacacuggauugccgcgaguaucaucuuagaguucuuuuuaaugguauugcuaauaccagaaccagaccgucaacgaacuccucaagacaaccaauuagccuaugugguaaucggcuugcuauucaugauccuaacaguggccgcaaaugaaaugggguuacuagaaacuaccaaaaaggauuuaggaauuggucauguugcgguugaaaaccaccaucacgcagcuaugcuggauguugauuugcauccggcuucagcguggacccuauaugcgguagccacuacgauuauaacaccuaugaugcgacacacuauugaaaauacuacggcaaauauuucacuaacagcuauagcuaaccaggcagcuaucuuaaugggacuagacaaagguuggccuauuagcaaaauggacauuggaguaccucuauuagcguuaggaugcuacucacaaguaaauccucuuacucugaccgcugcuguccuaaugcugguagcacacuaugcaauuauaggcccuggucuccaagcaaaggcuacaagggaagcucagaaacguacagcagcugggauuaugaaaaacccuacgguggauggaaucguagcuaucgaccuugacccaguaguauaugaugcaaaguucgaaaagcaacuggggcagaucaugcucuugauuuuaugcaccucucagauacuccugaugcggacaacaugggcacuaugugaaucaauaaccuuagcuacgggaccuuuaacuacucuuugggagggaucacccggaaaauuuuggaauacuaccauugccguaucuauggcgaacauauucagaggauccuauuuagccggugcggggcucgccuucagucucaugaaaagccuagggggagguagaaggggcacuggagcacaaggagaaacacugggggagaaauggaagcgucaauuaaaucaauuaaguaaaucugaguucaauacauacaagagaagugggauuauggaagucgauaggucugaagcaaaggagggauuaaaacgaggugaaacuaccaaacaugcagugagucgagguacggcuaaacuaagaugguucguugagagaaaccuuguuaagccagaaggaaaggugauagaccugggauguggccgaggcggguggagcuacuauugugcuggucuaaagaaaguaaccgaagucaaaggauauacaaaaggagggccuggucacgaagaacccaucccuauggcaaccuacggauggaacuuagucaaauugcacaguggaaaagauguguucuucauaccucccgaaaaaugugauacgcuauuaugcgauauuggugaaucuucaccaaacccaacaaucgaagaagguaggacucuacguguauugaaaaugguagagccauggcuuagggguaaucaguuuuguauuaaaauacuaaauccguauaugcccucgguaguugaaacccuugagcaaaugcaacgcaagcauggaggaauguuggugaggaauccccugucaagaaacaguacacaugaaauguauuggguaagcuguggaacaggaaacaucguaucggcuguuaauaugacuucucggauguuauuaaacagguucacuauggcgcauaggaaaccuacuuaugaacgagacguagacuugggggccggcaccaggcacguagccguagaaccagaaguugccaaucuggauaucauaggacaaaggauagagaauauaaaacacgaacauaaaucaacauggcauuaugacgaggacaauccguacaaaacaugggcguaccauggcaguuaugaaguaaaaccuaguggaucagcgaguucaauggugaacgguguggugaaacuacuuacaaagccaugggauguaauaccuaugguuacccaaauagcuaugacagauacgacaccauuuggacaacaaagggucuuuaaggaaaaaguagacacaaggacuccuaaggcgaaaagagggacagcgcagauaauggaaguaacagcaaaauggcuauggggauuucuaucaaggaacaaaaagccgcgaauauguacccgagaagaguuuacucgaaaaguuagaucgaacgcggcuaucggcgcugucuuuguagaugagaaucaguggaacucagcuaaggaagcuguagaagaugaacgguucugggacuuaguccauagagagcgcgagcuucacaagcaaggaaaaugcgcgacuuguguuuauaauaugauggggaaacgugagaagaaacuaggggaauuuggcaaagcuaaaggaucgcgagcuauaugguauaugugguuaggcgcccguuucuuagaauuugaggcuuugggcuucaugaaugaagaucauugguucuccagagaaaauaguuuaucugguguagagggagagggacuucacaaacuaggauauauauugagggacauuagcaagaucccaggaggcaacauguacgccgaugauacagcagguugggauaccagaauuaccgaggacgauuuacaaaaugaggcacgcauaacagacauuauggagccggagcaugcacuacucgcaaaaucgauuuucaaacuaacuuaccagaauaaagugguacguguacagcggccagccaaaaacggcacagucauggauguaauuucgagaagggaucagcguggaaguggucaaguggggaccuacggccuaaacaccuuuacaaauauggaagcacaacucauuaggcaaauggaaucugaaggaauauuuucuccaagugagcuugagacgccaaauuuagcugaacgaguacuggacuggcucgaaaaauacggaguugaacgccugaagcggauggcuauuucaggagaugacugcgucguaaaaccaauugaugacagguucgcaacugcucugaccgcccucaacgacauggguaaaguacgcaaagauauaccccagugggaaccuagcaaaggguggaacgauuggcaacaaguacccuuuuguucccaccacuuucaccaauuaauaaugaaagacggacgugaaauugucguacccuguagaaaucaagaugaauuagucggacgagcacgugucucucaaggagcgggcuggagucuaagagaaacagcgugccuugggaagucuuaugcgcaaauguggcaacucauguauuuucacagacgagauuugagguuagccgccaaugcuaucugcagugcaguaccuguagauuggauaccaacgagcagaacaacauggucgauacaugcucaccaucaauggaugacgacagaagauauguuaucuguuuggaacaggguuuggaucgaagaaaauccauggauggaggauaaaacgcauauaaguaguuggggugacguacccuauuuagguaaacgagaagaucaaugguguggaagucugauaggauuaacugcgcgagcgaccugggccaccaacauacaaguagcaaucaaucaggugagacgauuaauuggaaacgagaauuauuuggauuacaugacgucaaugaagagauuuaagaacgaaagcgauccagaaggugcuuuaugguga

SEQ ID NO: 21790 - RNA, 9879 nt, Artificial Sequence
  derived and/or modified CDS sequence (opt6) from DENV-1__GU131708__SS-prME
agcguaacgaugcugcuaauguuaaugccaacagcacuagcauuucaucuuacaacaagaggaggggaaccgcacaugguuguaucgaaacaagaacgagggaaaagccuuuuauucaaaacgucugcuggugucaauaugugcacacuaauagcaauggauuuaggugaauugugugaagacacuaugacauauaaaugccccagaauaacugaagcagagcccgacgauguggauuguuggugcaaugcaacagauacauggguaacauacggcacguguagucagacuggagaacaccgucgcgauaaacgcagcguugccuuagcaccgcauguaggauuaggauuagaaacccgcaccgaaacuuggaugucuucugaaggggcauggaaacaaauccaacgaguggaaaccugggccuuacgacauccuggauuuacuguaauugcccuauuuuuagcacacgccauagguacgaguaucacccaaaaagggauaauauuuauacucuugauguugguuaccccuaguauggcuaugagaugcguugguauaggaucucgugauuucguagaaggcuuaagcggagcgacauggguagauguaguauuagaacacggauccugcgugacuacaauggcaaaagacaaaccgacccuagacaucgaguuacuuaaaaccgaaguaacaaauccagcaauucugcgaaaacucuguauugaggcgaaaauuuccaauacuacaacugacagcagauguccgacucaaggggaagcaacccuaguggaagaacaagaugcuaauuuuguuuguagacguacauuuguugacagagggugggggaauggguguggccuauuugggaaaggaagccugauaacuugugcaaaauuuaaauguguaaccaaauuagagggaaaaaucguucaauacgagaaucugaaauauuccgucauuguaacugugcauacaggggaucaacaccaaguagguaaugaaucgacagaacauggcaccacagccacaauaacuccacaagcuccaacgacugaaauucaacuaacagauuacggagcccuaacccuagacuguucaccaagaacaggcuuagacuucaacgaaaugguacuucuuacgaugaaagagaaaagcuggcuuguccauaaacaaugguuccuagaucucccauuaccauggacaaguggagcuucaacuucucaagaaacauggaacagacaagaucuuuuagugaccuuuaaaacagcucaugccaagaaacaagaggucguaguucucggaucgcaagaaggagcuaugcauacagcacuaaccggugccacggagauacaaacaucaggcaccacaacaauauuugcaggacaccucaaauguaggcugaaaauggauaaauuaacccucaaagguaugagcuauguaauguguacuuccucguucaaauuagaaaaagagguagcagaaacacaacacggaacagugcuaguacaaauaaaauaugagggaaccgaugcgccuuguaaaauaccauucucaacucaggaugaaaaagggguaacucagaauggccgauugauaacagccaauccaauuguaacagauaaagaaaaaccaguuaauauagaagccgaaccaccuuucggagagucauauaucguaauaggugcuggagagaaagccuuaaaacucucuugguuuaagaaagguucaagcaucggaaaaauguuugaggcuacagcuagaggagcgcggagaauggcaauauuaggggauacugcaugggauuucggaaguauugguggaguguuuacaagcguagggaaacucgugcaccaaauauucggcacggcguacggaguacuuuucucgggggucucauggacaaugaaaauugguuugggcguuuuguuaacguggcuaggccuuaauucacguucaacaucucuuagcaugacgugcaucgccguuggccugguuacucuauaccuagguguaaugguacaggcugacucuggaugcguuauaaauuggaaaggacgugaguuaaaaugcggcaguggaaucuuuguaacaaacgaaguucacacauggaccgaacaauacaaauuccaagccgauuccccaaaacgucucagugcggccauaggaaaggccugggaggaaggaguaugcgggauaagaucugcuacuagguuagaaaauguuauguggaaacagauaucaaaugaauuaaaucauauacuauuggaaaacgauaugaaauucacgguuguaguaggagaugucgcugguauauuggcucaaggcaaaaagaugauccgaccacaaccaauggaauacaaauauaguuggaaaucuugggggaaagcaaagauuaugggugcggacgugcaaaauacuacauucauuauagauggaccaaauacgccugaaugcccagaugaucaacgugcauggaacauuugggaaguugaagauuacggcuuuggaauuuucacgacaaacauuugguuaaaguuacgugauaguuauacccagguaugugaccaucgcuugaugucagcagcuaucaaagacuccaaagcaguccaugcagacauggguuauuggaucgaaucagagaaaaacgaaacguggaaauuagcgcgagcuucauucauagaagugaaaacgugcauauggccaaagagccauacgcucuggaguaacgggguacuugaaucggagaugauuauaccuaaaauauauggcggcccuaucucucaacauaauuauagaccagguuauuucacacagacagcagguccuuggcacuuagguaaacuagaacuagauuuugauuuaugugagggcacuacuguagucguggacgaacauugugguaaucgcggaccaagucuccgcacgacuacaguaaccgggaaaaucauacaugaauggugcuguaggucuuguacgcucccacccuuaagauucagaggagaggauggguguugguauggaauggagauacgaccuguaaaagaaaaggaggaaaacuuagucaaaaguaugguaucagcuggguccggagagguagauagcuuuucucuuggacuguuaugcauaucuauaaugauagaagaaguaaugcggaguagguggucaaggaaaauguuaaugacagguacuuuagcggucuuuuuacuccuaaucaugggacaacuuacauggaaugauuuaauacgccuauguaucaugguuggugcuaaugccucagacagaauggguaugggaacaacauaucuagcucuuauggcaaccuuuaaaaugcgaccuauguucgcagugggauugcuguuucgacgauuaaccagcagagaaguguugcuucuaacaauuggccuaucccuuguagcuaguguagagcuacccaauagcuuagaagaacuuggggacggacuagcaauggguauaaugauuuugaaguuacucacugacuuucaaagucaucaacucugggcaacgcuuuuaucucuuacguucauuaagacuacuuucucacuccauuaugcuuggaagaccauggcuauggugcuuaguauuguaagccuauucccgcuuugucuuucuacaacuagccagaaaacuacaugguuaccaguacugcuagggucacuaggguguaagccauugacaauguuucucauugcugaaaauaaaauaugggguagaagguccuggccacucaaugaggguauaauggcuguugguauugugagcauacuauuaucuucgcuucuaaagaaugacgugccauuagcuggcccacugauagccggcggcauguuaauagcuugcuacgucauuucuggaucaucagcggacuugagucuggaaaaggcagcggaaguaaguugggaagaggaagcugagcacuccggagcuucccauaacauauugguagaaguccaagaugaugguacgaugaaaaucaaagaugaagaaagagacgauacauuaaccauacuccuaaaagcaacucuacuugccguauccggaguguacccacugaguauaccagcaacgcuuuucguaugguacuucuggcagaagaagaaacagaggucgggaguauuaugggacacacccagucccccagagguugaacgugcgguacuugaugauggaauauaccguaucaugcaaaggggcuuacuaggcagaagucaaguagguguggguguauuccaggaaaaugucuuccacacgauguggcacguaacacguggggccguacuuauguaucaagguaaaagauuggagcccucaugggccucugugaagaaagacuuaauaaguuacgggggaggauggcgucuacaggguaguuggaacacuggagaagaaguacaagucaucgcagucgaaccgggcaaaaauccuaagaacguucaaacugcaccagggacuuucaagacuccggaaggugagguaggugcgauagcacuagauuucaagccaggcacaagcggaagcccaaucguuaacagggaaggcaaaauaguuggccuuuauggaaauggaguggugacaacuucaggaacuuaugucucagcuauugcucaagcgaaagccagccaggaaggaccauugccugaaauagaagaugaaguauucagaaaaagaaaccuaacaauuauggaucuacauccuggcagcgggaaaacucgaagauauuuacccgcgauugugcgugaagcaauaaagcgaaaauugagaacacuaauucuggcgccaacaagagucguagcaucagaaauggcugaggcccugaagggaaugccgauacgguaccagacuacugcaguaaaaucagaacauaccgggaaagaaaucguagaucuaaugugucaugccacauuuacuaugcguuuacuuucaccagucaggguccccaauuauaauaugaucauuauggacgaggcacauuucaccgaccccucaaguauagcugcgaggggcuacaucagcacaaggguaggcaugggugaagcagcugcaauauuuaugacugcaaccccaccaggaaguguggaagcauuuccacagucaaaugcagucauucaagacgaggaacgagauaucccagaaagaucauggaacuccggguacgaguggauaacagacuucccaggaaaaaccguaugguucguaccuucaauaaagucgggcaaugauauagcaaacuguuuaaggaaaaauggcaaaagaguaauacaacuuucgagaaaaacuuucgauacagaauaucagaagacuaaaaauaaugauugggauuauguagugacaacugauauuuccgaaaugggugcaaauuuuagagcagaucgaguaauugacccuaggagauguuuaaagccuguaauuuuaaaagaugguccugagagggucaucuuagcgggaccgaugccgguaacugucgcuucggcagcgcaaagaagaggaagaauagggagaaaucauaacaaggaaggagaccaauauauauauaugggucaaccuuugaauaacgaugaagaccaugcacauuggacagaagcuaaaauguugcuggauaauauuaauacacccgaaggaauaauaccggcucuuuucgaaccugaaagagaaaaauccgccgcgauagauggcgaguacagguuaagaggugaagcaagaaagacauuuguggaacugaugaggagaggagauuuaccaguuugguuaaguuacaaggucgcaucagaggguuuucaauauuccgauagaagauggugcuucgauggagaacgaaacaaucagguguuagaagagaauauggacgucgaaauauggaccaaggagggugaaaggaagaaauugagaccaagaugguuagacgcucgaacauauucugauccauuagcucugagggaauuuaaagaauuugcagcgggccgacguucagucucgggugacuuaaucuuagaaauaggcaaauuaccacaacauuuaacucaaagagcgcaaaaugcccuggacaaccuaguaauguuacacaauucagaacaaggaggacgagcauaucggcacgcaauggaggaauugccagauacuauagaaacgcuaauguuguuagcacuuauagcuguguuaacagggggaguaacauuauucuuuuugaguggcaggggacucggcaaaacaaguauaggacuacuaugcgucauggcaucaucuguuuugcucuggauggcgaguguggaaccacacuggauagcagccagcauaauucuugaauuuuucuuaaugguacuccucauaccggagccggaccgacaacgcacuccacaagauaaucaacuagcuuacguagucauuggacuacuuuuuaugauacuaaccguagcagccaacgaaaugggauugcucgaaacuacuaagaaagauuuaggcauaggccacgcggcuguagggaaucaucaccacgcggcuauguuagauguagaucugcauccugcuucagcuuggacgcuauaugcgguugccacaacgauuauuacgccgaugaugagacauacgauagaaaauacuacagcaaacauaucauuaacggcaauagcaaaccaagcggccauccugauggggcucgacaaagguuggccaauaucaaaaauggauaucggagucccacuacuggcucuugguuguuacagccagguaaacccucuaacuuugacugcggccguacuaaugcugguugcgcauuaugcuaucauaggccccggccuucaagcuaaagcuacacgcgaggcacagaaaagaaccgccgcugggaucaugaagaaucccacaguugacgguauuguagcaauugacuuagacccuguaguguaugaugcgaaguuugaaaagcaacugggucaaauaaugcugcuuauauuaugcacuucacaaauucucuuaaugaggacaacaugggcguuaugcgaaaguauuacccuagcuacagggccgcuaacuacguugugggaaggcagucccgguaaauuuuggaauacaaccauagcuguaucuauggcaaauauauuuagggggucguaucuagcaggagcaggacuugccuuuaguuuaaugaaaucucuuggcgggggucggcgagguacaggggcacagggugaaacauuaggagaaaaauggaaaagacaauuaaaucaacuuucaaagucagaauuuaacaccuacaagagauccgguaucauggaagucgaucgaagugaagcaaaagaaggucucaagcgaggugagacuacuaaacaugcuguaagccgggguaccgcaaaauuaaggugguucguugagcggaaucuagugaagccugaaggaaaaguaauagauuuaggaugugggagagggggauggagcuauuacugcgcgggccugaagaaaguaacagaaguaaagggcuauacgaagggcggaccaggacacgaggaaccgauuccuauggcgacguacgguuggaaucuuguaaaauugcauagugguaaagacguauucuuuaucccaccagaaaagugugacacuuuacugugcgauauaggcgaauccuccccuaaucccacgauagaagaagguagaacccuaaggguucuaaagaugguagaaccuugguugcggggcaaucaguucuguauuaaaauauuaaauccauauaugcccagugucguagaaacuuuagaacaaaugcaaaggaagcacggggguauguuaguccgaaauccucuaucgcguaauucaacgcacgaaauguauuggguaucaugcgggaccggcaacaucguuucugcgguuaacaugacaagucgaauguuauugaaucgauucaccauggcccaucguaagccgacguacgaaagagaugucgaccuaggugcugggacacgccauguggcaguugaacccgagguugcaaaucuagauauuauuggacaacguauagaaaauauuaagcacgaacacaagaguacuuggcacuaugacgaagacaauccuuauaaaacaugggcuuaucacgguaguuaugaaguaaaaccaucggguucugcuaguucaaugguuaacggcguagucaaauuacuuacaaagccaugggauguaauaccuauggucacccagaucgcaaugacugacacuacaccguuugggcagcaacgaguuuuuaaggaaaaaguagauacaagaacgcccaaagcuaaaagaggcacggcccaaauuauggaaguuacugcgaagugguuguggggauuuuuaaguaggaacaagaaaccuagaauaugcacaagagaagaauuuacacgaaaaguaagaucgaacgcggcaauuggcgccguauucguagaugaaaaccaauggaauagugcuaaagaggcuguagaagaugaaagauuuugggauuuaguucaccgugaaagagagcuacacaaacagggcaaaugcgcuacauguguauauaacaugaugggcaaacgagaaaagaaacuaggugaauuuggcaaagcaaaggguucucgagccauaugguauauguggcuaggugcucgauuccuagaguuugaagcauuaggauucaugaacgaggaccauugguuuuccagagaaaacucacucucaggagucgaaggugaaggacuucacaaauuagguuauauacuucgggauauauccaaaauaccuggugguaauauguaugcagaugacacagcagggugggacacccgaauuacagaagaugauuuacaaaaugaagcuagaauaacagacaucauggaaccagaacacgcacugcucgcuaaaaguauauuuaaauuaacauaucaaaauaaaguaguaagaguacagcgcccagccaaaaacggcaccgucauggacguaauaaguaggagagaucaaagagggucuggucaaguagggaccuaugggcuaaauacuuucacaaacauggaagcacaauuaauaagacaaauggaaucagaaggaauauucaguccaagugaauuagaaacucccaauuuagcugaacgaguacuagacuggcuugaaaaauaugggguagaaagauuaaaacgaauggcaaucucaggagaugacugcgugguaaaaccaaucgacgauagguucgcuacugcauuaacugcacuuaacgacaugggcaaaguacgcaaagacaucccccaaugggaaccgucaaaggguuggaaugauuggcaacaagugccuuucuguucacaucauuuucaucaacugauaaugaaagauggucgugagauaguugucccuuguaggaaccaagaugagcuaguaggaagggcaagaguaagucaaggagcaggguggucauuacgagaaacugcuugcuuaggcaaaagcuaugcacagauguggcagcuaauguacuuccauagaagagauuuacgucuagcagcgaaugcuauauguagugcuguaccaguagauuggauuccuacaucgaggacaacguggaguauccaugcgcaccaucaauggaugacgaccgaagauaugcuuucgguuuggaauagaguauggauagaggaaaauccuuggauggaggacaagacacacaucaguucauggggcgacgugccauauuuaggaaaacgagaagaucagugguguggcucuuugauaggccugacugcgcgugcaacuugggcuacuaauauacaagucgcaauuaaucaaguuagaagauuaauagggaaugagaauuauuuggacuauaugacuuccaugaaacgauucaaaaaugaaucagacccugaaggugcucuaugguag

SEQ ID NO: 21791 - RNA, 9879 nt, Artificial Sequence
  derived and/or modified CDS sequence (opt6) from DENV-1__GU131710__SS-prME
ucuguuacaaugcuucuaaugcuuaugccaacugcacuagcguuccacuuaacgacuagaggaggugaaccacacaugauugcaucuaaacaagaacgggguaaaucacuucuauucaaaacaucagcaggaguaaacaugugcacacuaauugcaauggauuuaggagaacuaugcgaagauacaaugaccuauaaauguccuagaauaacagaaacagaaccggaugauguagacugcugguguaacgcuacugauacauggguuacauaugguacauguucccaaacaggagaacauaggcgcgauaaacgaucuguagcacuagcaccacaugucggauuaggcuuagaaacacguacugaaacauggaugagcucagaaggagcauggaaacaaauucaacgcguugagaccugggcccuacgacacccaggauucacuguuaucgcucuauuucuggcacaugcgauugguacuucaauaacucaaaaaggaauaauuuucaucuuauugaugcucguaacgccuaguauggcaaugcguugcgucggaaucgggucccgcgauuucguagaaggacugaguggcgcgacguggguugauguaguacuagaacacgggucaugcguaaccaccauggcgaaagauaaaccaacucuugacauagaacuauugaaaacggaagugacaaacccugccguauuaagaaaacuauguauagaagcaaaaaucaguaauacgacuacggauucacgauguccuacccaaggugaggcuacauugguagaagaacaagaugccaauuuuguuugcagaagaacuuuuguugaccgugguugggguaaugguuguggacuauucgggaaaggcagucuaauaacgugcgccaaauuuaaaugcguuacaaaacuagagggaaaaauuguccaauaugaaaacuuaaaauauucaguuauaguaacaguucauacuggagaucaacaucaaguggguaaugaaucaacugagcauggcacaacagcuacaaucaccccacaagcaccaacuacggagauacaacuuacagacuacggugcucuaaccuuagacuguagcccacgaacuggcuuagauuuuaacgaaauggugcuauugacaaugaaagaaaaaucaugguugguucacaaacaaugguuucucgaccugccuuuaccauggaccaguggagcuagcacgagucaagagacguggaauagacaagaccuccuaguaaccuucaaaaccgcucaugccaagaaacaagagguuguuguacugggaagccaagagggagcaaugcauacagcgcuaacuggugcgacugaaauucaaacaagugguacgacgacuaucuucgcugggcaccuaaaaugccgucugaaaauggauaaauuaacacuaaaaggcaugagcuauguaauguguacaggcaguuucaagcucgagaaagaaguagcugaaacgcaacauggaacuguucuuguucaaauaaaauaugaaggaaccgacgcgccauguaaaauacccuuuucuacacaagacgaaaaagguguuacucaaaauggacggcucauaacugccaacccgauagugacagauaaagaaaagccaguuaauaucgaggcagaaccaccauucggcgaaucauauauaguaaucggugcaggagaaaaggcuuuaaaauuaagcugguucaagaaagguucaucgauagggaaaauguuugaggcaacugcaagaggagcgcgcagaauggcaauccuuggagauacugcuugggacuucggaucaaucggaggagucuucacauccgugggaaaauuaguacaucaaauuuuuggaaccgccuaugguguguuauuuagcggugucagcuggacuaugaaaauagggauagguguuuuauuaacuugguuggguuuaaacagcaggagcaccucuuuaucaaugacauguauugcuguugggcuaauaacguuauauuuaggcguaaugguccaggcagauaguggcugugucauaaauuggaaagguagagaauuaaaaugcgguuccggcaucuucgucacaaacgagguacacacauggacggaacaauauaaguuucaagcugauucaccuaaacgauugagcgcugcuauuggaaaggcaugggaagaggggguaugcgguauaagaucugcgacacgguuggagaauaucauguggaagcaaauaagcaaugaacucaaucauauacugcuugagaacgacaugaaauuuacagucguaguaggagauguugcgggaauccuugcccaagguaagaaaaugauaagaccacaaccaauggaauacaaguauagcuggaagaguugggguaaagcuaagauaauaggggcggaugugcaaaacaccacauuuauaauagauggaccaaacacacccgagugucccgaugaccaacgagcguggaacaucugggaaguagaagauuauggauucggcaucuuuacgacaaauauauggcucaaacuucgggauucuuacacccagguuugugaccaccgccugaugucggcagcaaucaaagauucaaaggccguccaugcagacaugggguacuggaucgaaucagagaaaaaugaaaccuggaaacuagcaagagccagcuucauugaaguaaagacaugcauuuggccaaaaagucauaccuugugguccaacggaguccucgagucggaaaugaucauuccaaaaauauacgguggaccgauaucccaacauaauuaucgcccaggauauuuuacacaagcugcgggaccauggcacuuaggcaaacucgaguuagacuuugaccuaugcgaaggaacuacgguuguagucgaugaacacugcggcaauagggggcccucacuaaggacaacaacgguuaccggcaaaauaauacaugaauggugcuguaggagcuguaccuuaccaccguuaagguucagaggggaagauggauguugguacgguauggaaauuagaccagucaaagaaaaagaagagaauuuaguaaagagcaugguaucagcggguucaggugaaguggauaguuucucacugggacuacuuuguauaagcaucaugauagaagaaguuaugaggagucgguggaguagacgaaugcugaugacuggaacucuagccguguucuuuuuauugauaaugggacaguuaacuuggaacgacuugauuaggcuuuguaucaugguuggcgcaaaugcgagugacaggauggggaugggaacaacauaccuggcacuaauggcuacuuuuaagaugagacccauguuugcuguggggcuucucuucaggaggcuaacaagcagagaaguguuauugcugacaauaggauuaucacucguugccuccguagaacuaccaaacucacuggaagaacugggcgauggcuuagccauggguauaaugauacuuaaauuguuaacagacuuucaaucucaccagcuuugggcaacuuuauugucacucaccuuuauuaagaccacguucucccugcacuaugcauggaaaaccauggcaauggucuuaaguaucguaagucuauuuccauuaugcuuaucaacaacaagccagaaaacgacuuggcuuccaguuuuacuagguucgcuaggauguaaaccguugacgauguuccugaucgcagaaaauaaaaucugggggagaagaagcuggcccuuaaaugaggggaucauggcaguuggaauaguaucaauuuuacucaguagcuuacugaagaaugaugugccgcuugcuggcccguuaaucgccggugguaugcuaauagcaugcuacgucauaucugguucgagcgcagauuuaucccucgaaaaagccgcggaggucaguugggaagaagaagcugaacacuccggugccucccacaauauccuuguggaagugcaagaugaugggacuaugaaaaucaaagaugaagaacgagaugauacacuaacaauccuacucaaggccacauuauuagcagucucuggaguauauccucuaaguauuccggcaacacuguuuguaugguacuuuuggcagaggaagaaacaacgaucuggggucuugugggauacuccaucuccuccagaaguagaacgagccguauuagaugaugguauauaccgaaucaugcaacgcggucuucuaggucgcucacaagucggaguagggguguuccaggaaaacguauuucacacgauguggcacgugaccagaggcgccguacugauguaucaagggaagagauuggaacccucaugggcuaguguuaagaaagaccuaauauccuauggaggagguuggagauugcaaggaagcuggaauacuggugaagaaguccaggugauagccguagaaccggggaagaaucccaaaaauguacaaaccgcaccgggaacauucaaaacacccgaaggcgaaguuggagcuauagcacuagacuuuaaaccagggacaagugguagucccauuguuaauagagaaggaaaaauaguaggauuauauggcaaugguguggucaccaccucagguaccuauguuagcgccauagcacaagcaaaggcuucacaagaagggccgcucccagaaauagaagaugaggucuuuaggaagagaaacuugacgauaauggaucuccauccgggaagcggaaaaacuaggcgcuauuuaccagcaaucgucagggaagcgauuaaaagaaaacuaagaacccuuauccuugcgccaacucguguaguugcuucugagauggcugaggcuuuaaaagggaugccuauccgauaucagacaacugcaguaaaaucugaacauacgggaaaggaaauaguugaucucaugugccaugccacauucacaaugagauugcucucucccguaagagugcccaacuacaacaugauaaucauggaugaggcgcauuucacugauccaucaaguauagcagcaagggguuauauaucaacaagaguugguaugggcgaagcagcugccauauucaugacugcaacacccccuggauccguagaagcguucccacaaucuaacgcagucauccaagaugaggaaagagacauuccagaaagaucauggaauaguggauaugaauggauuaccgacuuccccgguaaaacagugugguuugugcccucuauaaaaagcggcaacgacauagcuaacuguuuaaggaagaacggcaaacgaguuauacaguuaucccguaaaacuuucgacacagaauaccagaaaacuaagaauaaugacugggauuacguugucacaacggacauuagcgagaugggggcaaauuuuagagcugauaggguaauagauccgagacgaugccucaaacccguuaucuuaaaagacggaccggagagagugauacuagcagguccuaugcccguaacgguagcgagugcagcucaaaggcgaggaagaauuggaaggaaccacaauaaggaaggagaucaguauauauauauggggcaaccucuuaauaaugacgaggaccaugcacauuggacagaagcaaaaaugcuacuugacaauauaaacacgccagaaggaaucauaccagcucuauuugaaccagaacgagaaaagucagccgcuauagacggggaguauaggcuucguggagaggcaaggaaaacuuuugucgagcugaugaggaggggagauuuaccgguauggcuaaguuauaagguggccucugaagguuuccaauauucugauaggcguuggugcuucgauggagagaggaauaaucaaguacuugaggaaaacauggauguagaaauauggacaaaggaaggugagaggaagaaacuaaggccucgguggcuugacgcccgaacguauagugauccgcuagcuuugcgagaauuuaaagaauuugcagcagggagaagaucaguuucgggagaucuaauucuagaaauaggcaaauuaccccagcaccuuacacagagggcacaaaacgcuuuggauaaccucgucauguuacacaauucagagcagggcggaagggcauauaggcaugcuauggaggagcuaccugacacuaucgaaacuuuaauguuguuggcuuuaaucgcaguauuaacaggugggguaacacuguucuucuuauccggacguggguuggguaaaaccucaauaggauuacucuguguaauggcuaguucaguacuacuauggauggcaucaguagaaccgcauuggauagcagcuuccauuauacuugaguucuuucugauggucuuauuaauaccggagccagacagacaacgaacaccucaagauaaucagcuagccuaugugguaaucggacugcucuuuaugauacuaaccguugccgcgaaugagaugggacugcuugagacgacaaagaaagaccuuggcauuggacauguugcaguagaaaaccaucaccacgccgcuaugcucgacguagauuuacauccugcaucagcuuggaccuuguaugcugucgcaacaacuauuaucacgcccaugaugcggcauacaauugagaacacgaccgcuaacauaaguuugaccgcuaucgcaaaucaagcugccauauuaaugggauuagauaagggauggccaauuuccaagauggauauaggaguuccccucuuggccuuagguuguuauagccaaguaaauccacugaccuugacagcagcaguauuaauguuagucgcucacuaugcuauaauuggaccaggccuucaggcaaaagcaacacgugaggcgcaaaagaggacggcagccgguauaaugaaaaaucccacaguggaugguauaguagcaauagacuuagacccaguaguauaugaugcuaaauuugaaaaacaauuaggacagaucaugcuucucaucuugugcacuagccaaauucuacuaaugcgaacgacaugggcacuuugugagagcauaacauuagcuacaggaccacugacuacgcuuugggaaggcucuccaggaaaguuuuggaacacaacaauagccguuagcauggcgaauauauuuagggguuccuauuuggcaggagcuggucuugcuuuuagucugaugaaaaguuuagguggaggaaggagagguacgggugcgcagggagaaacucuaggggaaaaauggaaacgacaacugaaccaacuaucaaaauccgaauuuaacacauacaagagaucgggaauuauggagguagauaggagugaagcgaaagaaggacuuaagagaggagaaacaaccaaacaugcuguuucacgggguacggcaaaacuacgcugguucguagaaaggaaccucguuaagccugaggguaaagugauagacuugggcuguggaagagguggcuggucauauuacugcgcggguuugaagaaaguuacugaaguaaaaggauacacaaagggaggcccugggcacgaagaaccaauaccuauggcuacauauggauggaauuugguaaaacuccauagcggaaaggaugucuuuuucauuccaccugaaaaaugugauacauuacuaugugacauaggugaauccaguccaaauccgacuaucgaggagggccgcacuuuaagagucuugaaaaugguagaaccgugguugcgaggcaaucaauucuguauaaaaauucugaacccauauaugcccucaguuguagaaacuuuggaacaaaugcaaagaaaacauggggguaugcuagugagaaacccccuuagcagaaauaguacacacgagauguacuggguaagcugcggaaccggaaauauugugucugcuguuaauaugacguccagaaugcuucuaaacagauucacgauggcacaccgcaagccuacguaugaacgggacguugauuuaggugcaggcaccagacacguagccguugagccagaggucgccaauuuagacaucauuggacaaagaauagaaaacauaaaacaugaacauaaaucaacuuggcauuaugaugaagauaaucccuauaagacgugggcauaucaugggagcuaugaagucaagccgucuggaucagcaucuucaauggugaauggugugguaaaguugcuuacuaagccuugggacguaauuccgaugguaacucaaauagccaugacugacacuacgccauuuggacagcaaagaguguucaaggaaaagguugauaccagaacacccaaagcaaagaggggaaccgcucaaauaauggaaguaacugcgaaauggcuuuggggauuuuugucgaggaauaagaaaccccgcauuugcacuagagaagaauuuacuagaaaggugcgaaguaacgcagcgauaggugccguguucguggaugaaaaucaauggaacucagcuaaagaagcuguugaggaugaaagauucugggacuuagugcacagggaacgagagcuacauaaacaggguaaaugugcaaccugcguguauaauaugauggggaaaagagaaaagaaguuaggugaguuugggaaggccaaaggaagccgagcaauuugguauauguggcuuggcgcccgguuuuuggaauuugaggcuuuaggauucaugaaugaagaucauugguucucacgugaaaauucuuuaagcggaguagagggcgaaggucuacauaaauuaggcuacauauugcgagauaucaguaaaauuccaggaggaaacauguaugccgaugauacugcaggaugggauacacgaauaacugaagacgaucuucaaaacgaagcacgaauuacagacaucauggagcccgagcaugcacuuuuggcaaaaagcauuuucaaacuuacauaucaaaauaaaguaguaaggguccagagaccagccaaaaacgguacuguuauggacguaauuuccagacgagaccagcgcgguagcggucaagucggcacguauggacuuaacacguucacaaacauggaagcacaacuaauuagacagauggaaagcgaaggaauauucucaccuucagaauuagaaacacccaacuuagcggaacguguacuugacuggcuagaaaaauauggcguugaaagacucaaaagaauggcaauaagcggugaugauugugugguuaaaccuauagaugaccgguucgccacagcucucacggcucuaaaugacauggggaaaguacgcaaagauauuccacaaugggagcccaguaaggguuggaacgauuggcaacagguaccuuucugcucacaucacuuccaucagcuuauaaugaaagacgggcgugaaaucguagugcccugucgaaaccaagaugaauuaguaggcagagcaagaguuagucagggagcaggauggucacugcgggaaacagccugccuaggcaaaucuuaugcgcaaauguggcaacugauguauuuucauagacgugauuuaagauuagcagcaaacgcuauauguucagcuguacccguugauuggauacccacaucucguacaacauggagcauacacgcucaucaccaauggaugacuacagaagauauguuauccguguggaacagaguauggauagaggagaaccccuggauggaggacaaaacgcacaucucaaguuggggcgacguacccuauuuagguaaaagggaggaucaauggugugguucccugauaggauuaacugcaagagcaaccugggcuaccaauauucaggucgcuauuaaccaagucaggagacuaauaggaaacgagaauuaccuagacuauaugacgucaaugaaaagguuuaaaaaugaaagugauccagaaggggcacuaugguag

SEQ ID NO: 21792 - RNA, 9879 nt, Artificial Sequence
  derived and/or modified CDS sequence (opt6) from DENV-1__GU131717__SS-prME
aguguaacaaugcugcuuauguuaaugccaacagcgcuugcguuucacuugacuacaagggguggggaaccacauaugauaguaucaaaacaagaaagagggaaaagucuuuuauucaaaacgucugcgggagugaauaugugcacccuuauugcaauggaucuaggagaauuuugugaagauaccaugacauacaaaugccccagaauaacugaagcugaaccugaugauguagauuguuggugcaaugcuacggacacauggguuaccuacggaaccuguucacagacgggugaacaccgaagagauaaacggaguguggcacuugcgccccacguaggacuaggauuagagacgagaacagaaacauggaugucuagcgaaggagcauggaaacaaauccaaaggguugagacaugggcucuuagacauccaggauuuacaguaauugccuuguuccuggcucaugcuaucgggacaagcauaacgcaaaaagguauaauauuuauccuucuaauguuaguaacaccuucaauggcgaugagguguguaggaauagguucacgagacuuuguggaaggguuaagcggugccaccuggguggacguagucuuggagcacggaaguugcguaacuacuauggcgaaagacaaacccacucuagacauagaacuucugaaaacagaaguaacagacccggcaguauugcggaaauuaugcaucgaagcgaaaauauccaauacaacaacugacuccagauguccgacgcaaggagaggcgacauuaguugaagaacaagaugccaauuucguguguagaagaacuuuuguugauagaggaugggggaauggaugugguuuauuuggaaaaggcagcuugaugacaugugcaaaauuuaaaugcguuacaaaacuggaaggaaagauaguccaguacgaaaacuugaaguacucgguaauaguaacugugcauacgggagaccaacaccaaguuggaaaugaaagcacagaacacgggacgacugcaaccauaacaccacaagcaccaucaacagaaauacaauuaacugauuacggugcacuuacacuagauugcagcccgcggacuggucuagauuucaaugagaugguacuccugacuaugaaggaaaaguccuggcuuguacauaaacagugguuccuugaucuaccacuacccuggacuucaggcgcgucgacuucacaagagaccuggaauaggaaagaucuuuuagucacuuucaaaaccgcacaugcaaagaagcaagaaguagucguguugggaucccaagaaggggcaaugcacacagccuuaacaggagccaccgaaauacaaacgucaggcacaaccacaaucuuugcuggucauuugaaauguagauuaaaaauggauaaguuaacacucaaagggaugucauaugucaugugcacuggcucauucaagcuagaaaaggaaguagccgaaacacaacaugguacaguauuaguccaaauaaaauaugaagguacggacgcgccguguaaaauaccuuucucaacacaggacgagaaaggaguaacccaaaauggcagauuaauuacugcuaauccaauaguaacagauaaagagaaacccguaaacauagaagcugaaccgccauucggagaaucguauaucgucaucggggcaggagagaaaacacuaaaguuaaguugguuuaagaaaggaaguaguauagggaaaauguuugaagcaacugcuagaggagcgaggaggauggcaauacuuggcgacacagcaugggacuuuggaucuauagguggaguuuucacauccguuggcaaguuaguacaccaaaucuuuggaacggcuuacggcguauuauucucaggagucucuuggacuaugaaaauaggaaucggcguauugcugacauggcuaggacucaauagucgaucgacgaguuuaucgaugacguguauugcaguaggacuugugacguuauacuuaggagucaugguucaagccgacagugguuguguaauuaacuggaaaggacgagagcuaaaauguggaucggggauauuuguuaccaaugagguucauacguggacugaacaauauaaguuucaagcagauucaccaaaacgauugucagcugccauaggaaaggcuugggaagaagguguaugcgggauuagaucagcgacgagauuggagaauauaauguggaaacagauaaguaacgaacugaaucauauccuauuagagaaugauaugaaauucacaguagugguuggagacguagcuggaauuuuagcucaagguaagaaaaugauuagaccucagccuauggaauauaaguacucauggaaaucauggggaaaagcgaaaauuauaggagccgauguucagaauacaacauucauuauugacggaccuaacacuccugagugcccagacgaccaaagagccuggaacauuugggagguagaagauuacgguuuugggauuuuuacaacuaauauauggcugaaguuacgcgacucuuacacccaaguaugcgaucauagacuaaugagugcagccauaaaagauagcaaggcuguucaugcagauaugggauauuggauugagucugagaaaaaugaaacauggaaacuagcacgcgcuagcuuuauagaaguaaaaacgugcaucuggcccaaaagccauacucuuuggaguaaugguguucuugaaagcgaaaugauuauacccaaaauauacgguggaccgauaucucaacacaauuauagaccuggguauuucacacaaacggcaggcccuuggcauuuaggaaaauuagagcuugauuuugacuuaugugaagguaccacugugguaguagaugaacauuguggaaaucgaggaccuucacuucgaaccacaaccguuacuggaaaaauaauucaugaauggugcugcagaucguguacacugcccccucuacgauuuaaaggagaagacggcugcugguauggcauggaaaucagaccgguaaaagaaaaagaagaaaaccuaguaaaaucaauggugucagcggggagcggcgagguagacucuuuuuccuuagguuugcugugcaucaguauaaugauugaagaaguaaugagaucgagauggucgcgcaaaaugcugaugacagggacauuagcuguuuucuuuuuacuaauuaugggacaauuaacguggaacgaccuaauaagauugugcaucaugguaggggcaaacgcaucagacagaauggggaugggcacgacauacuuggcacuaauggcaaccuuuaaaaugcgaccgauguuugcggucggacugcuauuucgucgacuaaccagcagagaagucuuauugcuaacaaucggacuaagccuuguggcaucgguagaacuaccaaauucacucgaggaacuaggggauggacucgcaauggggauaaugauacuaaaacuuuuaaccgauuuucaaucacaucaacugugggcuacacuguuaagccuaacauuuauuaaaacuacauucucuuuacacuacgcauggaaaacaauggcuaugguauugucaaucguuucacuuuuuccacugugucuaucuaccacaucgcagaaaaccacuuggcucccagucuuacuggguagucuuggcuguaagccucuuacgauguuccuaaucgcggagaauaagauauggggcagaaaaucauggccucuaaaugaaggaauaauggcgguaggcaucguaaguauucuguuaagugccuuacucaaaaaugaugugccguuagccgguccacuaauagcugguggaauguuaaucgccuguuaugucauuucgggaagcucugcggaccugagccuugaaaaagccgcggaggugaguugggaagaagaggcagaacacucgggagccucccauaauauccuaguagagguucaggaugacgguacaaugaaaauuaaggacgaagagagagacgacacgcuaacaauacuccuaaaagcgacguuacuagcaguuucagguguauacccacuaucgauaccugcuacacuguucguaugguacuuuuggcagaaaaagaaacaaagaagugguguauuaugggacaccccaagcccaccggaaguagaacgagcagucuuagaugauggaauauaucguauaaugcaaaggggacuuuuagguagaucucaaguugguguagguguauuucaagagaacguuuuucauaccauguggcauguuacgagaggcgcuguucuuaugcaccaggguaaaaggcuagaaccuucuugggccucagucaagaaagacuugauaagcuacgguggaggcuggcggcuacagggcucguggaacacaggagaggagguacaagugauagcaguugaaccagguaaaaaccccaaaaauguacaaacugcuccaggaacauucaaaacaagcgaaggagaaguuggagcuauugcgcuugacuucaaaccuggaacaucaggcagcccuauuguaaacagagagggaaaaauaguaggauuauauggcaacgggguaguuaccacaucagggaccuauguuucugcaauagcacaagccaaagcaagucaagagggcccacucccagaaauugaggaugagguguuucggaaacgcaaccucacgauuauggaucugcauccggguucugguaaaaccaggcgcuaucucccggcgauaguaagagaggcaauaaaacgaaaacuacgaacacuuauucucgcuccaacaagaguaguugccucugaaauggcagaagccuuaaaagguaugccaaucagguaccagacaacugcuguaaaaucugaacauacaggcaaagaaauagucgauuuaaugugccaugccacguuuacgaugagacuuuuaucacccguacgaguaccaaauuacaacaugauaauaauggaugaggcacacuuuacggacccuaguuccaucgcugcuaggggcuauauuagcacaagagucggaaugggugaagcagcagccauuuuuaugacugcaacgcccccagggucaguagaagcauucccacagagcaaugcaguaauucaggacgaagaaagagacauucccgaacggagcuggaacucgggauaugaauggaucaccgacuucccugguaaaaccgucugguuugugccaucaaucaaaucgggaaacgauauagcaaauugccuaaggaaaaauggaaagcguguaauucaacucucgcguaaaaccuuugauacugaguaccaaaagacgaaaaauaaugauugggacuauguggucacaacugauauuagugagaugggugcuaacuuuagggcagauagaguaauugacccgagacggugucuaaagccugugauuuuaaaagauggaccagagagaguaauacuagcuggcccuaugccgguuacuguugcaagugccgcacaacgacgagggcgaaucggaagaaaucauaauaaagaaggagaucaauauauauacaugggacagcccuuaaacaaugaugaagaucaugcgcauuggacggaagcaaaaauguuacuagauaauauuaauacgccagaaggcauaauaccugccuuguuugaaccggaaagagagaaguccgcagccauugacggcgaauaccgucuucgaggcgaagcuagaaaaacuuucguugaguugaugagacguggagaccuuccaguguggcuaucguauaaaguagcaucagaaggauuucaauauagugauaggcgauggugcuucgacggagaaagaaauaaccaaguauuggaagaaaauauggauguugaaauauggaccaaggagggagaaagaaagaaacucagacccagauggcuagaugcccguacuuauucagauccgcuagcucuaagagaguucaaggaauuugccgcaggcaggcgauccguuaguggagaucucauuuuggaaauagguaaacucccucagcacuuaacacaacgcgcucaaaaugcacuugauaaccugguaaugcugcauaacucagaacaaggaggcagagcauaccgacaugcaauggaagaauuaccugacacaaucgaaacacucaugcuuuuagccuugaucgcgguacucaccggggguguuacguuguucuuuuuaucaggacgaggguugggaaagacaucaaucggacuacugugugugauggcaucaucagugcuucuguggauggcgagcguagaaccacacuggauagcggcuucgauaauacuugaguucuuuuuaaugguacuacuuauaccugaaccggaucgucaaagaacaccacaagauaaccaguuggccuaugucguaauaggguuacuuuuuaugauucuaaccguggcggcuaaugaaaugggcuuauuagaaacuacgaagaaagaccuagguauagggcauguagcuguugaaaaucaucaucaugcugcaaugcuagacguagaucuucacccggcuuccgcauggacacuauaugcuguugccacgacuauuauaacacccaugaugagacauacaauagaaaauacaaccgcuaacaucucguuaaccgccauagcuaaucaagccgccaucuuaaugggcuuggacaaaggauggcccauaaguaagauggauauuggaguaccacuuuuggcauugggguguuacucucaaguaaauccucugacauuaacagcugccguacuaauguugguggcucacuaugccauaauuggacccggacuucaagcgaaagcaaccagagaagcacaaaaacgaacagcggcuggaauaaugaaaaauccaacaguggacgguauaguagcgauugaucuagacccagugguguaugaugcaaaauuugaaaaacaacuuggacaaauaauguuacuuauucugugcacaagucaaauccuuuuaaugaggaccaccugggcacugugugaguccauaacucucgcaacaggaccccugacaacucuaugggaaggguccccuggaaaauuuuggaauacuacaauagcaguuucuauggcuaauauauuucgugguucauaucuugcaggagcggguuuggcuuuuagccuaaugaaaaguuuaggaggagggcggcgagguacgggagcucaaggcgaaacacugggugagaaauggaaacgccaacuuaaccaacuuagcaaauccgaauuuaauacauauaagcguucuggaauuauggaaguagauagaucggaagccaaagaaggacuaaaaagaggagaaaccacuaaacacgcgguuucaagggguacggccaagcuaaggugguucguugagaggaauuuggugaaaccugaaggaaaggucauagauuuaggcuguggucgaggcggcuggucuuauuauugugcaggacucaaaaagguaacagagguaaaaggauacacaaagggagggcccggacacgaagaaccuauucccauggccacauacggauggaacuuaguaaaacuacacagcggcaaagauguguucuucauaccaccggaaaagugcgacacucuacuaugugacauuggagaaucaucgccaaauccaacaauagaagaaggccgaacacuacggguucuuaaaauggucgaacccugguuaagaggaaaucaauuuuguaucaaaauuuuaaauccguauaugccuucuguaguggagacuuuagagcagaugcaacguaaacauggcgguaugcugguuagaaauccauugucuaggaacucaacacaugagauguacuggguuucuugugggacgggcaauauuguuagugcuguaaauaugaccucacgaauguuacuaaaucguuuuacuauggcacaucgaaagccaaccuaugaacgagacgucgacuugggagcgggcacuagacauguagcggucgaaccagagguggcaaaucucgauauaauaggacagcgaaucgagaauauuaaacacgaacacaagucaacguggcauuaugacgaagacaacccauauaagacaugggcguaucauggaaguuaugaaguaaaacccagcggaucagcuagcaguauggugaauggcgugguaaagcugcuuacaaagcccugggauguuauaccuaugguaacucaaauugcaaugacugacacaacuccguuuggacaacaacgaguuuuuaaggagaaaguugacacuaggacaccaaaagcaaaacgagguaccgcucagauaauggaaguuacagcaaaguggcuauggggauuccuaucaaggaauaagaaaccacguauuuguacaagagaagaauuuacacgaaaggucagaagcaacgcagcaaucggagccguauuuguugacgaaaaccaauggaauagcgcaaaggaagccguggaagacgagagguucugggacuuaguacaucgagagcgagaauugcauaaacaaggcaaaugugccaccuguguuuauaacaugauggguaaaagggagaagaaacugggggaauuugguaaagccaaagggucaagagcaauaugguauaugugguuaggagcacguuucuuggaauuugaagcccuaggauuuaugaaugaagaccauugguuuucccgagagaauaguuugagcggcguugaaggagaagguuuacauaaguuagguuauaucuuacgcgacaucagcaaaauaccugguggaaauauguacgcugacgacacggcaggaugggacacccggauuaccgaagacgauuuacaaaacgaagcaaaaauaacagauaucauggagcccgaacaugcgcuacucgcuaaaagcauauuuaaauuaacuuaucaaaacaaggucguacgaguacaaaggccagccaaaaacggaacaguuauggacguaauuucgcguagagaccaaagaggaaguggacagguugggacguacggauuaaauacauuuacaaauauggaagcacaacuuaucagacagauggaaucggaaggaauauucagcccaagcgaacuggaaacuccuaacuuggcggggcguguuuuggauuggcuagagaagcacggcgucgagcgccuuaaacguauggcuauaucgggagacgacuguguuguuaaaccaauugacgaucgcuuugccgcugcauuaacggcucucaaugacaugggcaaaguucgcaaggacauuccccaaugggaaccauccaaagguuggaaugacuggcaacaaguucccuucuguagccaucacuuucaucaacucauaaugaaagauggucgagaaauagucgucccaugucgaaaccaggacgaacuggugggacgcgcacgggugucucaaggugcgggauggucauugcgagagaccgcaugccuuggaaaaucuuaugcacaaauguggcagcuaauguauuuccacagacgugauuuaagacuagcggcuaaugccauuuguucagcagugccgguagauugggucccgacaagccgaacgacuuggucuauacaugcgcaucaucaauggaugacaacagaagacauguugucggucuggaacagaguuuggauugaagaaaacccuuggauggaagauaaaacucauauaaguucauggggagauguaccauaucuagguaaaagagaggaucaguggugcgguucguugauuggacuaaccgcaagggcuaccugggcuaccaauauacaaguugcaauuaaccaaguacguagguugauugggaaugaaaauuaccucgacuacaugacuucgaugaaaagauuuaaaaacgaaagugaucccgaaggagcucugugguaa

SEQ ID NO: 21793 - RNA, 9879 nt, Artificial Sequence
  derived and/or modified CDS sequence (opt6) from DENV-1__GU131718__SS-prME
agcguaacuaugcuauugaugcucaugcccacagcucuagcuuuccaccuaacaacucgugggggugaaccacauaugauaguuacaaaacaagaaaggggaaaaagucuauuauucaaaacaagcgcuggcgugaauauguguaccuuaauagcuauggaucuuggugaauugugcgaagacacaaugaccuauaaaugcccgcgcauaacugaggcggaaccugaugauguagauuguugguguaaugcaacggacacauggguaaccuauggaacaugcucacaaacaggugaacauaggcgugacaaacgaagcguugcucuagcgccgcauguuggacuaggucuagaaacucgaacugagacuuggaugagcagugaaggagcguggaaacaaauucaaaggguugagacuugggcauugcgucaccccggauuuacgguuauugcacuauucuuagcacaugcgaucggaacaucgaucacacaaaaagguauaaucuuuauuuuauuaaugcugguaacucccaguauggcuaugaggugugugggaauuggaaguagagauuuuguagaaggcuugucaggugcgacguggguggacguugugcuagaacacgguaguuguguaacaacaauggcgaaagacaaaccaacuuuagacauagaacuauuaaaaacugaaguaacuaauccggcaguucuuagaaaauuaugcauagaggcuaaaauauccaauacuaccacagacaguagguguccaacacagggagaggcaacccuaauggaagaacaagaugcuaauuuuguaugccgucguaccuuuguagaucguggguggggcaaugguuguggacuuuuuggcaaagguucauuaauaacaugugccaaauucaaaugugugacgaaauuagaaggaaaaauagugcaauacgaaaaucucaaauauuccguaauaguaacaguccacacgggagaucaacaccaaguaggcaaugaaucaauugagcacggaacaacagcuacaauuacaccacaagcgccuacaucggaaauacaacugacagauuacggugcguuaacucuugauuguagcccccgaaccggauuagauuucaaugaaaugguucuacuaacaaugaaagagaaaucaugguuaguacacaaacaaugguuucuagacuuaccucuaccuuggaccucaggagcaaguacaucccaagaaacauggaacagacaagacuuacuuguuacuuuuaagacugcacacgccaagaaacaagagguaguaguucuaggaagucaagaaggagccaugcauacugcgcugacgggugccacggaaauucaaacaucagguaccacgacaaucuucgcaggacauuuaaagugucgucugaaaauggauaaacucacauuaaaaggaaugucauacguaaugugcacagguaguuucaagcuagaaaaggagguggcagagacgcagcacggcacuguacuggugcaaauuaaguaugagggaaccgaugcaccaugcaaaauaccauucagcacgcaggaugagaaaggugucacucaaaacggucgauuaauuacagcuaauccgauuguuaucgacaaggagaagccugucaacauagaagcugagccaccuuuuggcgagaguuauaucguuauaggagccggagaaaaagcgcugaaauuaucaugguuuaaaaaggggagcucuauaggcaaaauguucgaagccaccgcaagaggggcaaggaggauggcgauacuuggugacacugcuugggauuuuggcagcaucgggggcguuuuuacaucuauugguaaguuaguacaucaaaucuuuggaacggccuacggaguccuauucagcggagugucguggacgaugaaaauagggauaggaguuuuacuaacauggcugggccugaacagcagaaguacaucccuuaguaugacuuguauugcaguuggauuggugacucuuuaucuugguguaaugguacaagcggauucuggauguguaauuaauuggaaaggcagagaguugaaaugcggaaguggaauauucgucacaaaugagguccauacuuggaccgaacaauacaaguuucaagcggauagucccaagagacucucagcggcgaucgguaaagcgugggaagaaggagucuguggaauaaggagcgccacuagacucgagaauaucauguggaaacaaauuagcaacgaauuaaaccauauacuucuagaaaaugauaugaaguuuacuguugucguaggagacguugucgguauucuugcucaagggaagaaaaugauaaggccucaaccgauggaacauaaauacaguuggaaaagcuggggaaaagcuaagaucauaggcgccgacguucagaacaccacguucauaauugacggccccaauacaccggaaugcccggaugaucagagggcuuggaauauaugggaaguugaggacuacggauuuggaauauuuacgacuaacauuuggcucaagaugcgagacucauacacacaaguuugugaccauaggcucaugagugcagcuauaaaagacagcaaagcuguacaugcugauaugggauacuggaucgaaucagagaaaaaugagacguggaaguuagcgagagcuuccuuuauagaagugaaaaccuguaucuggccaaaaagccacacguuauggaguaacgggguccuagaaagugaaaugaucaucccaaaaaucuauggcggcccgaucucacaacauaacuauagacccggguauuucacucaaacggccggaccguggcacuuaggaaaacuagaauuagacuuugaccuaugugaaggaacaacgguaguaguggacgaacacugcgguaauagagggccuucacuuagaacaacuacugucacaggcaaaauaauucaugagugguguugcagaucuuguacuuuaccuccuuuaagauuuaaaggugaagacgguugcugguauggaauggaaaucaggccgguaaaagaaaaagaagagaaucuagugaagucaaugguauccgcagguagcggagaaguagauucauucucacugggauuauuaugcauuucaauuaugaucgaggaggugaugaggaguagguggagcagaaaaaugcuaaugacagguacuuuagcaguauuccugcuacuuauaauggggcaacucacauggaaugauuugauacgauuaugcauuauggucggcgcuaacgcauccgauaggauggggauggguacaaccuauuuagcacuaauggccacuuuuaaaaugcguccuauguuugcaguaggguuacucuuucgaaggcuaacaagcagggaaguccuauuacuaacuauaggacuuagucuaguagcgucaguggaauuaccaaauucccuagaggaauugggagacggacucgcaauggggauaaugauccuaaaguuacuuacggauuuccaaucacaucaguuaugggcaacuuugcuauccuugacauucauaaagaccacgcuaaguuugcauuacgcguggaaaacaauggcuaugguauuaucuauaguaagucuuauuccccuguguuuaagcacgacuucccagaagaccacauggcuaccaguacuccucggaucauuaggcugcaaaccuuuaacuauguuuuugauugccgaaaauaaaauaugggguaggaaaaguuggccacuaaaugaagguauaauggcuguuggaguugugucaauauugcucucuucacuacucaaaaaugauguaccccuagccggaccccugauagccggagguaugcuaaucgcuuguuaugucauaucugguaguucagcagauuuaucauuagagaaagcagccgaaguguccugggaggaagaagcggaacacaguggcgcaucucauaacauccuaguugaagugcaagacgaugguaccaugaaaauaaaggaugaagaacgcgaugauacucuaaccauacugcugaaggcaacucuccucgcaguuuccgggguauauccauuaucaauaccugcaacuuuguuuguuugguacuuuuggcaaaagaagaaacaacgaucaggaguucuuugggauacuccaucaccuccagaaguagaacgagcuguacuagaugaugggauuuaccggauaaugcaaaggggcuuguuaggaagaagucaaguagguguuggugucuuucaagaaaauguauuucauaccauguggcaugugacucguggagcuguucuuauguaucaaggaaagagacuugaaccauccugggcaucuguuaagaaagaccuaauaucguauggagguggauggcguuuacaagguagcuggaauacgggggaagaaguccaaguuaucgcuguagaaccuggaaagaaccccaaaaauguucaaacagcaccgggaacuuucaagaccccggagggggaagugggagcaauagcacuggauuuuaaaccugggacuucaggaucgccaaucguaaauagagaagguaaaaucguaggacuguacgggaacggagucguaacaacgagugguacuuacguaagugcaauagcacaggcaaaagcaagucaggaaggaccauuaccggagauugaggacgaaguguuucgcaaaagaaauuuaaccauuauggauuuacauccaggaagugggaaaacgaggcgauaucuuccggcuauaguacgagaagcgauuaaacguaaguuacgaacccugauucuagcuccaacacgaguagucgcuagugaaauggcagaagcacuaaaaggaaugcccauacgcuaucaaacuacugcagucaaaucugagcauacuggaaaagaaauaguagaucuuaugugucaugcuacuuuuacaaugagacuauuaaguccggucagagucccgaauuacaacaugauuauaauggaugaagcccacuuuacugaccccucgucgauagcugcuagaggcuacauaucaaccagagucgguaugggagaagcagcugccaucuuuaugacagcaacaccacccggaucagucgaagcauucccacaaagcaaugccgucauccaggaugaagaaagagauauaccagagagaaguuggaacucaggauaugaauggaucacagacuucccugguaagacaguuugguuuguuccauccaucaaaagugguaaugauaucgcaaauuguuuacggaaaaaugggaaaagaguuauacaacucucaagaaagacuuucgauaccgaguaccagaaaacuaagaauaaugauugggauuacgucguaacaaccgauaucuccgagaugggggcgaacuucagagcagacagagucauugauccuagacguuguuugaagccuguuauacuuaaagacggcccugaaagagucauacucgcaggaccgaugccggugacagucgcaucagcugcccaacguagggguaggauagguaggaaucauaauaaagagggagaccaauauauauauaugggccaaccacucaauaaugacgaagaucaugcgcacuggaccgaagcaaagaugcuacuugauaauaucaacacacccgaagguauuauccccgcucuguuugagcccgagcgagaaaaaucggcugccauagauggcgaauaucgccuacgaggagaggcacggaaaacauuuguggagcuaaugagaagaggugaccuuccgguaugguuaucauacaaaguagccagugagggcuuucaguacucagacagacggugguguuuugauggggaaagaaauaaucaaguacuagaggaaaacauggauguagaaauuuggaccaaagagggagaaagaaagaaauuacggccgagaugguuagacgccagaaccuacagugauccacucgcacugagggaauuuaaagaauuugccgccggaagaagaucaguuucaggagauuuaauuuuagagauagguaagcucccacaacauuuaacucagagagcccaaaaugcauuagauaaucuagugauguugcacaauuccgaacaagguggacgggccuaucggcaugcaauggaggagcuuccugauacuauugagacuuuaauguuauuagcauuaauagcaguacuaacuggcggaguaacuuuauucuuuuuaucgggaagagggcuugggaaaaccucaaucggacuccugugcgucauggcaagcaguguacuccuauggauggcaucaguugagccacauuggauugccgccaguauaauccucgaauuuuucuuaaugguauuguuaauuccugaaccggacagacaacggacuccccaagauaaccaauuggcuuacguaguaaucggguuauuauucaugauuuugacuguagcugcaaaugaaaugggccuacuggaaacgaccaagaaagauuugggcauugggcauguugccguagagaaccaucaccacgcaacuauguuggacguggaccuucauccugcaucagcauggacucuauacgcaguagccacuacgaucauaacaccaaugaugcgucauaccauagagaauacgaccgcaaacauuucacugacggcgauagcgaaucaagcggcuaucuuaaugggauuagacaaagguuggcccaucuccaaaauggauaucggcgucccucuuuuagcccuagguugcuauucacaaguaaacccacucacccuaacagcagccguuuuaauguuaguggcacacuaugcaauaauagguccugggcuccaggccaaagcgacccgugaagcacagaaaaggacagccgccgggaucaugaaaaacccaacaguggauggaauagucgccauagaucuggauccaguaguguaugaugccaaguuugagaaacagcucggacaaauaaugcuccuuauucuauguacaucucagaucuuguuaaugcgcacaacuugggcauuaugugaaucaauaacauuggcgacagguccgcuuacaacgcugugggaggggucaccaggaaaauucuggaauacuacaaucgcagugagcauggcaaacauuuuucggggaucauaucuugcaggagccggguuagcauucucucuaaugaaaucacuuggcggaggaagaagaggaacuggcgcucagggagagacucucggggaaaaguggaagagacagcucaaccaacuuaguaaaagcgaauuuaauauauauaagcgaucaggaauuauggaaguagaccgaagcgaagcgaaagaaggacuaaagagaggggaaaccacaaggcaugcaguaagcagagguacggcuaaguugcgaugguucguagagaggaacuuaguaaaaccggaagguaaagucaucgaucucggguguggaaggggagguuggucauauuauugugcuggacugaaaaagguuacagaaguuaaaggguauacgaaagggggaccgggacaugaagaaccuaucccaauggccacguacgguuggaacuuaguaaaacuucauucagguaaggauguauucuuuacaccacccgaaaaaugugauacacuccuuugcgauaucggagaaucgucaccaaauccuaccauugaagaaggcaggaccuugcguguacugaaaaugguagaacccuggcuacgcggaaaccaauuuugcauuaaaauauuaaauccauauaugcccucggucguagaaaccuuagaacaaaugcaaagaaaacacggaggaaugcuugugcggaauccacuaagcagaaacaguacacaugaaauguauugggucucgugcggcacuggaaauauuguaagugcuguaaauaugaccaguagaaugcuauuaaauagauuuacgauggcacaccgaaagccuaccuaugaaaaagauguggacuuaggugcagguaccagacauguugcuguggagccagagguggcgaaccucgacauaauuggacaaagaauugaaaacauaaaacaugaacauaagucaacauggcacuacgacgaagauaauccauauaaaaccugggcauaccacgguagcuaugaaguaaaaccuucgggaucugccucuucuauggucaauggaguaguaaaacuucucacgaaaccuugggauguuauaccgaugguaacccaaaucgcaaugacagacacaacacccuuuggucagcagagaguguucaaagaaaaaguagauacuaggacucccaaggcgaaaaggggaacggugcaaauuauggaaguuacggcgcgauggcucuggggauuccuuucccgaaauaagaaacccagaauaugcacucgugaagaauuuacuagaaaaguacgaucgaaugcagcaauaggagcuguuuuuguugacgaaaaccaauggaacuccgcuaaagaagcuguagaagacgaacgauucugggaucuugucaagaaagaacgagagcuucacaaacaaggaaaaugcgcaacaugcguuuauaacaugaugggcaaaagagaaaagaaacuuggagaguucggaaaagcuaaaggcaguagagcaauuugguauauguggcuuggggcucgauuccuggaguucgaggcauuaggauuuaugaaugaagaccauugguuuucgagagaaaacucuuuaucagggguugaaggagaggguuugcauaaauuaggauauauauuaagagauauaaguaaaauaccagguggaaauauguacgcugacgauaccgccgguugggacaccaggauuaccgaagaugaccuucaaaaugaggcaaagaucacagacauaauggagccugaacaugcgcuauuggcgacaagcauuuuuaaauuaacauaucagaauaaaguagucaggguccagaggccugccaaaaauggcacgguaauggauguaauaagcagacgagaccagagaggaaguggccaaguaggcacauaugggcuaaacacauuuacuaacauggaggcacaacuaauacgucaaauggagucggaaggaaucuuucuaccuagugaauuggaaacacccaauuuagcagaacguguauuagauuggcuggaaaaauacggaguagaacgacuuaaaagaauggcaauaucaggggaugauuguguugucaaaccuauagaugaucgcuuugccacugcgcuuacagcguuaaacgauaugggaaaagugcgaaaagacauuccgcaaugggaaccuagcaaagguuggaaugauuggcaacaaguaccguuuugcucacaucauuuucaucaacuuauaaugaaagacggaagggaaauagucguaccuuguagaaaccaagacgaauugguggggagagcucgaguuucucaaggcgcuggauggucacuaagggagacagcaugccuagggaaaucauaugcgcaaauguggcaacugauguacuuccacagaagagaccuacgacuagccgcaaaugcaauuuguucagcgguuccgguggauuggguaccuacaagccgcacaacaugguccauucacgcacaucaucaauggaugaccaccgaagauauguuaaguguguggaauagaguuuggauagaagaaaacccguggauggaggacaagacucacguuucaucuuggggagauguaccauacuuagggaaaagagaagaucaaugguguggaagccuaauaggauuaacggcuagggccacaugggcuagcaauauacaaguggcuauaaaucaaguaagaagauuaauagggaacgaaaauuacuuagauuauaugacguccaugaaaagguuuaagaacgaaggagauccugaaggggcguugugguag

SEQ ID NO: 21794 - RNA, 9879 nt, Artificial Sequence
  derived and/or modified CDS sequence (opt6) from DENV-1__GU131720__SS-prME
aguguaacaaugcuauuaaugcuuaugcccacugcacuggcuuuucacuuaacaacuagagguggagaaccccacaugauugucacuaagcaagaacggggaaagucacuauuguuuaaaacuucagcuggagucaauaugugcacacugauugcuauggauuuaggggaacuaugcgaagauacgaugacuuacaaguguccacgaauaacggaggccgaaccggaugacguagauugcugguguaaugcaacagauaccuggguaaccuauggaaccugcagccaaacaggggaacaccguagagacaaacggaguguugcacucgccccucauguuggucuaggacuagaaacacguacagagacuuggaugucgucagaaggugcauggaagcaaauacagagaguagaaacaugggcucuacgacauccaggcuucacugugauugcacuauuccuggcccaugcaauagguacaucaauaacacaaaaaggcauuauauuuauacucuuaaugcuaguaacacccucgauggcuaugcggugcgugggcauuggauccagagauuuuguagaaggacucagcggugcaacguggguggauguugucuuagaacauggaucauguguaacaaccauggcuaaagauaaaccuacuuuggacauagaacugcucaaaacagaaguaacaaauccugcaguucuacguaaauuauguauagaggcuaagauaucaaauacaacaacagacaguagaugcccaacacaaggggaagcaacgcuaauggaagaacaagaugcuaacuucguuugcagaaggacauucguagacagaggaugggguaacggcuguggauuauucggaaagggaucuuuaauaacaugcgccaaauuuaaaugcguaacaaaauuagaaggcaagaucguccaauacgagaacuuaaaauauucaguuauuguaacaguacacacgggggaccaacaucaaguaggcaaugaaagcacugaacauggcacuaccgcuacaauaaccccucaagcaccgacuucagaaauacaacuuaccgauuauggugccuuaacucuagacugcucaccuagaacugguuuagauuuuaacgaaaugguauuguuaacuaugaaagaaaaauccugguuaguccacaaacagugguucuuagaucucccguugcccuggaccaguggagcgaguacuucacaagaaacauggaaucgccaggaucuguuagugacuuuuaaaaccgcccaugcaaagaaacaagaaguuguaguguuggggagccaggaaggugcaaugcauacugcauugacaggagcaacggagauacaaacgucugggacuacgacaauuuuugcuggacauuuaaaaugucguuugaagauggacaaauugacccuaaaggggaugaguuaugugaugugcacugguagcuuuaaacuagagaaagaaguggcagaaacccagcauggaacagucuugguacagauuaaauaugaagggacagacgcaccuugcaagauaccauucagcacacaggacgaaaaaggaguaacacagaaugggagauuaaucacagcaaauccuauagugacagacaaggaaaagccuguaaauaucgaagcagaaccacccuucggagagucguauaucguaaucggggcuggcgaaaaagcucuaaaguuaucuugguuuaagaaaggcucauccauuggaaagauguuugaggcuacagcacgcggagcucguagaauggcgauacucggugacaccgccugggacuucggaucuguaggugggguuuuuaccucaguagggaagcuagugcaccaaauauucggaacugcuuacgggguucuauucaguggaguuucguggaccaugaagauaggaauuggaguucuauugacauggcuuggucuaaauucgagaagcacgagucugaguaugacauguauugcuguuggucuagugacccuguaucuagggguaaugguacaggccgauagugggugcguuauaaacuggaaaggucgugaauugaaauguggaucaggaauuuuugugaccaaugaaguacauacguggacagaacaauacaaguuucaagcugauagcccaaaaagauuauccgcagccauaggaaaagcaugggaagaagguguaugugguauacggagugccacucgucuagaaaacaucauguggaaacaaauaaguaaugaauuaaaccauauucugcuugaaaacgauaugaaauuuacagugguuguuggcgaugucguuggaauuuuggcacaaggaaagaaaaugauaagaccgcagccuauggaacauaaguacaguuggaaaagcugggguaaagcaaaaauuauuggagcggacgugcaaaacaccaccuucauaauagaugguccaaauacuccggagugcccugaugaucaacgagccuggaauaucugggagguugaagauuacggcuucggaauuuuugccacuaauauuugguuaaaauugagagauucuuauacacaaguuugcgaucauagauuaauguccgcugcaauuaaagacaguaaggcaguacacgcggauauggguuauuggauagaaucagagaaaaaugagaccuggaaguuggcucgagcuucguucauagaaguaaagacauguauuuggccgaaaucacacacuuuaugguccaauggaguguuggaaucugagaugaucaucccaaaaaucuaugggggaccgauuagucagcauaacuauaggccagguuauuuuacgcaaacagcaggccccuggcaccuaggaaaacucgaauuagauuuugaccucugcgagggaacuacaguagucguagaugaacauugcggaaaucgcgggccaagucuccggaccacaacugucaccgguaagauuauucacgaaugguguuguagaagcugcacauuacccccauugagauuuaagggagaagauggaugcugguauggcauggaaaucagaccaguaaaagaaaaagaggaaaaccuaguuaaaaguaugguaucagcagguucgggugagguagauucauuuucuuuaggacuauuauguaucucgauaaugaucgaagaaguaaugcgaucuagguggagccgaaaaauguuaaugacaggcacacuugcaguguuucugcuguuaaucaugggacagcucacauggaaugaucuuauccgccuaugcauuauggucggagcaaaugcuagcgauagaauggguaugggaacuaccuacuuggcccuaauggcaacuuuuaagaugaggccuauguuugcaguuggccuacuauuuagaagacugacaaguagggaaguucucuuauugacaauaggucucaguuuaguugcuuccguagaacuaccuaauucacuggaagaacuaggugauggauuagcaaugggaaucaugauauugaaacuacuuacagauuuucaaucccaccaauuaugggcgacacuuuuaucacuaacguuuauaaaaacaacguugagccuccauuaugcuuggaagacaauggcuaugguuuuaucuauuguaucucuauuuccacuaugucuuagcacuacgagccagaaaacaacaugguugccuguauugcuaggaucuuuuggauguaaaccucuuacaauguuucucauuacagaaaacaagaucuggggcaggaaaucauggccacuaaacgaaggaaucauggcuguuggaguaguuucaauccuucuaucauccuuauugaagaacgauguaccguuggcuggaccucuuauugcaggggguauguuaauugcaugcuacguaauaucagguucauccgcugaucucagccuagaaaaagcagccgaagucucuugggaagaggaagcugaacauagcggcgcaagccauaacauauuaguagaagugcaggacgauggcacuaugaaaauaaaggacgaagaacgagaugauacuuuaaccauacuccucaaagcuacgcugcuugcaguuagugguguauauccacuaucgaucccggcuacucuuuuuguuugguacuucuggcaaaagaagaagcagcgaagugguguuuuaugggauacucccaguccaccagaaguagagagagcugucuuagaugaugguauauauagaauuaugcaaagaggauugcuaggaagaagccaaguuggaguaggcguauuucaagaaaacguauuucauacuauguggcaugugacuagaggcgcgguacugauguaucagggaaagcgauuagaaccguccugggcgucuguaaagaaagaccuaauuuccuauggagguggauggagguuacaaggaucauggaacacuggggaagaagugcaaguaauagccguugaacccgguaaaaacccgaaaaacguucaaacggccccagggacauuuaagacuccagagggagaaguuggagccauagcauuggacuuuaagccggggacgucaggaucacccauugugaacagggaaggaaaaauuguggggcuguaugguaacggcgucgugacaacaagcgguaccuaugucagcgcuaucgcacaggcaaaagccucucaagaaggaccguuaccagaaauugaagaugaagucuuucgaaagagaaauuuaacuauuauggacuuacacccuggaagcggcaaaacccgaagauauuuaccagcaauaguuagagaagcaauaaagaggaaauugcgaacauugauacucgcuccaacgagaguaguugcgagugaaauggcugaagcacuuaagggaaugccuauuagauaucaaacuacugcugugaaaagcgaacauacuggcaaggaaauaguggacuuaaugugucacgcuacguucacuaugcgucuacuuucgccaguacgaguuccgaauuacaauaugauaaucauggaugaagcgcauuuuacugauccuucuaguauagcagcaagaggguacauaagcacacgaguaggaaugggggaagcugcagccauauuuaugaccgcuacaccuccugguucuguggaagcauuuccacagucuaaugcagugauacaagaugaggaacgcgauaucccagaacgaucuuggaacaguggauaugaauggaucacagauuuuccaggaaaaacgguaugguucguacccagcauaaaaucuggaaaugacauagcuaauuguuugaggaagaacggcaaaagaguaauacaacuuagucgcaaaacguuugacaccgaauaccagaagaccaaaaauaaugauugggacuacgugguuacaacugacauaucagaaaugggagcuaacuuccgagcugauagggucauagauccacgccgcugccuuaaaccaguuauccuaaaggacggcccggaacgcguuauauuggcaggaccaaugccuguaacaguagcuucagcggcccaaagaagaggcaggauuggaagaaaucauaauaaagaaggagaucaauauauuuauaugggucaaccucuaaauaaugaugaagaccacgcgcacuggacagaagccaaaaugcuauuagauaacauuaauacuccagaagguauaauacccgcacuauucgagccagaaagggaaaagagcgccgccauagauggugaauauagauugcggggugaggcaaggaagacguuuguugaauuaaugcgaagaggggaccucccaguuugguuaaguuauaaaguagcgagugaaggauuccaauauucagaccgcagaugguguuuugacggggagagaaacaaccaaguacucgaagaaaauauggauguugaaauauggacaaaagaaggcgaacgcaagaaacuacggccccguugguuagacgcaagaacguauucagacccccuagcucugagagaauuuaaagaauuugcggcaggacgaaggucaguaagcggagaccuuaucuuagaaauagguaaacugccacaacaucucacucaaagggcacaaaaugcauuagauaaccucgucaugcuucacaauucggaacaaggcgguagggcuuaccgacacgcaauggaggaauuaccggauaccauugaaacauugauguuacuggcacugauagcagucuuaacuggcggaguuacgcuauucuuuuuaucuggacgcggccuagguaagacaagcauaggccuauuaugugugauggcaucuucgguccuucuuuggauggcaagcguugaaccccacuggauagcugcaucgauaauuuuagaguucuuucuaaugguacuacuaauuccagaaccugauagacaacgaacaccucaagauaaucaacuagcauaugugguuaucgguuuacuguuuaugauacuuacuguagcggcgaacgagaugggguuguuggagacuacaaagaaagaucuaggaauuggacauguagcuguugagaaucaucaccaugcaacuaugcuugacgucgaucuccacccggccagugcauggacacuauacgccguagcuacuacuaucaucacgccuaugaugcgucacaccaucgaaaacacaacagccaacauaucucuaacugcgauugcaaaucaggcagcaauacuaaugggguuagauaaagguuggccuauaucuaagauggacauaggaguaccauuguuagccuugggguguuauucccaagugaacccguugacuuugaccgcugccguacuaaugcuuguagcacauuacgcaauuauugguccagggcuccaagcaaaggcgacacgagaggcucaaaaacgaacugcagcagggauaaugaagaaccccacaguggacgggaucguugcaauagauuuagaccccgucgucuaugacgcaaaauucgaaaaacagcuuggacaaauuauguuacugauauuaugcaccucacaaauucuacuaaugcgaaccacaugggcgcuuugcgaaagcauaacacucgccacgggccccuuaacgaccuuaugggaagguuccccagguaaguuuuggaauacgacaauagcuguaagcauggcaaauauuuuuagaggaagcuauuuagcaggagcaggacuagcguuuaguuuaaugaaaucauuaggaggugguagaagaggaaccggcgcacaaggagagacacucggagaaaaguggaaaagacaauugaaccaacuaucaaaaucggaauuuaauauuuauaagagaagcgggaucauggaaguagaccgaucugaagcuaaagagggucuuaaacguggagaaacaacacgacaugcaguaucacguggcacugcgaaacuucggugguuuguagaaagaaauuuaguaaagccagaagggaaaguuaucgaucuuggaugcgguagaggaggauggaguuacuauugugccggacugaagaagguuacagaagucaaaggauacaccaaggguggaccggggcacgaggaaccgaucccaauggcaacuuauggauggaaccuaguuaaacuacauagugguaaggacgucuucuuuacucccccugaaaaaugugauacgcugcuaugugauauaggugaaucaucaccgaauccuaccauagaagaaggacgaacauuacgaguuuuaaaaaugguagagccaugguuaagagguaaucaauuuugcauaaaaauccucaaccccuauaugccuagcguagucgagacacuagaacaaaugcaaagaaaacauggcggcauguuagugagaaauccccuuagucgaaacucuacacacgaaauguacuggguaucaugugguacggguaacauaguguccgcaguuaacaugaccucucgaauguuauuaaaccgauuuacuauggcucaucguaaaccgacauaugagagagauguagacuuaggggcgggaaccaggcauguggcggucgagccugaggucgcaaauuuagauauaauuggacagcgaaucgaaaacaucaaacacgaacauaaaucaacauggcacuaugacgaagauaacccauacaaaaccugggcauaucacgggaguuaugaaguaaagccuuccggguccgcgaguagcaugguaaaugguguaguuaaauuauuaacgaaaccuugggacguaauucccaugguuacgcagauugcaaugaccgauacaacuccguucggucaacaaaggguauuuaaggaaaaaguagacacucgaacuccaaaagcaaaacguggcaccgcacaaauuauggaaguaacggcccgauggcugugggguuuccucaguagaaauaagaagccaaggaucuguacaagggaggaguuuacucgcaaaguaagaucuaaugcagcaaucggcgcaguguuuguugaugagaaucaauggaauagcgcuaaggaagcaguugaagaugaacgauuuugggaccugguucagaaagaacgagaacuacauaaacaggguaagugugcgacuuguguguauaacaugauggguaaaagagaaaagaaguugggugaguucgguaaagcaaaaggaucucgggcaauuugguauauguggcuaggagcgagguucuuagaauuugaagcgcuugguuuuaugaacgaggaucacugguuuagcagggaaaauagucuuaguggaguugaaggagaaggucuacauaaauuaggauauauauuacgagacauuucaaagauaccuggcgggaacauguaugcagaugacacggcaggaugggacacacguaucacugaggaugaucuucaaaaugaagcgaaaauaacagauauaaugaagccggagcaugcucuguuagcaacgucaauauuuaaguuaacauaucaaaauaaaguuguucggguccagaggccagcuaaaaaugggacuguaauggauguuaucucccgaagagaucaaaggggaucaggucaaguggggacguaugguuuaaauacauuuacuaauauggaagcccaguuaauaaggcaaauggaaucagaggguauauuuuugccgucggaauuagaaacaccgaaccuagcugaaagagucuuagauugguuagagaaauacgguguugaaagauuaaagcgaauggcaauuaguggugaugauugcgucguuaagcccauugaugaccguuucgcaaccgcuuugacagcucugaacgacauggguaaaguucgaaaggauaucccucaaugggaacccucgaaaggauggaacgauuggcagcaaguucccuucuguagccaccacuuccaucaacuaauaaugaaagauggaagagaaaucguaguacccugucgaaaucaggaugagcuagugggacgagcacgagucucacagggcgcagguuggucauuacgagaaacugcuugcuuaggcaaauccuacgcccaaauguggcaacuaauguauuuucacaggagggauuuacgacuugcggcuaacgcuauaugcagcgcaguuccgauugacugggucccaacgucuagaaccacauggucuauacaugcccaccaucaguggaugacgacggaagauauguuaucaguauggaaccguguauggauagaagaaaauccuuggauggaagauaaaacgcacguaucgucauggggagaugucccguaccuagggaaaagagaagaucagugguguggauccuuaauaggacuaacugcucgagcgacaugggcaucaaauauccaaguggcgauaaaccaaguucgaagacugauagggaaugaaaauuaucuagacuauaugacaaguaugaagagauucaaaaaugaaggagacccugaaggcgcgcuaugguaa

SEQ ID NO: 21795 - RNA, 9879 nt, Artificial Sequence
  derived and/or modified CDS sequence (opt6) from DENV-1__HM181960__SS-prME
ucgguuacaauguugcucauguugaugccaaccgcgcuugcuuuucaucuuacaacacgagggggagaaccacauaugaucguaucuaaacaagaacgggguaaaucgcuucuauuuaaaacuucagcaggaguaaauaugugcacucuaauagcaauggacuuaggugaacuaugcgaagauacuaugaccuacaaauguccaagaauaacggagacagagccagaugauguagacuguugguguaaugcaacugacacuuggguaacguauggaacguguagucaaacaggcgaacacaggcgcgacaaaagaaguguagcacuugcaccacauguaggguuaggauuagaaacuagaacugagaccuggaugaguuccgaaggagcguggaaacaaauacaacgaguagaaacaugggcucuacgacauccuggauucacuguaauugcgcucuuuuuggcacaugcgaucggcacaucaaucacacaaaagggaauaauuuucauccuccuaaugcuaguaaccccaucuauggccaugcgauguguaggcauagguucacgcgauuucguugagggacuuaguggagcuacguggguagacguuguacuugaacacggcuccugcguuacgacuauggcaaaagauaagccaacgcuagauauagagcuauuaaaaacugaagucacaaacccagcgguccuaagaaaauuauguauagaagcuaaaauaagcaauacuacuacagauaguagaugccccacacaaggugaggcaaccuuaguagaagaacaagaugcaaauuuuguauguagaagaaccuuugucgauagaggaugggggaacggcugcggacuguuuggaaaagguaguuugaucacaugugcuaaauuuaaaugugugacaaaauuagagggaaagauuguucaauaugaaaaccuaaaauacaguguaauugucacuguacauacaggagaucaacaucaaguggguaaugagucaacugaacacgguaccacagcaacaauaacgccacaagcucccacaacagaaauucaacuuacugacuauggcgcuuuaacacuagacugcaguccucggacuggacuugacuucaaugaaaugguucuucugacaaugaaggaaaagucaugguuaguacauaagcaaugguucuuggaucucccgcuaccauggacaucaggagcauccacgagucaagagacauggaaucgccaagauuuauuaguaacauucaaaaccgcgcaugcaaagaaacaagaagugguagucuuaggaucacaagaaggugcaaugcacacagcuuuaaccggcgcaacagaaauccaaaccaguggcacaacaaccauauucgcuggccacuuaaaaugucgacuaaaaauggauaaacuaacauugaaaggaaugaguuacgugaugugcaccggaucauucaaacuagaaaaagagguggcagaaacucaacacggcaccgucuuggugcaaauuaaauacgaaggcaccgaugcaccuugcaaaaucccauucagcacucaggacgaaaagggaguaacccaaaaugguagauugauaacggcuaacccuauagugaccgacaaagaaaaaccgguaaauaucgaagccgagccuccuuucggcgaaucauauauaguuaucggagccggugaaaaggcacucaagcuaaguugguucaaaaagggaucgaguauaggaaagauguucgaggcaaccgcaagaggagcacgaagaauggcaauacuuggugacacagcgugggacuuuggaucgaucggcggaguguucacaagcgucgggaagcucguacaucaaaucuucggaaccgccuauggaguguuauucagcgguguuaguuggacgaugaaaauaggaauuggaguauuauuaacaugguugggacugaacucacgaaguacgagucuuagcaugacauguauagcuguaggauuggugacccuuuaccuuggcguuaugguacaagcagacagcggauguguuauaaauuggaaaggccgagaguuaaaguguggaucagguauauucgucacaaacgaaguucauacuuggacugaacaguauaaauuccaagcagauucuccaaaaagauuaagcgcugccauaggcaaagcaugggaagagggaguaugcgguauucgaucugcgacucgacuagaaaacaucauguggaaacagaucucaaaugagcuaaaucacauauuauuagaaaaugauaugaaauuuaccguaguagucggagaugucgcgggcauucucgcccaagguaaaaagaugauucgaccgcaacccauggaguacaaauacuccuggaaaaguugggggaaagcaaaaauaaucggcgcggauguucaaaauacaacuuuuaucaucgacggcccgaacacaccggaauguccagaugaucaacgagccuggaauauuugggaaguggaagauuaugguuucggaauauuuacuacgaauauaugguuaaaacuacgcgauagcuacacgcaggucugugaucacaggcuaaugagcgcagcaauaaaagacucgaaagcaguucacgcagauaugggcuauuggauugagagcgaaaagaacgagaccuggaaauuagcucgugccagcuuuauagaagucaagacguguauauggccgaaaucacauacauuguggaguaacggaguacuagagucagaaaugauaauaccaaaaauauacggggguccuaucucgcaacauaacuacagaccuggauauuuuacccaaacggcaggaccguggcauuuaggaaaacuugaauuagauuuugauuuaugugaagggacaacaguaguuguugaugaacauuguggaaacagaggacccaguuuaaggacuacuaccgucaccgguaaaauuauccacgagugguguugucggaguugcacucucccaccacuaagauuuagaggagaagacggaugcugguacggaauggaaauaagacccgugaaagaaaaagaagaaaaccuaguaaaaucaaugguaucggcuggauccggagaaguggauuccuuuagucuuggacugcuuuguaucaguauuaugauagaagagguaaugagaagccgauggucuagaaaaaugcucaugacggguacgcuggcuguguucuuucuuuuaauaaugggccaguugacuuggaacgaucuaauacggcuauguaucaugguuggggcaaaugcaagcgaccguaugggaaugggaacgacuuauuuggcacugauggccacuuucaagaugcgaccaauguuugcuguuggccuucuauuccgcagacuuacaagccgcgaaguucuauuacuaacuauaggauuaucucucguagcaucaguugaacuaccaaacucucucgaagaacuuggcgauggauuagccaugggcauaaugauucuaaaguugcugacagacuuucaaagccaucaacuaugggcaacauuauuaaguuugacauuuaucaagacaaccuuuucccuucauuaugcguggaaaacuauggcaaugguccucucgauuguuagcuuauucccgcuaugccuuagcacaacaucucaaaagacaacuuggcuuccuguccuucuuggaucauuaggaugcaaaccacuuaccauguuucuaauagcagagaauaagaucugggguagaagaucguggccccuaaacgagggaauaauggcuguuggcauuguaucuauacuguuaucgagucuuuuaaagaaugauguuccuuuagcgggaccgcuaauugcuggugguaugcuuauagcauguuaugucaucagugguucuagcgccgaccuaucguuggaaaaagcggcagaggugaguugggaagaagaagcggaacacucuggggcuagucacaacauauuaguagagguucaagacgacggcaccaugaaaaucaaagaugaagaacgcgaugauacacuaacuauacucuuaaaggcaacauuauuagccguauccgguguguauccguugucaauuccagcuacauuauuuguuugguacuucuggcagaagaagaaacagcguuccggaguauugugggacacacccucuccacccgaaguaggcagagcaguauuagacgacgggauuuaucguauuaugcaaagaggcuuacuaggcagaagucaggucggcguagguguauuucaagaaaaugucuuucauacaauguggcacguaacgcgaggagcgguucucauguaucagggcaaaagacucgaaccaagcugggcauccguuaagaaagacuuaauaaguuauggagguggauggcgacugcaaggaucauggaauacaggugaagagguccaaguuauagcuguugaaccagggaagaaccccaaaaauguacaaacggcgccaggcacguucaaaacuccagaaggggaaguaggagcaauagcucucgacuuuaagccaggaacgaguggaucuccuauaguaaauagggaaggaaagauuguaggacuuuacggaaaugguguugucaccaccucggggacuuaugugucagccauagcacaggcuaaagcgucucaagaagguccauugccugaaauagaagaugaaguauucagaaaaaggaauuuaacaauuauggauuuacacccagguucaggaaaaacacggagguacuuaccagcuaucgugagagaagcaauaaagagaaaauuacguacauuaauccuggcuccaacuagaguaguugcauccgaaauggcggaagcgcucaaggggaugccaauacgguaucaaacaacagcaguaaaaucagagcauacagguaaagaaaucguugaucuaaugugccacgcaaccuucacaaugagacucuuaucaccaguacgaguucccaauuauaauaugaucauuauggaugaagcucauuucacagauccaucuucaauagcggcuagggguuacauaaguacuaggguaggaaugggagaagcugcggcuauauucaugacggcaacgccaccaggcaguguggaagccuucccacaaucuaaugcaguaauacaggacgaagaaagggauauaccagaaaggaguuggaacucagguuacgaauggauuacagacuuuccggggaaaacaguaugguucguaccaucaauaaaaaguggaaacgacauugcaaacuguuugaggaaaaaugguaaaaggguaauccaacugucgagaaaaaccuuugauacagaauaucagaaaacgaaaaacaacgacugggauuacguaguuaccacugauauaagugaaaugggagcaaauuuuagggcagauagggugauagacccaagacgcugucuaaagccuguuauucugaaagacggcccugaacgcguaauccuagcaggcccaaugcccguaacaguugcuucagcagcgcaaaggaggggcagaaucggaagaaaccacaacaaagaaggcgaccaauauaucuacaugggacaaccccuaaauaacgaugaagaucaugcccacuggacugaagcuaagaugcuccuagauaacauaaauacuccagaagggaucauccccgcauuauucgaaccugaaagggaaaaaucagcagcgauagauggggaguaucgauugaggggagaagcucguaaaacauucguagaguuaaugagacgaggagaucuuccuguuugguuaucguauaaggucgcaucggaaggauuucaauacucagacagacgaugguguuucgacggagaacgcaauaaucaaguuuuagaggaaaauauggacgucgagauauggacuaaagaaggugaaagaaagaaacuuaggccccggugguuagaugcaaggacuuacagugauccguuagcccuaagagaauuuaaggaguucgccgcuggacggcgaucuguaaguggcgaucuaauccuagaaauaggcaaguugccucaacaccuaacccaaagggcacagaacgcgcucgauaaucuagucauguuacauaacagcgaacaaggagguagagcguauaggcaugcaauggaagaauugccugauacuauagagacuuuaaugcuucuggcauuaaucgcagucuuaaccggcggugugacccucuucuuuuuaagugggcgcggcuugggaaaaacaagcaucgggcuauuaugugucauggcgucuaguguuuugcucuggauggcuucaguugaaccucauuggauagcagccucuauaauacucgaguucuuucugaugguucuacucauaccagaaccggauaggcaacguacaccgcaggauaaucaauuggcauauguaguuauuggguuacuuuuuaugauuuugacuguugccgcaaacgagaugggucuacuugaaacaaccaagaaagacuuaggaauaggacacguggcaguagagaaccaucaucacgcugcgaugcuggauguagacuuacaucccgcuagugcguggacauuguaugcaguggcgacgacuauaauaacaccaaugaugagacauaccauagaaaauacuaccgcuaauauuuccuugaccgcaauagcaaaucaagcagcuauccuuaugggucuagauaaaggcuggccuaucucaaaaauggauauaggugucccucuacuagcgcucggguguuacucccaaguaaaucccuuaacucuaacugccgcgguauugauguuaguugcccacuaugcuauuauaggaccuggcuuacaagcaaaagcaacacgggaagcacaaaaacgaacagccgccggaauaaugaaaaacccaacuguagauggcauuguggcuaucgaucuagauccaguaguuuaugacgcuaaauuugagaagcaauugggacaaauaaugcuauugauccuguguacuagccaaauacucuuaaugagaacuacgugggcucuaugcgaaucaauuacuuuagcuacuggaccgcuaacaacauuaugggaagggucuccuggaaaauuuuggaacacgacaauagcaguuucaauggcgaauauuuuucgaggauccuaccucgcaggagcggguuuagcuuuuucucuuaugaagagucucggaggagggcgacgaggaacgggggcgcaaggugaaacgcuuggugaaaaguggaaacgacaguuaaaucaauuauccaagucugaauuuaacacuuauaaaagaucugguauaauggagguggauagaucagaagcaaaagaaggacuaaaaagaggggaaacuaccaaacacgcaguaagcagaggcaccgcuaaguuaaggugguucguugaaagaaauuuagucaagccggagggacgggucauugaccuaggaugugggcguggcgguuggucuuauuauugcgcaggucuaaagaaaguuaccgaaguuaaaggauacacaaaaggaggaccaggacacgaggaacccauaccgauggcgaccuauggguggaaucuuguaaaacuacacucuggaaaggaugucuucuuuaucccaccagaaaaaugugauacuuuauugugugacauaggagaaaguucaccuaauccaacaauagaggaaggccgcacacuaagagugcuuaaaaugguggaaccauggcuuagggguaaucaguuuuguaucaaaauuuuaaacccguacaugccauccguggucgagacucuagaacaaaugcaaagaaaacauggugggauguuaguuaggaacccuuuaucucguaauagcacucaugagauguacuggguuaguuguggaacuggcaauauaguuucagccguuaacaugacgucaaggaugcuacuaaauagauuuacaauggcccacaggaaacccacguacgaacgagacguagauuuaggugcagguacgaggcauguagccguagaaccugaaguagcuaacuuagauauaauaggucagaggauagagaauauaaagcacgaacauaaauccacauggcacuacgaugaggacaauccuuauaaaacaugggcauaucacgggucuuaugaaguuaaaccaucagguagugcaagcaguauggucaacggaguuguaaaauuacuaacuaaaccaugggacgugauuccaauggugacacaaauagccaugacugauacuaccccguuuggacaacaacguguauuuaaagaaaaaguagauacccgaacgccgaaagcuaaacgugguacagcucaaauaauggaaguaacugccaagugguuguggggauuuuuaagccguaacaagaaaccacgcauauguacgcgagaggaauuuacuagaaaagugcgaucaaaugcugcuaucggagccguauuuguugaugaaaaucaauggaauagugccaaagaggcaguagaagacgaaagguucugggauuuaguucacagagaaagggaacuucacaaacaggguaaaugcgcaacguguguuuauaacaugaugggaaaaagagagaagaaauugggugaguucggaaaagccaaaggcaguagggcaauuugguauaugugguuaggcgcgagauuccuagaauuugaagcccuuggauuuaugaacgaggaccauugguucucuagagaaaacucacuaagcggagucgaaggcgaaggccuucauaaauuaggguacauuuuaagagauauaucaaaaaucccaggugggaauauguacgccgacgauacagccgguugggauacucgcauuacagaagaugaccuacagaaugaagcacgaauaaccgauauuauggaacccgaacaugcucuuuuagcuaaaucuauauuuaaguuaacuuaccaaaauaaaguaguacguguccaacguccagcuaagaaugguacuguuauggauguuauuucccgcagggaucaaagagguaguggccagguaggaacuuauggacuaaauacuuucacaaacauggaagcccaauugauaagacagauggaauccgaaggaaucuucaguccuagcgaauuggaaacuccaaacuuggcagaaagagugcuagacugguuggaaaaauacggggucgaacgacucaaaaggauggcuaucaguggagaugauugugugguuaagccaauagacgauagauucgccacagcgcuaacggcguuaaacgauauggguaagguccgaaaagacaucccacaaugggagccaagcaagggauggaacgauuggcaacaaguaccuuucugcucgcaucauuuccaucaacuuauuaugaaagacggacgagagauugucguuccauguagaaaucaggacgaguuaguagguagagcuagagucagccaaggcgcagguuggucacuucgcgaaacugccuguuuaggaaaaucauacgcucaaauguggcaauugauguacuuucacagaagagacuuaagauuggcagccaaugcaauauguucagcaguaccuguagacuggauucccaccuccagaaccacaugguccauccaugcucaucaccaguggaugacaacagaagacaugcucucagucuggaauagaguauggaucgaagaaaauccguggauggaggauaaaacccacauuucaucauggggcgauguuccauacuugggcaagcgggaggaucaauggugcgguucacuuauuggauugacagcuagggcuacaugggcuaccaacauacaaguggcaauaaaucaaguaaggagguuaauuggcaacgagaacuaccuagauuauaugacgucaaugaagagauucaaaaaugagagcgauccagaaggagcguuaugguga

SEQ ID NO: 21796 - RNA, 9879 nt, Artificial Sequence
  derived and/or modified CDS sequence (opt6) from DENV-1__HM181963__SS-prME
agcgucacuaugcuucuuauguugaugcccacugcgcuggcguuucaucucacuacgcgagguggugaaccacauaugaucguaaguaaacaagaacgggggaaguccuuacuauuuaaaacuucagcuggaguuaauauguguacacuuauugcuauggaucuaggagaauuuugcgaagacaccaugacuuacaaaugcccgcgcauuacggaggcugagccugaugacguggauuguuggugcaaugcaacugacacgugggugacuuacgggacuuguagccaaauuggagaacaucgaagggacaagagaucaguagcgcucgcaccucaugugggacuuggacuagaaacaagaacagaaacuuggaugagcuccgaaggagcauggaaacaaauccaacggguggaaacaugggcacuucggcacccuggauucacgguaauugcacuuuuucuugcacaugcuauaggaacgagcauaacccaaaaagggaucauuuuuauauuacuaauguuaguaacacccucuauggcaaugaggugcguaggaaucggaucacgugauuuuguagaaggucuuucaggggcuacuuggguugacguuguacucgaacacggaucaugugucacaaccauggcuaaagauaaaccaaccuuggauauagagcugcuaaaaaccgaagugacaaauccagcuguauuaagaaaacuauguauagaagcuaagauaucaaauacgacuacugauucacgauguccaacacaaggagaagcuacccuaguagaggaacaagaugcgaauuuugucugucguaggacauucguagauagaggauggggaaaugguugcgguuuauuuggaaagggaucguuaauuacaugcgcaaaguuuaaaugcgucacaaaacuagagggcaaaaucguucaguaugaaaauuuaaaauauucaguaauagucacaguccauacuggagaucaacaucagguuggcaaugaaaguacagaacaugggacuacugcgacaaucacaccccaggcuccaaguaccgaaauacagcuuacagacuauggugcacuaacucuagauuguucucccaggaccggcuuggauuucaaugagaugguuuuacugacaaugaaggagaaaucguggcuugugcauaaacaaugguucuuagaucuaccacuacccuggacaaguggagcaaguacuagccaagaaacuuggaaucggcaagauuuauuaguaacauuuaaaaccgcucacgcaaagaaacaagaagucgucguucuggguucgcaagaaggagccaugcacacugcauuaacaggagccacugagauccagacaaguggaacgacaacaaucuuugcuggucaucucaaauguagacuuaaaauggacaaacuaacgcuaaaaggcaugucauacguuaugugcacgggcuccuuuaaacuagaaaaagaaguagccgagacgcaacaugguaccgugcucguacaaaucaaauaugaagguacagaugcaccauguaaaauaccuuucucaacccaagaugaaaaaggaguaacucaaaauggcagauuaauuacagccaauccaaucgugacagauaaagaaaagccaguaaacauugaagcagagccaccuuuuggagaaaguuacauuguaaucggaguuggagaaaaagccuuaaaacucaguugguucaaaaagggaucgucaauagggaaaauguuugaagccacugcucgaggagccagaagaauggcuauccuaggagacacagcuugggacuucgguagcauagguggcgucuuuacaagcguugguaaauuaguacaccagauauuugguaccgcuuacggaguacuauuuucaggagucagcuggacaaugaagaucggaauuggaguucuccuuacauggcuuggauuaaauucccgaucgacaaguuugucuaugaccugcauagcgguuggguuagucacguuguaccuaggagucaugguacaagcugauucggguuguguaauaaauuggaaaggcagagaacuuaaaugcgguagugggaucuucguaacaaaugagguacacaccuggacugaacaauacaaauuucaggcagauagucccaaaagguuaucugccgcaauaggcaaagcaugggaggaaggaguaugugguauaagaagcgcuacuagauuggagaacaucauguggaagcagauaaguaaugagcucaaccauauauuguuagaaaaugacaugaaguuaacugucguugugggugacguagcgggcauacuagcacaaggaaagaaaaugauaaggccgcagccuauggaauauaaauauagcuggaaaucauggggcaaagcuaaaauaauaggagccgacguacaaaauacaacauuuauaaucgauggaccaaauaccccagaaugcccggaugaucaacgagcauggaauauaugggaaguagaagacuacgguuuuggaaucuuuacaacaaacauuugguugaaauuacgagauuccuauacacaaguuugugaccauagauugaugagugcagcgaucaaagacagcaaagcuguccaugcugauaugggauauuggaucgaaucugagaaaaacgaaacauggaaacucgcacgggccaguuucauagaaguaaagacgugcaucuggccuaaaucacauacguuauggaguaacgggguccuugaaucagaaaugaucauucccaaaaucuauggugguccaaucucgcaacauaauuaccgaccuggauauuucacccaaacagcuggccccuggcauuuagggaaguuagagcuagacuuugacuuaugugaaggaacaacugugguagucgaugaacauugcggaaaccguggaccauccuuacggacgacaacuguaacagggaaaaucauccaugaaugguguugcagaucauguacucucccaccgcuaagguuuaagggagaagauggaugcugguaugggauggaaauaagaccggugaaggagaaagaagaaaaucuaguaaaaucgaugguuuccgcugggucuggcgaaguugauagcuucucgcuaggauuacucugcauaucaauuaugaucgaagaaguuaugagaaguagaugguccagaaagauguuaaugacugggacucuagcaguauucuucuuauugauaaugggacaguuaacuuggaacgauuugauacggcuauguauaauggucggugcaaacgcuucagauaggaugggaaugggaacuaccuauuuagcuuuaauggcuacuuuuaagaugagaccaauguuugccguaggucuacuuuuuagacgauugacaagucgagaaguuuugcuauuaacaauuggucuaagucuaguagcuucgguugaacucccaaauucccucgaggaacuaggagauggacuagcuaugggcauaaugauuuugaaauuguuaacagauuuucagucacaucaacuaugggcaacacuucuuaguaugacauuuauaagaacuacguuuucacuacauuaugcauggaaaacuauggcuauggucuuaagcaucgugucacuuuucccuuuguguuuaucaacaacgucgcagaaaacaacauggcucccaguauuauuagggagccuugguuguaagccacuaaccauguuuuuaauugccgaaaauaagauuuggggacguaaaucauggccauuaaaugaggggauaauggcgguagggauugugucaauuuuacuaagcucucuacuuaaaaaugacgugccguuagcgggcccgcucaucgcggguggaaugcucauagcaugcuauguaauuagcgggucaagugccgaccugaguuuggaaaaagcagcagucguaaguugggaagaagaggcagaacauaguggggcaucucauaauaucuuaguggaaguucaggaugauggcacuaugaagauuaaagaugaggaacgggaugauacacuaacuauacuauuaaaggcaacccuuuuggcaguaaguggaguauacccgcuuaguauaccugcaacacucuuuguaugguacuucuggcagaagaagaaacaacggucaggcguauuaugggauacaccgucuccuccugaaguagaaagagccguauuggaugacggaauauaucguauaaugcaaagaggauuauuaggacgaucccaaguagguguggguguauuucaagagaacguauuucauacgauguggcacguuacacgaggcgcggucuuaauguaccaagguaaaagauuggaaccaaguugggcuucaguaaagaaagacuugauaaguuauggcggggguuggagacuccaaggaaguuggaacacuggagaggagguacagguuaucgcgguugaacccgggaaaaauccgaaaaauguccagaccgcucccggaacauucaaaaccucagagggcgaaguaggugcgauagcgcuagauuuuaaacccggcacaaguggaaguccuaucguuaaucgugaagguaaaguaguugggcuauauggaaauggcguugugacuacaagugguaccuaugucucugcaauagcccaagccaaagcgucacaagagggcccuuugccagagauagaagacgaagucuuucggaaacggaacuugacaauuauggacuuacaucccggaucggguaaaacaagaagauauuuaccagcgauagugcgagaagcaauaaaacgcaagcuaagaacucuaauucuugcacccacaagagugguggcaagugaaauggcggaagccuugaaaggaaugcccauucgcuaucaaacaacagccgucaaaagcgaacacacuggaaaggaaauaguagaucuuaugugucaugcaaccuucacaaugcgucuauuaucuccuguucguguuccgaauuauaauaugauaaucauggaugaggcucauuucacagauccgaguucgauagcugcaagaggauacauaagcacucgcguaggcaugggugaggcagcugcuauuuucaugacugcgaccccaccgggcagcgucgaagcguuuccacaaaguaaugcaguaauacaagaugaggagagagauauaccagaaagaucauggaacucagguuaugaguggauaaccgacuuuccaggcaagacaguaugguucguaccuucaauaaaaagugggaacgauauugccaauugucuucgaaagaaugguaaaagaguaauacagcucucaagaaaaacuuucgacacugaauaucaaaagacaaagaauaacgauugggacuacguaguuacaacggacauauccgaaaugggagccaauuuccgagcugauagagugauagacccaagacguugucuaaaacccguaauauuaaaagaugguccagaaagggucauacuggccgguccuaugccuguaacuguagcuuccgcagcacagcgaaggggccggauaggacguaaucacaauaaagaaggcgaccaguauauuuacaugggacaaccauuaaacaaugaugaggaccaugcacauuggacugaagcaaaaauguuacuagauaacauuaauacucccgaagguauuauaccagcucuguuugaaccagaacgcgagaaaagcgcugcaauagacggagaguacagauuacguggagaagcaagaaaaacauucguggaacuaaugagaaggggugaccuaccagucuggcuguccuauaagguagcaucagaaggauuucaauauucugaccgaagauggugcuuugauggugaacggaacaaucaaguacuugaagagaauauggauguugaaauauggacuaaagaaggggaacgaaagaaauugagaccacgauggcuagacgcacgcacauacucagacccauuagcgcuucgagaauuuaaagaauuugcugcaggaagaagaucagucucaggggauuuaauacuggaaaucggaaaacuuccgcaacacuugacucaacgagcucaaaaugcuuuagacaauuuaguaaugcuacauaacagcgagcaagguggaagggccuaccgccaugcaauggaagaauugccagacacaauugaaacguugaugcugcucgcguuaauagccguucuuacagguggcgugacguuguucuuucugucuggucguggauuagguaaaacaucaauaggccuucucugcgugauggcgagcaguguacuauuauggauggcuucaguagagccacauuggauagcagcgucuaucauccuagaguucuuucuuaugguucuauuaauucccgaacccgauagacaaagaacaccucaagauaaucaguuagcauaugucguaauugguuuacuuuuuaugauucugaccguugcggcuaaugaaaugggguugcuugaaaccaccaagaaagauuuagggaucggucacguagcaguugaaaaucaccaccaugcagccaugcuagauguggaccuacacccugcuagugcuuggacauuauaugcaguagcuacaacaauuauaaccccuaugaugcgacacacuauugagaacacuacugcaaauauaagucugacugcaauagccaaccaagcagcgauauuaaugggacuagacaaaggauggccaauuucgaaaauggacauaggaguaccucuguuggcgcuagguuguuauucgcagguaaauccucucacacuuaccgccgccgugcuuauguugguagcacacuacgcaaucauaggaccaggucuacaagcaaaggcuacaagagaggcacagaaaaggaccgcagcugggauaaugaaaaacccgacuguagauggcauuguugcuauagauuuagacccugugguguaugaugccaaauucgaaaagcaauuaggacaaauaaugcuacugauuuuguguacuucacaaauucuauuaaugcguaccaccugggcucuuugcgagucaaucacgcuugcuacggguccguuaacgacuuuaugggaaggaucuccuggcaaauuuuggaauacaacaauagcagucucaauggcuaauauauucagggguaguuauuuagcuggugcuggcuuggcguuuagucuaaugaaaucauuaggcgguggucgcagaggaacuggugcccagggugaaacacugggagaaaaauggaaacgucaacuaaaucaauuaucgaaaucagaauuuaacacauauaaaagaucgggaauuauggaaguagaccgaagugaggccaaagaggggcuaaaacguggagaaaccaccaaacaugcgguuucacgagggaccgcaaaacuuaggugguucgucgagagaaaucuuguaaaacccgaaggaaagguaauagauuuaggauguggaaggggcggauggucguacuauugcgccggccuuaagaaaguaacagaagucaaaggauauaccaaaggaggucccggucaugaagaaccuauucccauggcaacuuacggauggaaucuuguaaaauuacauucagguaaagacguauucuuuauacccccagaaaaaugcgauacccugcuaugugauauaggugaaucgaguccaaacccuacgauugaagaggggaggacccuaagaguucuuaagaugguggaaccauggcuccgugggaaucaauucuguauuaaaauacugaacccauacaugccuucugugguggagacgcucgaacaaaugcagcgaaaacacggcggaauguuaguacgaaacccgcuaagccgaaauucuacacacgaaauguauuggguuucguguggcacggguaauauuguaagcgcaguuaacaugacaaguagaauguuacuaaaucguuuuacuauggcccaccguaagccuacauacgaacgagacguugauuugggugcuggaacacgacacguggcugucgaaccugaaguggcuaauuuagacaucauaggucaaagaauugagaauauaaaacaugagcauaagucuacuuggcacuaugaugaggauaauccuuauaagacuugggcguaccaugggucauaugaaguaaagccaagcgguucagcaucaucuaugguaaaugguguaguuaaauuacuuaccaaaccaugggauguaaucccuaugguuacccaaauagcgaugacggacacuacgccauuuggacagcaaagaguuuucaaggaaaaagucgauacaaggacgccaaaggcaaaacgaggcacggcacaaauaauggaagucacagcaaaaugguuauggggauuuuuaagccgaaacaaaaagccccggaucuguaccagggaagaauuuacuagaaagguuagaagcaaugcagccauaggagcuguuuuuguagaugaaaaucaauggaacucagcuaaagaagccgucgaagaugaaagguuuugggauuuaguucacagagaaagagaacuacauaaacaaggaaagugugcaaccugcguauacaacaugauggggaaaagagaaaagaaauugggagaauuuggcaaagccaaagguucuagagcgauaugguauauguggcuuggagcgcgguuuuuagaguucgaagcgcuaggauuuaugaaugaagaucauugguucucuagagaaaauagccuaaguggaguugaaggggaaggucuucauaaacuaggauacauccuaagagacauuucuaaaauaccgggcgguaauauguaugcugaugacacagcagguugggacacaaggaucacugaagaugaucuucaaaaugaggcaaagauaaccgacauaauggaaccggaacaugcccuauuagcuaaaucuauuuuuaaacuaacauaucaaaauaaaguaguuagagugcaacgaccggccaagaauggcaccguuauggacguaaucucuaggagagaucaacgaggaucuggacagguagggacauauggcuuaaacacauucacaaacauggaggcacaacucauacgacaaauggaaucggaggguauauuuucaccaagugaacuggaaaccccaaauuuggccgguagagcccuagauugguuagagaaacaugggguugaaagguuaaaaagaauggcaaucagcggugacgacugcgucguaaagccaauagacgacagauucgcuacagcauugaccgcucuuaaugauaugggcaaaguucgaaaagacauaccacaaugggaaccaucuaagggauggaacgacuggcagcaagugccuuuuuguucgcaccauuuucaccaauuaaucaugaaagauggucgagagauaguaguaccuuguagaaaccaagacgagcuugucgguagagcaagaguaucccaaggagcaggguggucacuccgggaaacugccuguuuggguaaauccuacgcccagauguggcaguugauguauuuucaucgacgcgacuugagacuagccgcaaaugcaauauguucggcugugccgguugauuggguuccgacgagucguacgacuuggucuauacacgcccaucaccaauggaugacaacggaagauaugcuaagugucuggaaucgcguuuggauugaggagaacccguggauggaagauaagacacacauuaguagcuggggcgacgugccguaucuaggaaagagagaagaucaauggugugguagccucaucggacuaacagccagagcgacaugggcaacaaacauacagguugcaauuaaucaaguacgucgguuguuaggaaaugagaauuacuuggacuauaugacgucuaugaagcgcuuuaaaaacgaguccgacccagaaggugcccucugguaa

SEQ ID NO: 21797 - RNA, 9879 nt, Artificial Sequence
  derived and/or modified CDS sequence (opt6) from DENV-1__HM181964__SS-prME
ucgguuacuauguuauugauguuaaugcccaccgcauuagcguuccaccuaaccacacgaggaggagaaccacauaugaucguaucaaagcaagaacgugguaaaucucuucuuuuuaaaacaagugcaggggugaacauguguacucuaauagcaauggacuuaggcgaguuaugugaagauacaaugacguauaaguguccacggauuacggaaacggaaccagaugauguugauugcuggugcaaugcgacggacacuugggucacuuacgguacauguucgcaaaccggcgaacauagaagagauaaacgcagcguagcacuugcuccacaugugggccucggacuagaaacacgaacagagacuuggaugucaagcgaaggagcauggaaacaaauccaaagaguagaaaccugggcacuaagacacccgggcuucacggugaucgcacuauuucuugcucaugcaaucggcacauccaucacccaaaaaggaaucauuuuuauccuauugaugcuaguaacuccgucuauggcaaugcguuguguaggaauuggaucacgggacuuuguugagggcuuaucaggggcaacuuggguagacguagugcuggaacacgguuccugcguaacaacaauggcaaaagauaaaccuacacuggauaucgagcucuuaaaaacagagguaacgaaucccgcaguauuacgaaaauuguguauagaagcaaaaaucucaaacaccaccacagacucccguuguccaacacaaggagaagcgacauuaguagaggaacaagacgcaaacuucgucugucguagaaccuuuguagauagggguuggggcaacggcugcggacuauuugggaaagggagucucaucacaugcgcgaaguucaagugcgucaccaaauuagaagggaaaauugugcaauacgagaaucugaaauauagcguuauagugacaguucauacuggagaucaacaccaaguaggaaaugaauccacagaacauggcacaaccgcgacgauaacaccgcaggcacccacgaccgaaauacaacuuacagauuacggugcacuuacucuugacuguucaccgcgaacuggacuagacuuuaaugaaauggucuuauugacaaugaaagaaaaaucuugguuaguacauaaacaaugguuucuagacuuaccgcuuccauggacaaguggcgcuucaacaagccaagaaacguggaacagacaagaucuauuagugacuuuuaaaacagcacacgcuaagaaacaagaaguuguaguccuaggaagccaagaaggggcgaugcauacagcauugacuggggcaacugaaauacagaccagugguacgacaacaauuuucgccggacaucuaaaaugcagauugaaaauggauaaacucacacugagagguauguccuacguaauguguaccggcagcuuuaaacucgaaaaagaaguugcagaaacacagcacggaaccgucuuaguacaaauaaaauaugaaggaacagaugcgccuugcaaaauacccuuuucuacacaagacgagaagggaguuacacaaaauggccgguuaauuacagcaaauccuauuguaacggauaaggaaaagccaguaaauauagaggcagaaccgccauuuggagagucuuauauagucauaggcgccggagaaaaagccuuaaaacucuccugguuuaagaaagguaguaguauaggcaaaauguucgaagcaaccgccaggggugcucguaggauggcuauccuaggagacacugcaugggauuucggaaguauugguggcguuuucacaucagugggcaaauuaguacaucaaauauucggcacggcauacggaguauuauuuucaggaguuucuuggacuaugaaaauagguaucggcguccuccuuacuuggcuaggauugaauagucggucuacuucauugagcaugacuugcauagcuguaggauuggucaccuuauaucugggcguaauggugcaggccgacucgggguguguuauaaauuggaaaggaagagaauuaaaaugugggucugguauauuuguaacaaaugagguacauacauggacagagcaguauaaauuccaagcugauucuccaaaacguuuaucagcugcuauuggcaaggcaugggaagaaggaguuugugguauucgaagugccacacgccuagaaaauauuauguggaaacaaaucaguaacgaacuaaaccauaucuugcuagaaaaugauaugaaguucaccgugguggugggagauguggcggggauccucgcccagggaaagaaaaugauuaggccacaaccaauggaauacaaauacaguuggaaaucauggggaaaagcgaagauaauuggagccgacguucaaaauacaacuuucauaauugauggucccaacacgccggagugcccagaugaucaacgagcguggaauauaugggaaguggaagacuauggauuugguauuuucacuacgaacaucuggcuaaaguuaagagacaguuauacacaggugugugaucacagauuaaugucggcagcaauuaaggacucuaaagccgugcaugccgauaugggauauuggauagagagugagaagaaugagacauggaaauuggcaagagcaucguuuauagaagugaagacaugcauuuggccaaaaucucacacccuauggaguaauggugugcuagaaucggaaaugauaauaccuaaaaucuauggaggaccaaucagucaacauaacuaccgaccaggcuauuucacgcagacugcaggacccuggcaucuaggcaaacuagaauuagauuuugaucucugugaagggacgaccgucguaguagaugaacacugugguaauagaggaccaagucugaggacaacaacuguaacaggaaaaauaauccaugaauggugcuguagguccuguacucuacccccuuugcgcuuuagaggugaagauggcuguugguaugguauggaaauucgacccguaaaggaaaaagaggaaaacuuggugaaaaguaugguaucugcgggcaguggagaagucgauucguuuucacucggacuuuuauguauuaguaucaugaucgaagaaguaaugcguaguagguggucgcgcaagaugcugaugacagguacauuagcuguauuuuucuuauuaauuaugggacaacuuacguggaacgauuugauacguuuauguauaaugguaggggccaaugccucagauagaaugggcaugggcacuaccuaucuggcucucauggcgacuuuuaaaaugcgaccuauguucgcaguugggcuguuguuuagacgauuaacaucgcgugaagugcugcugcugacuauugguuuaucacucgucgcuucgguugaauuaccaaauagucucgaggaacucggagacggccuagcgaugggaauaaugauccucaaacuccucacugacuuccaaagucaccaauugugggcuacauuacucucacuaacauucauaaagacaacauuuucguuacauugcgcauggaagaccauggcgaugguacucucuaucguaaguuuauuucccuugugcuuaaguacgacgucgcagaaaacuaccugguugccgguuuuauugggaucuuuagggugcaaaccguuaacaauguucuuaauagcagaaaauaaaauauggggucgacgaucauggccuuuaaacgaagggauaauggcaguugggauuguuucgauauuguugaguucucuccuuaaaaacgauguaccccuagcugguccgcuaauagcaggaggcauguuaauugcauguuauguuauuucugggagcagugccgaccuaucauuagaaaaggcagccgaaguaucuugggaagaagaagcugaacauaguggcgcuucucauaacauacuuguugagguucaagacgaugguacaaugaaaauuaaagacgaggaacgagacgauacgcuaacaauacuuuuaaaagccacacuucuggcuguuuccggcguguacccacuaaguauacccgccacacuguuugugugguauuuuuggcaaaagaagaaacaaaggucagguguacuaugggacacuccgagucccccugagguugaacgagccguucuugacgaugggauauacagaauaaugcaaaggggauugcuuggcagaucacaaguaggcguaggaguauuccaagaaaacguguuucauacaauguggcacguuaccaggggcgcaguacuaauguaccaaggaaagaggcuagaaccaucuugggcuucuguaaagaaagaccuuauuucauacggcggaggguggagacugcaaggaucauggaacacgggggaagaaguucaaguuauagccguagaacccggcaaaaacccgaaaaacguacaaacagcaccuggaacauuuaaaacuccagaaggagaaguuggugcaaucgcauuggauuuuaaaccagguacaagcggaaguccgauuguaaauagagaaggcaagauuguuggcuuauauggaaacgguguaguaacaacuucagggacauauguaagugccauagcacaagcaaaagccucacaagagggccccuuaccagaaauagaagacgaaguguuccguaaaagaaauuuaacaauaauggaucuucauccaggaucaggaaaaacuagacguuaccuaccagcgauuguacgcgaagccauaaagcggaaacuaagaacauuaauccuugcuccaacacguguaguugcaagcgaaauggcggaagcucuuaaagguaugccgauaagauaucaaacaaccgcaguaaagucagaacauacaggcaaggaaauaguagaucuuaugugucaugcuacauuuacaaugagacugcuaaguccggugaggguaccgaauuauaacaugauaauaauggaugaagcccacuucacugauccuucgagcauugcggccagaggauacauuucaacacgaguggguaugggugaagcagcggcaauuuuuaugacugcaacgccacccgguagcguggaagcguucccuuuaagcaaugcugugauccaagaugaagagagagauauaccagaaagaucauggaacucuggcuaugaauggauaacagauuuuccaggaaagacaguuugguuugugccuucaauaaagucuggcaaugauauugcuaauuguuuaagaaagaauggaaaacgaguuauacaacucagucgaaaaacauucgacacagaauaucagaaaacuaaaaauaaugacugggauuacguuguaaccacagacauuucugagaugggagcgaacuuccgagcugaccgaguuauugacccaagacguuguuuaaaaccaguaaucuugaaagacggcccagagagaguaauauuagcaggaccaaugccugucacaguggcgucagcagcacaaagacgugguagaaucggaaggaaccacaacaaagaaggagaucaauauauauacaugggucagccucuaaacaaugaugaagaucacgcucauuggacugaggcgaaaauguuacuagauaacauuaauacaccugaagggaucauacccgcauuguuugaacccgagcgggagaaaagcgcagccauagauggggaauaccgauuaagaggagaagcacguaaaaccuuuguggagcugaugcgaagaggagaucugccagucuggcuuucguauaaaguugcuuccgaggguuuucaguauucagaccgucguugguguuuugauggugaacguaauaaucaaguauuagaagaaaacauggaugucgaaauauggaccaaagagggcgaacguaagaaacuaagaccucguuggcucgaugcgagaaccuauucggauccuuuggcuuuacgugaguuuaaagaauuugcagccggcaggaggaguguaucgggagacuugauucuugaaauaggaaaacuuccacaacaccuuacacaaagggcccagaacgcgcucgacaauuuggucaugcuacauaacagugagcaaggaggucgagccuauaggcacgcaauggaggaguuaccagauacaauugaaacacugaugcugcuugccuuaaucgcaguucugacaggagguguuacgcuguuuuucuugagugggagaggauuaggaaagacaaguauaggauuauuaugcguuauggcaucguccgucuuacuauggauggcuucuguugaaccucauuggauagcggccuccauuauccucgaguucuuucuuaugguauuauuaaucccggaaccagauaaacaaaggacuccacaggacaaccaauuggcuuaugugguaaucggauugcuauuuaugauauugacaguggcugcuaaugaaaugggacuguuagaaaccacgaagaaagaccugggaauaggacauguagcuguugaaaaccaucaucacgccgccaugcucgacguggauuuacacccagcgucagccuggacauuauaugcaguagccacaaccauaauuacaccaaugaugcgccauacaauugagaauacaacagccaacauaucccuaaccgccauagcgaaucaagcggcaauacucaugggccuugauaagggauggcccauuucaaaaauggauauaggaguaccucuccuagcacuaggcugcuacucucaagucaauccauuaacauuaacagcagccguccuuaugcuagucgcucacuacgcgaucauaggaccgggccuccaagcuaaggcuacuagagaggcccaaaagagaacggccgcgggaauaaugaagaauccaaccguggacggcaucguagcuauagaucuggacccuguaguuuaugaugcuaaauucgaaaagcagcuaggccaaaucaugcuauuaauacuauguacaagccaaauacugcuuaugcgaacgaccugggcacuuugugagucaaucaccuuggcuacaggcccuuugacuacgcuuugggaaggaaguccagguaaauuuuggaauacgacgaucgcaguaucgauggcaaauaucuuuagaggaucuuaccuagccggugcuggccuugcguuuagccuuaugaaauccuuaggaggugggcgaaggggcacuggagcacagggagaaacucuaggugagaaauggaaaaggcaacuuaaucaacuauccaaaagugaauuuaauacauauaagaggucggggauaauggaaguugacagaucugaggcuaaagaaggguugaaaagaggugaaaccacgaaacaugcaguuucuagaggcacagcgaaguuaagaugguucguugaacgaaaucuaguaaaaccagaaggaaaggugauugaucuugggugugggagggguggauggagcuauuauugcgcaggccuuaagaaaguuacagaaguuaaaggguauacgaaaggagggcccggacaugaggaacccauaccaauggcuacauauggcuggaauuuaguaaaguuacacucuggcaaagauguuuucuuuaucccaccagaaaaaugugauaccuuacuaugugauauuggagaaaguucuccuaauccaacgauagaagaaggccgaacgcuccgaguccuuaaaauggucgagcccuggcucaggggaaaucaauucugcauuaaaauacuaaaucccuauaugcccucugucguugaaacauuggagcaaaugcaaaggaaacacggaggaauguuagugcguaaucccuuaaguagaaauaguacacaugaaauguauugggugucaugugggacaggaaauauaguuucugcuguaaacaugacaucgagaauguuacuaaauagguucacuauggcccacagaaaaccaacauacgagcgagauguugauuugggcgcaggaaccaggcauguggcuguugagccugaaguugcuaaucucgauauaauaggucaacgcauagaaaauauaaagcaugaacacaaaucaacguggcacuacgaugaagacaaccccuauaaaacgugggcuuaucacggcucauacgaaguaaaaccuaguggaagcgccaguucaauggucaacgguguuguaaaauuguuaacaaaaccaugggauguuauaccaaugguuacccaaauugcaaugacagacacuacucccuucggccagcagcguguauuuaaagaaaaagucgacacucgcacaccuaaggcaaaaagagggacugcacaaauaauggaggucacggcuaaaugguuauggggcuuccuaagccgaaacaagaaaccaagaauaugcacucgagaagaguuuacccgaaagguccgaaguaacgcagcuauuggagcagucuuuguagacgaaaaccaauggaacucagcaaaggaagcagucgaagacgaaagauuuugggaccuaguacauagggaacgagaacuucacaaacaggggaagugugcgaccugcguauacaauaugauggguaaaagagagaaaaaguugggagaguucggaaaagcuaaagguagcagggcuauuugguauaugugguuaggagcgagguuucuagaauuugaggcacugggauuuaugaacgaggaccacugguuuuccagggaaaauucacuaagugguguggaaggugaagggcuucacaaacucggguauaucuuacgagauauaagcaaaauuccagggggaaacauguacgcagacgauaccgcaggcugggauacaagaauaacagaagaugaccuucaaaaugaagccaggaucacugauauaauggagcccgaacaugcacuacuggcgaaaucuauauucaaacuaaccuaucagaacaagguuguacguguacagaggcccgcgaaaaacgggacgguuauggacgugaucagcagacgggaccaaagaggaucgggucaaguaggcacuuaugggcuuaauacauucacgaacauggaggcucaauuaauucggcaaauggaauccgaagggauauucucaccgagcgaacuugaaacacccaacuuggcagagagaguccucgacuggcuugagaaauaugggguagaaaggcucaagagaauggcaauaagcggcgacgauugcguagugaaaccuaucgacgaucgauuugcgacggcacuaaccgcuuugaaugauaugggaaaagugcgaaaagacauaccacaaugggaaccaucaaaaggauggaaugacuggcaacaagucccauuuugcucccaucacuuucaucaacucauaaugaaagacggaagagaaauugugguuccguguaggaaccaagacgaacuuguugguagggcgagaguuucacaaggggccggauggucgcuaagggagacagcaugucucggcaaaucuuaugcacaaauguggcaacucauguauuuccacagaagggauuuaagauuagccgcaaacgcaauauguucggcgguaccgguagauuggauacccacaagccguacuacuuggucgauccaugcgcaccaccaguggaugacuacugaagacauguuaagcgucuggaauaggguauggauagaagaaaacccguggauggaagacaaaacucacaucaguagcuggggagauguuccauaucucgggaaacgugaagaucaguggugugggagucucauuggcuuaaccgcgagggcaacaugggcgacaaauauacaaguagcgauuaaccagguuagaagguugauaggaaaugaaaacuaucuagacuauaugaccucgaugaaaagauuuaaaaacgaauccgauccagagggugcacuaugguaa

SEQ ID NO: 21798 - RNA, 9879 nt, Artificial Sequence
  derived and/or modified CDS sequence (opt6) from DENV-1__HM181966__SS-prME
aguguaacuaugcuacucaugcugaugccgaccgccuuagccuuucaucugacuacuagggguggggaaccgcauaugauagucacgaaacaagaaagaggaaaaucgcuacuauucaaaacuucuguuggggugaauaugugcaccuuaauugcgauggaccucggagaauuaugcgaagauacuaugaccuauaaauguccacguauuacggaagcggaaccagacgauguggauuguuggugcaaugccaccgauacguggguuacauauggaacaugcucccaaacuggugaacacaggagggauaaacgcuccguugcguuggcaccucauguuggccucgggcucgaaacucggacagaaacguggaugaguagugaaggggcuuggaaacaaauucaacguguugaaacuugggcacuaagacaccccggauucacuguuauagcgcuuuuucucgcacacgcgauaggaacuagcaucacacaaaaaggaauaauuuuuauacuuuugaugcuugucacaccauccauggccaugagguguguuggaauugguucaagagauuuugucgaaggacuauccggggcuacauggguagauguagugcucgaacauggaagcugcgugacuacuauggcuaaggauaaaccaacauuagacauugagcuacucaaaacugaaguuacaaacccggcgguuuuacgaaaauuaugcauagaagccaagaucagcaacacaacgaccgauucucgcugcccgacacaaggcgaagcaacauugauggaggagcaagaugcaaacuucguuugucgaaggacguucguugauagaggauggggaaauggguguggacuauuugguaaagggaguuugaucacaugugcaaaguuuaaaugugugaccaaauuggaggggaaaaucguacaauaugaaaaccuaaaauauaguguaauaguaacaguccacacaggugaucagcaucaagugggaaaugagucuaccgagcaugggaccacugcuaccauuacaccacaagcuccaacaucggaaauacaguuaacggauuauggugcacuaacauuagacugcucuccaaggacuggauuggauuuuaaugaaaugguacuauuaacuaugaaagagaaaaguuggcucguacacaaacaaugguuucuagaccuaccauuaccauggacgucgggcgcuaguacaucucaggaaacauggaauagacaagauuuauuggugacguuuaaaaccgcccacgcaaagaaacaggagguaguaguuuugggaucgcaagaaggggccaugcacacugcccugacaggagccacugaaauacaaacgaguggaacaacgacgauauucgcaggccauuugaaaugucggcuaaaaauggacaaacuuacgcugaaagggaugucauauguaauguguacaggaucuuuuaaacuagaaaaagaaguggcugaaacacaacacggcacgguuuuaguucaaaucaaauacgagggaacagacgcucccuguaaaauaccauuuagcacauuagaugaaaaaggcguaacucaaaauggaagauuaauaacugcgaacccuauuguuaccgacaaggaaaaaccagucaacauugaggcagaaccuccguucggagagagcuauauaguaauaggcgcaggagaaaaggcauuaaaauuaaguugguuuaaaaaggguuccucgaucggcaaaauguucgaagcaaccgcucgaggcgccagaagaauggcuauccugggggacacugcgugggauuuugguuccauuggaggaguuuucacgucagucggaaaguuaguacaccagaucuucgguacugccuauggaguucuauucagcgguguaagcuggacuaugaaaaucgguaucggugugcucuuaacaugguugggccuaaauagcagaaguacaaguuuaaguaugacauguaucgcuguaggacuugugacgcuauauuuaggugugaugguucaagcugauagcgguugcguuauuaauuggaaagguagagaacuaaagugcgguaguggaauauucguaacaaaugaagugcauaccuggacugaacaauauaaauuccaagcagauucaccuaaacgacuaucagccgcaauugguaaagcgugggaagaagggguuuguggaauacguucugccacccgauuggaaaauauuauguggaagcaaaucucaaacgaauuaaaucacauucuguuggaaaaugacaugaaauuuacuguagucguaggagacguuguggggauacucgcgcagggcaagaaaaugauucgaccgcaaccaauggaacacaaauauaguuggaaaaguuggggcaaggcuaagauaaucggcgccgacguccagaacacaacuuuuauaauugauggacccaauacgcccgagugucccgacgaccaacgagcauggaacauaugggaaguugaagauuacgguuuuggaauauuuacuacaaauauaugguuaaaauugagagauucguauacacaaguaugcgaccauaggcugaugagcgccgcaauuaaagacucuaaagcaguacaugcggacaugggguacuggaucgaaagugagaaaaaugagacauggaaacucgcaagagcuucauucauagagguaaaaacuuguauauggccaaaaagucauacauuauggaguaacggagugcuagagucagagaugauuauuccaaagauuuaugguggaccaaucucacaacacaauuaccgaccagguuauuuuacucaaacagcaggucccuggcacuuagguaaauuagaacuggacuuugaccuuugugaaggcacgacuguaguuguagaugaacauugcggaaauagagguccuucucugcgaacaaccacaguuacaggcaagaucauccaugaauggugcugcagaucauguacucugccuccacuaagguuuaaaggugaggauggcugcugguauggcauggaaauacgaccggucaaggaaaaggaagagaacuugguaaaaagcaugguuagugcuggaagcggggaaguagacucuuuuaguuugggucuuuuauguauaucuaucaugauagaggaaguaaugcgguccagguggucaagaaagaugcugaugacuggaacguuagcugucuuuuuacuacucauaaugggacaauuaacuuggaacgaucucauaagauugugcauuauggugggugccaaugcaucugaucgaaugggcaugggaacaaccuaccuagcucuaauagcaacauucaagaugcguccgauguucgcaguuggcuugcucuuuagaaggcuuaccucacgagagguuuugcuccuaaccaucggauuaagucuaguagccuccgucgaacuaccuaauucguuagaggaacugggagaugggcuagcaaugggaauuaugauacuaaaacuccucacugacuuucaaucucaucagcugugggcaacauuacuuaguuuuacauucauaaaaacgacauugucguuacauuaugcauggaaaacgauggcuaugguccuuucaauagucucacucuuuccgcugugucuaaguacuacaagucagaaaacuaccuggcugccaguacucuuaggaucccucggauguaagccucucacuauguuucuaauugccgagaauaagauuuggggacgcaaaagcuggccccuuaacgaaggaauaauggcaguagguguugucucaauacuacuuucaucccugcuaaagaacgauguaccauuagcgggaccguuaaucgccggcggaauguugauagcauguuacgugauuucuggauccagugcugauuugucccuggaaaaagcugcagaagucucgugggaagaagaagcggaacauucuggugcaagucauaauauacugguugaaguucaggaugauggaacuaugaaaauuaaggaugaagaacgugacgauacacuaacaauucuuuugaaagcaacccuccuagcuguaagcgguguuuauccauuaagcauacccgcaacacuauucgucugguauuucuggcagaagaagaaacaaagaaguggaguauugugggacacgccaaguccaccuaaaguugagagggcuguccucgaugacgguauauaccgaauuaugcagcgaggacuuuuaggaagaucgcaaguugguguagguguuuuccaagaaaacguguuucauacaauguggcaugugacucgcggagcaguauuaauguaccaagggaaaagacuagaaccaucgugggcuucagucaagaaagaucuaauuucguauggugguggauggcguuuacaaggaagcuggaauaccggugaagagguucaggucaucgcuguugaaccaggcaaaaaccccaaaaacguacaaacagcgccuggaacguucaagaccucagaaggcgaaguaggugccaucgcacuggacuucaaaccaggcaccagcgguaguccuauagucaacagagaaggcaaaauuguuggauuauacggaaacggaguaguuacaaccaguggaacauacguaagcgcaaucgcgcaggcaaaagcaucucaggaggggccauuaccagaaauugaagaugaggucuuccggaaacgaaacuuaaccaucauggaccuccaucccggaagugggaaaacaagaagauaccuacccgcuauuguaagagaagcaauaaaaagaaaacuucguacuuuaauuuuagcuccaacaaggguaguagcaucagaaauggcagaggcauuaaagggaaugccaauacguuaucaaacaacggcuguuaaaagugaacacaccggaaaggagauuguugaucucaugugccaugcaacauucacuaugagauuacuuucaccggugcgcgucccaaauuacaauaugaucauuauggaugaagcacauuucacggacccgucuucaauugcugcuagaggauacauaagcaccagaguaggcaugggcgaagcugcugccaucuuuaugacagcaacgccacccggaucaguugaagcauuuccacaaaguaacgcuguuauccaagaugaggaaagagauaucccggaacgguccuggaacucuggauaugaauggauaacagauuucccuggaaagacgguaugguuuguuccuucaauuaaaucagguaaugauauagcgaauugccuacgaaagaacgguaaaaggguaauacaauuaaguagaaaaacguuugacacugaguaccagaaaacuaaaaauaaugauugggauuaugugguaacgacagauauaagugaaaugggcgccaauuuccgugcggauagaguaaucgauccuagacgaugucuuaaaccaguaauucuuaaagacggaccugaacgcguaauacuagccggacccaugccuguuacaguugccucagccgcucaaagacgcggaaggauuggccgcaaccauaauaaggagggagaucaauacaucuauaugggccaaccacugaauaacgacgaagaucaugcacauuggacggaagccaagaugcuauuggacaacauuaauacaccggaaggaaucauaccugcucuuuuugagccagaacgagagaaaagugcagcgauagauggggaauauaggcuccgaggugaagcacgcaaaacauuuguagaacucaugaggcgaggagaucugccgguuuggcuaucauacaagguagcuagugaagguuuucaguacagcgauagacguugguguuuugauggagaacgaaauaaucaaguuuuggaagaaaauauggacguagaaaucuggacaaaagaaggggaaagaaagaaacuuagaccucguuggcuugaugcuagaacauauucggacccgcuagcgcuuagggaguucaaagaauuugcugcuggucgcagaucuguaucaggagaucuaauacucgaaauagggaaauuaccccagcaccuuacgcaaagagcacaaaacgcuuuagauaauuuaguuauguuacacaacagugagcaggguggaagggcuuaucgacaugcaauggaggagcuuccagauacuauagagacccuaauguuauuagcuuuaauugcaguccuaacaggagggguaacacuauucuuucuuucgggcagaggucuagggaaaacauccaucggauuacuuugugugauggcaagcagugcccucuuguggauggcuucuguagagccgcacuggaucgcggcaucuaucauuuuagaguucuuuuuaaugguucuguuaauaccagaaccggaccgacaaagaacaccacaggauaaucaacuugcuuacguuguuauuggauuacuauuuaugauucuuacaguagcugcgaacgagauggggcuuuuagaaacaacuaagaaagaucuagggauuggacacguugccguagaaaaccaucaucacgcgacaauguuggauguugaucuucauccggccagcgcauggacucuauaugcgguggcuacaacaauuauuacacccaugaugagacauaccauugaaaauacuacugcuaacauuucacuaacugcgauagcgaaucaggccgcaauuuuaaugggucuagauaagggauggcccaucucuaaaauggauauuggaguuccuuuacuagcauuaggauguuacucucagguaaaucccuugacacuaacagcagcagugcuuauguuaguagcgcauuacgcgaucaucggaccgggguugcaggccaaggcaacaagggaagcacagaaaaggacugcagcuggaauuaugaagaauccgacuguugauggaauaguugcaaucgauuuagaccccguaguauaugaugcgaaauucgaaaaacaacuuggacaaauaaugcugcuuauccuuuguacuucccaaauacuucuaaugaggacaacaugggcacuaugugagucaauuacccuugccaccggaccuuuaacuacauugugggagggcucuccaggaaaauuuuggaacacaaccauagcuguuuccauggcuaauauuuucaggggcucguauuuagccggagcgggacuggcguucaguuuaaugaagaguuuagguggcggccggagaggcacaggagcucaaggagagacauuaggcgaaaaauggaaaagacaacugaaucaacugagcaaaucggaguucaauauauauaaacgaagcggaauaauggagguagauagaucagaagcuaaagaaggcuuaaaaagaggggaaacaacucggcaugcagugagcagaggaaccgccaaauuacgcugguucguagaaaggaaucuuguaaaaccggaggguaaggucauugaucuaggaugcgggcguggugguuggucauauuauugugcuggcuuaaagaaagucacagagguuaaagguuacacuaaaggaggaccaggucaugaagaaccuauaccuauggcuaccuacggauggaacuuggugaaacuucauucugguaaagaugucuuuuucacgcccccugagaaaugcgauacgcuauuaugugacauuggagaauccucuccaaauccuacgauugaagagggaagaacuuuaagaguucugaaaaugguugaacccugguugaggggaaaucaauuuuguauuaaaauucuaaacccauauaugccaagcguaguagagacguuggaacaaaugcaaaggaagcacggagggauguugguaagaaacccuuuaagcagaaauagcacucaugaaauguacuggguaucuuguggcacaggaaauauuguuucugccgugaauaugacaucuagaauguugcucaacagauucacaauggcccauagaaaaccgacauaugaacgugauguugacuuaggggcagggacaagacacguugcaguagaaccagagguugcaaaucuugauauaauagggcaaagaauagaaaacauuaagcacgaacacaaaagcacauggcacuaugaugaagauaauccuuacaaaacuugggccuaucacgggagcuaugaaguaaagccuaguggaagcgcuaguucaaugguaaauggagugguuaaacucuuaacuaaaccuugggauguuaucccgaugguaacacaaauagcuaugacugauacgacaccuuuuggacagcaaagaguauucaaggaaaaaguugauacaagaacuccaaaggcaaaaagaggaacugcucaaauaauggagguaacagcgcguuggcugugggguuuccuaagucggaacaagaaaccacgaauaugcacucgugaagaauuuacaagaaaaguccgaucaaaugcagcuaucggagcuguuuucgucgacgagaaucaguggaacucggcgaaggaagcuguggaagaugaacguuucugggaucuagugcaaaaagagagagagcuacacaaacagggaaaaugcgcaacuugcguguauaauaugauggggaaaagagagaagaaacuuggggaguuuggaaaggcaaaagggagccgagcaauaugguauauguggcuaggggcaagguuuuuggaguucgaggcguuaggauuuaugaaugaagaucauugguuuucccgagaaaacucauuaaguggcgucgaaggagaaggccuacauaaacuaggguauauauuaagagauauaucaaaaauaccgggagggaauauguaugccgaugauacugcgggaugggacacccgaauaacagaagaugaccuucaaaaugaggcuaaaauuacugauauuauggaaccagaacacgcguuauuggcgacaaguaucuucaaauuaacauaucaaaauaaaguaguaagaguacaacgaccggccaaaaauggaacaguuauggacguuauaaguaggcgugaccaaaggggcucgggucagguuggcacguauggacuaaauacuuuuacaaauauggaggcccaacucauaagacagauggaaagugaaggaauauuuuugccaagcgaguuagaaacuccaaaucuugccgagaggguauuggauugguuggagaaauaugguguugaaagacuaaagagaauggcaauuucgggagacgauuguguaguaaaaccuauagaugauagguucgcuacagcauuaacagcauuaaacgauaugggaaaagugagaaaagacaucccccagugggaaccauccaaaggcuggaaugacuggcaacaagugccauuuugcucacaucauuuccaucaauuagugaugaaagauggaagggagaucguuguaccaugcaggaaccaggaugaauuaguaggccgagcgagaguaagccaaggggcaggauggucccugcgagaaaccgcuuguuugggaaagaguuaugcacaaauguggcaacuuauguauuuucaucguagagacuugagauuagcagcgaacgcgaucuguagugcugugccuguagauugggucccgacuucuaggacaaccuggaguauacaugcacaucaccaguggaugacaacagaagacaugcuaucaguauggaauagaguauggauugaagagaauccauggauggaagacaaaacccauguaagcagcuggggagauguuccuuauuuagguaaacgagaggaucaauggugcggcucgcugaucggacuuacugcaagggcuacaugggcgaguaauauacaaguagcaaucaaccagguaaggagguuaauuggaaacgaaaacuaucuggauuacaugacaaguaugaagagauuuaagaacgagggugacccggaaggagcacuaugguaa

SEQ ID NO: 21799 - RNA, 9879 nt, Artificial Sequence
  derived and/or modified CDS sequence (opt6) from DENV-1__GU131721__SS-prME
agcgugacaauguuacuaaugcugaugccgacagcucuagcauuccacuuaacaacgagaggaggagaaccacacaugauuguaucuaaacaagaaagaggaaaaaguuuacuauucaaaaccucagccggugucaauauguguacacuaauagcaauggaucuaggugaauuaugcgaagacacgaugaccuauaaauguccaagaauaacagaaacagaaccagacgacguagauuguugguguaacgcaacagauacauggguuacuuaugggaccugcagccagacuggcgaacaucggcgcgacaaacguaguguagcuuuggcaccucaugugggacuggggcuagaaacaagaacggaaacuuggaugucaagcgaaggcgcauggaagcaaauacagagagucgaaacaugggcucugagacacccgggcuucacugucauugcacuauuuuuagcgcaugcaauaggaacaucuauaacacaaaaagguauuauauucauauuacuaauguuaguaacuccaucaauggcaaugaggugcguugguauuggauccagggauuucguagaaggcuugaguggggcaacauggguugacguuguauuagaacauggaagcugcguaaccacaauggcuaaagacaaaccaacauuagauauagaauuauuaaaaacagaaguuacuaacccggcagucuugagaaaacuauguaucgaagcgaaaauuagcaauacgacuacggacagcagauguccuacucaaggagaagcaacuuuagucgaggagcaagaugcaaacuucgugugucggagaacguuuguugauagaggauggggaaaugguuguggucucuuuggaaaagggucccugauuacaugcgcgaaauuuaaaugugucacaaaacuagaaggaaaaauagugcaauacgagaauuugaaauauuccgucauagugaccguacauaccggggaucaacaccaaguagguaacgaaaguacugaacaugggaccacugcgacuaucacaccucaagcuccaacaacagaaauucaguuaacagacuauggagcuuugaccuuagacugcaguccacgaacaggauuagacuuuaaugaaaugguauuguuaaccaugaaagagaaaaguuggcuaguccauaagcaaugguuccuagaccuuccguuaccuuggacaaguggagcuucaaccagucaggaaaccuggaaucgacaggaucuauuagugacauuuaaaacagcucacgccaagaaacaggaagucgugguccugggaucacaagaaggugcuaugcauacagcgcuuacaggugcuacggagauucaaacguccgguaccaccacuauuuuugcaggacaccuuaaauguagauugaaaauggacaaacucacacugaagggaaugaguuauguaauguguacuggaucauucaaacuagaaaaagaaguagcagagacacaacauggaacggucuuaguacaaauuaaauaugagggaaccgacgccccuuguaaaaucccauuucuaacucaagaugaaaaaggcguaacucaaaacggaagauugauuacagcuaacccaauaguaacugauaaagaaaaacccguuaauauugaagcagagccgccguuuggagagucuuauaucaucaucggagcaggagaaaaagcauuaaaguuaagcugguuuaagaaaggaucuucgaucggcaagauguuugaagcaacggcgaggggugcaagaagaauggcaauucuaggcgauacagcgugggauuuugguucuauaggcggcguguucacaucugcaggcaaguuagugcaucaaaucuuuggaaccgcauacggaguacuauuuucagguguaucuuggaccaugaagauugggauugguguauuguuaaccuggcuuggacuaaacucacgcucuaccaguuuaagcaugacauguaucgcaguaggcuuaguuacguuguaccucggaguaaugguacaagcggacucuggcugcgugauuaauuggaaaggaagagaauugaaguguggaagcgggauauucguaacuaacgaaguccauacguggacagagcaguauaaguuccaagcugacagucccaagcgacucucagcugcaauugguaaggcgugggaggaagggguguguggcauaagaucugcaaccagauuagaaaacauaauguggaaacagauaucuaaugaauuaaaucauauccuauuagaaaaugauaugaaauucacgguggugguaggggacguagccgggauuuuagcgcaggguaaaaagaugauaaggccucaaccuauggaauauaaguauucuuggaaauccugggguaaggcaaagauaauuggcgcggaugugcaaaauacuacguuuauaaucgauggaccgaacacacccgaguguccggaugaucagagagcuuggaauaucugggagguagaagauuacggguucggaauauuuacaaccaacauaugguugaaacucagagauaguuauacacagguuugugaucaccgacugauguccgcagcaaucaaggacucaaaagcaguacaugcagauaugggguacuggauagagagcgagaaaaaugaaacuuggaaguuagcccgagcuucuuuuauagaagucaaaacuuguauauggccuaaaagucacaccuuguggagcaacggaguauuagagucugagaugauuguaccaaaaauauacggcgguccaaucagucagcacaauuauaggccaggauacuucacacaaaccgcuggaccguggcacuuaggaaaguuagaacuagauuucgacuuaugugaagguacaacuguagucguagacgagcauuguggaaacagaggucccagucugagaacaacuacagucacggguaaaaucauucacgagugguguuguaggaguugcacguuacccccacuccgauuucgcggugaagaugguuguugguaugguauggaaauacgacccguuaaagaaaaagaagaaaauuuaguaaaaucgauggucucagcgggaagcggagaaguagauucuuuuuccuuaggccuauuauguauuucaauaaucauagaggaagugaugagaucuagguggagucgaaaaauguuaaugacugguacauuagcaguauuuuuccuuuugaucauggggcagcuaacauggaaugaccucauaagauugugcauaaugguaggugccaacgcaagcgaucgcaugggcauggguacaacguaucuugcgcucauggcuacauuuaagaugcgaccaauguucgcagugggucuuuuguuucgaagacuuacaucaagagaaguauuguuacuuacaauuggauugaguuugguagcaucagucgagcuaccgaacucacuugaagaguuaggggaugguuuagcaauggguauuaugauucugaaauugcuaaccgauuuccaaucacaccaauuaugggccaccuuauuaagccuaacauuuauaaaaacgacuuucucacugcauuacgcuuggaaaacgauggccaugguucuuagcauaguaaguuuauucccauuaugucugucaaccacaagucagaaaacuacauggcugcccguucuccuaggaucacucgguugcaaaccacucacaauguuccucauagcggaaaacaaaauaugggggaggagaucuuggccacuuaaugaaggcauaauggcaguaggaauagugucgauacuauuaagcucauuauuaaagaaugaugucccacuagccgggccgcuaauagcgggcgggaugcuuauagcgugcuacguaauaucaggaagcucggcugaucuaagucuagagaaagcagcggagguuucaugggaagaggaagcugaacauaguggagcuagucauaauauccuuguagaaguccaagaugaugggacuaugaaaauuaaagaugaagaaagagacgacacauuaacuauacucuuaaaagccaccuuauuagcuguaagcggcguguauccuuuauccauaccagcaacauuauucguaugguauuuuuggcaaaagaagaaacaacgaucagguguucuaugggauacaccaucgccaccagaaguagaacgagcaguuuuggaugauggaauauaccgaaucaugcaacgaggacuacuaggacgaucucaaguuggaguuggaguauuccaagaaaacguguuucacacgauguggcacguaacaagaggugcaguuuuaauguaucaaggaaaacgucuagagccgucuugggcaagugucaagaaggauuugauuaguuacgggggaggcuggagacugcaagguagcuggaacacaggagaagaaguucaaguuauagcgguagagccaggcaaaaaucccaaaaacguucaaaccgccccagguacauuuaagacaccggaaggggaagugggagcaaucgcguuagacuuuaagccugggacguccggcagcccuauaguuaauagagaggguaaaaucguaggacuauacggaaaugguguagucacaacgucggguacuuacgugucagcuauugcucaagcaaaagcaagucaagagggaccacugccugagauagaggacgaagucuuuagaaagcggaauuugaccauuauggaccuacaucccgguagugguaaaacuagacgauaucuaccugcuauuguuagagaagccauaaaaagaaaacuaagaacucuuauauuggcaccaacaagaguugucgcgucagagauggcugaggcauugaagggaaugcccauucgauaccaaacuacugcagucaagucagaacauacagguaaggaaauaguggacuuaaugugccacgccacuuuuacaaugcgccugcugagcccgguaaggguucccaauuauaauaugauuauuauggacgaagcucauuucacugacccaucaagcauugcagcucgaggauacauaucuacaaggguagguaugggagaggcggcagcaauauucaugacggcgaccccgcccggcagcguagaagcauuuccacaaaguaaugcaguuauacaagaugaagagagggauauaccagaaagauccuggaacagugguuacgaauggauaacugacuuuccaggcaaaacagucugguuuguuccuaguauaaaaaguggaaaugacauagcuaauugccugaggaaaaauggaaaaagaguuauacaauugucucgaaaaacuuuugacacugaauaccagaaaacgaaaaacaacgacugggacuacguaguuacuacugacauuagugaaaugggagcuaauuuuagagcggauagagucauugacccacgaagaugcuuaaaaccaguaauuuugaaagacggcccugaaagaguaaucuuagcuggaccuaugccuguuacugucgcaagcgcagcacaacgucguggacgcaucggaagaaaucauaauaaagagggcgaucaguauauauauaugggucagccacuaaauaaugaugaagaccacgcucauuggaccgaagcaaagauguuacuugacaacaucaacacaccugaagguauaauaccagcccuuuuugaaccggaacgggagaagucagcugcaaucgacggcgaauauagacuuagaggagaggcgcgaaaaaccuuuguagaacucaugagaagaggggacuugccuguuuggcuaucauauaagguugcgucugaaggcuuccaguacagugauaggaggugguguuucgacggcgaacgaaacaaccagguauuagaagagaacauggacguagaaaucuggacuaaagagggcgaaaggaagaaauuaaggccucgaugguuggacgcgagaacuuauuccgaucccuuagcuuuacgagaauuuaaagaguucgcugcagguaggcguagcgucagcggggauuugauauuagaaauagggaaauuaccgcagcaucuaacgcagcgagcgcaaaaugcauuagacaacuugguuauguuacauaauucagaacaaggcggcagggcuuaucgccacgcaauggaagaauuaccagacaccauugaaacccucaugcuacucgcgcuaaucgccgugcugacaggugguguaacuuuauuuuucuuaaguggaagagguuuaggaaagacaucaauuggauugcuaugugugauggcuucaucaguucuccuauggauggcaucaguagaaccacacuggauagcagcuuccauaauacuggaguucuucuuaaugguguuacucaucccagagccagaccgacaaagaacuccucaggacaaucaacuugcguauguugucauuggauuguuauuuaugauauugacuguugccgcuaacgaaaugggcuuguuagaaaccacuaaaaaggauuuggguauaggucauguagcagucgagaaucaccaccacgcugcaauguuagacguagaucuaaggccugcuagugcguggacacuauaugcuguugcaacgacaauuauuacaccuaugaugcgacauacgauagaaaacaccacagcgaacauaucuuuaacugcaauugccaaccaagcagcuauacuaaugggcuuagauaaaggguggccaauaucaaaaauggacauaggaguaccauuacuggcuuugggcugcuacucccaaguaaauccauugacgcucacggcagcaguucugaugcugguugcccauuacgcaauuaucggaccaggccuacaagccaaagccacucgagaagcucagaaacgaacugccgcugggauaaugaagaauccgacaguugacggaaucguggccauagauuuagacccagucguguaugacgccaaauucgagaaacaacuuggacagauaauguuacuaauccuaugcacaagucagauauuauuaaugagaacuacaugggcguuaugugaaaguauaacacuggcaacaggaccccuuacaacacuaugggaaggaucaccgggcaaauucuggaauacaacgauugccgugagcauggcuaauauauucagagguucauauuuggcaggagcaggccuugcauucagucuuaugaaaaguuuaggcggugggagaagggguacgggagcgcaaggugagacauuaggggaaaaguggaaaaggcaguugaaucagcucucgaagucugaauuuaauacuuauaaacgcagcgggauuauggaagucgauagaagugaggccaaagaagguuuaaaaagaggugaaaccacaaaacaugcaguuucaagaggcacagcuaaauuacgcugguuuguugaaagaaaucugguuaaaccagaaggcaaaguuauagaccuaggaugcggacggggcggauggucuuacuacugugcgggucuuaagaaaguaacggagguaaaaggguauacuaaaggagguccgggucaugaagaaccuauccccauggcuacauaugguuggaacuuggugaaacuacacuccggcaaggacguuuucuucauaccuccggagaaaugcgacacguuguugugugacauaggggaaaguaguccuaacccuacgauagaggagggaagaacgcugcguguacuaaaaaugguagagcccugguuacgagguaaccaauucuguauuaaaauccucaacccauacaugccaaguguaguggaaaccuuggaacaaaugcaacguaaacauggagguauguuagugcgcaaucccuuaucaaggaacucaacucacgaaauguacugggugucguguggaacaggaaauauaguaucagcggugaacaugacuucgcguauguuauugaaucgauucaccauggcacacaggaaacccacguaugagcgggaugucgaccuaggugccggcacuagacauguagccguggaaccggaagucgcaaauuuagauaucauaggccagcguauagaaaacauaaaacaugaacauaaaagcaccuggcauuaugacgaggacaauccguacaaaacaugggcauaccacggaaguuacgagguaaagcccucuggcucagcuucaucgauggugaauggaguagucaaacuauuaacuaaaccuugggauguuauaccgauggugacacaaaucgcaaugacggacacuacaccguucggccaacaacgcgucuucaaggaaaaaguggacaccagaaccccaaaagcuaaaagggguacagcacaaauaauggaaguuacagcaaaauggcuguggggcuuucucagucgaaacaagaaaccuagaauauguaccagggaagaauuuacucggaaggugaggaguaaugccgcaauuggggcuguguucguggaugagaaucaauggaacucugcuaaagaagccguugaagaugaaagauuuugggaucugguucacagagaacgugaauuacacaagcaaggaaaaugugcaacaugcguguauaauaugauggguaagcgcgagaagaaauuaggugaguucggcaaagcaaaaggaagucgagcaauaugguacauguggcuaggagcucgauuccucgaguucgaggcuuuaggauucaugaaugaagaucacugguucucgagagaaaauaguuuauccggaguagaaggagagggucuccacaaacucggguacauucucagagauauaagcaagauaccaggaggaaacauguacgcugaugauacugcugguugggauacaagaauaacggaggaugaucuacaaaaugaggcaagaauaacugacaucauggagccagaacaugcauuguuagcgaagaguaucuucaaauuaaccuaucaaaauaaaguagugagaguacaaagaccugcgaaaaacggcacaguaauggacguaauaucuagaagagaccagcgugggucaggacaaguggggacauacggacugaacacauuuaccaacauggaagcucaauuaauacgacaaauggaaucagaaggaauuuucagcccgucugaacuggaaacgccuaacuuggcggaaaggguacuagacuggcuagaaaaguauggaguagagaggcuaaaaaggauggcaauaucaggcgaugauugcguggucaaaccaauagacgacagauucgccacugcguuaaccgcacuuaacgauaugggaaaagucagaaaggauauaccgcagugggaaccaucgaagggauggaacgauuggcaacaggugccauuuuguagccaucauuuucaucaacuuauaaugaaagacggcagagagaucguaguuccaugccgcaaccaggaugaauuagucggucgugcuagaguuagucagggcgccggauggucauuacgcgagacggcaugccuaggcaaaucauaugcgcagauguggcaacuaauguacuuccauaggcgugaccuaaggcuagcugcaaaugccauaugcagcgcuguaccggucgauuggaucccuaccucuagaacaacauggucaauacaugcucaucaucaguggaugacaacugaagauauguuaaguguauggaauagggucuggauugaagaaaauccuuggauggaagauaaaacacauauaagcaguuggggagauguuccauaccuaggaaaaagagaagaccaaugguguggaucguugauuggacucaccgcuagagcgaccugggccaccaauauacagguagcaauaaaucagguacgcagacuaauagguaacgaaaacuauuuagauuauaugacgucgaugaagcgauucaaaaacgaaggugaacccgagggagcauuaugguaa

SEQ ID NO: 21800 - RNA, 9879 nt, Artificial Sequence
  derived and/or modified CDS sequence (opt6) from DENV-1__GU131723__SS-prME
ucaguuacuauguuauuaaugcucaugccuacagcauuagccuuccaucuaacuacuagggguggggaaccucauaugauuguuucaaaacaagaaagaggaaaaucucuccuauuuaaaacguccgcuggcguaaauaugugcaccuuaauagccauggacuuaggagaacucugugaagauacuaugacuuacaaauguccgcguauaacugaaacugaaccugacgauguagacugcuggugcaaugccacugauaccugggugacauacgguacauguucacaaacuggcgaacacagaagggacaaaagauccguggcgcuugccccgcauguaggucuuggcuuagaaacucgcacagaaacauggaugucaucggaaggggcuuggaaacaaauucaaaggguggaaacaugggcguuacgacaccccgguuuuacgguuauagcacucuuuuuggcgcaugcaauagggacuucgauaacccaaaaaggaauaauauuuauauugcuuauguuaguaacgccuucaauggcuaugagguguguaggaauugguucacgugacuuuguagaaggucuuuccggugcuacaugggucgauguuguauuagaacaugguuccugugucaccacaauggcaaaagauaaaccaacacucgacauagaacuacuaaaaacggaaguaaccaauccugcugucuugcggaaauuaugcauugaagccaaaauuucaaacacuacaacagacucaagaugccccacacaaggcgaagccaccuuaguugaagaacaagacgcaaauuuuguauguaggagaaccuucgucgacaggggcuggggcaacgguuguggccuauuugguaaagggagccucaucacaugugcaaaauucaaauguguuacuaaacuagaaggaaaaaucguucaauacgaaaaucuaaaauauagcguaauuguaaccguucauaccggugaccagcaucaaguagguaaugagucgacagaacauggcacaaccgcuacgauaaccccucaagcucccacuaccgagauacaauuaacggauuauggggcccuuacccuagacuguucaccgcgaacgggccuagauuucaacgaaaugguguuauuaacaaugaaagagaaaucguggcuaguucacaaacagugguuuuuagaucugcccuugccauggacguccggggcaaguacuucccaagaaacauggaaucgacaagaccuauuaguuacuuucaaaacggcacaugcgaagaaacaggaaguuguaguuuuagggagccaagaaggcgcuaugcacaccgcuuugacaggugcuacugaaauucagacaucuggaacaacaaccauuuucgcgggacauuugaaaugucgguugaaaauggauaaacuaaccuuaaaaggaaugucguauguuauguguaccgguaguuuuaaauuggaaaaagaauuagcggaaacacagcauggaacaguauuaguacaaaucaaguacgaagggacagaugcaccaugcaaaauccccuuuucaacccaagaugaaaaaggaguaacucagaauggucgacuaauaaccgcuaauccuaucgucacagacaaagaaaaaccuguaaauauagaggcagagccuccauuuggugagucguauauagugauaggggcaggagagaaagcguuaaaacuaucaugguuuaagaaaggaucuaguauaggaaagauguucgaagcaacagcaaggggagcacguaggauggcgauauuaggagacaccgcaugggauuuuggaucaauaggaggaguuuuuaccagcgucggaaaacuuguccaucagaucuuuggaacggcauauggaguauuauuuagcggagucucauggacaaugaagauagggauuggaguucuuuuaaccugguugggauuaaauagucgaucuacaucauuauccaugacauguauugcgguugggcuaguaacucuguauuuaggaguuaugguacaagcugacucagguuguguaauaaauuggaaaggaagggaauuaaaguguggaucgggcauauuuguuacaaaugaaguacauacauggacugagcaguauaaauuccaagcagacuccccaaagagacuuagugcggcaauagguaaagcaugggaagaagguguuuguggcauuaggagugcgacgcgacucgaaaacauaauguggaaacaaaucaguaaugaacuaaaucauauucuacuagaaaaugauaugaaauuuacuguaguaguaggggacguggccggaaucuuggcacaaggcaaaaagaugauacguccacaaccgauggaacauaaguacucuuggaagucauggggaaaagcuaaaauuauuggagcagacgugcagaauacuacguucauuauagauggcccaaacacaccagagugcccugacgaucaacgagcguggaauauaugggaaguagaagacuauggauuugguauauucacuacaaauaucuggcuaaaguuacgugauaguuauacgcaaguuugugaucacagguugaugagugcagcuauaaaggauucgaaggcgguacaugcugacauggguuauuggauagaaagcgagaagaacgaaacauggaaauuagcaagagccucauucauagagguaaaaacauguauauggccaaaaucgcauacacuauggucuaaugggguuuuagagucggagaugauaauaccgaaaauauaugggggccccauaagucagcauaauuauaggccagguuauuuuacacagacagcaggacccuggcaucuagguaaacuagaauuggauuucgacuuaugcgaggggacaacgguaguagucgaugaacacugugguaaucggggaccuucauuacgaacgacaacugucacugguaaaauaauucaugagugguguugcaggucaugcacuuuaccuccgcuacguuuuagaggagaggauggguguugguaugguauggaaauuagaccaguuaaagaaaaggaagagaacuugguuaaaagcaugguuucagccggcucaggugaggucgacucauuuagucuuggguuacucuguauaucgauuaugauagaagaaguaaugagaagccgcuggucaaggaaaaugcuaaugacuggcacuuuagcaguauuuuuccuacugauugugggucaguugacauggaaugaucuuauacgccuuugcaucaugguaggagccaaugcuucugacagaauggggauggggacaacauacuuagcuuuaauggcaacauuuaaaaugagaccaauguuugcaguuggauuacucuuccgaagacuuaccucacgcgaagugcugcuacuuacaauuggacuuagcuuaguagcgagcguggagcuaccaaauaguuuagaagaauuaggugauggccucgcuaugggaauuaugauuuugaaacugcugacagacuuccaaucucaucaacuaugggccacguuacuaucauuaacuuucauaaaaacaacauuuucgcuacacuaugcauggaagacuauggcgaugguacuuucuguaguaaguuuauucccguuaugucucaguacaacaagucagaaaacuacauggcuaccuguccuacuagggucucuagggugcaagccacuuacaauguucuugauagccgaaaauaaaauauggggacgacgcucuuggccgcucaacgaagguauuauggcuguagguauaguaaguauuuuauuguccagcuuauugaaaaacgaugugccacuagccgguccgcucaucgccggaggaauguuaauagcuuguuaugucaucucugguagcagugcagaucucagcuuagagaaagcugcggaaguuucaugggaagaggaggcggaacauagcggagcaucccauaacauccuaguugaggugcaagaugaugguacaaugaagauaaaagaugaagaacgugaugauacucuuacaauauuacucaaagcgacucuacuggcuguuuccggaguuuauccacuaagcauacccgcuacacucuucgugugguacuuuuggcagaagaagaaacagcguagugguguacuaugggauacgccaaguccaccagagguggaacgggcaguuuuagaugacgggauauacagaaucaugcaacgugguuugcuuggaagaagucaagucggcgucggcgucuuccaagaaaacguguuccauacuauguggcacgugacaagaggagccguauugauguaucaagguaaacgauuagagccguccugggcaagugucaagaaagauuuaaucucuuaugguggaggguggagacugcaaggaucuuggaacacaggagaagaaguucaaguuauugcgguagaaccugggaagaauccaaagaacguacaaacagcucccggcacauuuaaaacgccugaaggagaaguaggagcaauagcucuggauuuuaaaccagguacuucuggcucuccaauagucaauagggaaggaaaaaucguaggauuauacggaaaugggguagugacuaccucuggaacauauguauccgcgauugcgcaggcgaaagcaagucaagaagggcccuuaccagagaucgaagacgaagucuucagaaaaaggaauuuaacaauaauggauuugcauccuggaucugguaagacccgcagguauuuaccagccaucgugcgagaagccauaaaacgaaaacucagaacgcuaauacuagcaccaacaagaguuguagccucugaaauggcagaagcucuuaaaggaaugccaauacgcuaucagacuacagcaguuaaaucggaacacacgggaaaagaaaucguugaccugaugugucacgcgacauuuacaaugcgucuuuuaucuccugugcgcguucccaauuacaauaugaucauuauggacgaagcgcauuuuacagacccgagcucuauagcugcaagaggauauauaucaacccgcguuggaaugggagaagcagcugcgauauuuaugacugcgacaccuccaggaucaguggaggcuuucccacaaucaaaugcaguaauacaagacgaggaaagggauauacccgaaagaaguuggaacucgggauaugaauggaucacggacuucccgggaaagacuguuugguucguaccguccauaaaaucugggaaugacaucgcaaauuguuuacggaaaaauggcaagagagugauucaauugucgcguaaaacuuucgauaccgaguaucagaagacgaaaaacaaugacugggauuaugucguaacaacagauaucucugaaaugggugcuaacuuuagagcggauagggucauagauccacgaaggugccuuaagccuguaauacugaaagauggaccagaacggguaauauuagcagguccuaugccaguuacaguugcuagugcggcgcaaagacgggggcgaguaggcagaaaucauaacaaggaaggugaucaauauaucuauaugggacaaccauuaaauaaugacgaagaucacgcacacuggacugaggcaaagauguuacucgauaacauaaacaccccugaaggcauuauuccggcauuguucgagcccgaaagagaaaaaucagcagccauagauggcgaguaccgucuuagaggugaagcuagaaaaacauucguagaauuaaugagaagaggagaucuuccaguaugguugucauacaaaguagcuucugagggauuccaauauagugauagacguugguguuuugauggugaacgcaauaaucaaguucuagaggaaaauauggacgucgaaauuuggacaaaagaaggggaaaggaagaaauugagacccaggugguuagaugcaagaacuuacucugauccauuagcucuaagagaguucaaagaauuugcagcaggacgacguucaguuaguggugauuugauuuuggagaucgguaaacuaccgcaacaccuaacacagcgugcgcaaaacgcacucgauaaucuagugaugcuccauaauucugagcaaggaggccgugcauacagacaugcaauggaagaacucccagauacaaucgaaacucucaugcuacuagcguugaucgccguucuuacaggaggggucacauuauuuuuccuuucagggagaggacuuggaaaaacaaguauaggucuauuaugcgugauggcaucaagugucuuacuguggauggccuccguggagccucauuggauagcggcaucaauuauacucgaauuuuuccuaaugguacuucucauacccgagcccgaucgucagagaaccccacaagacaaccaauuggcguacguaguaaucggucuauuauucaugauauugacagucgcugcgaaugaaauggggcugcuagaaacaacaaagaaagaucuagggauuggacaugucgcuguagagaaccaucaucaugccgcaaugcuagauguggaucuacauccugcgagugcguggacacuauacgcgguagcuaccacuauuaucacaccgaugaugagacauacuauugaaaacacaaccgcaaacauuagucuaaccgcaaucgcgaaccaagcagcaauauuaaugggucuggauaaaggcuggccgauaagcaagauggacauaggaguuccacuacuagcccuuggaugcuauucacaaguaaaucccuuaacucuaacagcagcugucuugaugcuuguagcucauuaugcuauuauugguccgggacuccaggccaaagcgacgagagaggcccagaagagaaccgcggcugguauaaugaaaaacccgacaguagauggaauuguagccauugauuuagauccggugguauaugacgcuaaauucgaaaaacaauugggacaaauaaugcuacucaucuuaugcacaucacaaauucuucugaugcgaacuacuugggcucuuugcgaauccauuacucuagcaacggguccacugacaacguuaugggaagggucgccagguaaauucuggaauacgacuauugcgguuucaauggccaauauuuuuagaggcagcuaucuagcaggcgcgggguuggcguuuagcuuaaugaaaucucuuggcggcggccgacgagguacaggagcucaaggagaaacauugggagaaaaauggaaaagacaacuaaaucaacugucaaaaagugaguucaauaccuauaaaaggucuggaaucauggagguagaucguagcgaagccaaggaaggucuaaaacguggugaaacaacaaaacaugcaguaaguaggggcacggcaaagcuacgaugguuuguagaacggaauuuagucaaaccggaagguaaagucaucgaucuagguugugguagaggaggauggucauacuacugugcuggacuaaagaaaguaacagagguaaaagguuauacaaaaggagggccaggccaugaagaacccauaccgauggcuacauauggcuggaacuugguuaagcuccauagcggaaaagauguauucuuuauuccuccagaaaaaugugacacuuuacuaugcgauauaggggaaaguucaccgaacccaaccauagaagaaggaagaacauuaagaguguugaagaugguagaacccugguuacggggcaaucaauuuuguauaaaaauauugaacccauauaugcccucgguugucgaaacauuagaacaaaugcaaagaaaacauggaggaauguuagucaggaauccacuaucuagaaauaguacucacgaaauguacugggugucaugugggacaggaaacauaguaagugcuguaaauaugaccucucgaauguugcuuaauagauucaccauggcucaccgaaagccaacauacgagagagacguggaucuuggagcagggacaagacacguggccguagagcccgaaguagcuaaucuugauauaauaggucaacgaauugaaaauauaaaacaugaacacaaauccaccuggcauuaugaugaggauaacccuuacaagacuugggcauaccauggcaguuacgaaguaaagccaucaggcucagcgagcaguaugguuaauggaguaguaaaauuacuaacuaaaccuugggacgucauaccuaugguaacacagaucgccaugacugacacaacaccauuuggacaacagaggguuuuuaaagaaaagguagauacccgcaccccaaaggcaaaaaggggaacagcacaaaucauggaaguuacugcgaaauggcuguggggcuuucucagccgaaauaagaaaccucgaauuugcacgagggaagaguucacacgaaaaguaaggaguaaugcagcuauaggugcaguauucgucgacgaaaaucaauggaacucggcgaaagaagcgguagaagaugaacgauucugggauuuggugcauagggaaagagaacuacauaaacaaggcaagugcgccacguguguauauaacaugaugggaaaacgugaaaagaaacuuggagaguucggcaaagcgaaggggagucgagccauuugguauauguggcugggagcgagguuccucgaguucgaggcccuuggguucaugaacgaagaucauugguuuucaagagaaaauucacugucaggaguugaaggagaagguuugcauaaguuaggcuauauucugcgagacaucaguaaaauuccuggaggaaauauguaugcggaugauacagccgguugggauacgaggauaacggaagaugaccuccaaaaugaggccagaauaacagauauaauggaaccggagcacgcccuauuggcaaagaguauuuuuaaacuuacauaucaaaauaaaguaguucguguccaaaggccagcuaaaaacggaacuguaauggauguaauauccaggcgagaucaaaggggcagugggcaagucgguaccuauggauuaaauaccuucacgaauauggaagcccaacuaauaaggcaaauggaaucugaagggauauuuucuccaucugaacuagaaacgccaaaccuagccgaaagaguauuagauuggcuugaaaaguaugguguagaaagauuaaaacguauggcaaucucuggcgaugauuguguuguuaaaccgaucgacgauagauuugcgacugcgcuaaccgcacuaaaugauaugggaaaaguaaggaaagauaucccacaaugggaaccuuccaagggauggaaugacuggcaacaagugccauuuuguagucaucauuuucaucagcuaauaaugaaagauggacgagagaucguugugcccuguagaaaucaagaugagcuaguugggagagcuagagucucccaaggagcuggauggagccuaagagagacugcaugucuagggaaaucauacgcacagauguggcaacuuauguauuuucauagaagggauuuaagacuugcagcuaacgcaauauguagugccgugccgguugauuggauuccgacaaguagaaccacauggucaauucaugcucaucaucaauggaugacaacugaggauauguuaaguguuuggaaccguguguggauagaggaaaauccauggauggaagauaaaacccacauuucaucuuggggagacguacccuauuugggaaaacgugaagaucaguggugcgggucucuaaucgguuuaacugccagggccaccugggcaacuaacauccaaguugccaucaaucaagucagacguuuaaucgguaaugaaaacuacuuagauuauaugacaucgaugaaaagauucaaaaacgaaucagauccagagggagcacucugguga

SEQ ID NO: 21801 - RNA, 9879 nt, Artificial Sequence
  derived and/or modified CDS sequence (opt6) from DENV-1__GU131725__SS-prME
ucaguuacuaugcucuuaauguuaaugccaaccgcacuagccuuucaccugacuacacggggaggcgaaccacauaugauagugucaaaacaagaaaggggaaaaagucuauuauuuaaaaccagugcggguguaaauauguguacuuuaauagcaauggaucucggagaacuuugugaagacacaaugacuuauaaaugcccaaggauaacugaagcugaaccugaugacguggauuguuggugcaacgccacggauacuugggugacuuauggaacaugcagucagaccggagaacacaggagagauaaaagguccgucgcuuuggcuccacauguugguuuagguuuagaaacgagaacagaaacguggaugaguucugaaggcgccuggaaacaaauucaacgaguugaaacgugggcacugcgccauccaggcuucacaguuauugcucuauuccuugcacaugcaauaggaacaucuauuacgcaaaaagguauaauuuucauauuacuaauguuggugaccccgucuauggcuaugagaugcguaggcauugggagucgagauuuuguagaaggauugaguggcgcaacuugggucgacgugguacuugaacaugggaguugcguaacgacaauggcgaaagauaaaccgacacuugauauagaauuguuaaaaacagaaguaacgaauccggcuguacugcgaaaacugugcauugaagcuaaaauuucaaacaccaccacagauaguagaugcccuacacaaggagaagcuacccucgucgaagaacaagaugcaaauuuugucugccgacggacuuuuguagauagggggugggguaauggguguggacuauuugguaaagguuccuuaaucacuugcgccaaauuuaaauguguaacuaaacucgaagggaaaauuguccaauaugaaaaucugaaauacucaguaauuguuacuguccacacaggagaucaacaccaaguagguaaugaaucuacggaacacggcacuacugcgacaauaacgccacaagcucccacgacagaaauacaauuaaccgacuauggggccuuaacccuagauuguaguccccgaacggggcucgauuucagcgaaauggugcuguuaacaaugaaagagaaaaguugguuaguacacaaacagugguuccuugauuuaccauuaccuuggacaucaggugcuucaacgucucaagaaacauggaaucggcaagaucuauuaguaacuuucaaaacagcacaugcgaagaagcaagaaguaguaguauuggguucccaagaaggugcgaugcacacggcacuuacaggcgcaacagaaauacaaacauccggcacuacaacuaucuucgcagggcaucucaaaugcaggcucaagauggauaaacugacucuaaaaggaaugaguuauguaaugugcacagguucauuuaaauuggaaaaggaaguugcagaaacgcaacauggcacuguguuaguacagauaaaauacgaggguacagaugcaccuuguaagauaccguuuucaacccaagaugagaaagggguaacacagaauggacggcuuauuacggcuaauccaaucguaaccgacaaagaaaaaccgguuaauauugaagcagagccucccuuuggcgagagcuauauuguaaucggugcaggagaaaaagcacucaaacuaucgugguucaagaaagguuccaguauuggaaaaauguuugaagcgacggcacgcggagcaaggagaauggcaauucugggagauacagcaugggauuuugggucaauuggagggguguuuacaucaguaggaaaauuagugcaucagauuuuugguacggcauacgguguucuauuuucagggguaucguggacuaugaaaauuggaauuggaguacucuuaacgugguuaggauuaaacucccguucaacgagcuuaaguaugacauguauagcaguuggauuagugacacuguauuuaggagugaugguacaagcagacucaggauguguuauuaauuggaaagguagagagcuaaaauguggaucugggauauucguaacaaacgaggugcacacuuggaccgagcaauauaaguuccaagcagauucaccaaaacgauuaucugcggcuauugggaaggcgugggaagagggaguauguggcauaagauccgcgacucgcuuggaaaacauuauguggaagcaaauaaguaacgaauugaaucauauacuucuagagaacgacaugaaguuaacuguaguggugggugauguagcaggaauccuugggcagggcaaaaagaugauaagaccacagccuauggaauacaaauacaguuggaagucguggggaaaagcuaaaauaauaggagcagacgcgcaaaacacuacauucaucaucgaugguccaaacacgccugaaugcccggaugaccaaagagcauggaauauaugggagguugaagauuacgguuuugguauauuuacaacaaacauauggcuaaaacuccgggauucauauacacaggugugugaucauagguugaugucggcggcuaucaaagauucaaaagccguucaugccgacauggguuauuggaucgagagcgagaaaaaugaaacauggaaacuugcaagagcuucguucauugaaguaaaaacaugcauauggccuaagucucacacuuuauggaguaauggcguauuagaaagugaaaugauaaucccaaaaauuuacggaggaccuaucagccaacacaauuacaggccagguuacuucacucaaacugcggguccauggcacuuaggcaaauuagaacuagacuucgaucugugugaaggaacgacuguaguaguugaugaacauuguggcaaucgcgguccaucauuaagaacaacuacuguaacuggaaaaauaauacacgaauggugcuguaggaguuguacgcuaccucccuuaagauuccguggagaagacggguguugguacgggauggaaaucagaccggucaaagaaaaagaagaaaaucuugucaaaagcauggugucagcaggaaguggcgaaguagauagcuucucgcugggucuccuauguaucuccauaaugauugaagagguaaugcgcaguagguggucacgaaaaauguuaaugacaggaacucucgcuguauucuuucuacuaauaaugggccaauugaccuggaaugauuuaauucguuuaugcauuaugguaggagcuaacgcgucagaccgaaugggaauggguaccaccuacuuagcucuuauggcaaccuuuaagaugagaccgauguuugcaguggggcuauuauucagacgcuugacaagucgagaagugcuauuauuaaccauaggcuuaaguuuaguugcgucuguagaacuaccaaauucucucgaggaauuaggagacggguuagcaauggguaucaugauacucaaacuccucacagacuuccagagcuaccaauuaugggcaacccuacucucucuuacauucauaaaaaccacauucucauuacauuacgcuuggaagacuauggccaugguucuaucaaucguaucauuguuuccacuauguuuaaguacuacgagccagaaaacgacgugguuacccguucuguuagggucguugggguguaagcccuuaacaauguuuuuaauugcugaaaauaagauuuggggacgaaagucauggccccucaacgaagguauaauggcaguaggaauugugagcauucuauuaucuucguuacucaagaaugaugucccucucgcugguccacuuauugcaggagggaugcuaauagcaugcuacguuauaagcggaucaucagcggaucuaucucuagagaaagcagccgaaguaagcugggaagaggaggccgagcacucuggagcgucgcauaacauucucgucgaaguacaagaugauggaacaaugaaaauaaaagacgaagaacgagacgacacauuaacaauccuacuaaaagcuacauuacuggcagucucaggagucuauccguugaguauucccgcaacccuauuuguaugguauuuuuggcagaagaagaaacaacgcucugguguucuuugggauacuccaaguccgcccgagguagagagagcuguacucgaugacgguaucuacagaauuaugcaaagggguuuacugggucguagucaaguuggaguaggaguauuccaggaaaacguauuucacacgauguggcacguaacgagaggagcgguucuuauguaccaaggcaaacgacucgaaccaucuugggcgucaguuaagaaagaccuaauaucuuaugggggagguuggaggcucagagggucuuggaauaccggagaagaaguacaaguuauugcaguugagccaggaaagaaccccaaaaacguucaaacggcaccagggacauuuaaaaccccggagggagaaguaggggcaauugcgcuggauuucaaaccugguacuucagggucgccaaucguuaauagagaagguaaaauagucggucuauaugguaaugguguagucacaacaagugggacauaugucucggccauugcucaagcaaaagcaucacaagaaggcccgcuuccugaaauugaagaugaggucuucaggaaaagaaaccucaccaucauggaccuacauccuggcucagguaagaccagacgguacuuaccagcaauaguucgcgaagcuauaaaacgcaagcuaaggacgcuuauauuggcuccuacgcggguaguagcguccgaaauggcagaggcacuaaaaggcaugcccauacgauaucagacuacugcuguuaaaggggaacauaccggaaaagaaauagucgauuugaugugccacgcaaccuuuacuaugagauuacuaaguccaguaagaguaccuaauuauaacaugauuauaauggacgaggcgcacuucacagaucccucaucuauagcagcacggggcuacauauccacaagaguggguaugggcgaagcggcugcaauauucaugacagcaacuccaccaggcucaguagaggcuuuuccccagagcaaugcaguuauacaagaugaggaaagagauauaccagaacgaagcuggaauagcgguuacgaauggauuacggauuucccuggaaaaacugucugguucguaccaucaauaaaauccgggaaugacauagcaaacugccuccguaagaacgguaaacguguaauucaguugagucggaaaacauuugacaccgaauaucaaaagaccaaaaauaaugacugggauuaugucgucacuacagauauuagugagaugggcgcgaauuucagagcagauagaguaauagauccuagaagaugcuuaaaaccaguaauacuaaaggaugguccggagagaguaaucuuagcaggcccaaugccuguaacuguugccagcgcagcucaacgucguggucguauaggcagaaaucauaauaaggaaggugaccaauauauauauaugggccaacccuuaaauaaugaugaagaccaugcccacuggacagaagcuaaaaugcuauuagacaauauaaauacgcccgaagguauuaucccagccuuauucgaaccugagagggagaaaagugcagcaguugauggagaguacagacuuagaggcgaggcaaggaaaacauuuguagaauugaugaggcguggcgaccuuccuguuugguuaucuuauaaaguagccucagaaggauuucaauauagugaucgucgauggugcuuugacggagagcguaacaaucagguacuagaagaaaauauggaugucgaaauauggacaaaagaaggugaaaggaaaaaguuacgaccgagguggcuugacgcgcggacguauuccgacccauuggcauuaagggaauuuaaagaguucgcagcuggucggcgaaguguuuccggugaucucauacuugagauuggaaagcuaccgcaacacuuaacccaaagagcacaaaaugcguuagauaaccuagugauguuacauaauagugaacaagguggucgagcauaccgacacgcaauggaagaauuaccagauacaauugaaacacuaauguuauuagcgcuuauagcaguuuuaacugguggugucacucucuuuuuccuaucaggaaggggacuagggaaaacaaguauaggacuacucugcgucauggccucaucaguacuucuauggauggcgucaguggagccgcauuggauugcagcaucgaucauacuagaguucuuucuuaugguacuacuuauaccggagccagaucgucagagaacaccucaagacaaucaauuagcuuauguuguaauaggacuauuauucaugauuuuaacaguggccgcgaaugagaugggguuauuagaaacgacuaagaaagacuuagguauaggucauguagcaguagaaaaucaucaucaugccgcgauguuagacguagaccuacacccagcaagcgcauggacauuguaugcaguagcaaccacgaucauuaccccuaugaugaggcauacuauagaaaauaccacggcgaacauaucauugacagcaauagcuaaucaggccgcgauccucaugggucuugauaaaggguggccuaucagcaaaauggauauagguguuccucuucuugcauuaggaugcuauucucaagucaacccauuaacgcuuacugcagcaguauuaauguuaguagcgcauuacgcaauuauagguccuggauuacaagcgaaggcgacaagagaggcacagaaaaggacagcagcagguauaaugaagaacccaacgguugacgguaucguagccauagacuuagauccugucguuuacgaugcaaaguucgaaaaacaauuggggcaaaucauguuacuaauccuuuguacuucucagauccugcucaugcgaacgacgugggcacugugugaaagcauaaccuuggccacagguccuuuaacaacauuaugggaaggaaguccaggcaaguuuuggaacacgacaauugcagugucuauggccaacauauuuagaggcuccuaccuggccggcgcaggauuggcauuuucgcuaaugaaauccuuagguggaggaagaaggggaacaggugcacagggugagacuuugggagagaaauggaaacgccaacuuaaccagcugaguaaauccgaauuuaacaccuacaaaaggaguggcaucauggaaguugauagaucagaagcuaaagagggucuaaaacggggugaaacgaccaaacacgcgguuucucgagguaccgccaaguuacgaugguuuguagaacgaaaucuggugaaaccagaaggaaaagucauagacuugggcugugguagaggagguuggaguuauuauugugcuggucuaaagaaaguaacagaggucaaaggauauaccaaagguggaccaggccacgaagaaccaauaccaauggcuacauauggcuggaauuuagucaaauuacacagcggaaaagacguuuucuuuauuccaccugaaaaaugcgauacguuauuaugcgauaucggugaaucaaguccuaauccuacaauugaagagggaagaacucuuagaguauuaaaaaugguugaacccugguugcguggaaaucaauuuuguauaaaaauccuaaaucccuacaugccuaguguuguugaaacucucgaacaaaugcaacguaagcauggaggaauguuaguaagaaauccauuauccagaaauucuacacaugagauguauugggugucaugcggaacaggaaauaucguuucugcaguaaauaugacaagucggauguuauuaaaccgauuuacaauggcacaccgaaagccuaccuaugaaagagacguagauuuaggaacuggaaccagacacguggcaguugagccggagguugcgaaccuagacauaauaggacaaagaauugaaaauauaaaacacgaacauaaaucaacuuggcauuaugaugaggacaaucccuauaaaacaugggcauaucaugguucauaugagguaaagccgucaggcucagcaagcucuaugguuaauggaguagugaagcucuuaacaaaaccuugggacgugauaccuaugguaacucaaauagcuaugacggauacaacuccuuuugggcaacagaggguuuuuaaagaaaaagucgauacaagaacaccaaaagcaaagcgcgguacagcacaaauuauggaggugaccgcucguugguuauggggguucuugucgcguaauaagaagccucgaauuuguaccagagaggaauuuacgcggaaagugaggucaaacgccgcuaucggagcuguauucguggaugaaaaucaauggaacagugcuaaagaggcaguagaggaugagcgcuuuugggacuuaguacauagagaaagggaauuacauaagcaggggaaaugugcaacaugcguauacaauaugauggggaagagagagaagaaacuaggugaauuugguaaggcuaaagguucacgagcuauaugguauaugugguuaggugcaagauuccuagaguucgaagcguuaggauuuaugaaugaagaucauugguucuccagagagaacagucuuucuggcguagaaggagagggacuucacaaauuggguuauauauugagagauauaucaaagauaccaggagguaauauguacgcagaugauaccgcuggcugggauacaagaauaaccgaagacgaucuucaaaaugaagcaaagauuacagauauuauggagccggaacaugcucuacucgcaaaagcaauauucaaacuaacguaccaaaacaaggugguacgcguacagcgacccgcuaaaaauggaacaguuauggauguaauuagcagacgcgaccaacgagguucaggucaaguaggaacauaugggcucaauacguuuacaaauauggaagcacaguuaauacgucaaauggaaagcgagggaaucuuuucaccaagugaacuagaaacuccaaaccuagcagagagagcccuagacuggcuagaaaaauauggaguugagagauuaaaacgcauggccauaaguggugacgacugcguuguaaaacccaucgacgaucgcuuugcgacagcauugacugcucuaaaugauauggggaaaguaagaaaagacaucccacaaugggagccaagcagaggauggaaugacuggcaacagguucccuuuuguagucaucacuuccaccaguuaauuaugaaggauggaagagaaaucguuguaccuuguagaaaucaagaugaauugguuggacgcgcgagaguaagucaaggagcgggauggagucugagagaaacugcauguuuaggcaaaagcuacgcacaaauguggcaacuuauguauuuucacagaagggaucuaaggcucgcugcuaaugcaauaugcucggcagugccgguagauuggguuccaacuucaagaaccacguggucgauccacgcacaccaucaauggaugacgacggaagauauguuaucagucuggaauagaguauggaucgaggagaauccuuggauggaggacaaaacgcacauaucaaguugggaggauguaccauauuuaggaaagagagaagaucagugguguggaucacuuauaggacugacagcacgugcuacuugggcuacuaacauucaggucgcuauaaaucaagugcguaggcucauugguaaugaaaauuauuuagauuauaugaccuccaugaaaagauucaagaaugaaagcgacccugaaggugcucuuugguaa

SEQ ID NO: 21802 - RNA, 9879 nt, Artificial Sequence
  derived and/or modified CDS sequence (opt6) from DENV-1__GU131726__SS-prME
ucaguaacaaugcuauugaugcugaugccuacagcucucgcuuuucaccugacaacccgugggggagaaccacauaugauaguaacaaaacaagaacgugggaaaucguuacuauucaagacgagcgcaggagugaauauguguacguugaucgcuauggaucugggagaauuaugugaagauacaaugacuuauaaguguccacggauuacagaagcagaaccggaugacguugacugcugguguaacgcaacugauacauggguaaccuauggaacguguucacagacaggagaacaucgccgagauaaacguaguguggcccuagccccgcacguggguuuaggucuagaaacacgaaccgaaacuuggaugucaagcgaaggggcauggaagcaaauacaaagaguagaaacaugggcauugcgacacccuggguuuaccguaaucgcauuguucuuggcacaugcuauugguacaucuauuacacagaagggcauaauauucauauuguuaauguuaguuacgccguccauggcgaugcgcuguguggggauaggcagccgugauuucguagaaggacuuucaggagcgacauggguagauguaguacuagaacacggguccugugucacaacgauggcuaaagacaagccuacuuuagacauagaauuauugaaaacugaaguuacgaacccagcuguuuuacgcaaauuauguauagaagcgaaaaucucaaacacaacaaccgauaguagaugcccgacacaaggugaagcaacgcuaauggaagaacaagaugcuaacuucguaugccgacgaacuuuuguagaucgaggauggggcaacggauguggguuguuugguaaaggaucauuaauuacgugcgcuaaauucaagugugucacaaaacuugaagggaaaaucguccaauaugaaaauuuaaaguauucuguuauaguuacgguccacacaggagaucagcaccaagucgguaaugaauccacggaacauggaacuacugcuacuauaacaccccaagcaccaacgagugaaauccaauuaaccgauuauggcgcuuuaacccucgauuguuccccaaggacuggauuagauuuuaacgaaaugguacuacuaacaaugaaagagaaaagcuggcuaguacauaaacagugguuucucgaucuaccccuaccauggacgucaggggcgucaaccucccaagaaacuuggaauagacaagacuuauuaguaaccuuuaaaacagcucacgcuaaaaagcaagaaguuguaguucuggguucacaggaaggugccaugcauacagcucuaaccggggcaacagaaauccagaccucggguacaacgacgaucuuugccggucaccuuaaaugucgguuaaagauggauaaacuaacacuuaaaggaaugagcuauguaaugugcacgggaaguuuuaaacuggaaaaagaaguagccgagacccaacauggaacuguauuaguacagauuaaauacgaggggacggacgcaccauguaaaauaccuuuuucaacucaagaugagaaaggggcgacgcaaaacggaaggcuaauaacagcaaacccaauuguaacagauaaagaaaaaccaguaaauaucgaagccgaacccccuuucggcgaaaguuauaucgucaucggugcaggagaaaaagcucugaaacugucgugguucaagaaaggaaguaguauugguaaaauguuugaggccacggcaagaggggcuagacgaauggcuauucuaggagauacugcaugggauuuuggcuccguaggagggguuuucacgucgguaggcaagcugguccaucaaauauucgguacugcauauggaguucuauucagcggcgucaguuggacaaugaaaauagguauaggaguacuacuaacgugguugggucuaaauucucgaucuacaagucuuaguaugacauguauagcaguaggauuagugaccuuguaucugggcguuaugguacaagcugauaguggauguguaauaaauuggaaaggucgcgaguuaaaauguggcucuggaaucuuuguaacuaaugaaguacauaccuggacggaacaauauaaauuucaggcagauaguccuaagagacuuagugcagcuauuggcaaagcaugggaagaagguguuuguggcauccgcucagccacaagauuggaaaacauaauguggaagcaaauaaguaacgaguuaaaucacauuuuauuagaaaaugacaugaaguucaccguaguaguuggggacgucgugggcauucuggcacaagggaagaagaugauuagaccacaaccaauggaacacaaauauucuuggaaaucaugggguaaagcgaaaauuauaggggcagauguccaaaauacuacuuuuauaauagaugggccgaacacuccagaauguccugaugaucaaagagcguggaauauuugggagguggaagauuacggauucggaauauuugcaacuaauauuuggcucaagcuacgugauucuuacacacaagucugcgaccauagauuaaugucugcugcaauuaaagacagcaaggcugugcacgcggauaugggauacuggauagaaagugagaaaaaugaaacauggaaacuugcccgagcuucguucauagaaguaaaaacuugcauauggccuaaaagccacacacuauggaguaauggggucuuagaaagcgaaaugauuaucccaaagauuuauggaggucccauuucgcaacauaacuacagaccuggauacuucacccagaccgcaggaccuuggcauuuaggaaaauuagaauuagauuucgaccugugcgagggaacgaccgucguaguagaugaacacugcggaaauaggggaccuucccugaggacuacuaccgucaccggcaaaauaauacaugaaugguguuguagaucaugcacauuaccaccgcuucgauucaaaggagaagaugguuguugguauggaauggaaauucgaccgguaaaggaaaaagaggaaaauuugguaaagagcaugguuucggcagguucaggagaagucgauuccuucagucugggauugcuauguauaagcaucaugauagaagaaguaaugcgaucuagguggagcaggaaaauguugaugacagguacucucgcuguguuucuauuacugaucaugggacaauuaacauggaaugaucuaauuagauuguguauaauggucggugcaaaugcaucugauagaauggguaugggaaccacauacuuagcccucauggcgacguucaaaaugcgaccuauguucgcagugggauuacuacuucgaagacuuacaagucgcgaagugcuccuucuuaccauaggauuaucauugguugcaucaguggaguuacccaacucuuuagaagaguuaggagauggauuagccaugggcauaaugauacugaaacuguugacugacuuucagucacaccagcucugggcgacauuacuaucacuaacauucauaaagacuacacuuagucuucacuaugcauggaagacaauggcaaugguauugucaauagucucguuauucccuuuauguuuguccacaacuagccagaaaaccacaugguuaccagucuuauuaggcucauuuggauguaaaccucugacgauguuuuuaauaacagaaaauaaaauuuggggccguaagucuuggccucugaacgaaggcauuauggcaguugggguuguuucuauauuauuaucaucacuucugaaaaacgauguaccuuuggccggcccucuaauugcaggcgguauguuaauagcguguuacgucauuucggguucuaguccagacuugucacucgaaaaagcagcagaaguuaguugggaggaagaagcugaacacucaggagcaagucauaacauccuaguggaaguccaggaugacgguacaaugaaaaucaaagaugaagaaagagacgacacauuaacgaucuuacugaaagcaacauuauuagcgguuaguggaguauauccacuaucgauccccgcaacacuguuugucugguauuuuuggcaaaagaagaaacagcguuccggcguacuaugggauacgccuucuccgccugagguggagcgugccguccuugaugauggaauauauagaaucaugcagcguggauuguugggaagaagucaaguagguguuggaguauuucaagaaaaugucuuccauacaauguggcacguaacuaggggagcgguuuuaauguaccagggcaaacgguuagagccaucaugggcaucagugaaaaaggauuuaauaagcuacggagggggauggcgucuucagggcagcuggaacacuggugaagaaguacaaguaauagcuguugaaccgggcaagaauccaaagaauguucaaacagcgccuggaacuuuuaagacaccugaaggcgaagugggggcgauugcacucgauuucaaaccaggaacaucaggauccccaauaguuaaccgagaaggaaaaaucguaggucucuauggaaaugguguuguaacaacuucaggcacguauguuagugcgauugcacaagccaaagccagucaagagggcccguugccggagaucgaagaugaaguguucaggaagcgaaaccuaaccauaauggaucuacauccuggaucaggaaaaacgcgaagauacuuaccugcaauaguacgcgaagcaauaaaaagaaaacugagaacacucauauuagcgccuacucgcgucguugcaagugagauggcugaggcacugaaggggaugccaauacguuaucaaacaacagcaguuaagucggaacauacagggaaggagauuguggaucuaaugugccacgcgacuuuuacaaugcgacuccucucgccagugagaguuccaaauuauaauaugauuaucauggaugaggcccacuuuacggauccaucgagcauagcagcaagaggauauaucuccacuaggguuggaaugggcgaggcugcggcgauauuuaugacugcaacgccucccggaagcguggaagcauuuccacaaaguaacgcagugauccaagaugaagaacgagacauuccagaacggucguggaacucagguuacgaauggauaacagacuuuccaggaaagacaguaugguuuguucccucgauaaaaagugguaaugauauagcgaacuguuuacgaaagaaugggaagagggugauucaauugucaagaaaaacauuugauacugaauaucagaaaaccaaaaauaacgacugggacuacguuguaacuacagauauaagcgagaugggagcaaauuuuagagcagacagaguaauagacccgagaaggugcuugaaaccuguaauuuugaaagacggcccggaacgaguuaucuuggcagguccgaugccggugacgguugcaagcgcugcacaaagacguggacggauagggagaaaucacaauaaagaaggagaucaauauauauauaugggccaaccuuuaaauaaugaugaggaccaugcacacuggacggaagcaaaaauguuacuagauaacauuaauaccccagaagggauaauccccgcucucuuugagcccgaacgcgagaaaagcgcagcuauagauggagaauauagauugcgaggagaagcuagaaaaacauucguagagcuuaugcggcgcggggaccuaccgguauggcuaucauacaaagucgcuagugaggguuuucaauauucggacagaaggugguguuuugacggugagcguaacaaccaaguauuggaagaaaacauggacguugaaauuuggacgaaagaaggggaaaggaaaaaguugagaccucgcuggcucgaugccaggacuuacagugauccuuuggcccuucgagaauuuaaagaguuugcggcuggucgaagaucaguaucaggggauuuaauuuuagaaaucggaaaauuaccucaacacuugacgcaacgugcacagaaugcacuagacaauuuaguuauguuacacaauuccgaacaaggaggacgcgcuuauagacacgccauggaagaacuacccgacacaauagaaacauugaugcuguuggcguuaauugccguauuaacgggaggaguuacccuauucuuccuuucagguagaggcuuagguaagaccucuauaggauuauuaugugucauggcgucgucugucuuauuguggauggcaaguguggaaccacacuggauagcggcuucuauaauacuugaguucuuccuaaugguacugcuuaucccugaaccggauaggcaaaggaccccacaggauaaucaacuagcguauguagugauaggucuauuauuuaugauccucaccguggccgcuaaugaaaugggucugcuugagacaacaaagaaagaucucgguaucggccaugucgcgguagaaaaccaccaucacgcaacaauguuggauguggauuugcauccggcuucugccuggaccuuauacgccguugcuacaacuaucauaacuccaaugaugagacacacuauagaaaauacuacugcgaauauuagccucacggccauagcgaaucaagcagcaauuuuaaugggacuagacaaaggauggccaauaucaaaaauggacauugguguaccgcuccuagccuuaggcuguuauagucagguaaauccacuaacgcuaacagcagcagugcuaauguuaguagcucacuacgcuauuauaggccccggauugcaagcaaaagccacgagagaagcacagaagagaacugcugcagguauaaugaaaaacccuacuguggaugggauaguagcuauagaucuugacccaguggucuaugaugcaaaguuugaaaagcaacuuggucaaauuauguuacuuauacucuguacaucacaaauauuacuaaugaggacaacaugggcauuaugugagucgauuacacuagcuacaggcccguugaccacacuaugggaaggauccccgggaaaauucuggaauacgacgauagcaguaagcauggcuaauauuuuuagagguucguaucucgccggagccggauuagcauuuucacugaugaaaucucugggagguggaagacguggcacuggagcgcaaggggaaacuuuaggggaaaaguggaaacgacaacuuaaucaacuuucaaaaucagaguucaacauauacaaacguagcggaauuauggaaguggaucgcucagaggcaaaagagggguugaagagaggggaaacaacacgacacgcaguaucuagaggaacagccaaacuacgaugguuuguggagaggaaucugguuaagccagaaggaaaaguuauugacuuaggaugcggaagaggaggguggucguauuauugugcuggcuugaagaaaguuaccgaaguaaaaggauacaccaaagggggacccggacaugaagaaccaauccccauggccacguaugguuggaaucugguaaaauuacauucuggaaaagauguauucuuuacuccacccgaaaagugugauacacuauuaugcgauaucggugaaucaagucccaacccuacaauagaggaaggcagaacacuccggguucuaaaaaugguugaaccaugguuaagaggaaaucaauucugcauaaaaaucuuaaauccauacaugccaucaguaguagaaacauuagagcagaugcaacguaaacauggagguauguugguaagaaauccucuuaguaggaacagcacccacgaaauguauuggguaagcugcgguacggggaauauagucagcgcagucaauaugacaaguagaauguuguugaaccguuuuacaauggcccaccguaaaccuacauaugaaagggauguagaccuuggugcgggaaccagacacgucgcuguagagccggaaguggcuaaucuugauaucauagggcaaaggauagaaaacauaaaacacgagcacaaaucaacauggcauuaugaugaagauaacccauacaaaacaugggcuuaucacggcaguuaugaagugaaaccgagcggcucggcaaguucaaugguuaacggaguaguuaaacuguugacaaagccuugggacgucauucccaugguuacgcaaaucgccaugacagauacuacaccguuuggucagcaacgugucuuuaaagaaaaaguagacacaaggacuccuaaagcgaaaaggggaaccgcgcaaauaauggaggugacagcuagaugguuguggggauuucuuagccgaaacaaaaagccuagaaucugcacacgggaagaguuuacacguaaaguacgauccaaugcugccauuggagcaguauuuguagacgagaaucaauggaacucugcuaaagaagcaguagaagaugaaagauuuugggacuuaguacaaaaagaacgcgaauuacauaaacaagguaaaugugcgacguguguguauaacaugaugggcaaaagagagaagaaauugggugaguucggcaaagcaaaaggaaguagagccaucugguacauguggcucggugcaagauuuuuagaguucgaagcgcucggauuuaugaaugaggaccacugguuuucuagggaaaauucccuaucggguguugaaggagaaggacuacacaaauuaggcuauauuuugagagauauaucgaagauuccaggggguaauauguaugcugaugauacagcuggaugggauacaagaauaacugaagacgaucugcaaaaugaagcuaaaauaacugauaucauggaaccugagcaugcacuacuugcaacaucuauauucaaauuaacauaccaaaauaagguggugagaguccagagaccggccaagaaugguacagugauggacguaauuucaagaagggaccaacguggcucuggacaaguagguacauauggacuuaauacuuucacaaauauggaagcacaauuaaucagacagauggaaagcgaagguaucuuucuaccuagugaacuugaaacucccaaccucgcagaaagaguuuuagauuggcuagaaaaauacggaguagaaagguugaaacgaauggcaauaucaggugaugauuguguuguaaaaccuauugaugaccgcuucgcuacugcacucacagcauuaaaugacauggggaaaguuaggaaagacauaccgcaaugggaacccuccaaagguuggaaugauuggcaacaagugccuuucugcucacaucauuuccaucagcucauaaugaaagacggaagagaaaucgucguuccauguagaaaccaagaugaauuagucggacgugccagaguaucacagggagcuggguggucgcuccgugaaaccgcuuguuuagggaaaucauaugcucaaauguggcaacuaauguauuuucauaggcgagaccuaagguuagcagcaaacgcaauauguucagcagucccuauagauuggguacccaccaguagaaccaccuggagcauacaugcacaucaucaguggaugacuaccgaggacauguuaucuguauggaauagaguauggauugaagaaaauccguggauggaagacaagacucaugucucgaguuggggugaugucccauaccuagguaagagggaagaucaaugguguggaagucuaauuggccugacagcgagagcgaccugggcaaguaacauacagguugcuauaaaccaggugaggagauugauugggaaugaaaauuauuuagacuauaugacuucgaugaaaagauucaaaaaugaaggggauccugagggugcucucugguaa

SEQ ID NO: 21803 - RNA, 9879 nt, Artificial Sequence
  derived and/or modified CDS sequence (opt6) from DENV-1__GU131727__SS-prME
ucaguuacgauguuauugaugcuuaugccgacagcguuggcuuuucauuuaacaacucggggaggagaaccgcauaugauaguaacuaaacaagaacgugggaaaaguuuauuguucaaaacuuccgcugguguuaauaugugcacuuuaaucgcaauggauuugggugaauugugugaagauacuaugacauacaaaugcccacgaauuacugaagccgaaccugaugacguagacuguuggugcaaugccacagauacaugggugacuuacgggacauguucccaaacaggagaacaucguagggauaaaagaaguguugcguuagcaccucaugucgguuuagguuuggaaacgcguacggaaacuuggaugaguagugaaggagcuuggaaacagauccaacguguugaaacaugggcacuacgccacccaggguuuacuguaauagcuuuguucuuagcccaugcaauagguacaucgaucacucaaaaaggaauuauuuuuauccuucuaaugcuaguuacuccaaguauggcgaugagauguguaggcauugguagcagagauuucguagaaggauugucaggagcgacuugggucgaugugguacuagagcacggaucuuguguuacgacuauggcuaaagacaaaccaacccuggauaucgaauuauuaaaaacugaaguuacaaauccagcaguguuacgcaaauuaugcauagaagcaaaaauaucuaacacaacaacagauucucguugcccuacacagggcgaagcaacucuaauggaagaacaagaugcaaacuuuguaugcaggagaacguuuguugaucgcgguugggggaacggaugcggacuuuucggcaaagguucauuaauuaccugugcaaaauucaaaugcgugaccaaacuugaaggaaaaauuguacaauaugaaaaucuaaaauauagcguuaucguuacaguccauacaggagaucaacaucaaguaggaaacgaaaguacugagcauggaacaacugcaacaauaacaccacaagcaccuacaagcgagauucaauuaacugacuauggugcuuugacauuagacuguucccccaggacugggcuagauuucaacgaaaugguacuucuuacgaugaaagaaaagucaugguuaguccacaaacagugguucuuagaccugcccuuacccuggacgucaggugccaguaccucgcaagaaacauggaacagacaagaucuccugguaaccuuuaagacagcacaugcaaagaaacaagagguuguuguuuuaggaucacaggagggagcuaugcauacugcuuuaacgggggccacugagauccaaacuuccggaacgacaacuauauucgcagggcauuugaaaugccgacuaaaaauggauaaauuaacuuuaaaggggaugucauacguaauguguacuggaucguuuaaacucgaaaaagaaguagcugaaacccaacacggcacaguccuaguccagauaaaauaugaaggaacugaugcacccuguaagauucccuucucuacacaggaugaaaaagguguuacacaaaaugggagacuuauaacggcuaauccaauuguuaccgauaaagagaaaccggucaauauugaagcugaaccaccguucggggagaguuauauaguuauuggugcaggagaaaaggcuuuaaaauuauccugguuuaaaaagggaaguagcauaggaaagauguuugaagccacagcucgaggagcaaggcgaauggcgauauuaggcgauaccgcaugggacuuugguucggucggaggcgucuucacaucgguugguaaauuaguucaccaaaucuuuggaacagcauauggcgugcuauuuaguggaguguccuggacaaugaaaauagggauaggcguacucuugaccugguuaggucuaaauucuagaucuaccucacuaaguaugacuugcauugcaguagguuuagucacacuauauuuaggaguaaugguccaagcagacucggggugugugauaaacuggaaagggcgggaauuaaaaugcggaucaggcaucuucguaacaaacgaggugcacacguggacggaacaauacaaguuucaagcggauucccccaaaagacuaagugcugcaauaggaaaggcuugggaagaaggagucuguggaaucagaagcgcgacacgccuagaaaauauaauguggaaacaaaucucaaacgaacuaaaucacauccucuuagaaaaugauaugaaauucacaguggugguaggugacguaguaggcauauuagcccagggcaagaaaaugauaaggccccaaccuauggaacacaaauauaguuggaaaaguuggggaaaagcuaaaaucaucggagcagauguacaaaacacaacauucauuauagacgguccaaacacgccagaaugcccggaugaccaacgggcauggaacauuugggaaguagaagacuacggauucgguaucuuuacaacaaauauaugguugaaacucagagauuccuacacccaaguuugcgaucauagacuaaugucagcugccaucaaggauucaaaagcuguccaugccgauaugggauacuggauagagagugaaaagaaugaaacuuggaaacuagcaagagcuagcuuuauugagguaaagacgugcaucuggccaaaaucccauacacuauggucaaaugguguucuagagagugaaaugauaauaccgaaaauauacggaggacccaucagccaacauaacuacagacccgguuauuucacacaaacggccgggccauggcauuugggaaaacucgaacuagacuuugaucugugugaaggcacuacagugguaguagaugagcauugcgguaaccgagggccuucacuaaggacaacgacaguaaccggcaaaaucauccacgaaugguguuguagaucgugcacauugcccccgcuuagguuuaaaggcgaagauggcuguugguauggcauggaaauuaggccugucaaagaaaaagaggagaaccugguuaaaagcaugguaagcgcuggcucuggugaaguggacucuuucucuuuagguuuacuauguauuucaauaaugaucgaagaagugaugagguccagguggaguagaaaaaugcugaugacggguacccuugcgguuuuucuuuuauugauuaugggucaauuaacguggaacgacuugauccgacuaugcauuaugguuggcgccaacgcgucugauagaauggguaugggcacaacauacuuagcgcucauggcuacuuuuaaaaugagaccuauguucgcaguugggcuauuauuuaggaggcuaaccucaagggagguauuacuacuaaccaucggauugucucucguugcaucagucgaacuaccuaauaguuuagaggaacuaggugaugguuuagcaaugggaauaaugaucuuaaagcucuugaccgacuuccagucacaucaauuaugggccacauuacuaaguuuaaccuuuaucaaaacgacacuuaguuuacacuaugccuggaaaacaauggcuaugguauuaucuauugucucucuauuuccacuguguuugagcacuacaagucagaaaacuacuugguuaccuguauuacuagguagcuuaggaugcaagccauugacgauguaucuuauaacggaaaacaagaucugggguaggaaauccuggccacugaacgaagggauaauggcaguagggguuguguccaucuuauuaagcucccuguugaaaaacgauguuccccuagcagguccguuaauagcgggagggauguuaauagcuuguuauguaauuucagggaguagugccgaucuaucgcuugaaaaagcagcggaaguguccugggaagaagaggccgagcauaguggggcuucacacaacauucuaguggaaguacaagacgacggaacaaugaagauaaaagaugaagagagagaugauacacuaacaauacucuugaaagcaacuuuauuagcuguaucagggguuuacccuuuaaguauuccugccacccuauucguaugguacuuuuggcagaaaaagaaacaacggucaggagucuuaugggacacgccaaguccaccagaaguagaacgcgcgguccuagacgacggaauauacagaauuaugcaaagaggcuugcucggucgaagccaaguuggaguagguguauuucaagaaaacguauuucacaccauguggcacguaacaagaggagcuguucugauguaucaagguaaacguuuagaaccauccugggcaucaguuaagaaagauuuaauuucauauggcggaggauggagacuccaaggaucuuggaauacaggugaggaaguucagguaaucgcggucgagcccggaaagaacccaaagaacguucagacagcuccaggcacauuuaaaacaccagaaggugaaguuggagcaauagcuuuagauuuuaaaccaggaacaucggguaguccaauuguuaauagggaggguaaaauagugggacuauacggaaacgggguuguaacaacaaguggaacauaugucagugcaauagcacaagcaaaggcuucccaggaaggaccuuuaccugaaauagaagacgaaguauuucgaaaacggaaucuuacaauaauggacuuacacccaggcagcggcaagaccaggcgauaucucccagcgaucguuagagaagccauuaaaaggaagcuaagaacacuuauucuugcuccaacgcgugucguugcauccgaaauggcagaagcguuaaagggaaugccaauccgguaucagacaacagcagugaaaucugaacauacgggaaaagaaauuguagaucuaaugugucacgcuacuuuuaccaugcgacuacuaagucccguacguguacccaacuauaacaugauuauuauggaugaggcacauuuuacugacccgucaagcauagcugccagaggauauauuucaacucgagugggaaugggagaggcugccgcgauauuuaugaccgcaaccccgcccggcagugucgaagcauuuccucaaaguaacgcagucauacaagaugaggaacgcgacauuccugaacggucauggaacucggguuacgaauggaucacagacuucccuggcaaaacaguuugguuuguuccgucuaucaagaguggaaaugacauagcaaacugccucaggaaaaaugggaaaagagugauccaauuaaguagaaaaacauucgacacugaauaccagaaaacuaaaaauaacgauugggauuaugucguuacaaccgauauaucagaaaugggagcaaauuuccgcgcagauagggugauugauccgagaaggugccucaaaccaguuauuuugaaagaugggccugaaaggguaaucuuggcaggacccaugccaguaacgguagcaucagcagcucagaggcgaggucgaaucgguagaaaccacaacaaggagggagaucaauacauauauaugggucagccacuuaacaacgaugaagaucaugcucauuggacggaagccaaaaugcucuuagacaacaucaauacuccggagggaauuauucccgcgcuauuugagccagagagggagaaaagugccgcaaucgauggcgaauaccgauuaagaggcgaagccaggaagacauucguagaacucaugagacguggugacuuaccuguguggcugagcuauaaaguugccagugaggguuuucaauacagugaucgacgcugguguuuugauggcgaaaggaacaaucaaguuuuagaagaaaacauggaugucgaaauauggacgaaagagggugaacgcaagaaauugagaccaagguggcuagaugcgagaacguauagugauccuuuggcuuuaagggaguucaaagaguuugccgcagguagaaggucaguaucuggugaucuaauccuagaaaucgguaaacugccucaacaucuuacucagagggcucaaaacgcacucgauaaccuggucaugcuccacaauucugagcaaggaggcagagcauaucgccacgccauggaagaacuucccgauacgauagagacucuaaugcuauuggcccugauagccguuuuaacggguggagugacuuuauucuuucuuucuggacgcggcuuaggaaaaacgagcauuggacuucucugugugauggcaucuaguguucucuuguggauggcuucgguugagccacacuggauugccgcauccauaauuuuagaguucuuuuuaaugguucuacucaucccggaaccugaucgccagcgaacaccccaagauaaucaauuagcauauguaguaauaggauuauuauuuaugauacuaaccguugcagcgaaugaaaugggucuauuagaaacuaccaagaaagauuuaggcauaggucacguugcaguagaaaaucaccaccaugcaacuauguuagauguggaccuccauccagcuagugcuuggacauuauaugcuguagcuacuacuauuaucacgcccaugaugcgucacacaauugaaaacacgacugcaaacauuagucuaacagcgauagccaaccaggcagcgauucuuaugggccuagauaaaggguggccaauaucaaaaauggacauuggaguaccacuacuggcccucggaugcuacucacaggucaacccauugacauuaacagccgccguucuaauguuaguugcgcauuacgcgauuauuggaccaggacuucaagcuaaggcgacaagagaggcucaaaaacgcaccgcggcaggcauuaugaagaaucccacaguagaugguauuguggcgauugacuuagacccaguuguauaugaugcgaaguucgagaaacagcuagggcaaaucauguuauuaauccuuuguacuagccagauuuuguuaaugcgcacuacuugggcacucugugaaucuauaacucucgccacgggcccccucaccacuuugugggaaggaaguccagggaaauuuuggaauacaacaauagcaguaucgauggcaaacaucuuuagaggaucguaucucgcuggcgccggacuagcauucucauuaaugaaaucacuuggugguggaagacguggaaccggugcgcaaggagaaacacugggagagaaauggaaaagacaauuaaaccagcuaucaaaaagcgaguuuaacauauauaagcgaagugggauaauggaaguagaccgcagugaggcaaaagaagggcucaaacguggagaaacaacucgacacgcagugucuagggggacugccaaacuacgaugguuuguugagcguaaucuaguuaaacccgaaggcaaaguuauugauuuaggaugcggaagagguggguggaguuauuacugugcuggucucaagaaaguaacagaaguaaaagguuauacaaaaggagguccugggcacgaagaaccgauaccaauggcaacauacggcuggaauuuaguaaagcuacacucagggaaagacguguucuuuacuccaccugagaaaugugauacucuucuuugugauauaggagaaucaaguccaaacccuacaauagaagaaggacgaacuuugaggguauuaaagaugguugaaccgugguuaagaggaaaucaauuuugcauaaaaauuuuaaacccauacaugccuaguguugucgaaacauuagagcaaaugcaacgaaagcacggaggaauguuagucagaaauccacugaguaggaauaguacacaugagauguauugggucucauguggaacuggcaauauugucucugcagugaauaugaccucucgaaugcuccuaaaccguuuuacaauggcacauagaaagccuacguaugagagagacgucgaccugggugcggguaccaggcacguagcaguagaaccagaggucgcgaaucuagauauaauaggacagcguaucgagaauaucaaacaugaacauaagagcacuuggcauuacgacgaagauaauccauauaaaacuugggcuuaccacggcagcuacgagguuaagccuucaggaagugccaguucuaugguaaauggcgucguaaaauuauuaacgaaacccugggacguaauaccuauggugacacagaucgcuaugaccgauacaacaccauucggacaacagcguguauucaaggaaaaaguagauacucgaacgccaaaagcaaaacguggaacggcucaaauuauggaaguuacagccagauggcuuuggggauuuuugucuagaaauaagaaacccagaauuugcaccagagaagaguuuacaagaaagguaagaaguaaugcggcaauaggggcuguuuucguagacgagaaccaguggaacucugcaaaggaagcaguggaagacgagagguuuugggacuuaguacagaaagaaagagaacugcauaaacagggaaagugcgcgacuugcguauauaauaugaugggaaaacgugagaagaaacuaggggaauuugguaaagccaaaggaagcagagcuaucugguauauguggcuuggagcacguuuucuugaguucgaagcacuaggguucaugaacgaagaucacugguuuagcagagagaauaguuuaucaggaguagagggagaaggucuccauaaauugggauauauuuuaagagauauuagcaagauuccuggaggaaacauguacgcugacgauaccgcaggaugggauacuaggauaaccgaagaugauuugcagaaugaagcuaaaauaacugauauaauggagccagaacaugcuuuacucgcaacaaguauauucaaacuaacguaccagaacaagguuguccgugugcaaaggcccgcuaaaaacggcacggucauggacgugauaucgagaagagaucagaggggaucuggucaaguaggaacauauggguuaaacacguuuaccaauauggaagcccaacugauuagacaaauggagagcgaaggaauauuuuugccgucagaacuagaaacaccuaauuuagcagaaaggguguuagacugguuagagaaauaugguguagaaagauuaaagaggauggccaucucaggagaugacugcgugguuaaaccaauugaugauagguuugcgaccgcccuaacggcacuuaaugauaugggaaaggugcgcaaggacaucccgcaaugggagccuagcaaaggauggaaugacuggcaacaaguuccauuuuguucacaucauuuucaucaacuaauaaugaaggacgguagggaaauugucgugccauguagaaaucaggacgaauuaguagggcgagcacgggucagucaaggcgcaggauggucacuucgugaaacugcguguuuagggaaaucuuaugcccaaauguggcaguuaauguauuuccaucguagagaucugagacuugcugccaaugcaauaugcucagcuguaccgguugacuggguuccaacaucccguacgacuuggucaauucaugcgcaucaucaguggaugacaacagaagacauguuaucaguauggaacagaguauggauugaagagaacccguggauggaagauaagacgcauguaucaaguuggggugauguaccauacuuagguaaaagagaagaccaauggugcggaucucugauaggacuaacagcccgagcuacgugggcgucaaacauacaaguggcaauuaaucaggucagacgucuaauagguaaugaaaauuauuuagacuauaugacauccaugaaacguuuuaaaaaugaaggggauccggagggggcucuaugguga

SEQ ID NO: 21804 - RNA, 9879 nt, Artificial Sequence
  derived and/or modified CDS sequence (opt6) from DENV-1__HM631850__SS-prME
aguguuacaaugcuauuaauguuaaugccaacagcacuugcuuuccacuuaacuacaagagggggcgaaccucauaugaucguuaguaaacaagaaagagguaaaaguuuguuguucaaaacgucugcagggguuaauaugugcacauuaauugcaauggauuugggcgaguucugugaagauacaaugacauauaaaugcccuagaauaacagaagcagaaccggacgacguagacuguugguguaacgcaacagauacauggguuacauauggcacaugcagucaaacaggugaacauagaagagacaaaagaucuguggcacuggcuccccacguuggguuaggauuagaaacuagaaccgaaacauggaugucuagugaaggggcauggaaacaaauccagagaguagaaacaugggcacuuagacacccaggauuuacuguuaucgcucuauuccuagcucaugccauagggacuucgauaacacagaaaggaauuauauuuauuuuauuaaugcugguaacaccaucuauggccaugcgauguguaggaauuggaucaagagauuuuguggagggccugagcggagccacauggguagauguaguacuagaacauggcuccugcgucacaacgauggcaaaagauaaaccaacguuggauauagaauuauuaaaaacggaaguaacaaaccccgcagugcuaagaaaauuauguauugaggccaaaauuucaaauacaaccaccgauucccgguguccuacucagggagaagccacucuagucgaggagcaggaugcuaauuuuguguguagacguacuuuuguugaucgaggauggggaaauggauguggccuauucggaaaagguucacugauuacuugugcaaaauuuaaauguguuacaaagcuagaagggaaaacagugcaauaugagaaucucaaauacucagucauagugacaguacauacaggagaccaacaccaaguuggcaaugaaaguacggagcauggcacuaccgcgaccaucacgccacaggcacccaguacggagauacaguuaacugauuauggagcuuuaacuuuagacuguucacccaggacaggacuugauuucaaugaaauggucuuacuaacaaugaaagaaaagagcuggcuaguacauaaacaaugguucuuggauuugccauuacccuggacaaguggggcuaguacuucgcaggaaacuuggaaucggaaagacuuauuaguaacuuuuaagacggcccaugccaagaaacaagagguugugguccuuggcagucaagaaggagcuaugcacacagcgcugaccggugcaaccgaaauucagaccucaggaacaacaacgauuuuugcagggcauuuaaaaugucggcuaaaaauggauaaacugacgcuaaagggaaugucauacguaauguguacgggaaguuuuaaguuagaaaaggaaguugcggaaacacaacacggcacuguauuagugcagauuaaauaugaagguaccgacgcaccuuguaagauuccuuuuuccacgcaagacgagaaggguguaacccaaaacgguagauugauuacagcaaauccgaucgugacagacaaggaaaagccagugaauauugaagcagaaccuccauucggagaaucuuauauaguaauuggugcuggggaaaaagcacuuaaacuuuccugguuuaagaaaggaucuuccauagguaagauguuugaggcuacugcuaggggagcuagacguauggccauauugggggacacagcaugggacuucggaagcauagggggaguauucacaaguguugggaagcuaguucaccagauauuugguacugcauacggcguacuauuuucaggaguaagcuggacaaugaaaauagguauuggaguccuauuaaccugguuaggauuaaacucuagauccacaucauugagcaugaccuguauugcaguaggccuagucacuuuauauuuaggugugaugguacaggcugacaguggcugcgugauaaauuggaaaggacgugaauuaaaaugugggagugggaucuuuguaacaaaugaaguccacaccuggacugaacaguacaaauuucaggcggacaguccaaaaagacuaucagccgcuauaggcaaggcuugggaggaaggcguuuguggcauacgaucagcaacacgcuuagaaaauauaauguggaaacaaaucucaaacgaauuaaaccauauucuauuggagaaugacaugaaauuuacaguaguagugggugacgucgccggcauuuuagcacaagggaagaaaaugauucgaccacaaccuauggaguacaaauauucauggaaaucauggggcaaagcaaaaauuauaggagccgacguccaaaacacaaccuuuauaauagacggaccgaacacaccugaauguccagacgaccagagggcauggaauauuugggaaguugaggauuauggguuugggauuuucacgacuaacauauggcuaaagcuaagagauaguuauacccaagugugcgaccaccgguuaaugagugcugccauuaaagauagcaaagcuguacaugcagauauggguuacuggaucgaaucugaaaagaaugaaacuuggaaacuagcacgggcuaguuuuauagagguaaaaacgugcauuuggccuaaaucacacacauuaugguccaauggcguacucgaauccgaaaugaucauacccaaaauuuauggaggaccuauaagucaacauaacuaucgcccugguuacuucacucaaacagcaggcccguggcaccuaggaaaauuagaacuugacuucgacuugugcgaagguacgaccguaguaguugacgaacacuguggcaaccgugggccaucacuaaggaccaccacugucacgggcaaaauaauucaugaaugguguugucgaucuugcacauuacccccauugcgauucaaaggagaagauggguguugguacgguauggagaucaggccuguaaaagagaaagaagagaauuuggucaaaucgaugguaucagcagggagcggagaagucgauagcuucaguuuaggccuauuauguauuagcauaaugaucgaagaagucaugaggaguagauggucacguaaaauguugaugaccgggacgcuagcaguauucuuccuauuaauaaugggacaauugacauggaacgacuuaauacggcuauguauuaugguaggcgcuaaugcuagugacagaauggggaugggaacaacauauuuagcgcuuauggcaacauuuaaaaugcgaccuauguuugcaguaggauugcuguucagaagauuaacaucacgugaaguguuacuauuaacaauugguuuaucccuuguagccucggucgaauuaccaaacagccuagaggaauuaggagauggacucgcuaugggaauuaugauccuuaaauuacuaacagauuuucagucacaucaacugugggcgacacuacucagucuuacguuuauuaaaacuacuuucucguuacauuaugccuggaaaacuauggcaaugguauuaaguauuguaucucuauucccuuuauguuuaucaacgacuucccaaaagacaacuugguuaccuguguuacuuggaucacuaggaugcaaaccacuaacaauguuuuuaauugcugaaaauaagauuugggggagaaaaucauggccauugaaugaagguauaauggccgucggaauaguaaguauauuacugucaucccuacuuaaaaaugauguaccccuagcaggaccuuuaauugcuggugguaugcugauagcauguuauguuauuucaggaucaucaccagaccucaguuuggaaaaagcagcugaaguaaguugggaagaagaggcugagcacucaggugcuucucacaauauacuggucgagguccaggacgaugggacaaugaaaauuaaagacgaagaaagagacgauaccuugacuauauuacuuaaagcaacucuguuagcaguaaguggaguguauccgcucaguauaccggccacacuguuuguuugguauuuuuggcaaaagaagaaacagagauccgggguccuuugggacacacccagucccccagaaguagaacgagccguguuggacgaugguaucuacaggauaaugcaaagggguuugcuggggagaagccaaguaggaguaggcguuuuucaggaaaacgucuuucauacaauguggcauguaacaagaggagccguacucauguaccaagggaagcgacuagagcccucgugggcaucagucaagaaagauuugauaagcuacggaggggguuggcgauuacagggaucauggaauacgggcgaagaaguacaagucauagcaguagaaccaggaaagaacccuaagaauguccaaacugcuccagggaccuucaaaaccucggaaggugaggucggugccauagcccuggauuuuaagcccgguacgucggguuccccgaucguaaauagagaggggaaaaucgucggccuauacggcaacggcguaguaaccacuucuggcacuuacguaucagcaauagcucaagcaaaagcgagucaagaaggaccucuaccagaaauagaagaugaagucuuuagaaaacgaaaccuaacuaucauggacuuacauccagguagcggaaaaacaagacgauauuuaccugcuaucguucgggaagccauaaagaggaaacuacgaacccuaauccuagcgccuacgagaguuguagccagugaaauggccgaggcucugaaggggaugcccauucguuaccaaacuacagccguaaaaucugagcacacagguaaagaaaucguggaucuaaugugucaugcaacauucacaaugaggcuauugucuccagugagagugcccaauuacaauaugauaauuauggacgaagcacauuucacggaccccucuucaaucgcugccaggggauacauuucuacccgaguaggaaugggggaagcagcugccaucuuuaugacagcaacgccaccaggaaguguggaggcauuuccacaaucgaaugcaguuauucaggacgaggaaagagauauacccgaaagaucauggaauaguggguaugaguggauuacggauuucccuggaaaaacagugugguucguaccuagcauaaaaaguggaaaugauauagccaauugucucaggaaaaauggaaaaaggguaauucaguugucacgcaaaacguucgauacagaauaucaaaagacuaaaaauaacgauugggacuauguuguuacgacggacauaucugaaaugggagcaaacuuccgggcugaccguguaauagacccgagaagauguuuaaagccugugauuuuaaaagacggucccgaaagggugauuuuagcagggccaaugccaguaacagucgcuucagcagcacagagacgagguaggaucggacgaaaccauaauaaagagggugaccaauacauauauaugggucaaccuuuaaacaaugaugaagaucacgcacauuggacagaggcaaaaaugcuucuugacaacauaaauacaccagaagggauaauaccugcucuguucgaaccagaacgugagaaaagcgccgcgauugauggagaauacagauuaaggggugaagcgcgcaagacguuuguugaauuaaugagaaggggagauuuaccggucugguuaucauauaaaguagcaagugaaggauuucaauauuccgauaggaggugguguuuugacggugagcggaauaaucaaguguuggaggaaaacauggauguagaaauauggacuaaggaaggagaacgaaagaagcucagaccuagauggcucgaugcuaggacauauucugaccccuuagcuuuaagggaauuuaaggaguucgcggccggacgucgaucgguuucaggugaccugauauuagaaauugggaaauuaccucaacacuugacacagaaggcgcaaaaugcguuagauaaccuggugaugcuccauaacuccgaacaagguggacgcgccuaccgccacgccauggaagaauuaccagauaccauugaaacgcuaauguuguuagcuuuaauugcugugcuaacaggagggguaacguuguucuuccuuagcggaaggggacuagggaagacaucaauuggacuccuauguguaauggcuucaucgguucuuuuguggauggcauccguagaaccacauuggauugcugcuucaauaauauuagaguucuucuuaaugguauuauugauaccagaaccagauagacaacggacaccacaagauaaucaacuagcuuacguaguaauaggccuacuuuuuaugauuuugacaguugcugcaaaugaaaugggacugcuugaaaccaccaaaaaggauuuaggaaucggucauguagcaguugagaaucaucaucacgcagccauguuagauguugaucugcacccugcaucugccuggacuuuauaugcgguagcaacgacgauaauaacaccuaugaugcgucacacuauugaaaauacuacugcuaacauaucguuaacagcuauugccaaccaagcagcaauccugauggggcucgacaaagguuggcccauuagcaaaauggacaucgggguaccauuacuugcucuuggauguuacucacaaguuaacccguuaacucuuacagcugccguacucaugcuuguugcacauuaugcaauaauaggcccgggguuacaagcuaaggcaacacgagaagcucaaaagagaacggcugcugguauaaugaaaaauccgaccguugacgguauaguugcaauagacuuagauccgguaguuuaugaugcuaaguuugagaagcaauugggacaaauaaugcuauuaaucuuauguaccagucaaauucuuuuaaugcguaccacgugggcuuuaugugagaguaucacucuagcgacaggaccuuuaacgacauuaugggaggguaguccagggaaguucuggaauacgacgauagcagucucaauggcaaacauauuucgagguucuuauuuagcgggcgcgggacuagcauuuucuuuaaugaaaucauuagguggcggccggcguggcacuggagcacagggugaaacuuugggggaaaaauggaaaagacaauuaaaucaauuaucuaaaucggaguuuaacaccuacaaacguagcggaaucauggagguggaccgaagugaagcaaaagaaggccuuaaaaggggagaaaccacgaagcaugccguaucacgcggaacugcuaagcuaagaugguuuguggaaaggaaccuaguuaaaccagaaggaaaggugauugaucuaggcugcggacgaggaggguggucguacuauugcgccgguuuaaagaagguuacagaaguaaaaggauauacuaaagggggccccggucacgaagaaccuauuccaauggcaaccuacggauggaauuuagucaaauugcacaguggaaaagacguauucuuuaucccucccgagaaaugugacacgcuauuaugcgacauaggagaaagcucgccaaacccuacuauugaagaaggucguacucucagaguuuuaaaaaugguagaaccauggcuuagaggaaaccaauuuuguauaaagauuuugaacccuuauaugcccagcguuguugaaacuuuagaacagaugcaaagaaaacauggggguauguuaguaagaaauccguugaguagaaacagcacgcaugagauguacugggucucaugcggcacaggaaacauaguaucugccguaaauaugaccuccagaauguuauuaaacagauuuacaauggcacauagaaaaccuacauacgaaagagacguggaucuuggugcgggaacgagacauguagcaguagaaccggaaguugcaaacuuggacauuauaggccaaagaaucgaaaauauaaaacacgaacacaaaucaacguggcacuacgaugaagauaacccauacaagaccugggccuaccauggaaguuaugaagucaaaccgagcgguagcgcaagcaguaugguaaauggcguaguaaaguuauuaacuaagccaugggauguaauuccaaugguaacgcaaauugcaaugacugacacaacuccauuuggccaacaacgaguauuuaaggagaaaguugauacuagaacaccuaaagccaagcgaggaacagcacaaauaauggagguaacagcuaaguggcuguggggauuccuaucacggaacaagaaaccacguauaugcacuagggaggaauuuaccagaaaagugcgcucaaaugcagcuauuggagcagucuucguugacgaaaaccaauggaacucagcuaaagaagcuguggaagaugaaagauuuugggaucuaguacauagggagagggaauuacacaaacaaggaaaaugugcaacgugcguauauaacaugauggguaagcgcgagaagaaacuaggcgaguucggaaaagcuaaagggagccgagcaauaugguauauguggcuaggagccagauuuuuggaauuugaagcauugggauucaugaacgaagaucacugguuuucaagagaaaauucauugucuggaguagagggagaaggauuacacaaacuagguuacauauuacgggacauaucgaaaauacccggagggaauauguacgcagaugauacggcggguugggacacaaggauuacugaagaugauuuacagaacgaagcaaaaauaacagacauaauggaaccagaacacgcguuacuagcuaagucaaucuucaaguuaacauaucaaaauaagguugugagaguccagcgccccgccaaaaaugggaccguaauggacguuauaucaaggcgagaucagcggggcucaggucagguaggaacauauggauuaaacacguuuacuaauauggaagcccaacucauaaggcaaauggaaucggaaggcauauuuagcccaucugaacuugaaacuccgaauuuggcuggacgugugcucgauuggcuagagaaacacgguguugagcgucucaaaagaauggcuauuucaggugaugauuguguggucaagccaauagacgaucgauucgcaaccgcauuaacugcauugaacgauauggguaaaguucguaaagauauaccucagugggaaccgagcaaaggguggaacgauuggcagcagguaccguucugcucacaucauuuucaccagcugauaaugaaagauggaagagaaauuguugugccaugccgcaaucaggaugaacugguagggcgugcucgcguuucccagggagcgggauggagccucagagaaaccgcaugucuaggcaaaucuuaugcacaaauguggcaguugauguacuuucacagacgagauuuaagacuugcugcgaacgcaauaugcagcgccguccccguggauugggucccgacaaguagaaccacauggaguauccaugcucaucaccaauggaugacuacggaggacauguuaucugucuggaaucgagucuggauagaagaaaauccguggauggaagacaagacucauauaucgaauuggggagauguaccuuaccucggcaaacgagaagaucaauggugugggucgcuaauuggucugacggcacgcgcaacaugggcaacaaauauucaagucgcgauaaaucaaguucggcgguuaauaggaaaugaaaauuauuuagauuauaugacauccaugaaaagguuuaagaaugaguccgauccagaaggugcccuaugguaa

SEQ ID NO: 21805 - RNA, 9879 nt, Artificial Sequence
  derived and/or modified CDS sequence (opt6) from DENV-1__KF955446__SS-prME
uccguuacaauguuuuugauguuaaugccaacagcauuagcguuucaccuuacuacaagaggaggggaaccucacaugauuguaagcaaacaagaacgugggaaaucauuacuauucaaaacgagcgcugggguaaauaugugcacucuuauagcaauggaucuuggagaguuaugugaggacacgaugacuuacaaguguccgcgaauuacagaaacugaacccgaugacguagauuguuggugcaaugcgaccgauacuuggguaaccuacggcacaugcagucaaacgggggaacauaggagggauaaacgaaguguggcauuggcgccacacguugguuuaggauuggaaacucgaacugagacauggaugucuucagaaggcgcuuggaaacaaauacaacgcguagaaacaugggcucuaaggcauccaggguucacaguaauagcacucuuucuagcgcaugccaucggcacuucaauuacacaaaaagguaucauauucauuuuguuaaugcuaguuacaccaucaauggcuaugaggugcguugguauugguucaagagacuuuguggaaggguuaucaggugcaacauggguggaugucguacuugaacauggcucuuguguaacgacuauggcuaaagacaaaccaacauuggacaucgaauuacuaaaaacagaaguuacaaauccggcuguucuuaggaaauuauguauagaggcuaaaauaucgaauacaaccacggauagccgauguccuacacagggagaagcuacucuaguggaagaacaagacgcuaauuuuguaugucgaagaacguuuguugaccgcggguggggaaacggaugcggacuauuugguaaaggaucccuuauaacgugugcaaaauuuaaauguguuacuaaauuagaaggcaaaauaguacaauacgagaaucugaaauacagugugauaguuacaguucacacaggcgaccaacaucaaguuggaaaugaaucaacagaacauggcacaacggcuacaauaacgccacaagcgccaacuacagaaauccaauugacugauuauggagcacuaaccuuagauugcucuccacgaacuggucuugacuucaacgaaaugguucuucugacgaugaaagagaaaaguuggcuaguccauaaacaaugguuuuuagacuugccccuaccauggacauccggugcaaguacuagccaggaaaccuggaauagacaagaccuccuaguaacuuuuaaaacugcgcacgccaagaaacaggaaguugugguucuagggucacaagaaggugcuaugcauacagcacucaccggugccacagaaauacaaacaagcggaacuacaacgauauuugcuggucaucugaaaugucgauuaaaaauggauaaauuaacuuugaaaggaaugagcuauguuaugugcacaggaaguuucaaauuagaaaaagagcuugcagaaacccaacauggaacaguacucguucaaauaaaauaugaagguacagacgcaccgugcaaaaucccuuuuucgacccaagacgaaaaaggugucacacaaaauggacggcuaaucacagcgaauccuauuguaacagauaaagaaaaaccugugaacaucgaagccgagccgccauuuggcgagaguuauauaguuauaggugccggugaaaaagcgcugaaacuaaguugguuuaagaaaggaucgaguaucggaaaaauguuugaggcgacagcacgaggugcgcgcaggauggcuauauuaggggauacagccugggauuucggcaguaucgggggaguauuuacaucaguaggaaaacugguacaccaaauuuuugggaccgccuauggcguguuguuuagcggugucucauggacgaugaagauugguaucggaguauugcuaacaugguuaggauuaaauucgcgaaguacaaguuugucaaugaccugcauagcgguuggauuagugacguuauaucucgggguuaugguacaagcagauuccgguugcguaauaaauuggaaaggccgagaauuaaaaugcgggucagguauauuuguuacuaaugaaguacacacguggacggagcaauauaaguuccaagcagacagcccaaaaaggcuaagcgcagcaauaggaaaagccugggaggaaggaguguguggaauaagaagugcaacucggcucgagaauauuauguggaaacagauaucaaacgaacuaaaucacauuuuauuagagaacgacaugaaauucacagucguuguuggagauguugcagguaucuuagcucaggguaagaaaaugaucaggccacagccaauggaauauaaauacaguuggaaaaguuggggaaaggccaaaauaauaggggcugauguucaaaauacaacuuuuaucaucgauggcccgaauacccccgaguguccggaugaucaaagagcauggaacauuugggaaguggaagacuauggguuuggaauauuuacaaccaacauauggcucaaacuaagagacagcuauacgcaaguuugugaucacagacucauguccgcggccauaaaagauucaaaggcaguacacgcugauauggguuacuggauagaauccgagaaaaaugaaacguggaaauuagcacgagcuagcuucauagaaguaaaaacguguauuuggccaaagucacacacacuuuggaguaacgguguuuuagaaagugagaugauaauaccgaagauauaugguggacccauuucacaacacaacuaucguccaggauauuuuacacaaaccgcaggucccuggcacuuggguaagcuagaacuugauuucgaccuaugcgaggggacuacaguaguagucgacgagcauugugguaaucgaggaccaagucuuagaacaacuacuguaacugguaaaauuauucaugaaugguguuguagaucauguacgcugccgccgcuacguuuucgaggggaagacggauguugguacggaauggagauaagaccagugaaagaaaaggaggaaaaccuuguuaaaucuaugguuucugcagggagcggcgaagucgauagcuucagccuaggauuacuauguauaucuaucaugauagaggaggugaugcguaguagauggucccgaaaaauguuaaugacugggacacuugcgguauucuuuuuacucauaauggggcaauuaaccuggaaugaucuaauccggcuguguauuaugguaggggcaaacgcuagugaucgaauggggauggguacaacguaccuagcuuugauggcaacauucaagaugagaccaauguuugcaguugggcuucuauuuagacgccuaacaucccgugaagucuuauuacuaacgauaggguuaucauuaguugccucuguagaacugccaaauucuuuggaagaauuaggagauggacuagcgauggggauaaugauauuaaaacuucuaacugacuuucaaagucaucaauuaugggcuacacuccugucacucacauucaucaaaacaaccuucagcuuacacuaugcauggaaaacgauggcgaugguacuaucgauagugagccucuucccucuauguuuaucaacaacaucacagaaaacaacuuggcuuccaguauuacuuggcuccuuagguuguaaaccuuugacuauguuucuuaucgcggaaaauaaaauuuggggacggcgaagcuggccguuaaaugaaggaauaauggccguugggauagucuccauccuucuaucaagucuucucaaaaacgauguuccauuagccggcccauuaaucgcgggagguaugcuaauagccuguuauguuaucagugguagcucugcggauuuaaguuuagaaaaagcggcagaaguaagcugggaggaagaagcugaacacuccggagcaucacacaauauacucguggaaguucaggaugacggaacuaugaaaaucaaagacgaagaaagagacgauacucuuacgauuuuauuaaaagccacauuacuugcaguaucaggaguauauccacuuuccauacccgccacguuauucguuugguauuuuuggcagaagaagaaacaacgcucgggcguauuaugggacacuccuucuccaccugaaguugaaagggcaguacuagaugacggaauauacagaauaaugcaaagaggacuucuuggcagaucgcaaguagggguggguguuuuccaagagaauguauuccacacuauguggcauguaacacguggcgccguacuuauguaucaggggaaacgacuggaacccaguugggcaucaguuaaaaaggaccuuauuaguuacggugguggauggagauugcaaggcucauggaacacaggagaagaaguacaagucauagcugucgaaccugggaagaacccuaaaaauguacaaacggcaccugguaccuuuaaaacuccagagggugaagucggagcaauagcucuugacuuuaagcccggaacuuccggaaguccgauugucaacagggaagggaaaaucguaggacuguauggaaacggggucguaaccacaucugggacuuaugugagcgcaaucgcacaagccagagcaagucaagaggggcccuugccugagaucgaggcagagguuuucagaaaaagaaauuugacgauuauggaucuacaccccgguucagguaaaacacgccgauacuuaccugcuauagugcgagaggcgauuaaaagaaaacuuaggacauuaauacuagcgccuacaaggguaggugcuucagaaauggccgaagcccuaaaaggaaugccuaucagauaccagacaacugcaguaaaaagcgaacacacagguaaagagauaguagaucuaaugggccacgccacuuuuacaaugggguuauuagcuccuggacgagugccgaacuauaauaugguaauuauggaugaagcucauuuuacagauccauccagaaucgcagcucgaggauacaucagcacccguguugguaugggugaggccgccgcaauuuuuaugacagcaacaccaccaggaucaguagaggcuuuuccucaaaguaaugcuguaauacaagacgaagaaagagacauaccagagcgauccuggaacagugguuaugaguggaucaccgauuuuccgggaaaaacuguuugguuuguaccaucaauaaagucuggaaaugauauagcgaacugccugagaaagaacggaaagcgcguuauacaacuaaguagaaagacuuucgauacagaauaccagaaaaccaaaaacaacgauugggacuauguuguaacgaccgauauaucugagaugggagccaacuuuagggcugaucgaguaaucgacccacgucgaugucuaaauccagucauuuugaaagauggaccggaacgcgucaucuuggcuggucccaugccggugacagucgcuucugcagcucagaggaggggaagaauuggaagaaaucauaacaaagaaggcgaccaauauauuuauaugggacagcccuuaaacaaugacgaagaucaugcucccuggacggaagcaaaaauguugcuugacaauauaaacacgccagaaggaauuaucccagcucuguuugagcccgaaagggagaaaagugcagccauugauggggaauccagacuuagaggggaagcaagaaaaacauuuguggagcuaaugagacgaggagauuuaccggucugguuaagcuacaaaguugcaagcgaggguuuucaguauagugauaggagauggugcuuugauggggagcgaacaaaccagguccuagaagaaaacauggcgguggagauuuggccaaaagaaggagaaaggaagaagcuaagaccaagauguuuagaugccagaacuuacagcgauccccuggcucuacgagaauuuaaggaauuuccaccaggucgcagaaguguaaguggcgaccucaucuuggaaauagguaaacuaccacauccuuugacucagagaccgcagaaugcgcucgcgacacuuguaaugagucacacuucggaacaaggcgggcgagcauaccgacaugcgauggaagaguuaccagcuaccauagaaacauuaaugcuucucgcgcucauagcagucuugaccggaggcguaacgcuguucuuuuuaucugggaggggcuuggguaaaacaaguauaggccuauuauguguaauggcauccucuguauuacuauggauggcuagcgucgaaccccacuggauagcugccagcauaauuuuagaguucuuuuugaugguacuacucauaccggaaccagauaguaaugcaacaagacaggauaaucaguuagccuaugucguuaucggauugcuauuuaugauacuuacaguagcugcaaaugaaaugggcuuauuagagaccacuaagaaagauuuaggaauagggcauguugcagucgagaaccaccaucaugcugcuaugcuugauguagaccuucauccggcauccgcuuggacucuuuacgcaguagcaacaaccauuauaaccccgaugaugagacauaccauagaaaacacaacugcgaacaucucguuaacagcgaucgcuaaucaagcugcaauacugaugggucuagcuaaaggauggccaauaaguaaaauggauauaggaguaccuuuauuagcccuagguuguuacucccaaguuaacccgcuaacuuuaacggccccgguuuugauguuagugccucauuauccgauuauaggaccuggacugcaagcgaaagcgacaagagaagcacagaaaaggacagcagcuggaauaaugaaaaauccgaccguagacgguauuguggcaauagauuuagacccgguggucuaugaugcuaaauucgaaaagcaacugggacaaauaaugcuauuaauacucuguaccagucaaauucuauuaaugcgcacuacuugggcguuaugugaaagcauaacccuagcaacaggaccuuuaacaacuuuaugggagggcaguccuggaaaguucuggaauacaacuaucgcaguaagcauggcuaacauuuuucgugguucauauuuagcuggugcuggccuugccuucucgcuuaugaagagucucgguggcggacgacgagguacgggagcgcagggugagacgcuaggugaaaaauggaaaagacaauuaaaccagcuuacaaagucggaguucaauacauauaagagauccgguauuauggagguggaccgaucagaagcgaaggaaggucuaaaacggggagaaacaaccaaacacccuguaucaagaggaacugcaaaauuaagaugguuuguagaacggacucuuguaaagccggaagggaaaguuauagauuuaggaugcgggcgagguggcuggaguuauuauugcgcuggacuaaagaaaguaacagaaguaaagggguacacgaaagggggaccaggacacgaggaccccauucccauggguacauacggauggaaucuaguuaaacucagaagcgguaaagacgucuuuuucauuccaccagaaaagugcgauacuuuacuaugugauauaggagaaaguucaccaaauccaacuauugaagagggaagaacuuuaaggguguugaaaaugguagaaccuugguugagaggaaaucaauuuugcauaaagaucuugaacccauauauggcuuccguuguagaaacccuagagcagaugcaacguaaacacgguggcauguuaguuaggaaucccuuaaguagaaacucaacucaugaaauguauuggguuagcuggggcacaggaaauauugucagcgcuguaaauaugacaucgcgaaugcuuuuaaacagauuuacaauggcccauagaaaaccaacauaugagagagacguagaccuaggggcagguacacggcacguagcaguagaacccgagguagcgaaccucgacauaauugggcaaagaauagagaauaucaaacaugaacacaagaguacauggcauuacgaugaagacaauccuuauaaaacaugggcuuaucaugggucauacgaaggaaaaccuucugguucagcaaguagcaugguuaauggugguguaaaacuauugacaaagccaugggaugguauuccgauggugacucagauagcgaugacagauacgaccccauucggccaacaacgcguuuucaaagaaaaagucgauacaagaaccccuaaggccaagcgagggacggcacaaauuauggaaguuacagcuaagugguuguggggauuuuuaagcagaaacaaaaagccuagaauuuguaccagagaggaguuuacacgaaagguacgcucaaaugcugccauuggagccguuuuuguugaugaaaaccaauggaacucagcaaaagaggcgguugaagaugaaagauuuugggauuuaguacacagagaacgggaauuacauaaacagggaaagugugcuacguguguauacaacaugauggggaagagagagaagaaauuaggcgaauuuggaaaggcuaagggaucccgagcgauuugguauaugugguuaggggcacguuucuuggaauuugaagcguuaggauucaugaaugaagaccauugguucucgagagaaaacucacugucaggcgucgaaggcgaaggacugcauaaacuaggcuacauuuuacgagacauaucaaagauuccaggaggcaauauguacgccgaugacacggcaggaugggauaccaggauaaccgaggacgacuuacaaaacgaggcacguauaacagauaucauggaaccagagcaugcauuacucgcaaaauccauuuuuaaacucacuuaucagaauaaaguaguucgcgugcaaagaccggcuaaaaacgguacggugauggauguaauaucaagacgugaucaaagggggucggggcaaguugggacauauggauuaaauacguuuacuaacauggaagcacagcuaaucagacagauggagagcgggggcauauuuucuccacgagaacuagagacgccuaacuuagcggaacguguauuagauuggguagagaaauacggcgucgaaagacucgagagaauggcaaucucuggugaugauugucuaggugaaccaauauacgauagguucgcuaccgcucuaacagcucucaaugauaugggaaaaguaagaaaggauauuccacaaugggaaccauccaaaggauggaaugauuggcagcaggguccauucugcagccaccauuuucaccaacucaucaugaaagacgggcgcgaaauagucguuccuugucgaaaucaggaugaauuagucgguagggcaagaguuucgcaaggcgccggcuggagucucagagaaacagcauguuuaggaaaaagcuaugcucaaauguggcaauugauggauuuucaucgaagagacuuacggcucgccgccaaugccauauggucagcaggcccgggagauuggauuccaacuagaaggacgacauggucaauucacgcacaucaucaauggaugaccacagaggacaugcuaucagucuggaacaggguguggaucgaagaaaaccccuggauggaagacaaaacccauauaucuucuuggggagacguaccauaccuuggcaaacgagaggaucaauggugugggagucuaauuggacuuacagccagagccaccugggcaacaaauauacaagucgcaauaaaucaaguacguagacucauaggaaaugaaaauuaucuagauuauauggcgaguaugaaaagauuuaaaaaugaaucagauccugaaggugcacuuugguaa

SEQ ID NO: 21806 - RNA, 9879 nt, Artificial Sequence
  derived and/or modified CDS sequence (opt6) from DENV-1__KF921942__SS-prME
uccguaacgauguuauugauguuaaugccuacugcauuagcauuucaucucacuacacgaggcggagaaccucacaugauagugucaaaacaagaaagggguaaaagccuccuguucaaaacuucugcuggcguaaauaugugcacacucauugcaauggacuuaggugaacugugugaagauacaaugacguauaaaugcccucguauaacagaaacugaaccagacgacguagauuguuggugcaaugccaccgauacgugggugaccuacgguacuugcagucaaacaggggaacaucgaagagacaaacgaaguguugcacucgcgccacacguaggacugggauuggaaacaagaaccgaaacguggaugagcucagaaggggcuuggaaacaaauacaaagaguagaaacaugggcucugcgacauccuggauuuacuguaaucgcuuuauuucuugcucaugcaauaggaacaaguauaacucaaaaaggaauaauuuuuauccuauuaauguuaguuaccccuucgauggcgaugagauguguagggauugggucacgagauuuuguagaaggacuuagcggcgcuaccuggguugauguuguucuagaacauggaaguuguguaacuacaauggccaaagauaaaccaaccuuagacauagaacuacuaaaaaccgaaguggcaaauccggcgguacuuagaaaacuuugcauagaagcaaaaauuucaaauacaacgaccgacucacguuguccaacucaaggagaagccacauugguggaggagcaagaugcuaauuuuguaugccgccgaaccuuuguagaucgcggcuggggaaauggcugugggcuauuuggaaaagguaguuuaauaaccugcgcuaaauuuaaaugcguuaccaaacucgaagggaaaauaguucaauaugaaaaucuaaaguacucgguuauaguuacgguacauacuggggaucaacaccaaguaggcaaugagucuacggagcauggaacgacggcaacaauuacgccacaagccccgacaacagagauacaacuuacagauuacggagcacucacauuagauugcucuccaagaacaggacuugacuucaaugaaaugguacucuuaacaaugaaagaaaagucaugguuagugcauaagcaaugguuccuggaccuaccauuaccuuggacaaguggagcuagcaccucgcaagagacauggaaucgccaagauuuauuagucaccuuuaagacugcacaugccaagaaacaagaaguuguuguccuagggucacaagaaggagcuaugcauacagcacuaacuggugcaacagagauucaaacaucaggaaccaccacaauuuuugcaggccaucugaaaugcagauuaaaaauggauaagcuaacccucaaagguauguccuauguaaugugcacaggaucauuuaaacuagagaaagaacuagcugagacacaacauggcacaguguugguucaaauuaaauaugaggggaccgacgcuccauguaagauaccguuuuccacgcaggacgaaaaggguguaacacaaaaugguagguuaauuacugcgaacccaauaguaacugacaaggaaaaacccgucaauauugaagcagagccaccguuuggagagaguuacauaguaauuggugcaggggaaaaggcgcuaaaauuaucuugguucaagaaaggaaguagcaucggcaagauguuugaagcaacugcgaggggugcaaggagaauggcuauuuuaggcgauacagcuugggauuuuggaucuauuggcgggguuuucacuucugccggaaaacuuguacaucaaauuuucggcacugcguauggcguauuauucagcgguguaagcuggacaaugaaaauuggaaucggcguuuuauugacauggcuagguuuaaauaguaggucaacuucacuauccaugacaugcauagcugucggucucguaacucuguaucuggguguaauggugcaggcagauucagguuguguuauuaauuggaaggggagagaacugaaauguggaagcggaaucuuuguaaccaacgaaguucauaccuggacagaacaauauaaguuccaagcagacucacccaagagacugucagccgcaauuggcaaagcaugggaagagggagucuguggcauaaggucugcaacgcgucuggaaaacauuauguggaaacaaauuucaaacgaacuaaaucauauauuacuugagaacgacaugaaauucacaguaguuguuggggacgucgccgggauuuuagcccaggggaagaaaaugauuagaccucaaccaauggaauacaaguacucauggaaaucaugggguaaagcuaagauaauaggagccgacguacaaaacacuacguucauaauagaugggccuaauacaccagaauguccagaugaucaaagagcauggaacaucugggaaguugaggauuauggguuugguauauuuaccacuaacauuugguuaaagcugcgagauucauauacucaaguaugugaccauagacuaaugucugcggcaauaaaagauaguaaagccguucaugcagacaugggauauuggauugaaucagagaaaaaugaaacauggaaguuagcccgagccucguuuauagaagugaaaacgugcauuuggccaaaaucucacacacucuggucgaauggaguacucgaaucagagaugauuauuccgaaaauauacggagggccuauaucacaacacaacuauagaccgggguauuuuacccaaacagcaggaccauggcauuuaggcaagcuagaauuagauuuugaucugugugagggaaccacggucgugguugaugaacauugcggcaacagggggcccucuuuaaggacgacaacagucacaggaaaaauaauacacgaaugguguuguaggucgugcacuuuaccgccauugcgauuuaggggagaggauggcugcugguacggaauggaaaucagaccaguaaaagaaaaagaggaaaaucucgucaaaucaauggucagugcuggcaguggagagguagauaguuucucuuuaggacucuuaugcaucagcauaaugauugaggaagucaugaggucaagauggaguagaaaaaugcuaaugacagguacuuuagcgguguucuuuuuauuaaucaugggacaauugacauggaacgaucugauacgucugugcauuaugguuggagcuaaugcgagugauagaaugggcaugggcacaacauaccuugcacuaauggcaacuuuuaaaaugagaccuauguucgcaguagggcuacucuucagaagguuaacaucuagagagguucucuuguuaacuauagguuuaucuuuaguugcaucgguagagcucccgaacucuuuggaggaauugggugaugggcuagccauggggauuaugauuuuaaaauuauuaacggacuuucaaucucaucaauuaugggcuacauuacuuucuuugacuuuuauuaaaacaacguuuucucuacauuaugcauggaaaacaauggccaugguucuuuccaucgucagccuguucccacugugucuaucaacgacaagucagaaaacuacguggcuacccguucuauuaggauccuuaggcuguaaaccccuaacaauguucuuaauagcagagaacaaaauaugggguaggaggucuuggccauuaaaugaggggauaauggcugugggaaucguauccauacuacugagcucauuauugaagaaugaugucccccuagccgguccucugauagcgggugguauguugauugcauguuacgugauaucgggcucgucagcugacuuaucgcuagaaaaagcggcugaaguauccugggaagaagaagccgaacauaguggagccucacauaauaucuuaguugaagugcaagacgauggaacaaugaagauuaaagaugaagaacgagaugauacgcuaacaauucuuuuaaaagcgacauuauuagcaguaagugguguguauccccuaaguauaccagcaacacucuuuguaugguauuuuuggcaaaagaagaaacaacguucuggaguccuuugggacaccccuucuccaccagaaguagaacgagcaguccuugacgauggaauauacaggauaaugcagagagggcuccuaggccgcucucagguaggaguuggcguguuccaagagaacguauuccacacuauguggcaugucacaagaggcgcugugcuuauguaucaaggcaagagguuggaaccuucaugggcgucagucaagaaagauuuaauaucuuauggcgguggcuggaggcuucagggcaguuggaauacaggcgaagaaguccagguaauagccguugaaccugguaaaaaucccaaaaacguacagacugcuccaggaaccuucaaaacacccgaaggagaggucggggcaauugcguuggauuucaagccaggaacaucgggaucccccauuguuaaucgagaaggaaaaauaguagggcuauacggaaaugguguaguaacgaccucagguacguauguaucugcaauugcucaagcaaaagcaucacaagagggaccauuaccugaaauagaagacgaaguauuuagaaaaagaaaccuaacgauuauggaccuccauccagggucaggaaaaacccgucgauaccugcccgcuauugucagggaggcaauaaaaaggaaacuucguacccuuauacuugcaccgacacgcgucguggccucagaaauggcugaagcauugaaaggcaugccuauaagauaucaaaccaccgcaguaaaaucagagcacacagggaaagaaauagucgacuugaugugucaugcuacauuuaccaugagauuauuaaguccagugagaguuccaaauuauaauaugauaauaauggacgaagcacauuucacagauccuaguucuauagcagcacgcggguacauaucaacaaggguaggaaugggggaagcggccgcaauuuucaugaccgcaacuccuccaggaucagucgaggcguuuccccaauccaaugcugugauccaggaugaagaacgugacauaccagaacguaguuggaacucuggauacgaauggauuacugauuuuccaggaaaaaccguaugguuuguacccucaauuaaaagcggaaaugauauugcaaacugccuucgcaaaaacggaaaacgagucauccaacucucucguaagacguucgauacugaauaucagaaaaccaaaaauaacgauugggauuauguaguuaccacggauauaagcgaaaugggugcaaacuuuagggcggacaggguaaucgaccccaggcguugccugaagccugugauuuugaaagacggaccagaaagaguaaucuuggcagguccaaugcccgucacgguagccagugccgcacagagacgaggcaggauuggacggaaucacaacaaagagggcgaccaauauauauauaugggccaaccauuaaauaaugacgaggaccaugcucacuggacugaggcgaaaauguuauuggacaauauaaacacaccagaaggcauuauacccgcacuuuuugaacccgaacgugaaaaauccgcagccauugacggagaguacagacugagaggcgaagcucggaaaacuuuuguggaauuaaugcgccggggagaccuccccguuuggcuaaguuauaaaguagcuagugaaggcuuucaauauagcgauagaagaugguguuuugacggagagagaaauaaucagguuuuggaagaaaauauggacgucgagauuuggacgaaggagggugaaagaaagaaauuacgaccuagauggcuugaugccaggacuuacagcgauccuuuagccuugcgugaguuuaaagaguucgcggcagguaggcgaucuguuuccggagauuuaauucuagaaauaggcaaacuuccgcagcaucuuacacagagagcgcaaaacgcccuagauaauuugguuaugcuacacaauucagagcagggaggacgugcuuacaggcaugcgauggaagaauugccagacacuauagagacucuuauguugcuugcgcugauagccguuuuaacaggaggaguuacucuguuuuuccucucagguagaggacuagggaagacaaguauagggcuauuaugcguaauggcaaguucaguacucuuauggauggcaaguguagaaccucacuggauagcagcaagcauaauuuuagaguucuuccucaugguguuauuaauaccagaaccagaucggcaacgaacaccacaggacaaucagcuugcuuacgucguaauaggauuacuuuucaugauacuuacaguagcggcuaaugaaaugggccuccuugaaacgaccaagaaggaccucgguauaggacacguagcaguagagaaucaccaucaugcggcaauguuggacguagacuugcaucccgcaucugccuggacgcuuuaugcaguggcuacaacgaucaucaccccaaugaugagacauacgauugagaacacuaccgcaaauauaucucuaaccgcaauagcuaaccaagcggcgauccucaugggacuagauaaaggguggccuaucaguaaaauggacauuggcguaccauuguuagcuuugggcugcuauucccaagucaauccgcucacgcuaacagcggcaguacugaugcuagucgcgcacuacgcaauaauuggacccggauugcaggccaaagcuacgcgugaggcacagaaaagaacagcugccggaauaaugaaaaacccaacugucgauggaauaguagcaaucgauuuggaccccguagucuaugaugcaaaauuugaaaaacaauugggacaaauaauguuacugauucuuuguaccagucaaauacuacuaaugagaacuaccugggcauuaugugaaucaauaacauuagcuaccggaccauuaaccacacuuugggagggaaguccuggaaaauuuuggaauacaacuauugcuguaucgauggcgaauauauuucgggguagcuacuuagcgggagcuggcuuagcuuuuaguuugaugaaaucuuuagguggagggaggagagggaccggagcacaaggagaaacccucggugaaaaguggaaaaggcaguuaaaucaacuaucuaagagcgaguucaacacauacaaaagaucuggaaucauggagguagauagaucugaagcaaaagagggccuuaaacgaggagaaacaacuaagcacgcaguuagucgagguaccgcaaaauuacguugguucguagaaaggaaccuaguaaaaccugaaggcaaagucauagauuuaggauguggccgagguggguggaguuauuauugcgcuggucugaagaaaguaacagaaguaaaaggauacacuaagggugguccugggcacgaagaaccaauccccauggcgacuuauggauggaacuuggucaaauuacacucaggaaaggauguauuuuucaucccaccagaaaaaugugacacucuccuaugcgacauuggagagaguucuccgaauccuacuauagaagaaggacguacauugagaguauugaagauggucgaaccgugguuacgagguaaucaauucugcauuaagauucuaaauccauacaugccuucagucguagaaacucuagaacaaaugcaacguaagcaugguggaaugcuaguaagaaauccacuuucacguaauucaacacaugaaauguacuggguaucuugugggaccggaaauauuguaucagcaguaaauaugacuuccagaaugcuacuaaacagauuuaccauggcccaccguaaaccaacauacgaacgugauguagaucuuggagcaggcacgagacauguugcuguagagccagaaguugccaaucucgacauaauagggcagagaauagagaacauaaaacacgaacauaaaaguaccuggcacuacgacgaagacaacccuuauaaaacgugggcuuaccaugguucguacgaaguaaaacccaguggcagugccucuaguaugguuaauggcguagugaaauuauugacgaagccgugggaugucaucccaauggucacucaaauagcgaugaccgacacgacgccguucggccagcaaagggucuuuaaggaaaagguagacacgcgaacuccaaaggccaagcguggcacagcacagauuauggaaguaaccgcaaaaugguuguggggauuuuuaucucgaaauaagaaaccucgaauauguacaagagaagaauuuacuagaaaaguacgcucaaaugcugcaauuggugcuguguuuguggacgaaaaccaauggaacucagcaaaagaagccguugaagacgagagauucugggacuugguacauagagagagagaacugcacaaacagggaaaaugugcaacauguguuuacaauaugauggguaaaagggagaagaaacuaggugaauuuggaaaagccaaagguagcagagcaauaugguauaugugguuaggagcuagauuuuuggaguuugaggccuuaggauucaugaaugaagaucauugguuuucaagagaaaacucauuauccgguguugaaggggagggucuacauaaauuggguuauauacucagagauauuucaaaaauaccugguggcaacauguacgcggaugauacagcuggaugggacacaaggauuacagaagaugaccuacagaaugaggcaagaauaacggauauaauggaacccgagcaugcccuacuugcaaaaucuauauucaagcuaacauaccaaaauaaaguugugcguguacaaagaccugcaaagaacggcacgguaauggacgugauuagccguagagaucagcgugguucaggucaaguuggcacauacggauuaaacaccuucacaaauauggaagcgcaguuaauucgacaaauggagucggaggggauauuuucuccaagugaacuagaaacucccaauuuagcggagagaguucuugauugguuagagaaguacggcgucgaaagguuaaagcgaauggcgauaagcggugaugacuguguaguuaagccuaucgacgaccgauuugcaacugcacuaacugcauuaaacgauaugggaaaaguuagaaaagacaucccccagugggaacccucgaaagguuggaaugauuggcaacaaguccccuuuuguucacaccauuuucaucagcucauuaugaaagauggaagagaaauuguuguaccaugucgcaaccaagacgaauugguaggccgugccagggugucucagggcgcaggcuggagucuaagagaaacagcgugucuaggaaagagcuacgcgcaaauguggcaguugauguacuuucauagaagggaucuaaggcuagcagccaacgcaauaugcagcgcuguaccugucgacuggauuccaacuagcaggaccaccuggaguauacaugcucaucaucaauggaugacgacagaagauauguuaagcgucuggaaccguguguggauugaagaaaauccauggauggaggacaaaacgcacauaagcucguggggagacguaccauacuuaggaaaacgugaagaccagugguguggaaguuugauaggacucacagcacgagccacaugggcaacuaacauacaaguagccauuaaucaaguacgccgcuuaauaggaaacgaaaauuaucuugauuacaugaccuccaugaaacgguucaaaaaugaaucggacccugagggugcuuuaugguaa

SEQ ID NO: 21807 - RNA, 9879 nt, Artificial Sequence
  derived and/or modified CDS sequence (opt6) from DENV-1__JF937602__SS-prME
ucaguuaccaugcuacucaugcucaugccaacggcacuagcauuucaccuuacuacccgugguggugaaccacauaugauagucagcaaacaagaaaggggaaaaucuuugcuauuuaaaacuucagcagggguuaauauguguaccuuaauagcaauggacuuaggugaauuuugugaagauacuaugacuuacaaaugcccaagaauaacggaagcugaaccagaugaugucgauuguuggugcaacgcaacggauacguggguuacuuauggaaccuguagccaaacaggagaacaccgaagagacaaaagaaguguggcgcuagcaccucacguugguuuggguuuagaaacacgaacggaaacauggaugaguucugaaggggcauggaaacaaauacaacggguggaaacaugggcccucagacaccccggguuuacugugauagcguuauuccucgcgcaugcgauugguaccucuauaacucaaaaaggaauuauuuucauacuacugauguuaguuacccccucaauggcgaugagaugcguggguauaggaucuagagauuuuguugaaggucucaguggagcgacuuggguggacguaguucuugaacaugggucaugcguaacaacuauggcuaaggauaaaccaacguuggauauugaguuauuaaaaacggaagugacuaauccagcaguauugagaaaauuaugcauugaagcuaaaauuuccaacacaacuaccgauagcagaugcccuacacaaggggaagcaacccuaguugaagaacaggaugcuaauuuuguaugucggcgaacuuuuguugaucgaggauggggaaauggauguggucuauuugguaaaggaucacuuauuacgugugcaaaguucaaaugcguaacgaaauuagaaggaaaaauaguccaauaugaaaaucuaaaauauucaguaauuguaacuguucacaccggagaucaacaucagguugggaaugaaaguacagaacacgguacuacggccacgaucacuccucaagccccuaguaccgaaauccaauuaacugacuauggcgcgcuaacucuggauuguucaccgagaacuggacuagauuuuaacgagaugguccuccuuaccaugaaagagaaaaguuggcuaguacauaagcaaugguuuuuagacuugccauuaccuuggacaucaggagcaaguacuucacaagaaacguggaauagacaagaccuccuuguaacauuuaaaacggcgcacgcuaaaaagcaagagguaguuguacuggggucucaagagggagcuaugcauacagcgcuuaccggugccacagaaauacaaacgagugggacuacuacaaucuucgcaggucaucuaaagugccgauuaaaaauggauaaacucacgcuaaaggggaugucguaugucaugugcaccggaucuuuuaagcuagaaaaggagguugcagaaacucagcauggaacuguauugguacaaauuaaguaugaaggaacggacgcuccguguaaaauaccauuucuuacacaagaugaaaaaggaguaacacaaaaugggcgauuaauaacugcuaacccaaucgugacggauaaggaaaaaccaguaaacauagaagcggagcccccuuuuggcgagucauacauagucauaggagcaggagaaaaagcacuaaaauugucgugguuuaagaaagguucuaguauagguaaaauguuugaggcuacugcaagaggugcacguagaauggccauacugggugauaccgcgugggauuuugguagcauaggagguguauuuacgucagucggaaaacucguacaccaaauauucggaacagcauauggaguacuauucagcgggguuaguuggacaaugaagauagguauuggaguacuauuaacuuggcucgggcuuaauucaagaagcaccagccuuucaaugaccugcauagcgguuggccuaguaacuuuguaccucggcgugaugguacaggcagauaguggcugcgucauaaauuggaaaggaagggaauuaaaguguggaucgggaauuuuuguaacaaaugaaguacacacauggacagaacaguauaaauuccaagcagacucaccaaagcgacuaucagccgccauaggaaaggccugggaagaagguguauguggaauaaggucugcuacuagacucgagaacauuauguggaaacaaauaucuaaugaguugaacuauaucuuauuagaaaacgauaugaagcuaacagugguugugggagacguugccggaauauuggcacaagggaagaaaaugauucgcccacagccgauggaauauaaauauucuuggaaaagcugggggaaggcaaaaaucauaggagccgaugugcaaaauacaacauuuauaauugaugguccuaauacacccgaaugcccggaugaucaacgagccuggaauaucugggaggucgaggauuaugguuucggaauauuuacaacuaacauaugguuaaaauuacgagauucuuacacacaaguuugugaucaucgacugauguccgcggcaauaaaggacucgaaggcaguucacgcagauaugggguauuggauugaaagugagaaaaaugaaacauggaaacucgcaagagccagcuuuauagaagucaagacguguaucuggccgaagucucauacucuuuggagcaacggaguccuagagucagaaaugauaauaccaaaaauuuauggcggaccaauaagccaacacaauuaucggccaggauacuuuacgcaaaccgcuggaccguggcacuuggguaaauuagaacuggacuuugaucuuugugaaggaacgacaguagucguugaugaacauugcgguaauagagggccaucacuacgaacgacaacggugacaggcaaaaucauacacgagugguguuguaggaguugcacguuaccuccccucagauuuaagggagaagacgguuguugguauggaauggaaauacgaccuguaaaggagaaggaagaaaaccucguaaaaagcaugguauccgcaggauccggcgagguagauaguuuuucccucggguuacuuuguauaucaauuaugauugaggaaguuaugcggucacgauggucaagaaaaaugcuuaugacugguacucuggcuguauucuuuuugcuaauaaugggacaauuaacauggaaugaucuaauuagacuaugcaucauggugggagcaaaugcuucagaccgaaugggcauggguacuacauaucuugcccuaauggcaacuuuuaagaugaggccgauguuugcugucggccuucuuuuucguagauugacaaguagggaaguacuauuauuaacaaucggacuuuccuuaguggccagcguagaacuucccaacagucuagaagaauuaggugauggacuugcaaugggaaucaugauauuaaaauuacugaccgacuuucaaagccaucaacuuugggcuacacuuuugucguugacauuuguucgaacaacuuucaguuuacauuaugcuuggaaaacaauggcaaugguauugucaauagugagccuuuucccucuuugucucuccacuacaucacagaaaacaacaugguuaccgguacuacuagguaguuuagguugcaagccauuaacuauguuuuuaauugcugagaauaagauaugggggcguaagagcuggccauuaaaugagggcauuauggcgguaggcauagugagcauacugcugucgucccuucugaaaaaugaugugccauuggcaggaccuuuaaucgcugguggaaugcuaauagcauguuacgucauuaguggaucuagugcggauuugagccuggaaaaggcugcugucgugucaugggaggaagaagccgaacauucaggagcuagucauaauauauugguugaaguacaagaugacgguacaaugaaaauuaaagaugaggaaagagacgauacauuaacuauacuucuaaaagcaacauugcuugcuguaucagguguauauccccucagcauaccggcaacauuguuugucugguauuuuuggcagaagaagaaacaaagguccggaguucuuugggauacuccaaguccaccggagguagaaagagcgguucuagaugacggcaucuacagaauuaugcaacgaggauuguuaggaagaucacaaguuggaguagggguguuccaggaaaacguauuccacacaauguggcauguaacaaggggagcaguauuaauguaucaagggaaaagauuagaaccuucuugggcaucgguuaaaaaggauuugauuagcuauggaggagguuggcgacuucaaggauccuggaauaccggagaagaaguacagguaaucgcgguggagccugguaaaaacccaaagaacguacaaacagcuccgggcacuuuuaaaacaagcgaaggugagguuggagcgauugcccuugacuucaaaccagguacaaguggcagcccgauaguuaaucgugaaggaaaaauuguaggacuauaugggaauggaguaguaacgaccuccgggacuuacgugagugccauugcucaagcuaaggcaucgcaggagggcccuuuaccagaaauagaagacgaaguguuuagaaaacgaaaccuaacuaucauggaccuacaucccggaucagguaaaacgagacguuaucuaccugcaauugugagagaagcaauaaagagaaaauuacggacauugauauuagccccaacgagaguaguagcaucagagauggcagaggcacugaaagguaugccaaucagauaucaaacaacugcaguaaaaucagagcauaccggcaaagaaauaguugaccuuaugugccaugcuacauuuacuaugagauuauugaguccuguuaggguaccgaauuacaacaugauuauaauggaugaggcgcauuuuaccgacccgucuucaaucgcggcgagaggcuacauuuccacgcgcguaggcaugggggaagcagcugcuauauuuaugaccgcaaccccaccgggaucugucgaggccuucccgcaauccaaugcuguaauacaagaugaagaaagagacauuccggaaagauccuggaacucgggcuacgaauggauuaccgauuuuccgggaaaaacggugugguuuguaccuuccauaaaaucugggaaugauauagcaaauugucuaagaaagaauggaaaaagagugauucaacugagccguaaaacguucgacacagaauaccagaagacuaaaaacaacgacugggacuauguuguaacaacugauaucucagaaaugggagcaaauuuucgcgccgauagaguuauagauccccgaagaugucuaaaaccuguaauucuaaaggauggaccagaaagaguaauacuugcgggaccgaugccuguuacuguugcaucggcggcgcaaagacgagggagaauaggacgcaaccacaauaaagaaggagaccaauauauauacaugggucagccacuaaauaacgacgaggaccacgcucauuggacggaagcaaagauguuauuagauaacauuaacacuccagaggggauuauuccagcacuuuucgagccugagagagagaaaucagccgcuauagacggcgaauauaggcuuagaggggaagcgcgcaagacauuuguggagcucaugaggaggggcgaucuaccuguguggcuuagcuacaaaguugcaucagagggcuuccaguauucggauagaagguggugcuuugauggagaaagaaauaaccaaguauuagaagagaauauggauguugaaauauggacuaaagaaggugaaaggaagaaauuacggccuagaugguuggaugcucgaacuuauucggauccacucgcauugcgggaauuuaaagaguucgcggcaggaagaagaucuguaaguggagaccuaauccucgaaauagggaaacuuccacaacauuugacacagcgugcgcagaaugcacuagacaaucuuguuaugcuccauaauucugaacaaggaggucgggcauaccgccaugcuauggaagaacuuccagauacuauugaaacacuuauguuauuggccuuaauugcuguacuaaccgggggaguaacucuguucuuuuuaagcgggagggguuuaggcaaaaccucaaucggauuauugugcguuauggcuucaucaguccucuuguggauggcuucaguagaaccccauuggauugcggccagcauuauucuagaauuuuuccuuauggugcugcuuauacccgaaccggacagacaaagaacaccacaggauaaucaacuugcguauguagucaucgguuuacuguucaugauauuaaccguggcugcgaacgaaaugggccuauuagaaacuacuaagaaagaccuagguauuggacauguggcaguagaaaaucaucaucaugcugcaauguuagacguagaucuacacccggcuucagcuuggacauuguacgcagucgccaccacgauuauaacuccuaugaugcggcacacaauugaaaauacaacagcuaauauaaguuuaacagcuauagcaaaucaagcggccauccucauggggcuagacaaaggguggccaaucuccaaaauggauauagggguaccucucuuagcauuaggauguuauucucaaguaaauccgcuaacuuuaacagcugcggugcugaugcucguagcucauuaugcaauaauugguccgggacugcaagcaaaagcaacaagagaagcccagaaaaggacugcagcaggcaucaugaaaaacccaacaguagacggcauuguagcaaucgaucuagauccagucguauaugaugcuaaguucgaaaaacaacugggccaaauaaugcucuuaauucuaugcacuucacaaauacugcuaaugagaacaacaugggcauuaugcgagaguaucacucuagcuacagguccccuuacuacguuaugggaaggaagcccuggcaaauuuuggaauacgacuauagccguaagcauggcaaauauauucagggggagcuaucucgcuggggccggucuugcuuuuagcuuaaugaaaucacucggaggaggacgucgugguacaggagcucaaggagagacccugggggaaaaauggaaaagacaguuaaaccagcuuagcaaaucagaauuuaacacauacaaacgcucugguauuauggaaguggaccguagcgaggcuaaagaaggacucaaaaggggugaaaccacgaagcaugccgugucacguggcacagcaaagcuccggugguuuguagaacgaaauuuagugaaaccagagggaaaaguaauagacuugggcugcggaagaggugguuggucauauuacugugcaggacucaaaaagguaaccgaaguaaaggguuacacuaaaggcgggccaggacaugaagaaccaauaccaauggccacauauggauggaauuuagugaaacuccacucaggcaaagauguguucuuuauuccaccggaaaaaugugauacacuauugugcgauaucggugaaucaucaccuaaucccacaauagaagagggucguacacuaagaguacuuaagaugguagaaccaugguugagagggaaccaguuuugcauuaaaauauuaaacccauauaugccaagcgugguugaaacacuagaacaaaugcaacgaaaacacggaggaauguuaguaagaaauccauuaaguagaaacaguacacaugaaauguauugggucucaugcggaacugguaauauaguauccgcaguaaauaugaccucgcguaugcuauuaaacagauuuacaauggcucaccgaaagccaacguaugaacgagaugucgaccuuggugcugguacccgucaugucgcugucgagccagaaguagcuaaucuggacauaaucggacaacguauagaaaauauaaaacaugagcacaaaaguaccuggcauuacgacgaagacaauccguauaaaacaugggcguaucacggaucauaugagguuaaaccuagugguagugcuuccagcaugguaaaugguguaguaaaacucuuaacuaaaccaugggauguaauuccgauggugacucaaauagccaugacagacacuacaccauuuggacaacagagaguuuuuaaagaaaaaguugauacaagaacacccaaagcaaagcgaggaacagcccagauuauggaagugacagcaaaauggcuauggggauuuuuaucacgcaauaaaaagccuaggauauguacuagagaggaguucacacgaaaaguaagaaguaaugcagcaauaggugcugucuucguggacgagaaccaauggaacucugcaaaagaagcuguugaggaugaacguuuuugggaccuuguccacagggaaagagaauuacauaaacaagguaaaugcgcgacaugcguguauaauaugaugggaaaaagagaaaagaaauuaggugaguucggcaaagcaaagggcucgagagcaauuugguacaugugguugggagcaagauuccuagaauuugaagcauuggguuucaugaaugaggaccauugguuuucucgggaaaauucauuaucaggaguggagggagaaggacuucauaaacuuggauauauucuucgagacauuaguaaaauaccaggugguaacauguaugcggacgauacagcgggcugggacacaaggauaacagaagaugaucuacaaaaugaggcuaaaauuaccgauauaauggaaccagaacaugcucuuuuagcaaaaagcauauuuaagcuaacguaucaaaauaagguaguaaggguccaacgaccggccaaaaauggaaccguaauggacgucauuuccaggagagaucagcgggguagugggcagguaggaaccuacggcuugaacacauucaccaacauggaagcgcaauuaauacgucaaauggaaucugaagguaucuucucgccaagugaacuggaaacaccuaacuuagccggacgaguucuagauuggcuggaaaaacauggaguagagagauugaaaagaauggcuaucaguggagaugauuguguuguaaagcccauagaugacagauucgcaacagcacucacagcacuaaaugacaugggaaaaguaagaaaagacaucccucaaugggaaccaucaaaaggauggaaugauuggcaacaaguaccuuuuugcucccaccacuuucaccaacuaauaaugaaagaugggcgggagauaguugugccaugccgaaaucaagaugagcucguagguagagcacggguaucccagggagcugguuggaguuugagggaaacagcuuguuuagguaaaucauacgcacaaauguggcaauuaauguauuuucaucgucgugauuuaaggcuagccgccaaugccauuuguucagcuguaccggucgauuggguuccgacuucgaggacaacuuggucgauacaugcacaccaccaauggaugacuacugaagauauguuaaguguauggaauagaguuuggauagaagaaaauccauggauggaggauaaaacgcauauaaguucguggggugaugucccguaucuuggaaaacgagaagaucaguggugcggcucuuugaucggacuaacugccagagcaaccugggcuacaaacauacaaguggcaauaaaucaaguacgucgucuauugggaaacgaaaauuaccuagacuauaugacgucuaugaagcgguuuaagaaugaaagugauccagaaggugcacuaugguag

SEQ ID NO: 21808 - RNA, 9879 nt, Artificial Sequence
  derived and/or modified CDS sequence (opt6) from DENV-1__GU131729__SS-prME
ucaguuacuauguugcuuauguuaaugccuacggcucuagcauuucauuuaacuaccagagguggagaaccucacaugauuguaucgaaacaagaacgcgguaaauccuuacuuuucaaaaccagcgccggagugaauauguguacccuaauagccauggacuuaggugaauuaugugaagacaccaugacauacaaauguccaagaaucacugaaacugaaccugacgacgucgauuguugguguaaugccacggauacaugggugacguauggaacgugcucucaaacuggagaacacaggcgagauaaacgcucaguugcccuggcuccucaugucggucugggauuagaaacacguacugaaacguggaugucgucagaaggugcuuggaaacaaauacaacggguugaaacaugggcacugagacaucccgguuuuaccguuauugcuuuauuucuagcucaugcaauugguacaaguauaacacaaaaaggaauaauuuucauacuacugauguuagucacacccucuauggccaugagauguguuggaauugguucgagagauuuuguagaaggacuuucaggugcaacauggguagauguaguacuggagcacgguucgugcguuacuacaauggcuaaagacaaacccacauuagauauugaauuacugaaaacagaagugacgaacccugcagugcuaggaaaacuauguauugaggcaaaaaucucaaauacuaccacugacagccgauguccaacucaaggugaggcaacguuaguagaagaacaagaugcuaauuucguauguagaagaacguuuguugaccgcggguggggcaauggguguggauuguuuggaaaagguagucuaauaacaugugcaaaauucaaaugcguaaccaaauuagagggaaaaauaguucaauacgagaauuuaaaauauucugugauagucacuguacacacaggagaccaacaccagguaggaaaugaaucgacagaacacgguacaacggcaacuauuacaccgcaagcgccaacaacagaaauacaauuaacugauuauggagcgcuaacauuagauuguaguccgagaacaggccuagacuuuaacgaaaugguacugcuaacaaugaaagagaaaaguugguugguccauaaacaaugguuuuuagaucugccauuaccuuggacaagcggcgcaucuaccagccaagagacauggaacaggcaggaucuccuagucacuuucaaaacugcacacgccaagaaacaagaaguggucguccucgguucacaggagggagcaaugcacacugcgcuaacuggugcaacagaaauacaaacaagcggaacaacaacaauauucgcaggccaucugaaaugccgauuaaagauggauaaguuaacccugaaagguaugucuuacguuauguguaccgguucauucaaacuggaaaaggaacucgccgaaacacaacaugggaccguguugguccagauaaaauacgaagguacagaugcaccaugcaaaauacccuucagcacucaagacgaaaaaggcgucacucagaacggacgucuaauaacggccaaucccauaguuaccgauaaggaaaagccgguuaacaucgaagcugaaccaccauucggcgagucauacauaguaauuggggccggcgaaaaggcuuuaaagcucucuugguuuaagaaagguucaucuauuggaaaaauguuugaagcaaccgcaaggggagcaaggcgcauggcaauucuuggugauacagcaugggauuuuggaagcauugggggaguuuuuacaaguguuggcaagcuagugcaccaaauauucgggacagcauacggcgugcuauuuucaggcgucaguuggacaaugaagauaggcauugguguauuacuaacuugguuagggcuuaauucaaggaguacaucuuuaagcaugacauguauugcggugggauugguaacauuauauuuaggggucauggugcaagcugacucuggaugugucauuaauuggaaagggcgcgaauugaaguguggcucaggaauuuucguaacuaacgaaguacauacauggacugaacaguauaaauuucaggcugauaguccuaagcgauuaagugcagccauaggaaaagcaugggaagaaggagucugcgggauucgaucagcuacacgcuuagaaaacauaauguggaagcagauaucuaaugaauuaaaccauauacugcuagagaaugauaugaaauucacuguagugguaggagauguggcaggaaucuuagcccaaggaaagaagaugauacgcccccaaccaauggaauacaaguauagcuggaaaaguuggggaaaggccaaaauaauaggagcagauguucaaaacaccacuuucauuaucgauggaccaaauaccccugaaugcccugacgaucaacgggcuuggaacauuugggaaguagaagauuauggauucgguaucuuuacaacaaauauauggcucaaacuccgagauagcuacacacaagucugugaccauagguuaaugagcgccgcaauaaaagacaguaaagcuguacaugcagauaugggauauuggauagaaucggagaaaaacgagacguggaaguuagcaagagccucauuuauagaaguaaagaccugcauauggccuaaaagccauacguuauggaguaaugguguucuagaaucggaaaugauuauaccgaaaaucuaugggggcccaauaagucaacauaauuacagaccagguuacuuuacucagacggcaggcccuuggcaccuaggaaaauuagaacuagacuuugacuuaugugaaggcacaaccguggugguugacgaacauugugguaaccgaggacccagcuuaaggacuaccacagucacggggaaaauaauucaugaaugguguugucggaguugcacccuaccaccacuucguuuccgaggagaagacgggugcugguaugggauggaaauuaggccaguuaaggaaaaagaagaaaauuuaguaaaaaguauggugucugcuggaagcggagaaguugacucauucuccuuaggauugcuaugcaucaguauuaugauagaggaaguaaugagaucuagguggagucggaaaaugcuuaugaccggaacacucgcuguauucuuuuugcucauuaugggacaauugacauggaaugacuuaauucgcuuauguaucaugguaggugcaaaugcgagugaucgcaugggaaugggcacgacuuauuuggcauugauggcuacauuuaagaugagaccgauguucgcaguaggcuuauuguucagaagauuaacuucaagggagguuuuacuucugacgauuggucucucccuggucgcuucuguagaacugccaaauucacuagaagaguugggugaugguuuagcaaugggaauuaugaucuuaaaacuauuaaccgauuuucaaucacaucaacuuugggcaacgcuguuaaguuugacuuuuauuaaaacuacuuucagccuacauuacgcauggaagaccauggcaaugauauuaucuauaguaucacuguuccccuuauguuuguccacaacgucacagaaaaccacauggcucccuguguuauugggcucuuuagguuguaagccccugacaauguuuuuaaucgcggaaaacaaaauauggggaagaaggucauggccuuugaaugaaggaauuauggcagucggcauuguaucuauacuacugaguucauuacucaaaaacgauguaccauuagcaggaccauuaauagcuggcgggaugcucauugcuugcuauguaauaucuggaucauccgcugauuuaucauuagaaaaagcugcggaaguaucaugggaagaagaggccgaacauuccggcgcaucccacaacauucuuguagaaguacaagaugauggacccaugaaaaucaaagaugaagagagagaugauacgcucaccauacucuuaaaagcgacauuacuggcugucucuggugucuauccucuaaguaucccugcgacgcuuuuugugugguauuuuuggcagaagaagaaacagcgaucuggaguguuaugggauacaccuuccccucccgaaguggaaagagccguuuuagaugauggcauauacaggauaaugcagagaggacuuuuagggcguagucaggucggugugggcguauuccaagaaaacguuuuucacacgauguggcauguuacacgaggggcagugcucauguaccaggguaaacgucuugaacccaguugggcuagcguaaagaaagacuugauuucauacggcggaggguggaggcugcaaggaaguuggaauacaggagaggagguucaagucauagccguggaaccuggcaaaaaucccaaaaacguccaaacagcaccggggaccuuuaaaacaccggaaggagaaguaggugcaaucgcacuggauuucaaaccagggacuucgggauccccuauuguuaaucgugaagguaaaauaguaggauuauauggaaauggaguaguaaccacuucaggaaccuacguuucugcaauagcccaagcuaaggcuucucaagaaggaccuuuaccggaaauagaagaugaaguauuccgcaaacggaacuugaccauaauggaucugcauccugguucuggaaaaacucgucgguaccuucccgccauagugcgugaagccauaaaacgaaaacuacgaacguugauacuagcuccgacacgaguuguggcuagcgaaauggccgaagcguuaaaaggcaugcccauaagauaccaaacuacagcuguuaaauccgaacacacgggcaaagagauaguagaucucaugugccaugcuacauuuacaaugcgccuauugucgcccguuagagugccgaacuauaauaugauaaucauggacgaggcucacuuuaccgauccuaguaguauugcugcccgagguuauaucuccacaagggugggaaugggugaagcagcagcuauauucaugacagcaacgccaccuggaucagucgaagcauucccacaaucuaaugcgguaauucaagaugaggaaagagauauccccgagagauccuggaauaguggguaugaauggauaaccgacuuuccugguaaaacagugugguuugugccaucgauaaaaaguggaaaugacauagccaauugcuugcgcaaaaaugggaaacgcgugauacaauuaucacguaaaaccuuugauacggaauaucagaaaacuaaaaacaaugacugggacuauguggucacuacggacauaucagaaaugggagcaaacuucagagcugcccgcguuauagacccaagaagaugcuuaaaaccgguaauauugaaagaugguccggaaagggucauacuagcagguccuaugccugucacaguugcuucagccgcacaacgacgaggaagaaucggaagaaaucacaauaaagagggugaucaguauauauauaugggacaaccacugaauaaugacgaggaucacgcgcauuggacagaagcuaaaaugcuuuuggacaacaucaauacaccugaaggaauaauuccggcucuauuugaacccgaacgggagaaaucugcagcuauugauggcgaauaccgucugagaggagaagcuagaaagacguucguagaauugaugaggagaggggacuuaccaguaugguuaucauacaaaguggcaucugaagguuuccaauauucagacagacgaugguguuucgacggcgaaagaaacaaccaaguucuugaagagaacauggauguagagauuuggacuaaagagggagaacguaagaaacugcgaccuagaugguuagacgcuaggacauacucugacccccuugcauuacgagaauuuaaagaguuugcagccggaagaagaucaguaucuggggacuuaauacuggagauugguaaacuaccacaacauuuaacacaaagagcacaaaaugcguuagauaaucuaguaaugcuacauaauucagaacaaggcggacgggcauauaggcaugcuauggaagaacuuccggauacgaucgaaacgcucauguuacuggcgcuuauugcgguacuuaccgguggugugacacuauuuuucuugagcgggcguggauuaggcaagacuucaaucggcuuacucugcguaauggcuucaagcguacuucuguggauggccagcguagaaccucacuggauugcagcaucaauaauucuugaauuuuuccuaaugguauuauuaauucccgaacccgaccgucaaaggacuccucaagauaaccaguuagccuauguuguaauaggacuacucuuuaugaucuugacgguagcagcaaaugagaugggucuauuagaaaccacuaagaaagaucugggcauaggccacguugcuguggaaaaucaucaccacgccgcgaugcucgauguagacuuacauccagcaagcgcuuggacauuguaugcuguugcaacuacaauaauaacuccaaugaugcgucauacaauugagaacacaacugcaaacauaucauugacugcuauagccaaccaagcugcaauauuaaugggccuggacaaaggauggcccauaucaaagauggauauugggguacccuuauuggcauuaggcugcuauagucaaguaaauccauugacccucacagcagcuguucucaugcuaguugcucacuaugcaauaauuggaccggguuuacaggcuaaagcaacgagagaagcccaaaagcgcacagcagcaggcauaaugaaaaauccuacaguggauggaauugucgcaauagaucuggauccagugguauaugaugccaaauucgaaaagcaacuggggcagauuauguuacuaauacuguguacuucucaaauacuauuaaugaggacuacaugggcacuaugugaaagcauuacucucgcuacagguccacuuacuacccuuugggaagggucgccaggcaaauuuuggaacacaacuauagcugucucuauggcaaauauauucagaggaucguaccuagcaggggcgggcuuagccuuuagcuuaaugaaaaguuuagggggugguagacgaggaacaggugcucagggagagacucuaggugaaaaguggaaacgacaacugaaccaguuguccaaauccgaauuuaauaccuauaaacgaucaggaaucauggaaguugacagaucugaagcuaaggaagguuuaaagcgaggcgagacaacaaaacaugcgguuucacgugggacggcuaaacuaagaugguuuguagagcguaccuuaguuaaaccugaaggaaagguuauugaucuaggaugugguaggggugguuggucuuauuauugugcgggucucaagaaaguuacagaagugaaaggcuauacgaagggcggcccaggacaugaggagccgauaccgauggccacuuauggauggaacuuagucaaacuacauucgggaaaagacguauuuuucauacccccggaaaagugcgauacucuguuaugugauauuggugagaguucuccaaacccgacgaucgaagaagguagaacacuucgaguacuaaagaugguagaaccauggcuaagaggaaaccaguucuguauaaaaauuuugaauccuuauaugccaucaguuguagaaacuuuagaacaaaugcagcgcaaacacgguggaaugcuuguaaggaacccgcuaucaagaaauucaacccacgaaauguauuggguaucaugugguacagguaauaucguaagugcuguaaacaugacuagccguaugcucuuaaaucguuuuacaauggcccaccgaaaaccuacauaugaaagagaugucgaucuaggugcaggaaccagacauguagcuguugaaccagaaguagccaaccuugauauaauuggucaaagaauugaaaacauuaaacacgagcauaagaguaccuggcauuacgacgaagauaacccguauaaaacuugggcuuaucaugguucauaugaagguaagccaucagguuccgcgucgucuaugggaaacgggguuguaaaguuauuaacgaaacccugggaugucauucccaugguaacacaaauagcgaugacagauacaacuccauucggucaacagcguguguucaaagagaaaguagacacacgcacucccaaagcuaaaagagguacagcgcaaauuauggaaguaacagccaaaugguuauggggauuuuuaagccgcaauaaaaagccaaggauuugcacuagagaagaguucacuagaaaggugcguucaaacgcugcaauaggagccgucuuuguagaugaaaaucaauggaauagugccaaggaagcaguagaagaugaacgauuuugggaucuaguacauagagaaagggaacuccacaaacaaggaaaaugugcgaccuguguguauaauaugaugggaaagcgagaaaagaaacuuggggaauuugguaaagcuaaagggucucgugcaauuugguacaugugguuaggagcaagguuuuuagaauuugaggcuuuaggcuucaugaaugaagaucauugguuuuccagagaaaauucauuaucgggcgucgaaggagaaggucuacauaaacugggauauauuuuaagggacauaucaaagauuccuggagguaauauguaugcugacgacacugcgggaugggauaccagaauuacagaagaugaccuacaaaaugaagcaagaauaacugacauuauggaaccagagcacgcauugcuagccaaaucaauuuuuaaacucacauaucaaaacaaaguaguuagaguacaaaggccugcuaaaaaugguacaguaauggacguuauuucuaggagggaccaacguggaaguggacagguuggcaccuauggacuuaauacguuuaccaacauggaagcacaauuaauuagacagauggagucagaagggauuuuuagucccucagaacuagaaacgccaaaucuggcagaacguguacuugacugguuagaaaaguacggaguagagagacuaaagcggauggcaauaucaggggacgauugugucgucaaaccaauugaugacagguuugccacggcucuuacagcguugaaugauaugggaaaaguuagaaaagacaucccucaaugggaaccuaguaaaggauggaacgacuggcaacaaguacccuucuguucacaccauuuucaucagcugauaaugaaggauggacgugaaaucguaguuccuugucgaaaucaagacgaacucguuggacgagcgcgagucagucaaggagcgggauggucccugcgagagacugcaugucuggguaaaucguaugcacaaauguggcaacugauguacuuucauaggagagauuuaagacuagcagccaacgcgauuuguucugcagucccaguugacuggauacccacaagucgcacaacauggucgauacacgcucaccaucaguggaugacgacagaagauaugcucagugucuggaacagaguauggauagaagaaaauccguggauggaggacaaaacacacauuucuaguuggggcgacguaccguaucuuggaaaaagggaagaucaguggugcggcagccucauaggucuuacagcacgggcaacaugggcaacuaacauucaaguggcuauaaaccaagugcgucgacucauugggaaugaaaauuaccuagacuacaugacaaguaugaagagauuuaaaaacgaaagcgacccugaaggggcacuaugguaa

SEQ ID NO: 21809 - RNA, 9879 nt, Artificial Sequence
  derived and/or modified CDS sequence (opt6) from DENV-1__GU131730__SS-prME
ucaguuacuauguuacuuauguuaaugccgacagcauuagcauuucaucuaacgacgcgggguggagaaccacauaugauaguaucaaaacaagaaagaggaaaaucacugcuauuuaaaacuuccgccggaguaaauauguguacauugauagcgauggaucuaggagaauuuugugaagauacaaugacauauaaaugcccaagaauaacagaagcagaaccugacgauguggauuguugguguaaugcuacugauacauggguuacauacggaacuugcagucaaacgggugaacacagacgcgauaaaagauccguagcgcucgcuccucacguuggguuaggacuagaaacgagaacugaaacauggauguccagugaaggugcguggaagcaaauucaaagagucgaaacaugggcccugaggcauccugguuuuacuguuauugcuuuguuucuugcgcaugcaauagggacuucaauuacacaaaaggggauaauauucauacuuuuaaugcucgucacaccuaguauggcgaugcguugcguaggaauagguaguagagauuuugucgaaggucuaagcggugcaacauggguagauguaguacucgaacaugguaguugugucacuacaauggcgaaagacaaaccaacucuugacauagaacuacuaaaaacagaagucacuaaucccgcaguauuacggaaauuauguauagaagcaaaaaucucaaauacuacaacugauagccguuguccgacgcaaggugaagcaacccuaguugaagaacaagacgcuaacuuuguuugucgacgaacauuuguugauagagguugggguaauggaugcggcuuauuugguaagggaucauuaaucacuugugcaaaauuuaagugugugacaaaguuagaaggcaagauugugcaauaugaaaauuugaaauauagcguaauuguaacgguacauacaggugaucaacaucaaguuggaaaugaaagcacugaacacgguacgacagcuaccauaacgccacaagcuccuaguacagaaauucaauuaacugacuacggagcauuaacacuggacugcucaccacgaacagggcucgacuuuaacgagaugguuuuacuaacaaugaaggagaagucuugguugguccacaaacaaugguuucuugacuuaccuuuaccuuggacaucgggagcaagcacaucucaagaaacauggaaucgucaagaccuucuuguuaccuuuaagacugcacaugccaagaaacaagaagucguuguauuaggaucucaagaaggugcuaugcauacagcauugacgggugcgacugaaauacaaacuucugguacaacaacaauuuucgcaggccaccuaaaaugccgauuaaaaauggauaaacuaacauuaaaagguaugaguuaugugaugugcacagguaguuuuaaacuggaaaaagaaguagcugaaacacaacauggaacaguuuuaguacaaauuaaguacgaaggaacggaugcuccuugcaagauaccauuuagcacgcaagacgagaaagggguuacccaaaacggcaggcucauaacagcaaauccaauagugacagauaaagagaaaccugugaauauagaagcggaaccaccuuucggugagucuuacauaguaauuggcgcaggcgagaaggcacuaaaguuaucaugguucaagaaaggcucguccauuggaaaaauguuugaagcuacagcucguggagcacggagaauggcgauauuaggagacaccgcaugggauuuuggaucaauagguggaguguucacauccgucggcaagcuaguucaucaaauauuuggaacagccuauggaguucucuuuaguggaguaaguuggacaaugaaaaucgggaucgggguuuuauugaccugguugggacuuaacagucgaucuaccucacuuucaaugaccugcauugcggugggccuaguaacguuguaucuuggaguaaugguccgagcagauaguggaugugucauuaauuggaagggucgcgaacuuaaaugcggcucagguaucuucguuacgaacgaggugcauacauggacggagcaauacaaauuccaggcagauagcccgaagcggcuaagugcugcaauaggaaaagcgugggaagaaggaguuugcgggauuagaagcgcaacgagacucgagaacauaauguggaaacaaauaaguaaugaauuaaaccacauccuacucgaaaaugauaugaaacuuacaguggugguuggugauguugcaggcauuuuagcacaagguaaaaagaugauacgcccgcaaccgauggaauauaaguacucguggaagucauggggaaaagcgaagaucauaggagccgacguccaaaacaccacauuuauaauagaugggcccaauacaccugaguguccugacgaucaaagagcuuggaauaucugggaaguagaagacuauggauucgguauuuuuacaaccaauauuuggcugaaguuaagagauucauacacucaaguuugugaccacaggcuaaugucagcugcaauuaaagacucuaaggcggugcacgcagauauggguuacuggaucgaguccgagaaaaaugaaacauggaaacuugcacgagcaucauuuaucgaagucaagaccuguauauggccuaagucacauacacuuuggagcaauggcguguuagaaucugagaugauaauaccaaaaauuuacgggggaccaauuucacaacacaacuauagacccggguacuuuacccaaacagcgggaccuuggcauuugggcaaguuagaguuagauuuugaucuaugugaaggcaccacaguaguuguugacgaacauuguggaaacagaggaccuucgcugagaacaacgacugugacuggaaaaauuauucacgaauggugcugucggaguugcacccugccucccuuacgguucaaaggggaggaugggugcugguaugggauggaaauccggccugugaaagaaaaggaagagaaucuagugaagucgaugguaagcgcaggauccggugagguagacaguuucaguuuaggacuauuauguauaucgauuaugaucgaagaaguaaugcgcucuagguggucucgaaaaaugcuuaugacagggacuuuagcugucuucuucuugcuaaucaugggacaauuaacauggaaugauuugaucagguuauguaucaugguuggugcuaacgccuccgaccgcaugggcaugggcacgaccuacuuagccuuaauggcaacuuuuaagaugagaccaauguuugcaguggggcuucuguuuaggagguuaaccagccgugaaguacuauuauugaccauaggacuaucauuaguugcaucuguugaauuaccuaacagucuagaagaauugggggaugguuuggcuauggguauuaugauccuaaaacuacuaacagacuuccaaucccaccaauugugggccacccuguuaucguuaacguuuauaagaacgaccuuuucacuacacuaugcauggaaaacuauggccaugguccugucaauagucaguuuguuuccacuauguuugucgacaacuucacagaaaacaacaugguuaccuguucuauuggguucacuuggaugcaaacccuuaacuauguucuuaauagcugaaaacaaaauaugggguagaaaauccuggccccuuaacgaaggcauaauggccguaggaauuguaucuauccuauuaucaucacuacuuaaaaacgauguccccuuagcaggaccacuaauagccggaggaauguugauagcaugcuacguuauuagcgguaguucggccgauuuauccuuagaaaaggccgcggugguguccugggaagaggaagcagaacauucgggugccucucacaauauacucguugaaguucaagaugaugguacgaugaaaauuaaggaugaggagcgagacgauaccuuaacaauacuucuuaaggcgaccuuauuggcagucagcggcguguauccccuaagcauaccagcaaccuuauuuguuugguacuuuuggcagaaaaagaaacaacgaucugggguguuaugggacacaccaucaccaccagaaguggagcgcgcaguacuugacgaugguauuuaccgaauuaugcagcgcggucuucucgguagaagucaagucggaguaggaguauuucaagagaaugucuuucauaccauguggcacguaacacguggggcugucuugauguaccaaggaaaacguuuagaaccaaguugggcuucagucaaaaaggacuuaauuucauacggaggggguuggaggcuucagggcuccuggaauacaggagaagaaguucaaguaauagcaguggagccaggcaaaaaucccaaaaauguccaaacggcucccggaacuuuuaaaacgucagaaggugaaguaggagcaauugcacuugauuucaaaccaggaaccagugggagccccauagugaaccgagagggaaaaauuguaggcuuauacggaaauggagugguaacaacaagugggacauacguuucugcaauagcucaagcuaaggcuucccaggaaggaccacuuccugaaauugaggaugaaguauuucguaagaggaaccuaacgacaauggacuugcauccagguuccgguaagacacgacgauacuuaccagcaauugucagagaagcuauaaagagaaaauuaagaacuuuaauuuuagcaccaacacguguaguagcgucagaaauggccgaagcacuuaagggaaugccaauuagauaucaaacuacagcaguuaaaagugagcacacugggaaagaaauaguagacuugaugugccaugcuacauucacaaugagauuauuaucaccggugcgaguuccgaacuauaauaugauuauaauggaugaagcccacuuuacugauccaucgucaauagcagcgcgcgguuauauaagcacgcguguuggcaugggcgaagcagcagcgauauucaugacggcuacaccuccuggaagcguagaggcuuuuccccagucaaaugcaguaauucaagaugaggaaagagauauuccugaaagaucuuggaacucaggauaugaguggauaacagacuucccgggaaagacgguaugguuugucccgucaauuaaaucggggaaugauaucgccaauugcuuacgcaaaaauggaaaaaggguaauucaacuaagucggaagaccuucgauacagaauaucagaaaaccaaaaauaacgauugggauuauguaguuacuacggauaucagcgaaaugggagcuaauuuuagggcagaccggguaauagauccaagaagauguuuaaaaccugucauauugaaggaugguccggaaagaguaauauuggcaggaccgaugccgguaacuguugcuagugcagcgcaacgacggggacgaaucggucgaaacccgaauaaagaaggagaucaguauaucuauauggggcaacccuugaauaaugaugaagaccaugcacccuggacagaagcaaaaauguuacuggacaauauuaauacgccggaagggauaauaccagcucuuuuugagccagaaagagagaaaagcgcggcgaucgauggagaauacagauuaaggggcgaggccagaaaaacuuuuguggaauugaugagaagaggcgauuuaccaguauggcuaaguuacaaagucgccuccgaggguuuucaguacucagaccgaaggugguguuuugacggagaacgcaauaaccagguacuagaagaaaauauggauguugagaucuggaccaaagaaggggagaggaagaaacuacgaccuaggugguuagaugcuagaaccuauucagacccuuuagccuugagagaauuuaaagaguucgccgcaggacggagaucaguuucaggggacuuaauuuuagaaauaggcaaguugccacaacaucuuacucaaagggcgcaaaacgcccuugacaauuuaguuauguuacauaacagugagcaagguggucgagcauacaggcaugcuauggaggagcucccagauacuauagaaacacucauguuguuggcauugauugcuguucuaaccggugggguuacuuuauucuuuuuaaguggaagggggcugggaaagacuucaauuggauugcuuugugucauggcgucaucaguucucuuauggauggcgagcguagaaccgcauuggauagccgcaagcauaauuuuggaguucuuuuuaaugguuuuguuaauuccugaaccugaucgacagaggacaccacaagauaaccaacuggccuacguagugauaggguuacuauuuaugauuuuaacuguugcagcaaacgaaaugggacuacuugaaacuacaaagaaggaucuggguauaggccauguagcgguagagaaccaucaccaugcagcgauguuagacguugauuugcauccggccucagcauggaccuuguaugcaguggcaacuacaauaaucacuccaaugaugcgacacacaaucgaaaauacuacagccaauaucagcuuaacagcuauagcuaaccaagcugcgauuuuaauggggcucgauaagggcuggccuauuaguaaaauggauauaggggucccacuucuugcacucggcuguuauagucaaguuaacccauuaacauugacagccgcgguuuuaaugcucgucgcucacuacgcuauuauuggaccuggccuccaagcaaaggcuaccagagaagcccaaaaacgaacugcugccggcauuaugaaaaauccuacaguagauggaauaguggcaauugaucuagacccaguaguauaugacgcaaaauuugaaaaacaauugggacagauuaugcuucuaauccuuuguacuagccaaauacuauugaugagaaccacaugggcauuaugugaaucaauaacauuggcaacggggccccugacgacucuuugggagggaagcccaggaaaauuuuggaauacuacaauagcaguaagcauggcaaacauuuuuagaggcucuuaucuagcuggugcgggauuggccuuuaguuugaugaagucgcuggguggaggaagacgaggcacaggagcccaaggcgaaacuuuaggugaaaaguggaaaaggcaauuaaaccaacuuuccaaaucagaguuuaacacauacaaaaggucagguaucauggaaguagacaggagugaagccaaagagggacuaaaaagaggagaaacuacaaagcacgcaguaagucgagggacugcuaaauugagaugguucguugaaaggaauuuaguuaaaccggagggaaagguaauugaccugggcugugguagagggggauggucuuacuacugcgccgggcuaaagaaaguuacugaggucaagggguacacaaaaggcgggccggggcacgaagaaccgauacccauggccaccuauggcuggaacuuagucaaacuacauucaggaaaagacguguucuuuaucccaccugaaaaaugugauacuuuguuaugugauaucggcgaaucgaguccuaacccaacuauagaggaagggcgcacccuacgaguauuaaaaaugguagaaccaugguugcgugguaaucaauuuugcauaaaaauuuuaaauccuuacaugccuagcgucguagaaacacuagaacagaugcaaagaaagcacggcggcauguuaguacguaauccguuaucccgaaauagcacgcaugaaauguauuggguauccugcgguacagguaacauaguaucugcaguaaacaugacaagucgcaugcuacucaaucguuucaccauggcacauagaaaaccaacuuaugagagggacguggaucuaggcgcgggcacaagacacguugcuguagaaccugaaguugcaaaucuagauaucauuggacaacggauagaaaauaucaaacaugaacacaaaucuacuuggcauuacgacgaagauaaucccuauaagacgugggcauaucacggaaguuaugaggucaagccuagugggucugcuagcucuaugguaaacgguguggucaagcuacuuacaaaacccugggauguaauaccuaugguuacacaaaucgccaugaccgacaccaccccuuuuggacaacaacgcgucuuuaaagagaaaguagacacaagaacgccuaaagcgaaaagaggaacagcccagauaauggaagugacagcuaaguggcuguggggauuucuuucaagaaauaagaaaccacgcauauguacaagagaagaguucacacgaaaaguaagaagcaaugcagcaauuggagcaguuuucguagaugaaaaucaguggaacucagcuaaagaggcagucgaagaugagcguuucugggacuuaguacauagggaacgagaacugcauaaacaggguaaaugcgcgacauguguuuacaacaugaugggaaaaagggagaagaaauuaggugaauuuggcaaagcuaaaggaaguagagcaauaugguauauguggcugggugcucgauuucucgaguucgaagcacugggcuucaugaacgaagaucauugguuuucgagagaaaauucauuaaguggaguagaaggagaggggcuacauaaacuaggauauauauuacgugacauauccaaaauaccagguggcaauauguaugcagaugauaccgcgggcugggauacaagaauaacggaggaugaucuucaaaaugaagcaaaaauaaccgacauaauggaaccagaacacgcuuuacucgcaaaaucuauuuucaaauugacauaucaaaauaaaguaguuagaguucaaaggccagccaaaaacggcacaguaauggacgugaucaguaggagagaucaaagaggcucuggccaagucggaacguauggauuaaacacauucacaaacauggaagcacaauuaauaagacagauggagucugaagguauauuuucuccuagcgaacuggaaacuccuaaucucgcuggaagaguacuagacuggcuagaaaaacauggaguagagagauuaaagagaauggccauuuccggagaugauuguguggugaagccgaucgacgauagguuugcuacagcacucacggcuuuaaaugauaugggaaaaguuagaaaagauauaccccaaugggaaccgucgaaaggauggaacgauuggcaacagguaccauucugcucacaucacuuccaucaguugaucaugaaagauggacgcgaaauaguggucccuugccguaaucaagaugaguuaguaggaagggccagggugagucaaggagcaggauggagcuuacgcgaaacggcuugccuugggaaaagcuaugcucagauguggcaauugauguauuuucacagacgagauuuaaggcucgcugcaaaugccauauguucagccgugcccguagauuggguacccacuucucguacgacauggucaauccacgcucaucaucaauggaugacuaccgaagauaugcuuagcguauggaauagagucuggauugaggaaaacccuuggauggaagauaaaacccacauuucaaguuggggagauguccccuaccuugguaaacgagaggaucaauggugugggagucugauugguuuaacggcaagagcaacuugggcaaccaacauccaaguagcgauaaaucaaguaagaagauuauugggaaaugagaauuaccucgacuauaugacaucgaugaagagauucaaaaaugagagcgacccagaaggugcacuaugguaa

SEQ ID NO: 21810 - RNA, 9879 nt, Artificial Sequence
  derived and/or modified CDS sequence (opt6) from DENV-1__GU131731__SS-prME
ucagugacuaugcuacugaugcugaugcccacggcuuuagcuuuccacuugacaacaagaggaggugaaccacauaugauaguuacaaaacaagaaagagguaaaucauugcuauuuaaaacuucggccgguguaaauaugugcacacuaauagcgauggaucuaggugaacuaugugaagauacaaugacauacaagugccccaggauuacggaagcagaaccagaugauguagacugcuggugcaacgcaaccgauacuugggugacguacgggacgugcucucaaaccggagagcauagaagggauaaacgcuccguggcacuugcaccgcaugucggacuagguuuggaaacacguacagaaacguggaugagcucugaaggcgcuuggaaacaaauacaaagaguugaaacaugggcacuaaggcauccaggauucacuguaauagcacuuuucuuagcacacgcaauaggaacgucaauuacacaaaaaggaauaauauuuauauuacuuaugcugguaaccccgucaauggcuaugagauguguaggaauagguagccgagacuucguggaaggguugaguggugccacauggguugacgucguuuuagagcauggaucuugcguaaccacaauggcaaaggauaaaccuacguuggauauugaacuuuuaaaaaccgaaguaaccaacccagcaguucuaaggaaacuuuguauugaagccaaaauuucuaauacaacuacagauuccagaugcccuacucaaggugaggcuacccucauggaagaacaagaugcaaacuucguauguagacgaacauucguagacagaggauggggaaauggauguggauuauuugguaaagggucguuaauaacgugcgccaaauuuaagugcguaacaaaauuagaaggaaaaauuguacaguacgaaaaccugaaauacucugugauugugacugugcacaccggagaucaacaucaaguaggaaaugaauccacagaacacggaacgacugccacuaucacuccacaggcucccacuucagaaauacaacucacagauuauggcgcauuaacacuggauugcagcccaagaacuggccuggacuuuaaugaaaugguacuuuugaccaugaaagagaaaucuugguuaguucacaaacagugguucuuagaucugccccuucccuggacaucaggugcaucuacuucacaagaaacauggaauaggcaagaucuauuggugaccuuuaagacagcccaugcuaaaaagcaagagguaguaguguuagguagccaggaaggagccaugcacacagcauuaacaggcgcaacagagauacaaacuagcggaacgacgacgauuuucgccggacaucuuaaaugcagacuaaaaauggauaaacugacuuuaaaaggcaugucuuacguaauguguacuggcagcuuuaaacuagaaaaagaagucgcagagacacaacacgggacgguccuagugcaaauaaaauacgaggggacagaugcaccgugcaaaauaccguuuucaacucaagaugaaaaggggguuacccaaaacggaagauugauuacagcgaacccaaucgugacagauaaagagaagcccgugaauauagaagcagaaccaccauuuggagaaucauauauaguuauuggugcuggugaaaaagccuuaaaacuuucuugguucaagaaaggcucauccauagguaaaauguuugaagcgacggcaagaggggccagaagaauggcaauccuaggcgauacagccugggacuuugggucaguaggagguguguucacaagcguuggaaaauuaguucaucagauauuuggaacagcauauggggugcucuuuucuggaguuuccuggacaaugaaaaucggcauaggcguucuauuaaccuggcucggacuuaauagucggagcacaaguuuaagcaugacuuguauugcaguaggguuaguuacacuauaucuugggguuaugguacaagcagacucugggugcguaauaaacuggaaagguagagaauuaaaguguggaucugguauauuuguaacuaacgaaguacauacauggacggaacaauauaaauuucaggcagacaguccgaaaagauuaucugccgcuauaggaaaggcuugggaagaagguguauguggaauccggucagccacacgauuagaaaacauuauguggaaacagauaagcaaugaacuaaaccacauauuguuggaaaaugauaugaaauuuacaguagugguaggagaugugguuggcauucuugcacagggcaagaaaaugaucaggccacaacccauggaacauaaguacucuuggaaaagcuggggcaaagcuaaaauaauaggcgcugaugugcaaaauacaacuuucauaauagauggaccaaacacaccugaauguccagaugaccagagagcguggaauaucugggaaguagaagauuacggcuucgggauauucaccaccaauauaugguugaaacuacgagauucauacacacaagugugugaccauagacuuauguccgcggcaauaaaagacuccaaagcaguccaugcggauaugggauauuggauagaaucggagaaaaacgaaacauggaagcuagcaagggcaucuuuuauugaaguuaagacaugcauauggccuaaaagccauacauuauggucaaauggaguucucgaaucggagaugauaauuccuaaaauuuacggaggcccuauaucacaacauaacuauagaccugguuauuucacucagacagccggcccauggcaucuaggcaaacuagaacuugauuucgacuugugugaagggacgacaguuguaguagacgaacacuguggaaauagagguccaagucugaggacaacaacaguuacggguaaaauuauacacgaaugguguuguagaaguuguacuuuaccgccuuuacgcuuuaaaggggaagacggaugcugguauggcauggaaauacgcccuguuaaagaaaaagaagaaaaucuagugaaauccaugguaagugccggaucuggagaaguugauucuuucagcuugggccuuuuauguauaucaauaaugaucgaagaggugaugagaaguagauggucuagaaaaauguuaaugacaggcacucuugcaguauuucuuuuauuaauaaugggucaacugaccuggaacgaucucauacgacugugcauuaugguuggugcaaaugccucagaccggaugggcaugggaacuacauaucuagcguuaauggcaaccuuuaaaaugcgaccaauguuugcugucggucuuuuauuuagaagacuaaccucaagagaaguauuguuacuaacaauaggacuuucucuuguugccuccguagaacuuccaaauagcuuagaagaguuaggugacggucuugccaugggaauuaugauauugaagcuacucacggacuuucaaucacaucaauugugggcaacauuauugucauuaacguucauuaaaaccacucuaucauugcacuacgcauggaaaacuauggccaugguacuaucaauaguuaguuuguuuccauugugccuuucuacaacuucucagaaaacaacauggcugccgguucuauuagggucacuuggauguaaaccccugacuauguuuuuaauuacagaaaacaagauauggggcaggaaaaguuggccgcugaacgaaggaauaauggcaguuggaguugugaguauucuacuuucaucacuccucaaaaacgacguuccucuggcuggucccuugauugcaggagguauguugauagcaugcuaugucauaagcggaagcagugccgaucuuucgcuagaaaaggcagcagaaguaaguugggaggaagaagcagagcauaguggagcuucucauaauauccucguggagguccaagacgacggcacuaugaagauaaaagacgaagaaagagacgacacacuaacuauuuuauuaaaagccacccuauuggcugugagugggguuuauccuuuaucuauuccagccaccuuauucgugugguacuucuggcagaagaaaaagcaacgauccggaguuuuaugggacacacccaguccaccagaaguagaaagggcaguuuuagaugaugggauauacaggauaaugcaaagaggauuguugggacgaucacaagucggcguuggaguauuucaggaaaacguauuccacacaauguggcacgugacaagaggagcuguccugauguaucaaggaaaacguuuagaacccucaugggcgucaguaaagaaagaucuuauaagcuauggaggcggauggaggcuacaagggucauggaauaccggcgaagaaguacaaguaauugcaguagaaccaggcaaaaauccaaagaaugugcagacggcccccggcacuuucaaaacgccagaaggagaaguaggugcuauugcguuggacuuuaaacccgguacaagcggaagcccaauagucaacagagaaggcaagauuguaggauuauaugguaaugguguaguuacaacgucaggaacguaugugucggccauagcucaggcuaaggcaagucaagaagguccauugccagaaauugaggaugagguuuuucguaagcgaaaccucacuauuauggauuuacauccuggaagugguaagacaaggcgguaccuuccugccauuguaagagaagcuaucaaacguaaacuacgaacguuaauauuagcuccgacccgugucguggcguccgaaauggcggaagcccucaaaggaaugccaauacguuaccaaaccacggccgucaaaucugaacauaccgguaaagaaauagucgaccucaugugccacgcuacauuuacaaugcguuugcuaucccccguacgagugccgaauuacaauaugauuauaauggaugaggcgcauuuuaccgacccgucuucaauugcagcuagaggauauauaucgacaagggucggaaugggagaggccgccgcgauauucaugacagccacaccaccagguagugucgaagcauucccacagucgaacgcuguaauccaagacgaggaacgagauauccccgaacgaucguggaacuccggguacgaguggauaaccgacuuuccgggcaaaacagugugguucguaccauccauaaaaucagggaaugacauagcgaauugucuuaggaagaaugggaaaagaguuauccaguugagcagaaaaaccuuugauacugaauaucagaaaaccaaaaauaaugauugggacuaugucgucacgacagacauaucagaaaugggggcuaauuuccgugcugauagaguuauagauccccgacguugucuaaaacccgugauccugaaagauggaccagagaggguaauccuggcagggccaaugccaguaacuguugcaucugcagcccagcgccgagguagaaucggacgcacgcauaacaaagaaggugaucaguacaucucaaugggucaaccacucaacaccgcagaagaccacgcaccauggacggaggccaaaauguuacucgauaauauaaauacaccagaaggaauuauucccgcacuuuucgaaccagagagggaaaaaucugcggcuaucgacggggaauaccggcuacguggggaagcuaggaaaacauuuguugaacugaugcggagaggugaccuuccgguauggcugucauacaaaguagcaucggagggauuccaauacagcgaucgaagguggugcuuugacggagaacgcaacaaucagguuuuagaagaaaacauggacguggaaauuuggacaaaagaaggagagaggaagaaauuacguccacgcuggcuugaugcacgaacauacucagacccccucgcauuacgggaauuuaaagaguucgccgcagggcgaagaaguguaaguggggauuuaaucuuagaaaucggaaaauuaccccaacaccugacacagagagcacaaaaugcguuagauaaccuuguuauguuacauaauucggaacagggaggccgagcuuaucgucaugcuauggaggaacuaccggacacaaucgaaacacucaugcuacuugcacuuauugccguucucaccggcggugucacucuauucuucuugagugggcgaggacuugguaagacuucaaucggacuguuaugcguaauggcuaguucaguacuuuuauggauggcauccguagagccucauuggauugcagcauccauaaucuuggaguucuuccuuaugguguuauuaauaccugaacccgacagacaaagaacaccgcaagacaaccaacuagcguacguagucauaggauuauuauucaugauucuuacaguagcugccaaugagaugggcuuacucgaaacaacuaagaaagaucugggcauaggacaugucgcuguagaaaaccaccaucacgccaccaugcuagacgucgauuuacauccagcuagugcguggacuuuauacgcaguagcgacaacuauaauaaccccuaugaugcgacauaccaucgagaauaccacagcgaauauuagccuuacggcuauagcaaaucaagcagcaauacuaaugggucuagacaaaggcuggcccauaucaaaaauggauauugguguaccacuacuggcauugggauguuauagucagguuaauccauuaacccuuacugccgcuguauuaaugcuggucgcgcauuaugcgauaaucggcccuggguuacaagcgaaagcuacucgcgaagcucagaaaagaacagccgcuggcauaaugaaaaauccuacaguugacggaaucgucgcaauugaccuagaccccguuguauaugacgccaaguuugaaaaacaacuaggccaaauuaugcuucuaauacuuuguacaucacaaauauuacuuaugaggacuaccugggcauuaugugagagcauuacguuagccacggguccuuugacgacuuuaugggaaggaagcccaggaaaauucuggaauacuacaaucgcugugaguauggcaaauaucuucagaggauccuaccuugcuggagcuggguuagcuuuuucucuaaugaagucacuaggagguggacguagaggaacuggugcgcagggcgaaacuuuaggugaaaaguggaagcgccaauuaaaucaacuauccaaaagugaguuuaacaucuacaagcggucugggauuauggagguugaucgcagugaagcaaaagaaggauugaaacgaggagagacaacaagacacgcugucucacgaggaacugcuaaauugaggugguuugucgaacguaaucucguaaaaccagaagggaaaguaauagauuuaggcugugggagaggcggguggagcuacuacugugccggauugaaaaagguaacugagguaaaaggguacaccaaagguggacccgggcacgaagauccaauacccauggcaacguacgguuggaaccuagugaaacuucauucagguaaggauguauuuuucaccccuccugaaaaaugugacacccuccucugugacauaggagaaucaucuccgaacccgacaauagaagagggacguacuuuaagagugcucaagaugguagagccaugguuacguggaaaucaauuuugcauaaaaaucuuaaacccauauaugccuaguguaguugagacgcuggaacaaaugcaaaggaaacacggugguaugcuaguaaggaauccccuaucgcguaauucaacucaugaaauguauugggugaguugcggaacgggcaacaucgugucugcaguaaauaugacaucccgcaugcuacuaaauagauuuacaauggcccaccgaaaaccgacguaugaacgugauguagaccuaggugcugggacuaggcaugucgccguugaaccugaggucgcaaaucuggauauaaucggccaaagaauagaaaacauuaaacacgaacacaaauccacauggcauuacgaugaagacaaucccuacaaaacaugggccuaccacggaaguuacgaaguaaaacccagcggcagugcgaguagcaugguuaacgguguaguaaaauuauuaacgaagccaugggaugugaucccaauggugacgcagauagcuaugacugauacgacaccguuuggucaacagcgcguauucaaagagaaaguugauacgagaacaccaaaagcaaaaagaggaacagcucaaaucauggaggugaccgccagaugguuaugggguuuucucucaaggaacaagaaaccgcguauauguacucgagaagaguuuacgaggaaagugcgcucaaacgcagccauaggugcaguauuuguagacgagaaccaauggaacucagcuaaagaagcuguugaggacgagagguucugggaucuuguacagaaagaaagagaauugcacaaacaaggaaaaugugcgaccuguguuuauaauaugaugggaaaaagagagaagaaauuaggugaauuugggaaagcgaaaggauccagagccauaugguauaugugguuaggggcaagauuuuuggaguuugaggccuuaggauuuaugaaugaagaucacugguucagccgggagaacaguuugucaggaguagagggugaagguuuacacaaacuuggauauaucuugagagacauuucuaaaauuccaggcggaaacauguaugcagaugacacagcggguugggauacaaggauaacagaggacgacuugcaaaaugaggcaaagaucacagauauuauggaaccggaacacgcucuauuagcaacaucuaucuucaaacuaacuuaucaaaacaaaguagugagaguccaaagaccugcuaaaaacgguacagucauggauguaauaucuagaagagaucaacgcggcucugggcaaguagguacuuauggucuaaauacguucacuaauauggaggcucaacuuauuagacaaauggagagugaggguauauuccuuccaagcgaauuggaaaccccgaacuuagccgagagaguacucgacugguuagaaaaauacgggguagaaagacugaaaagaauggcaaucucgggcgaugauugugucguuaagccaauugaugacagauuugcuacagcgcucacagcacuuaaugauauggguaaaguaagaaaagacauuccccaaugggaaccgaguaaaggcuggaaugauuggcaacaaguuccuuuuuguagccaccacuuucaccaauuaauaaugaaggacggucgagaaauaguaguaccgugcagaaaccaggacgaauuaguugggcgugcucggguuagccaaggagcggguuggaguuugcgugagacugcauguuugggaaagaguuaugcucagauguggcaauuaauguacuuucaucgaagggauuuaaggcuugcugccaacgcuauaugcagugcaguuccuguagauuggguaccgaccagcagaaccaccuggagcauacacgcacaccaucaauggaugaccacugaagacaugcuaucaguauggaaccgaguguggaucgaagaaaauccauggauggaagauaaaacacacguaaguucuuggggugaugucccguacuugggcaagcgcgaagaucaauggugugggucguuaauaggacuuacagccagagcaaccugggccucaaauauacaaguagccaucaaccagguccggagacucauaggaaaugaaaauuaucuagauuauaugacaaguaugaaacgguuuaaaaaugagggggacccagaaggagcguuaugguaa

SEQ ID NO: 21811 - RNA, 9879 nt, Artificial Sequence
  derived and/or modified CDS sequence (opt6) from DENV-1__GU131733__SS-prME
ucuguuacaauguuucuaaugcuuaugccaacugcacuugcauuucaccuaacuacgagaggaggagaaccucacaugauaguaagcaaacaagaacgagggaaaucuuugcuauuuaaaacaagcgcaggaguuaauauguguacgcuuauagcuauggauuugggagaauuaugugaagauacaaugacuuacaaauguccaagaaucacagaaacagaaccagaugauguagacuguugguguaacgcaacagauacauggguuacuuauggcacaugcucucaaacaggagaacacagacgcgacaaacgaagcguugcguuggcaccacauguaggguuaggccuagaaacgagaacugaaacauggaugucgagugaaggggcguggaaacaaauacaaagggucgaaacgugggccuugaggcauccaggauucacggucaucgcguuauucuuggcacacgcuauagggacauccauuacacaaaaaggaaucauauuuauacuacuaauguugguuaccccgucuauggcuaugcguugcgucggaauaggaucucgggauuucgucgaagggcuuucaggcgcaacauggguagacguaguacucgaacaugguucaugugucaccacuauggcaaaagauaaaccaacguuggauauagaacuguuaaagaccgaaguaacuaauccggcaguucuuagaaaacuguguauagaggccaaaauaagcaauacuacuacagauucaagaugcccaacucaaggggaagcgacccuaguugaggaacaagacgcuaauuuuguguguagacguacuuuuguugaccgaggcuggggaaaugguuguggacuauuuggaaagggauccuuaauuacgugugccaaguuuaaaugcguuacuaaauuagaaggcaaaauagugcaauacgaaaaccuuaaauauucuguuauaguaacugugcacaccggcgaucaacaucaagucggaaacgagagcaccgaacaugggaccaccgccacuauuacaccacaggcgccaacuacagagauccaauuaacagauuauggugccuuaacgcuugauuguucuccacgaacgggguuagauuuuaaugaaaugguucuacuaacgaugaaggagaaaaguugguuaguucauaagcaaugguuucuagauuuaccauuaccauggacaaguggugcaaguacaagucaggaaacguggaaucgucaagaucugcugguuacauuuaaaacagcccacgcuaaaaagcaagaaguuguaguuuuaggcagucaagagggagcaaugcauacagcucuaaccggcgcuacugaaauccagaccagcggaacaaccaccauuuucgcgggucacuugaaauguagguuaaagauggauaaauuaacucuuaaaggaaugucauauguaaugugcacggguucauucaaacuagaaaaagaguuagccgagacacagcacgguacuguguuagugcaaaucaaauacgaaggcacggaugcgccauguaaaauuccauuuucgacccaagaugaaaaggguguuacacaaaauggucgguuaauuacagcuaacccuauuguuacagauaaagagaaacccguaaacauagaagcagaaccaccauucggugaaucuuacauaguaauaggcgcuggagaaaaggcuuuaaaauuaucuugguucaagaaaggauccuccaucgggaaaauguucgaagccacagcccgaggagcccgacggauggcaauacuuggggacaccgcaugggauuucggcagcauuggcggagucuuuacaaguguuggaaagcuaguacaucaaauuuucgggaccgcguauggaguacuuuuuagcggaguuagcuggacgaugaaaauaggaauuggaguuuuacuuacauggcuuggguugaauagcaggucuaccucacucaguaugacauguauugcaguagguuuagugacauuauaucuaggaguaaugguucaagcugauagcggaugcgucauaaauuggaaagggagagaauuaaagugcggaucagggauauucguaacaaacgagguucacacauggacagaacaauacaaguuucaagcggacucuccgaaaagauuguccgcagcaaucgguaaagcaugggaagaggguguuuguggcauuagaucugcaacacguuuagaaaacauuauguggaaacaaaucaguaaugaguuaaaucacauauuacuagaaaaugacaugaaauuuacaguaguaguaggagacguugcgggaaucuuagcccaaggaaagaaaaugauucgaccucagcccauggaauacaaauacucuuggaagucguggggaaaagcuaagauuauaggugccgaugugcaaaacacgacauuuaucauagauggcccuaauacaccagaaugccccgaugaccaaagggcauggaauauaugggaaguagaagacuauggauucggaauauuuaccacuaauauauggcuuaaacuuagagauaguuauacucaaguuugcgaucauaggcuuaugucagccgcgauuaaagauaguaaagcagugcaugcggacauggguuauuggauugaaagcgagaaaaaugaaacuuggaaacuagcacgagccagcuuuaucgaagucaaaacaugcauuuggccuaaaucccauacccuguggucuaauggcgugcuggaaagugagaugauaaucccaaaaaucuacgguggaccaauaucucaacacaacuacagaccaggauacuucacgcaaacagcggggccauggcaccuagguaaguuagaguuagauuucgauuugugcgaagguacuacuguuguuguagacgagcacuguggcaaucgaggacccagucugaggaccacaacggucaccggaaaaauaauacaugaaugguguugccgaucaugcacuuugccaccauuacguuuucgaggagaagacggguguugguacggaauggaaauaaggccuguaaaagagaaagaagaaaauuuagucaaaaguaugguguccgcgggaucgggagaaguugacuccuuuagcuuaggacuauuaugcauaucuauaaugauagaagaaguaaugaggucaagaugguccaggaaaaugcuaaugacgggaacacuugcaguauucuuucuacuaauaaugggucaacucacuuggaaugauuugauccggcuuuguauaaugguaggugccaaugcaagugacaggaugggcaugggcacuacuuaccuggcucuuauggcuacauucaagaugcgcccuauguucgcgguaggauuacuauuuagacgucucacaucaagggaaguauuacuucuuacgauaggacuuucucuuguagcaucuguagaacuaccuaacucgcuagaagaacucggugaugguuuagcuaugggaauuaugaucuuaaaacucuuaacagacuuucaaucacaccaguuaugggcaacucuacucucccugacuuucaucaagacuaccuuuagucuucauuacgcauggaaaacaauggcgaugguacugaguauugugaguuuauucccucuaugccugaguacaaccagucagaaaacuacgugguuaccaguacuucuuggaucauuaggcugcaaaccguuaacgauguuuuuaauugcagaaaauaaaauauggggcagaagaucuuggccacuuaaugaagguauaauggcaguugguauaguguccauauuguuaucuucucugcucaaaaacgauguuccccuugccgguccuuuaauagccggugguauguugauugccuguuauguaaucucagguaguucagcugauuugucuuuagagaaagcugcugaaguaucaugggaagaagaagcagaacacagcggcgccucgcauaauauucugguggaaguacaagaugacggcacuaugaaaauuaaagaugaggaaagagacgauacacugacaauucuacuuaaagcuacccucuuagcgguaucaggaguuuauccauugagcauucccgcaacauuauucguuugguacuuuuggcagaaaaagaaacaacgcucuggcguuuuaugggauacgccuucaccuccagaaguugagcgagcaguuuuggaugaugguauuuauagaauaaugcaacgaggauuguuaggucgaagccaaguaggcgucggagucuuucaggaaaaugucuuucauaccauguggcacguaacaagaggggcggugcucauguaccaggggaaaagacucgaaccaaguugggccucagugaaaaaggaccuaauuucuuacgguggcggauggagacugcagggaaguuggaauacaggcgaggaaguacaggugauugcaguugaaccugguaaaaaucccaaaaauguacagacagcaccagggacauuuaagacucccgagggagaggugggcgcuauugcauuagauuucaaaccgggaacgagcgguaguccaauagugaauagggaggggaaaaucguuggacuuuauggaaacggcguagugaccacuucgggaacauaugugucggcaauagcccaagcuagggccagccaagagggaccucuuccugaaaucgaagacgaaguuuucagaaaaaggaaccuuacaauaauggaucuucacccggguucuggaaaaacccgaagauacuuaccggcaauuguaagagaagcaauuaagagaaaacuccguacacuaauccucgcuccuacacgaguaguagccucagagauggcugaagcucuuaagggaaugccuauaagguaucaaacaacagcuguaaaaagcgaacacaccgggaaggaaauagucgaccugaugugucaugcuacguuuacaaugagauugcuaagcccaguucgaguaccgaauuauaacaugauaauaauggacgaggcccauuucacagauccaagcagcauagcagccagaggcuacauuucaacgaggguaggaaugggagaagcagccgcaaucuucaugacugccaccccgccaggguccguggaggcguucccucaaucaaacgccguaauccaggacgaagaacgggauauacccgaaagauccuggaauagugguuacgaauggauuacggacuuccccgggaagacagugugguuuguaccaaguauaaaaucgggaaacgauauagcaaauugucuccguaagaauggaaaacgaguaauacaauugucaaggaaaacguucgauacagaguaccagaaaacuaagaauaacgauugggacuaugugguaacgacagauauaagcgaaaugggagcaaauuuuagggcagauagggucauugacccacgacgguguuuaaaaccagucauccugaaggacggaccagagagaguuauccuggcugguccaaugcccgugacgguagccucagcagcgcaacgcagaggaaggauuggaagaaaucauaacaaagaaggagaccaauauauauacaugggucaaccguugaauaacgaugaagaucaugcacauuggacagaagcaaaaaugcuguuagauaacauaaauacgccagaaggcauuauaccugcacuuuuugaaccggaaagagagaaaagugcagcaauugauggggaauacagauuacguggcgaagcacggaaaacguucguagaacuaaugcgcagaggggauuuaccaguuugguugaguuacaaaguggccucggaaggguuccaauacucagauagacgauggugcuuugauggugaaaggaauaaccaaguauuagaagaaaacauggacguugagauauggacuaaagaaggggagaggaagaaacuucgcccaagguggcuagaugcgagaacauauucggacccacucgcucugagggaguuuaaagaauuugcggcagguaggagaagugugucaggagaucucauucuugaaauagguaaacuaccgcaacaucucacacaaagggcacaaaaugcacuagauaauuuagugaugcuucauaacucggaacagggugggagagcuuaccgacacgcuauggaagaacuaccugauacuauugaaacucugauguuauuggcccuaauagcaguauuaaccgggggcguaacacuauucuuucuuucaggacgaggacuggguaagacgagcauaggauuauuaugcgucauggcaagcucagugcuucuauggauggcaucuguagagccacauuggauagcugcaucgaucauacucgaauuuuuccuaaugguacuccuaauccccgagccggacagacaaagaacaccccaggauaaucagcuagcauacguuguaauagggcuucuguucaugauauuaaccguugcagcaaaugaaaugggcuuguuagaaacgaccaagaaagaucuggguauaggucauguugcuguagaaaaucaucaucaugcugccauguuagacguagacuuacaccccgcuagugcauggacauuauaugcgguagcgacuacuauaauuacgccaaugaugaggcacacaaucgaaaauacgacugcaaacauuagucuaacagccauugccaaccaggccgccaucuuaaugggguuggauaagggauggccaauuucuaagauggauauuggcguaccauuacuugcguugggauguuauagucaaguaaauccccuuacauugacggcugccguucucauguuaguagcucauuaugcaaucauugggcccggacuacaagcuaaagcuacaagagaagcacagaaaagaaccgcggcagggaucaugaagaauccuacuguagacgggauugucgcgauagauuuggacccuguaguauacgacgcaaaauuugaaaaacaacuugggcaaauuauguuacuaauucuuuguacuagccaaauuuuguuaaugcggacaacaugggcacuaugugaaaguaucaccuuggcaacagguccauuaacaacuuuaugggagggaucuccaggaaaguuuuggaacacaacaauugccguuagcauggcuaauauuuucagaggaucguaccuagccggugcagggcuagcguuuaguuuaaugaagucucuaggagguggucgacgugggacuggggcacaaggagagaccuuaggcgaaaaguggaagagacagcuaaaucaacuaaguaagucggaguucaacacauauaaaaggagcggaauuauggaggucgaucgaagcgaagcaaaagaaggauugaaaagaggagaaacuacaaaacacgcuguaaguagaggaacggcuaaauuacggugguuuguugaacggaaccuaguuaaaccggaggggaaaguaauagauuuaggguguggacguggugguuggaguuacuauugugcggggcuuaagaaaguaacggaaguuaaaggauauacaaaaggaggucccggacaugaggaacccauaccaauggcuacuuauggauggaaccuggucaaauuacauucaggaaaagacgucuucuuuauaccaccggaaaagugcgauacauuacuaugugauauuggagagucgaguccgaacccaacuauagaagaggggaggacuuuacggguucucaaaauggucgaacccugguuacgcggcaaucaauuuuguauuaaaauuuuaaauccguacaugccuucagucguagaaacacucgaacagaugcagcgcaaacacggcggaaugcuugucagaaacccucucucccgaaacucaacacaugaaauguacuggguaucuugugguacuggaaauaucguuagugcgguaaacaugacaucaagaaugcuucucaaccguuucacuauggcacacagaaaaccaacauaugaaagagauguggauuuaggugccggaacaagacacguggccguagaacccgagguagcgaauaucgauaucauaggacagagaauagaaaauauaaaacacgaacauaaaucgacauggcauuaugacgaggacaacccauacaaaacgugggccuaccaugguucauacgaaguaaagccuuccggauccgccucaucuaugguuaacggaguaguaaaacuauuaacaaaaccaugggaugucauaccaaugguaacucaaaucgcaaugacugacacgacaccauuuggucaacaacgaguuuuuaaagaaaaagucgauaccagaacaccaaaggcuaaaagaggaacugcucagauuauggaagugacugccaaauggcuauggggauuuuugagccguaacaagaaaccccgcauuuguacuagggaagaauuuacacgaaaaguaagaucuaaugccgcaauaggugcuguauuuguugacgaaaaucaguggaacucggcuaaagaagcaguugaagaugaaagauucugggauuuaguacaucgagagagggagcuccacaagcaggguaagugcgcuacaugcguauauaauaugauggggaaaagagagaagaaacugggugaauuugguaaagcaaaagggucgcgggcaauaugguacauguggcuuggugcuagauuuuuagaguucgaagcccuuggauuuaugaaugaggaccacugguucuccagagaaaacagcuugucuggcguagaaggagaaggauuacauaaacuaggauauauacuucgagauauaagcaagaucccaggagggaauauguacgccgaugauacugcuggaugggacacacgcauaacagaagacgaucuacaaaaugaagcuaggaucacggauauuauggaacccgaacaugcacuucucgcgaaauccauuuuuaaacuuacuuaccaaaauaaaguaguaagaguccaaagacccgcgaagaaugguacaguaauggaugugauaaguagaagagaccaacgagguaguggucaggucggaacguacgguuuaaauacguuuaccaacauggaagcacaacucauccgacaaauggagucagagggaauuuuuagcccgucagaguuagaaacgccaaaccucgcagaaagggucuuagacuggcuugaaaaauacggaguugagcgauuaaagcgaauggcaauuagcggcgacgacuguguuguaaaaccaaucgacgacagguuugcaacugcccucacugcauuaaacgacauggguaaaguaaggaaagauauuccgcaaugggagccuucaaaaggguggaaugauuggcagcagguaccauucuguagccaccauuuucaucaauuaaucaugaaagauggacgagaaaucguaguuccguguagaaaucaggacgaauuaguaggcagggcaagagugucacaaggugcaggaugguccuuacgugaaacagcguguuugggcaaaagcuaugcccaaauguggcaacuuauguauuuucauaggagagaccugcgacuugcggccaaugcaauaugcagcgccgugccaguugacuggauuccaacgucacgaacgaccuggucaauucaugcacaccaucaauggaugaccacagaagacaugcuaucuguauggaauagaguauggaucgaagaaaacccauggauggaagauaaaacacacauaucgucuuggggugacguacccuaucuagguaaaagagaagaucaguggugcggcucuuuaaucggucuaacggcgagagcgacaugggcuacgaauauacaaguagccaucaaccagguaagaagacugauuggaaaugagaauuacuuagacuacaugacaaguaugaaaagguucaagaacgagucggauccagaaggagcacuaugguag

SEQ ID NO: 21812 - RNA, 9879 nt, Artificial Sequence
  derived and/or modified CDS sequence (opt6) from DENV-1__GU131734__SS-prME
agcguaacaaugcuacuaaugcuaaugccaacagcacuagccuuucacuugaccacaagagggggagaaccacauaugaucguuaguaaacaggaacgggguaaaucucuacuauucaaaacgucagcaggaguuaauauguguacauugauagccauggacuuaggagaguucugugaagauacuaugacguacaaaugcccaaggauuacugaagcagaaccugacgacguugauuguuggugcaaugccacagauacauggguuacauaugggacaugcagucagacaggcgaacauagaagagacaaaagaagcguagcuuuagcuccccauguuggacugggcuuggaaacacggaccgaaacauggaugucauccgaaggugcuuggaaacaaauacaacgagucgaaaccugggccuuacgucauccaggcuucaccguuauugcccuguuucuagcacaugccauaggaacaucaauuacucagaaaggcaucauauuuauuuuauuaaugcuaguaacaccaucaauggcuaugcgaugcgugggaauaggguccagagacuuuguugaaggauugucuggugcaaccugggucgauguggugcuugaacauggaucgugcguaaccacuauggcaaaagauaaaccgacacuugauauagaacuacuaaaaacagaaguuacugacccggcgguccucaggaaauuaugcauagaagcgaaaauaaguaauacgacaacugauucacguuguccgacacaaggagaagcuacucuagucgaagaacaagaugcgaauuucguuugcagacgcacauucguggauagagguugggggaaugguuguggcuuauuuggcaaaggaucucucaugacaugugcgaaauuuaaaugcgucacuaaacuggaaggcaaaauuguucaguacgaaaaucuuaaauauagcgucauaguaacuguccauacaggagaucaacaucaaguagguaacgaauccaccgaacacggaacuacagccacaaucacaccacaagcaccuaguaccgaaauacaauuaacagacuauggggcucuaacgcuugauugcucaccucgcacgggauuggauuuuaacgaaaugguacuacuaacuaugaaagaaaaaucuuggcuaguucauaaacaaugguuuuuagaccuaccauuaccguggacuucaggugcuaguacuagccaggaaacguggaaucguaaagauuuauugguaacauuuaaaacagcacaugccaagaaacaggaagugguaguauuagguagccaggaaggcgcaaugcauacagcauugacgggugcaaccgaaauccaaacaaguggaacuacaacgauuuuugccggccaccuuaaauguagacuaaaaauggauaaauuaaccuugaaaggaaugucauauguuaugugcacagacucauuuaaacucgaaaaagaaguagcagaaacccaacauggaacgguucugguacagauaaaauaugaagggacugaugcaccauguaaaauuccauucucuacacaagacgaaaaagguguuacacaaaauggcaggcuuauuacggcaaacccaauuguuacagacaaagaaaaaccagucaauauagaagcugaaccgccauuuggagaauccuacauaguuauuggagccggagagaaagcgcucaaauuaucaugguucaagaaaggaagcucgauaggcaagauguucgaggccacggcacguggugcaaggagaauggcaauauuaggggacacugccugggauuuuggcagcauaggugguguauucacaagcguuggaaagcuaguacaccaaauauucggaacagcauacgguguacuauuuagcggcgucucuuggacaaugaaaauaggaaucgguguuuuauuaacauggcuagggcuaaacagucguagcacgucccuuagcaugacaugcauagcaguagguuuaguaacccucuauuugggaguaaugguucaggccgacucaggauguguaauuaauuggaaagggagagaauugaaauguggaucuggaauuuuuguuaccaaugaagugcacacuuggacagaacaauauaaauuucaagcggauucaccaaaaagauugucagcugcuauaggaaaagcaugggaagaaggaguguguggcauaagaucggcaacaagacuugagaauauaauguggaaacaaaucucaaacgaguuaaaucacauacuguuagaaaacgacaugaaauucacuguaguagucggcgaugucgccgggauucuagcacaaggcaagaaaaugauucggccccaaccgauggaauauaaauacucauggaaaaguuggggaaaagccaagaucaucggcgcagacgugcagaacacaacuuuuauaauugaugguccaaacaccccagaauguccggacgaucaaagagccuggaacauuugggagguagaagacuacgguuuugguauuuuuacgaccaacaucugguugaaauuaagagacucauacacgcaaguuugugaucauagauugaugagugcagcuauaaaagauuccaaagcggugcaugcugacaugggauacuggauagaaucagagaaaaaugaaacguggaaauuggcuagagccaguuuuauugaaguaaaaacauguauuuggccuaagucucauaccuuaugguccaaugggguccuugaaagugaaaugauaauuccaaagaucuauggcggaccaaucucacaacacaauuaucgcccgggcuacuuuacccaaacugcaggucccuggcauuuagguaaacuagaacucgauuucgauuuaugugaaggcaccaccgucgugguagacgagcauugcggaaaccguggaccgucgcugagaacaacaacuguuacagggaaaaucauacaugaauggugcuguagaucaugcaccuuaccuccguuacgauucaaaggagaagacgggugcugguauggcauggagauucgcccugugaaagagaaggaagaaaaccugguaaaaaguaugguaucagcaggaaguggagaaguugauuccuucucgcuuggucuauuauguauuucuauuaugauagaagaagucaugcgaagucgcuggagcaggaaaaugcuuaugacgggcacccuagcgguuuucuucuuauugauaaugggccaacuaacauggaacgaucuaauacgucuauguauaaugguaggagcaaacgcaucagaccgaaugggaaugggaaccacuuaucuugcacucauggcuacauuuaaaaugagaccaauguuugcagugggacuccuauuccguaggcugaccucaagggaaguuuuguuacuuacaauaggacuuuccuuaguagccaguguagagcuaccuaacucuuuagaagaguugggugacggauuagccaugggcaucaugauauuaaaacugcuaauagauuuucagucacaucaacucugggcaacauuauugagccucacauuuauuaaaacaacauuuucccuacauuacgccuggaaaacgauggcgaugguucucagcauaguaucccuauuucccuuaugucuaagcacuaccucccaaaagacgacuuggcuacccguacuucuggguucacuaggcuguaagccucuaacaauguuccuaauugcagaaaacaaaaucuggggcagaaaaucauggccgcuaaaugaggggaucauggcugucgguauaguuucaauuuuacuaucagccuuacugaagaacgauguuccauuagcuggaccucuaauagcaggggguauguuaauugccuguuacguaauauccgguaguagcgcugaccuaaguuuagagaaagcugcugaggucagcugggaagaagaggcagaacacucuggcgcuucucacaauauauuagucgaaguucaagaugauggaacaaugaaaaucaaagaugaggaacgcgacgauacauuaaccauucuuuuaaaagcaacacuucuagcaguuagugguguguacccguuaucaauaccagcgacacuauuugucugguacuuuuggcagaagaagaaacaacguuccgguguccuaugggauacuccaaguccuccggaaguagagagagccgucuuagacgacgguauauauaggauuaugcaaagaggauuauuggguagaucacaaguuggcguaggaguuuuucaagaaaacguauuucauacaauguggcauguuacaagaggagcaguuuuaauguaucaggguaaacgccuugagccuagcugggcuucgguuaagaaggaccuuauuucauacggagggggcuggagacugcaaggaucguggaacacaggagaggaaguucagguuauagcugucgagccagguaagaaccccaaaaauguucaaacagcacccggaaccuuuaaaacaucagagggugaaguuggugcuaucgcguuggauuuuaaacccggaacaucugguagcccuaucguaaacagagaaggcaaaauuguugggcucuacggaaauggggucgugacaacaagcgggacuuauguuagugcaauagcacaagcaaaagcaucacaagaagguccccuaccagagauugaagaugagguguuucgaaaacgaaauuuaaccaucauggacuuacauccuggaucggguaaaacccgacguuaucuucccgcuauuguacgggaggcuaucaagcgcaaacuacgaacgcugauauuggcuccaaccagaguugucgcgucggaaauggccgaagccuuaaaaggaaugccuauaagauaucaaacaaccgccgucaaaagcgaacauaccggaaaagagauagucgauuugaugugccacgcgacuuucacaaugcgauuacucucaccgguucgaguuccaaauuauaauaugauaauaauggaugaggcccacuuuacagacccaucauccaucgcagcucgcggcuacauaucaacgagagucggaaugggggaggcggcugcgauauucaugacugccacaccacccggcucagucgaagcauuuccgcaaagcaacgcuguaauacaagaugaggaaagagauauaccagagagaucguggaacucgggcuacgaauggauuaccgauuuccccggaaagacgguaugguuuguaccaucaauaaaaaguggaaaugauaucgcaaacugccuaaggaaaaauggaaaaagaguaauucaacugucacgaaaaacauucgacacugaauaucagaaaaccaaaaauaaugauugggauuauguaguaacgacagauaucucagaaaugggagcgaauuuuagagcugauagaguaauugauccaagacguugucuuaaaccuguaauuuugaaggacggcccugaaagaguaauauuagccgggccuaugccaguuacagucgcaagugcggcucagcguagagggagaauuggacggaaucauaacaaagaaggagaccaauacaucuauaugggccaacccuugaauaaugaugaggaccaugcgcacuggacagaggccaaaaugcucuuagacaauauaaauacuccugaagggauuaucccagcacuauucgagcccgagagggagaaaucagcagcaaucgauggagaguauagguugcgcggagaagcacguaaaacauucguagaguuaaugcguagaggagacuuacccguaugguuguccuauaaaguagcuagcgaggguuuucaauauucugaccggcgauggugcuuugacggagaaagaaauaaucaaguauuggaagaaaacauggacguggaaauauggacaaaggaaggugaaaggaagaaauugagaccacgcuggcuagacgcucgaaccuauagugauccauuagcuuugcgggaauuuaaagaauuugccgcuggaaggaggagcgucucuggugauuuaauucucgaaauuggcaaauugccacagcauuuaacucaaagagcgcagaacgcucuagauaauuuagugaugcuccauaacagugaacagggcggacgagcauauagacaugcaauggaagaacuaccggauacaauagaaacucuaauguuguuagcuuuaauagcagugcuuacaggcggcgucacuuuauucuuucucucggggagaggcuuaggcaaaacuucaauuggguuacuuuguguuauggcuaguucaguauuacuuuggauggcgagcguagaaccacauuggauugcagcgaguauaauacucgaguucuuuuuaaugguucucuugauuccugaaccagauagacaacggacuccucaggacaaccagcuugcuuacguaguaauuggucuuuuauuuaugauucuuacaguugcagcgaacgaaaugggauuauuggagacaacaaagaaagacuuagguauugggcauguggccguugagaaucaccaccacgccgccaugcuggaugucgaccuacauccagcaucugcauggacguuauacgccguagccacuacuauaauuacgccaaugaugagacacacaauugaaaauacaacagcaaacauuagucuaaccgcaaucgcaaaucaagcugcgauuuuaauggggcuggacaagggauggcccauaucuaaaauggauauaggcguaccucuauuggcgcuuggauguuacagccagguaaauccuuuaacucucacugcugcuguacuaaugcuaguggcucauuaugcaauuaucggaccuggucuacaagcaaaagcuacacgggaagcucaaaaacgaacggcugcugguauaaugaagaaccccacagucgauggcauugucgcuauugauuuggacccugucguauacgaugcaaaauuugagaagcaauugggacaaauaauguuauuaauacucugcaccucacaaaucuuauuaaugagaacaacaugggcauuaugcgaaucgauaacacuggcuacaggaccucuuacaaccuuaugggaaggcucaccgggcaaauucuggaauacgaccauugcuguaaguauggcuaacauauuucgaggaucuuauuuagcgggagccggacuugcauuuucuuugaugaaaucuuuaggcggaggaaggagaggaacaggagcacaaggcgagacuuuaggagaaaaguggaaacgccaguuaaaucaauugaguaaaucagaguucaauacauacaaaagaaguggaaucauggagguagaccguucggaagcaaaggaaggucucaaaagaggggaaacuacuaaacacgcuguuagucguggaaccgcaaaacugagaugguuuguugaacgaaauuuaguuaaaccggaggggaaaguuauagacuuagguugcggccggggcggauggucuuauuauugugcuggacucaagaaaguaaccgaagugaaaggcuacacaaaaggugggccuggacaugaggagccuauuccaauggcaaccuacggauggaauuuagucaaacugcauucugguaaagacguauucuucaucccaccggaaaaaugugacacucuuuuaugugauauaggagaaucaaguccaaauccaacaauugaggaaggaagaacccuucggguauuaaaaaugguagagccauggcugcgaggcaaucaauucuguauuaagauauuaaauccauacaugccgucggugguugagacguuagaacaaaugcagaggaaacauggagguauguuagucaggaacccauuaucacgaaauagcacacacgaaauguauuggguaucuugcgggacaggaaauaucguaucagcgguuaauaugaccucacggaugcugcuaaaucgcuucacaauggcccaccguaaaccaacauaugaaagggauguugaccucggagcaggaacaagacauguagcaguagaaccagaaguagccaacuuagauaucauuggucaaagaauagaaaauaucaaacaugaacacaaauccacuuggcauuaugaugaagacaaucccuacaaaacaugggcauaucauggaaguuaugaagugaaacccuccgguucagccuccucaaugguaaauggaguaguuaaguugcuuacuaagcccugggacguuaucccuaugguaacgcagauagcaaugaccgauacuacgcccuuuggacaacaacgcguuuucaaagaaaagguagauacccggacaccuaaggcuaaacggggcacagcucagauaauggaaguaacugcuaaguggcuauggggauuccugucgcgaaauaagaaaccuaggauuuguacgcgagaggaguucacuagaaaaguucgaagcaacgcggccauaggugcagucuucguagacgaaaaccaguggaacuccgccaaagaagcuguagaggacgagagauuuugggaccuaguccauagggaacgcgaauuacacaaacaaggcaaaugcgcaacaugcguuuauaauaugaugggaaaacgagagaagaaacuuggagaauuuggaaaagcuaaaggguccagggccauaugguauauguggcuuggcgcacgguuucuugaauuugaagcgcugggguuuaugaaugaagaucauugguucucacgugaaaacuccuuaagcggcguagaaggagaagguuugcacaaacuuggguauauuuuacgagacauuucaaaaauuccuggugggaacauguacgcugacgauacagcggggugggauacgcguauaacagaagaugauuuacaaaaugaggcaaaaauaacggauaucauggaaccugaacaugcacuuuuagccaaaaguauuuucaaguugacauaucagaacaaagucguccgaguacaacgcccagccaagaauggaacaguuauggacguuauaaguagaagagaucaaagaggcucuggacaagucggaacauauggccuuaacacauuuacaaauauggaggcacaacuaauaagacaaauggaaagcgaaggaaucuucagcccaucagagcuggaaacaccaaauuuagcuggaagaguauuggauugguuagagaaacaugguguggaaagauuaaaaaggauggcaaucaguggggacgauuguguaguuaaacccauugacgacagguucgcagccgcacuuacagcccugaacgacaugggaaaaguuagaaaagauauaccucaaugggaaccaucuaaagguuggaacgauuggcaacaagugccauuuuguagucaucauuuccaccaauugauaaugaaagaugguagagaaauagugguaccuugcaggaaucaagaugagcuagucggacgugcaagagugagccaaggugcugguuggucauuaagggaaacugcaugucuaggcaaaaguuacgcacaaauguggcaacuaauguacuuucaucgucgugauuugcgacuagcagcaaacgcuauaugcagugcuguucccguugacuggguacccacuucaagaacaaccugguccauccaugcgcaucaucaauggaugacaacugaagacauguuaucaguauggaauagaguauggauagaagaaaacccuuggauggaagacaaaacacacauaagcucauggggagacgucccauaucuuggaaagagggaagaucaaugguguggaucucuaauaggcuuaaccgcgcgagcaaccugggcaacuaauauacaaguugcaaucaaccaaguccgacgacuaauugguaacgaaaauuaucuugacuacaugaccucgaugaaacgauuuaaaaaugaaagcgauccugaaggugcgcucugguga

SEQ ID NO: 21813 - RNA, 9879 nt, Artificial Sequence
  derived and/or modified CDS sequence (opt6) from DENV-1__GU131738__SS-prME
ucaguaacuauguuauuaauguuaaugccgacggccuuagcguuucacuugacuacuagaggaggggaaccgcauaugauugugacuaaacaagaaagaggaaaaucucucuuauuuaaaacgagugcgggagucaacauguguacccuaauagcaauggaccuuggggaauuaugcgaagauacaaugacuuacaaaugucccaggauaaccgaagcagaaccugacgacgucgacugcugguguaaugccacugauacaugggugacuuacgguaccuguagucaaacuggcgaacauaggcgagauaaacgcucuguugcuuuggcgccacacguagguuugggucucgaaacacgaacggaaacauggaugagcuccgaaggcgcauggaaacaaauacagcguguagaaacuugggcccuacgacauccaggauuuacuguaauagcacuuuuccucgcucacgcgaucggaaccagcaucacacagaaaggaauuauuuuuauauuacuaaugcuagucacuccaucaauggcuaugcgaugcguuggaaucggcucccgagacuucguagaaggguuaucaggagcgacauggguugauguuguacuugaacaugguagcugcguaacgacgauggccaaagacaaacccacauuggacauagaauuguuaaaaaccgaggucacuaacccagcuguacugcgaaaacugugcauugaagcaaaaauauccaacacaacaacugauagccgcuguccuacccaaggagaagcgacguuaauggaagaacaagacgcgaauuucguauguaggagaacauucguagauagagguugggguaacgggugcgguuuauuugguaaaggaagucuaauuaccugcgcgaaauuuaaaugcguuacgaaauuagaaggcaaaaucguccaauacgaaaauuuaaaauauucuguaauuguuacugugcauacgggugaccagcaucaagucgguaaugaaagcaccgaacaugggacgacggcaacuauaacgccacaagcaccaacaagugaaauccagcuuacugauuauggcgcauuaacacuagauugcuccccucgaaccggauuagauuucaaugaaauggucuuacuaacaaugaaggaaaaaucuugguuaguucauaagcaaugguucuuagaucuuccauuaccguggacgagcggcgcauccacaagccaagaaacguggaauagacaagacuuacucguuacauuuaagaccgcccaugcgaaaaagcaggaaguaguagugcuuggaucgcaggaaggcgcaaugcauacugcguugacaggagcuacugaaauucaaaccucagguacuacaacaauauuugcaggccacuugaaauguaggcuaaaaauggacaaguuaacacuuaagggaaugucauaugucauguguacuggaucauuuaaauuagaaaaagaaguagcagaaacccaacauggaaccguccuagugcaaauaaaguacgaaggaacggacgcaccauguaaaauuccauuuaguacacaagacgaaaagggaguuauccaaaauggacgacuaauuacugccaauccuauaguaacugauaaagaaaagccugugaauauugaggccgaaccuccguucggcgaguccuauaucgugauuggggccggagaaaaagcauuaaaacuaucaugguuuaagaaagguuccucuauagguaagauguucgaagcaacagccagaggugcaaggaggauggcaauucucggagacacagccugggacuuuggaagcguuggugguguauuuacgucuguagguaaacuuguucaucaaauuuuugggacagcguaugguguuuuauuuagcggagugagcuggaccaugaaaaucgguauaggagucuuguuaacauggcuuggauugaacagccgaagcacuucacucuccaugaccuguaucgcgguaggucuaguuaccuuguauuuagguguaaugguacaagcagacaguggaugcgugaucaauuggaaggggagagaacuuaaauguggcagugguauuuuuguuacaaaugagguacauacuuggaccgaacaauauaaguuccaagcugauuccccuaagagacuaucagcagccauaggaaaggcaugggaagagggggugugugguauacgaucagcaacgcgacuugaaaacauaauguggaagcaaauuucgaaugagcuaaaucacauccuucuagagaaugacaugaaguucaccguagugguaggugacguagucggcauuuuagcgcaagggaagaaaaugauuagaccgcagccaauggaacacaaguacucauggaagucaugggguaaggcuaaaauuauaggugcagacguucaaaauacaacauuuauuauugacgggccaaacacaccagagugcccagacgaucagagagcauggaauaucugggagguagaagauuauggauucgguauauuuacuacaaacauuugguuaaaauuacgugacucauauacccaaguuugugaucauagguuaaugucugccgcuauuaaggacucuaaggcuguccacgccgacauggguuacuggauugagagugagaaaaacgagacuuggaaacucgcaagagcaucguucauagaggugaaaacaugcauauggccaaaaucucauacuuuauggagcaacggugucuuggaaucggagaugaucauaccgaagauauacggugguccgauaucccagcauaauuauaggccggguuauuuuacacaaacugcaggaccauggcauuuaggcaaacuagagcuugauuuugacuuaugugagggcaccacgguagugguugaugaacauugcggcaauagagguccgucacuacgcacaaccacggucacugggaaaauuauucaugaaugguguugucgaucgugcacccugccacccuuacguuucaaaggugaggacggauguugguauggcauggaaauacgacccguuaaagaaaaagaagaaaaccucgugaaaucaauggucuccgcugggucaggcgaaguugauucauuuagcuuaggacuacuauguaucagcauaaugauagaagaagucaugagaucacgauggucucgaaaaauguuaaugaccgggacgcuugcaguguucuugcuauugauuaugggacaauuaacauggaacgaucuuauccgccugugcauaauggucggagccaacgcaagugacagaaugggcauggggacaacuuacuuagcccuaauggcaaccuuuaaaaugcgaccaauguuugcaguugguuuguuauuuagaagguuaacaucgagagaaguacuccuauugacaauagguuugucuuugguagcaagcguggaacuaccaaauucgcuugaggaacuuggagauggauuagccauggguauaaugauucugaaguugcuaacugauuuucagucacaccaacuuugggcuacacuccugaguuuaacauucauuaaaacaacgcuaucacuucauuaugcauggaaaacuauggcgaugguuuuaaguauagucucucuauucccguugugccugagcacgacaagucagaagaccaccuggcuaccagucuugcuggguaguuuaggcugcaagccacuuacuauguuccuaauaacggaaaacaaaauauggggacgcaagaguuggccuuugaaugaagguauaauggcuguugguguagucagcauccuucuauccucauuacuuaaaaaugaugugccccucgcgggaccuuugauagcaggaggaauguuaauugccuguuauguaauuucaggcaguuccgcagauuugucccuagaaaaagcagcggagguaagcugggaagaagaagcagaacauagcggcgcuucucauaauauacugguugaaguccaagaugaugguacaaugaaaauaaaagacgaggagagggacgacacucuaacaauuuugcuaaaggcgacacuauuggccguuucuggaguguauccacuuucuauacccgccacauuguuugugugguauuucuggcaaaagaagaaacaacguagcggaguccucugggacacuccuagcccuccugaggucgaacgugcagugcuagaugauggcauuuauagaaucaugcagagaggccuguuaggacgaagccaaguagggguaggaguguuucaagaaaauguauuucauacaauguggcauguaaccaggggagcggugcuaauguaccaagggaaaagguuagaaccuucaugggcaaguguaaagaaagaccuuauaagcuauggaggaggguggcguuuacaagguaguuggaauacuggagaggaaguacaaguaauagcaguugaacccgguaaaaauccgaagaauguccaaacugcaccugguacguuuaaaacgccugaaggagaaguaggagcaaucgcauuagauuuuaaaccaggaaccagcggaagucccauagucaaccgugaaggaaaaauagucggucuauaugggaauggagucgugacaacaucgggaacuuaugucucagcaaucgcccaagcuaaagcuagccaagaaggccccuuaccggaaauagaagaugaaguauuccguaagcgaaacuuaacgauaauggaccuacauccaggaucaggaaagacacgccguuaucuaccugcuauaguaagagaagcuauuaaacguaaauugcgaacauuaauacuagcgccaacgagaguugucgccucagagauggcagaagcacuuaaaggaaugccaauacgauaucaaacaacagcugucaagucugaacauacggguaaggaaaucguggaucuuaugugucaugccacauucacaaugcgucuacuaaguccgguccgaguuccgaacuacaauaugauaauuauggacgaagcccauuucacggauccuucaaguaucgccgcucgagguuacauuagcacaaggguaggaaugggagaggcugcugcgauuuucaugacagccacaccacccggaucaguagaagcauucccccagucgaaugcaguaauacaagacgaagagagagauauaccaggaagaucuuggaacuccggcuacgaauggauaaccgacuucccgggaaagacaguaugguuuggaccaacgauaaaaucaggaaaugacauagcaaauuguuuacggaaaaauggaaaaagagugauacaauugucucgaaaaacuuuugacacagaguaucagaaaacgaagaacaaugacugggauuacgucgguaccacugauaucucagaaaugggugcuaauuucagagcggauagagugauagacccucggcgauguuuaaaaccgguaauauuaaaagauggaccggagcgaguaauauuagcagggccaaugccaguaacaguagcuucagcagcacaacgaagaggaagaaucgggagaaaucacaacaaagagggcgaucaauauauuuacauggggcaaccguugaauaacgacgaggaucacgcacauuggacagaagcgaaaauguuacuagacaauauuaauacgccugaaggcaucauaccagcucuuuucgagccagagagagaaaaaucugccgcuauagauggugaauacagauuacgcggagaagcccgaaaaacauuuguugaacuuaugcgaagaggagauuugccugugugguugaguuauaagguggcuagcgagggauuucaauauucugacagaagaugguguuucgacggagaacgcaacaaccaaguauuagaagagaauauggauguugaaaucuggaccaaagaaggugagcgcaagaaacuuagaccucgauggcuagacgccagaacguauucugacccccuagcuuuacgggaauuuaaggaguuugcggccgggcguagauccgucucgggagauuuaauauuagagauaggcaaauuaccacaacauuugacacaacgggcacaaaacgcacuagacaaucuggucaugcuacauaauucagaacaaggugguagagcguacagacaugcgauggaagaauuacccgauacuauagaaacucuaauguuacuugcacuuauugcagucuuaacuggcggugucaccuuguucuuucuuucgggaaggggacugggcaaaacaucaaucggacuauuaugugucauggcaaguucaguccuucucuggauggcaucagucgaaccucacuggauagcagcaucaauuauauuagaauuuuuccuaaugguguuacuaaucccggaaccugacaggcaacgaaccccucaggauaaccaacuggcguauguaguaauagggcuacuguuuaugauacuaacgguugcugcaaaugaaaugggccuguuagagacaacgaagaaagauuuaggaauaggccauguugcuguggagaaccaccaccaugcaacaaugcuagauguagaucugcaucccgcauccgcauggacgcuauaugcgguugccacgacgaucauaacaccgaugaugagacacaccauagaaaacacuacagcaaacauuaguuuaaccgcuauugcuaaccaggcagcuauccuuaugggucuagauaagggcuggccuaucuccaagauggauauuggugugccacuucuagcauuaggauguuauagucaagugaauccauuaacguugacggcagcaguacuuaugcuagucgcccauuaugcaauaauaggccccggacuccaagcaaaagcuacacgagaagcacaaaaacgaacugcagcuggcauuaugaaaaacccgacaguggacggaauaguugcuaucgaccuugacccagucguauacgaugcaaaauuugagaaacaguuaggacaaaucaugcuucuaauauuaugcacaucgcaaauauuacuaaugcgaacaacuugggcuuuaugugaaucaauuacacuagccacggguccacuaaccacacuaugggaagggucaccagguaaguuuuggaacaccaccauagcaguaucgauggcgaacauuuucagagguucuuaccuagcgggagcaggacuagccuuuuccuuaaugaaaucauuaggagguggucgacguggaacaggugcacaaggugagacccuaggugaaaaauggaagagacaauugaaucaacugucgaaaagcgaauuuaacauauauaaacguucaggaauaauggaaguggaccgaucugaagcuaaagaaggacucaaacguggagagacgacgcgacaugcgguaucgcgaggcacggccaaacucagaugguucguugaaagaaauuuaguaaaaccagaagggaaagugauagauuuaggauguggucgaggaggguggaguuacuacugcgccgggcugaagaaaguuaccgaggugaaaggcuauacgaaagggggccccgggcaugaagaacccaucccaauggcaacuuauggauggaaucugguaaaacuucauaguggcaaagauguauucuuuacaccaccggaaaaaugcgacacucuuuugugugacauuggagagucaucuccaaacccgacaauagaagaagggaggacgcuuagaguauuaaaaaugguagagcccuggcugagagguaaucaguuuuguauaaagauauuaaaccccuacaugcccucaguagucgaaacauuagaacaaaugcagagaaagcaugguggaaugcucgucagaaacccacuuucccgaaauucaacacaugaaauguacuggguuuccugcggaacugguaauaucguuuccgcuguuaacaugacaucuagaauguuguuaaaucgauucaccauggcgcauagaaaaccuacauacgaaagggacgucgauuuaggagccggcacaagacauguugcgguugaaccugaggucgcuaaucuagacauuauugggcagcgaauagaaaauauaaaacaugaacacaaaucuacauggcauuacgacgaagacaacccauauaaaaccugggcuuaucacggcucuuacgaaguuaaaccaucagggucagcuucaagcaugguaaacggaguagucaaauugcugacaaaaccaugggacgugauacccaugguaacacaaauugcuaugacugauacaacaccuuuuggccaacaacgaguauuuaaggaaaaaguagauacucguacuccuaaagcaaagcgaggcacugcacaaaucauggagguaacagcgagauggcuauggggguuucugucuagaaacaagaaaccccgaauaugcaccagagaagaguucacaagaaaggucagaaguaaugcagcgaucggcgcuguauucguagaugagaaccaauggaacagcgcaaaggaagcaguagaagacgaaagauucugggacuuaggacaaaaagagagggaauuacauaaacaaggcaaaugugccacaugcguauauaauaugaugggcaaacgugagaagaaacugggugaguucggcaaagcaaaaggaucaagggcuauuugguacaugugguuaggagccagauuucuugaguucgaggcguuaggcuucaugaacgaggaucauugguuuagccgugaaaauagccuuagugguguagaaggagaaggguuacacaaacuaggguauauauuaagagauauaucgaaaauaccugguggcaacauguaugcugaugacacugcaggaugggauaccaggauuacagaggaugauuuacaaaacgaagcaaaaauuaccgauaucauggagccagagcacgcacuucucgcgacgagcauauucaaacuaacauaucaaaauaaaguaguucgaguacaaagaccagcuaaaaacgguacugucauggauguaauuucaagaagagaccaaagagguucgggacaaguaggcacuuauggacuuaacacauuuacuaauauggaagcacagcuaauaagacaaauggaauccgaagggauauuccugccguccgagcuagaaaccccaaacuuggcggaaagaguacuugacugguuagaaaaauauggaguugaacgucuuaaaagaauggccauaaguggagacgacuguguugucaagcccauagacgauagguuugccaccgcguuaacagcccugaaugauaugggaaagguuagaaaagacauuccucaaugggaacccagcaaagguuggaaugacuggcaacagguaccauucugcagucaucauuuucaucaauuaauaaugaaggacgguagagaaaucgugguacccugccgaaaucaggaugaacuuguaggcagggccagaguaucacaaggagcugguuggucuuuacgugaaacugcaugcuuggguaagucauaugcacaaauguggcaauuaauguacuuucacaggagagaccuaagauuagccgccaaugcaauuugcucagccguaccaguugauugggucccuacaagucgaacuacauggagcauccacgcacaucaucaguggaugacgacugaggauaugcuaagcgucuggaauaggguuuggauugaggaaaauccauggauggaagacaagacgcacguuaguucauggggagauguaccauaucuagggaaaagagaagaccaauggugugguucacuaauaggauuaacagcacgcgccacaugggccagcaacauccagguugcaaucaaucaggucagaagacuuaucggaaaugaaaauuauuuggacuacaugacaaguaugaaacgauucaaaaaugaaggggauccugaaggggcccuuugguaa

SEQ ID NO: 21814 - RNA, 9879 nt, Artificial Sequence
  derived and/or modified CDS sequence (opt6) from DENV-1__JF937604__SS-prME
aguguaaccauguuacuaaugcucaugccuaccgcucuggcauuucaucuuacgacucgcggaggagaaccucauaugauuguaucuaaacaggaaagaggaaaaaguuuauuguuuaagacaagugcugggguaaacauguguacacucauagcgauggauuuaggugaauugugcgaagauacuaugacguacaaauguccuagaaucaccgagacagaaccugacgacguugacuguuggugcaacgcaacugacacuugggugaccuacgggacuugcucacaaacaggagaacaucgaagagacaaacguaguguggcgcuugcaccccauguuggacuuggacuugaaacucguacggaaaccuggaugagcucagaaggcgcguggaagcaaauacaacgaguugaaacaugggcacuuagacauccagguuuuaccguuaucgcacuuuucuuggcgcacgccauagggacuucaauaacacaaaaaggcauaauuuuuauuuuguuaauguugguaacgccaaguauggccaugagauguguaggaauugggucacgagauuuugucgaaggacuuuccggugcaacauggguugacgucguguuggaacauggcagcuguguaacuacaauggcuaaagauaaaccuacacuugauauagaauuacugaagaccgaaguuacaaaucccgcaguacuacguaaauuauguauugaagcgaaaauaucuaauaccacaacggacucccgcuguccaacucaaggcgaagcaaccuuaguugaagaacaagacgcuaacuuugugugcagaagaaccuuuguagacagaggaugggguaauggaugcggacuguuuggaaaagggucauugauuacaugcgcuaaauucaaaugcguaacaaaacuagaggguaagauaguacaguacgaaaauuuaaaauauuccguuauaguaacaguccauacuggggaucaacaccaagucgggaacgaguccacagaacacggcacaacagcgaccauaacaccacaagcuccaacuacugaaauccaacugacagacuacggcgccuuaacauuggacuguaguccaagaacagguuuggacuucaacgaaaugguacuguuaacuaugaaagagaaaaguugguuaguccauaaacagugguuucuggaccuuccacucccguggacgagcggugcaaguacaagucaggaaaccuggaauagacaagauuuacuugugacauucaaaacugcucacgcuaagaaacaggaaguuguuguacucgggucgcaagaaggagcaaugcauacugcacuaaccggugcgacugagauccaaacauccgguaccaccacaaucuuugcugggcaccuaaagugccgguuaaagauggacaaauugacccuaaaaggcaugucuuacguaauguguacaggcaguuucaagcuagaaaaagagguagcugaaacacaacaugggacaguacuuguacaaauaaaauaugaagguacagacgcccccuguaagaucccauuuagcacucaagacgaaaagggaguuacccaaaacggacgccuaauaacugcuaauccaauuguaacggacaaagagaaaccaguuaacaucgaagcugaaccuccuuuuggggaaaguuauauuguaauuggcgcgggcgaaaaagcacuaaaauugagcugguuuaagaaggguaguaguauuggaaaaauguuugaagcaacggcucggggugcccgaagaauggcaauuuuaggcgacacugcuugggacuucggcagcauuggugguguauuuacuucaguuggcaaacuuguacaucaaacauucggaacagcuuacggcgucuuauucucaggugugagcuggaccaugaaaauuggaauaggaguccuuuuaacuuggcucggauuaaacagucguucaaccaguuuaucaaugaccuguauagcaguaggccuagugacccuguaccucgguguaaugguccaagccgauucagguuguguaaucaauuggaaaggaagggaauuaaaaugugguucagggauauuugugaccaaugaaguucauacuuggacggagcaguacaaguuccaagcugacucgccgaaacgucuaucagcggcuauuggaaaagcaugggaagaaggcguaugcggcauuaggucggcuacucggcuagaaaacaucauguggaagcaaauaucgaaugagcuaaaucauauacuauuagaaaaugauaugaaauuuaccguaguugugggugaugucgcuggaauauuagcacaaggcaaaaagaugauuagaccacagccaauggaguauaaauauaguuggaaaaguugggguaaggcuaaaauaauuggagcagauguucaaaacaccacauuuauaauugaugguccaaauacaccugagugcccagacgaucagagagcauggaauaucugggaaguggaggauuauggguucggaauauucacaacaaacaucugguuaaaauugagagauucauacacacaaguaugugaucaucgauugaugucagcagcaauaaaagauaguaaagccguacaugcugacaugggauacuggauagaaucagagaaaaaugagacauggaaguuagcccgggccagcuuuauugaaguuaagacuuguauauggccgaaaucccauacacuauggucuaacggcguacuagaaagcgaaaugauaauucccaaaauauauggcggcccgauaagucaacacaauuaccgcccaggguauuuuacacaaaccgcuggaccauggcaccuaggcaaacuugaacuagauuucgaucuaugcgaaggcaccacugucguaguugaugagcacugugggaauagaggcccguccuugaggacgaccacaguuacaggaaaaauaauucacgaaugguguugccggaguugcacccuaccaccacuaagauuccguggagaggauggguguugguacggaauggaaauacgaccaguaaaggaaaaagaggaaaacuugguuaagucaaugguauccgccggaaguggagaaguugauucauucucucuaggacuucuguguauuuccauaaugauugaagaagucaugagauccagauggucgcgaaagauguuaaugacgggaacuuuagccguauucuuccuguuaauaaugggucagcuuacauggaaugauuuaauaagacuuuguauaaugguaggcgcuaacgccucugaccgaaugggaaugggcacaacauauuuagcguugauggcuacguuuaaaaugcgucccauguuugcuguaggcuuacuauuccgcaggcuaacaucuagagaaguucuuuuacugacgaucggccuuucccuaguagcaucugucgaauuaccaaacucauuagaagaacuaggugacggccucgccauggguauuaugauuuuaaaacucuugacugauuuucagucguaucagcucugggccacacuauuaagucucacauuuaucaaaacuacguucuccuuacauuacgcuuggaaaacuauggcuaugguauuaucgauagucaguuuauucccacucuguuuaucaacaacaagucaaaagaccacaugguuaccuguccuccuaggcagucuggguuguaaaccacucacuauguuuuugaucgcagaaaacaagauauggggccggagaaguuggccauuaaacgaaggaauaauggcaguugggaucgucaguauauuacuuaguagucuacucaaaaaugacguaccccucgcaggaccacugauugccggcggaauguuaauagcgugcuauguuauuucuggaucaucugcugaucugaguuuggaaaaagcugcugaaguaagcugggaagaggaagcagagcacucgggagcaucacauaauauccuaguagaaguccaagacgacggaacaaugaaaauaaaagaugaagaaagggaugauacucugaccauucuacuuaaggcgacucucuuagcaguaucaggaguuuauccucuuaguauuccagcuacucuauuugucugguauuuuuggcagaagaagaaacaaagaagcgguguacuaugggauaccccgucgccuccugagguugaacgugccguuuuagaugaugguaucuacagaauuaugcaacguggauuauuagguaggagccaagucgguguugguguuuuucaagagaauguguuucacaccauguggcauguuaccagaggggcagucuuaauguaccaaggaaaaagacuggaaccaaguugggcguccgucaagaaagacuuaauuagcuacggcggaggcuggaggcuucaaggguuuuggaauacaggcgaagaaguucaaguaauugccguugagccugguaaaaaucccaaaaauguucaaacggcaccaggaacauuuaaaacuccugaaggcgagguaggagccauagcuuuagacuucaaaccaggaacaaguggcaguccaauaguaaauagagaagggaaaauagugggccuauauggcaacggaguuguuacuacuucaggaacauacguguccgccauugcccaagcaaaagcaagccaagaagggccuuuaccugagaucgaagacgaaguauuucguaagcgcaaucuaacaauaauggaccuacacccgggaucugguaaaacacgaagauaucucccagcaauaguaagagaagcuaucaaacgcaaacuaagaacucugauacuagcaccaacaagaguuguggcuagugaaauggcggaagcucuuaaggggaugccaauacgguaucaaacgacagcuguuaaaucagaacauacgggaaaagaaaucguagauuuaaugugucacgcaaccuucacuaugagacuuuuaagccccguuaggguuccaaauuauaacaugauuaucauggaugaagcacauuuuacggaccccaguagcauagcugcucguggguacauuagcacaagaguagggaugggagaggcagcagcuaucuucaugacugcuacgccuccgggguccguagaagcauuuccacaaucaaacgccguaauacaagaugaagaaagagacaucccagaacgcaguuggaacucugguuaugaauggauaacagacuuuccagguaaaaccguaugguuuguucccucaauaaaaucuggcaacgauauagcuaacugccuuaggaaaaacgguaaaagggugauacaauugaguagaaaaacguucgacacggaauaucagaaaacuaagaauaaugauugggauuauguaguaaccacugacauauccgaaaugggagcaaauuucagagcugauagggugauugacccaaggaggugcuuaaagcccgucauacuaaaagacgguccugagaggguaauacuugcuggacccaugccgguaacaguagcaucggcagcccaacgaagaggucgaauagguagaaaucauaacaaggagggggaucaguauauuuauaugggacaaccauuaaauaacgacgaagaucaugcucauuggacagaagcuaaaauguuacuagacaauauaaauacuccagaagguauuauaccugcuuuauucgaaccagagcgcgaaaaaucagcggcaauugacggggaauaucggcuucgcggggaagcucgaaaaacuuucguagaacugaugagaagaggagaccuuccaguuugguuaucuuacaaaguugccagugaaggauuccaauauucagauagacgauggugcuuugacggagaacggaauaaucaagugcuagaagagaacauggacguggaaauauggacgaaggaaggcgagaggaagaaauugcguccgcgauggcuagacgcacguacauaugcagauccacucgcacuacgagaguucaaggaauuugccgcaggccgcagaagugugagcggggaccuaauacucgaaauugguaaauuaccccaacaucuaacacagagggcacaaaaugcuuuagacaauuuagucauguugcacaacagugaacagggagguagagcauauaggcacgcuauggaggaacuaccagacacaaucgaaacguuaaugcugcuugcacuuauugcuguauuaacgggcggggucaccuuauuuuuccuuucggguagagguuuaggaaaaacaucaauaggucuacuuuguguuauggccaguucaguauugcuauggauggcgucaguagagccacauuggauagcggcaagcauuauuuuagaguucuuuuuaaugguauuauuaauuccagaaccagaucgacaaagaacuccccaggauaaucaacuugccuauguaguaaucggccuguuguuuaugaucuugacaguagcagcaaaugaaaugggacuauuggaaacaacgaaaaaggaccuugguaucggucauguggccguagaaaaccaucaccaugcagcaauguuagacguagaccuucacccugcgagugcauggacacucuaugcuguagcuacuaccauuauuacaccuaugaugcgacauacuauagaaaauaccacagcaaauauaucacuuaccgcaauagcaaaccaagcagcgauccuuaugggcuuggacaaaggauggccaaucaguaaaauggacauugggguucccuuacuagcucucggaugcuacagccaaguuaauccccuaacccuuacugccgcuguuuugaugcuuguugcccauuaugcgauaaucgggccugguuugcaagcaaaagcuacgagagaggcacagaaacgaacggcugcuggaauaaugaaaaaucccacaguugacgggauaguagcaauagaccuagauccuguaguguaugaugcuaaauucgaaaaacaauuagggcaaauaaugcuauuaauauuauguacaucgcaaauacuacucaugaggacaacuugggcuuugugugaaucaauuaccuuggcaacugggccccuaacgacgcuuugggaaggguccccggguaaauuuuggaauacuacgauagccguuaguauggcaaacauauuccgugguucuuaccuagcuggcgcugggcuggcauucucuuuaaugaagucucuagggggcggacgcagagguaccggggcgcagggagagacuuugggagaaaaguggaaacgacaguuaaaucagcuauccaaguccgaauuuaacacauacaagaaaagugguauaauggagguagacagaagugaggcaaaagagggguuaaaacgaggcgaaacuacuaaacacgccguuucucgaggaaccgcgaaacuaagaugguuuguagaaagaaauuuaguaaaaccugagggaaagguuauagacuuagguuguggacguggaggauggucuuacuauugugcaggcuugaagaaaguaacugagguaaaagguuacacuaaaggaggcccuggccaugaagaaccgauaccgauggcaaccuaugguuggaaucuaguaaaacuacauucaggaaaggacguguucuuuauucccccugaaaagugcgacacauuguuaugcgacauaggggaaucaucacccaacccgacaaucgaagaagggagaacccuaagaguauugaaaaugguugaaccgugguuaagggggaaucaauuuugcaucaaaauacuaaacccguauaugcccucugucgucgaaacgcuggaacaaaugcaacgaaaacauggagggaugcugguaagaaaccccuuaaguagaaauaguacucaugaaauguauuggguaucguguggcacugggaauauagucuccgcuguaaacaugacaucaaggauguuacucaaccgauuuacaauggcacaccguaagccgacuuaugaaagagauguggacuuaggggcaggaacacgccacgucgcaguagaaccagaaguagcuaacuuagauauuauagggcaacggauagaaaauauaaaacaugaacauaaaaguacuuggcacuaugaugaggauaauccuuauaaaacgugggcauaccacgggagcuaugaaguaaaaccaagcggaucagcaucuagcaugguaaacggggugguaaaacuacuuacuaaacccugggauguaauaccaaugguaacccaaauugccaugacagacacaacaccauuuggucagcaaagggucuucaaggaaaagguagacacucggacaccaaaagcuaagcagggaacugcccaaauuauggaagugacagcuaaaugguuauggggauuuuuaucuagaaacaagaaaccaagaaucugcacuagagaagaguucacccgcaagguaagaaguaaugccgcaauaggugccguauuugucgaugagaaccaguggaauagugcaaaggaagccguagaagacgagagauucugggaucuggugcaucgggaacgugagcuucauaagcaggggaagugcgcaacauguguauacaacaugaugggaaaaagggaaaagaaacuuggagaauuuggaaaggcuaaagguucccgagcaauaugguauauguggcugggagcgcguuuucuagaauuugaagcucuaggauucaugaaugaagaucauugguuuaguagagaaaauuccuuaucggguguagagggagaaggacugcauaaguuaggguacaucuugagagauauuagucaaaucccaggcgggaauauguacgcugaugauaccgcugguugggauacucguauuacugaagaugacuuacaaaacgaagcacguauaacagacauuauggagccagagcaugcacuucuagcaaagucaauauuuaaguuaacuuaccaaaauaaaguaguaagaguacagagaccugcuaaaaauggaacuguuauggauguuauuuccagaagagaucaacggggaucggggcaaguuggcacuuacggccuaaacacauucacaaacauggaagcacaauuaauuaggcaaauggaaucagaaggaauauuuuccccgucugaacuagaaacaccuaauuuggcagaaagagucuuagauuggcuugagaaauacgguguugagagauuaaaaagaauggcuaucaguggagaugauugcgucguuaaaccuauagaugaccgauucgcaaccgcucucacugcacuuaacgauaugggaaagguacggaaagauauaccacaaugggaaccuaguaaaggauggaacgauuggcaacaaguucccuucuguagucaucauuuccaucaauuaauaaugaaggacgggagggaaaucgucgugccgugucgaaaucaggaugaacuggugggcagagcgcgagucucucaaggugcagguuggucauuacgagagacagcuugucuuggaaaaucuuaugcacaaauguggcagcuaauguacuuucauaggagggacuuacgccuagcagcaaaugcaauauguagugcaguuccggucgacuggauuccgacaucaagaacuacaugguccauacacgcucaucaucaguggaugacuacugaagauauguugucagucuggaacagagucuggauagaagaaaacccauggauggaagauaagacccacaucuccuccuggggugaugucccauaccuggggaaaagagaagaccagugguguggcucacucauuggacuaacagcaagagcuaccugggcaacaaauauucagguagcaauaaaucaaguacgacgacuuauagggaacgaaaauuaccuagauuacaugacaucuaugaaaagauuuaaaaaugaaagugauccagaaggggcacuaugguaa

SEQ ID NO: 21815 - RNA, 9879 nt, Artificial Sequence
  derived and/or modified CDS sequence (opt6) from DENV-1__JF937605__SS-prME
agcguuacaauguuauuaaugcuaaugccuaccgcacuagcauuccaccuuaccacccgcgguggugaaccccauaugauuguaaguaaacaagaaaggggaaagagcuuacuauucaaaacaucggcugggguaaauaugugcacauuaauagcaauggaccugggagaacugugugaagacacaaugacauacaaauguccaaggauuacggaaacagaaccggacgauguagauugcugguguaacgcuacugauacuugggugacguacggaacaugcucccagacuggagagcauagaagagauaaacguaguguggcacuagcuccacaugucggacugggacuagaaaccaggacggaaacuuggaugucuuccgagggggcauggaaacaaauacaaaggguagaaacaugggcauuacgucauccaggauucaccguuaucgcauuguuucuagcacacgcgauagguacaaguauuacucaaaaaggaauuaucuuuauauuacuaauguuaguaacgccaucuauggcaaugagauguguagggauagguagcagagacuuuguagaagggcuuaguggggcaacauggguagauguaguacuugagcacgguagcuguguuacgacuauggcgaaagauaaaccuacucuagauauugaauuacuaaaaaccgaaguaacaaacccugcaguacugcgcaaacuuugcauagaggcgaagauaucgaacacaacgacagacucucgauguccuacacaaggagaggcaaccuuaguagaagaacaagaugcaaauuuugugugcagaagaaccuuugucgaucgugguuggggaaacggaugcgguuuauuuggaaaaggcucucuuauuacgugcgcaaaauuuaaauguguaacgaaacuugagggaaaaauaguucaauaugaaaauuugaaauauucugucauaguaacagugcauacaggagaccagcaucaaguagguaacgagucgacggaacacggaacuaccgcgacaauaacuccacaagccccuacuaccgaaauacagcuaacagauuacggagcuuuaacucuggauuguaguccgcguacgggacuugauuucaacgaaaugguucucuugacaaugaaagagaagucaugguugguacauaaacaaugguuuuuggaccuacccuuaccauggacaucuggagccuccacccuucaggagacauggaaccgucaagaccuacuuguaacguuuaaaacagcacacgcuaagaaacaagaaguagucguauuagguucacaagagggugcaaugcacacugcacuaacuggugcuacugagauucaaacaucagguacuacaacaauauucgcagggcacuuaaaaugcaggcucaaaauggauaaacuuaccuugaaaggaaugucauauguuaugugcacgggaucauuuaaauuagaaaaggaaguagcugaaacacagcauggaacaguguuaguccaaauaaaauaugaaggcacagacgcgccuuguaagauacccuuuaguacacaagacgaaaagggcguuacccaaaacggaagauugaucaccgcaaaucccauuguaacagauaaagagaaacccgugaauauagaagccgagccacccuucggugaguccuacauaguaauuggugcgggugaaaaggcgcucaaacuaucgugguuuaagaagggaagcaguauagguaagauguuugaggccacugccagaggggcucgaagaauggcuauacuaggcgauacagcaugggauuucggauccauaggugguguauuuacaucagugggaaaacuugugcaucagaucuucgguacagccuauggcguacuauuuucaggcguaucauggacaaugaagauaggaauuggaguucuacuaacauggcuuggguuaaacucaagauccacaucauuaaguaugacguguauagccgugggcuugguuacauuauauuuggguguuaugguacaagcugauagugguugugugauuaauuggaaaggaagagaauuaaaguguggcagcggaaucuucguaacuaaugaaguacauacauggacugagcaauauaaauuucaagccgauucuccuaaaagacuuagugcugcaaucggaaaagcgugggaagaggggguaugugguaucagauccgcgacuagacuagagaacaucauguggaaacagauaucuaacgaauuaaaucauauacuucuggaaaaugacaugaaguuuaccguaguuguuggugauguugcagggauauuggcacagggcaagaaaaugauacguccacaaccuauggaauacaaauacuccuggaaaucguggggcaaagcgaagauaauaggcgcugauguacagaauaccacauuuauaauagacggcccgaauaccccggaguguccggacgaccaaagagcauggaacauaugggaaguugaagauuacggauucgggauauuuaccacaaauauauggcuaaaauuaagagauagcuacacgcaaguuugcgaucaccgcuugaugucugcagcuauaaaggauaguaaagcuguacaugccgauaugggcuauuggaucgaaucugaaaagaacgagacauggaaauuagcgagggcgucauuuauugaggugaaaacuuguauuuggccuaagucucacacacuguggucuaacggcgucuuagaaucugaaaugauaaucccuaaaauauauggagggccaauaucacagcauaauuauagaccagguuacuuuacacaggcagcagguccuuggcacuuaggaaaacuagagcucgauuuugaccuaugugaggggacaacaguagugguggaugagcacuguggaaaccgcggaccaucucuuaggacgaccacugugacagguaagauaauucaugaaugguguuguagaucaugcacuuuaccuccacugcguuucagaggggaagauggauguugguacggaauggaaauaagaccgguaaaagaaaaagaagaaaacuugguaaagucaaugguaucagcaggaagcggagaagucgacucuuucucacuaggacuauuauguauaucaauuaugauugaggaagucaugaggucacgcuggucacggagaauguuaaugacgggcaccuuagccgucuucuuuuuacuaaucauggggcaacuaaccuggaaugacuuaauuagacuaugcaucaugguuggugcaaaugccucugauagaauggguauggggacaacauauuuagccuuaauggcaacauucaaaaugagaccaauguuugccgugggacuauuguuuaggagauuaacgucuagggaagugcuuuuacuaacuauaggucuuagccuuguagcuucaguggagcuaccaaauucccuagaagaacuuggagacggucuagcuaugggaauuaugaucuugaaacuacuaacugacuuucaaagucaccagcuuugggcaacauuguuaucccucacguuuaucaaaacgaccuuuucucugcacuaugcguggaaaaccauggccaugguacuuucaauugucucauuguuuccacuuugucuuucgacuacaucgcagaaaacuacauggcucccaguacuguugggaagccugggguguaaaccacuuacaauguucuuaaucgcagaaaacaaaauauggggccgccgcagcuggccacuuaacgagggcauuauggcuguaggaauuguuagcauacugcuaaguucauuacucaaaaaugauguaccucucgcugguccacuuaucgcaggaggcaugcuaauugcgugcuauguaauaucgggaagcucagcugaucuaucguuggaaaaagcugcaaaagugucuugggaagaggaggcagaacauucuggagcaagucauaauauucuuguagaaguucaggaugacggaaccaugaaaauaaaagacgaagaaagagacgauacguuaacaauucuucuuaaagccacucuacuggcaguguccgggguuuacccacuauccauaccagccacccucuuuguuugguauuucuggcagaagaagaaacaacguucuggagugcuuugggacacaccaagcccaccagaaguggagagagccguacucgaugacggaauauauagaaucaugcaacgaggucuacucgguaggagccaaguuggagucgggguauuucaagaaaauguuuuucauacgauguggcacguuacuagaggcgcaguguuaauguaucaaggaaagagauuagagccauccugggccaacguuaagaaagaucuaauuucauacggcggcggguggaggcuccagggaucauggaacaccggugaggaaguucaaguuaucgcaguagagcccggcaaaaaucccaagaacguccaaacugcaccaggaacuuucaaaacaccugaaggagaaguuggugcgauagcuuuagauuuuaaaccugggacaagugguaguccgauuguaaacagagaagguaaaauuguuggucuguaugggaaugggguaguuacaacgaguggaacguacguauccgccauugcccaggcuaaggcuagucaagagggaccccuccccgaaauagaagaugaaguauucagaaaaagaaaccuuacaauaauggacuugcaccccggaucgggcaaaacuagacgcuaccuuccagcuauugugcgggaagcuauuaagaggaaacuucgaacacucaucuuagcaccaaccagaguaguggcuucggagauggcagaagcauuaaagggcaugcccauaagauaccaaacaacagccgucaagucugaacauacaggaaaggaaaucgucgacuuaaugugucaugcuacauuuacaaugagacuacuaagucccguacgaguaccgaauuauaauaugauaauaauggacgaagcccauuuuacagauccgucaucaauagcagcccggggauacauuucaacacggguggggaugggugaagcugcugcuauauucaugacugcuacucccccugggagcguugaagccuuuccgcaaucuaacgcgguaauucaagaugaggaaagagauauacccgaacguagcuggaauaguggauaugaauggaucacagauuuuccaggcaaaacuguuugguuuguuccuaguauaaaaucugggaaugacaucgcgaacugcuuacguaagaacgggaagagggucauacaauugucucgcaagacauucgacacagaguaucagaaaacuaaaaauaacgauugggauuaugucgugacaacggauauauccgaaaugggggcuaauuuuagagcagacagagucauugauccaagaaggugucuuaaaccaguaauccuaaaagauggaccagagcguguaaucuuagcaggacccaugccaguuacaguagcaucagcggcucagcgucgcggucgaauaggcagaaaucacaauaaagaaggagaccaauacauuuacauggggcagccucucaauaacgaugaagaccaugcacauuggaccgaagcuaaaaugcucuuagauaacauuaacacuccggagggaauaauaccagcacuauuugaaccggaaagggaaaaauccgcagccauagauggagaguauagauuaaggggagaagcgcgcaaaaccuucguugaacucaugcgacgcggagauuuacccguuugguuauccuauaaaguagccagugaagguuuccaauauagugaucggagaugguguuucgacggggagagaaacaaccagguguuagaagaaaauauggacguagaaauauggacuaaagaaggcgaacgaaagaaacuaaggccucgcuggcuagaugcucguacauauucagacccuuuagcauuacgugaauuuaaagaauuugccgcuggccgucgaucagucaguggugacuuaauauuggaaaucgguaaacuuccacaacaucuaacgcaaagggcucaaaaugcauuagauaaucuugugaugcuacacaacucagaacaaggaggacgagcuuacagacacgcuauggaagaacuuccagacaccauagaaacucuaauguuauuagcuuuaauagcagugcucacuggcggaguaacccuauucuuucuuucaggacguggauuaggaaaaacuuccauaggauuauuguguguaauggcgaguucaguuuuauuauggauggcauccguagaaccucauuggauugcagcaucgaucauacuagaguucuuccuuaugguuuuacucauuccugaaccugaccgucaacguacaccacaagacaaucaguuagcguauguuguaaucggauuauuauuuaugauauuaacaguagcagcaaaugagaugggcuugcuagaaacuaccaagaaagacuuagguaucggacacguagccgucgaaaaucaucaucacgcagcgaugcuugauguugaccuucacccagcaucggcauggacucuauacgcgguagcaacaacaauaauuacaccuaugaugagacacacaauugaaaauaccacagcaaacauaaguuuaacggcuaucgcaaaccaggcugcuauacuaaugggguuggacaaaggcuggccaauaaguaaaauggacauaggaguuccauuauuagcauuaggcugcuauucgcaaguuaauccccuaacucuaacagcugcgguauuaaugcuaguagcacauuacgcgauaauagguccaggguuacaagcaaaagcuacaagggaagcucaaaaacguacggcagcagguauaaugaaaaacccaacuguagauggcaucgucgcaauugauuuagacccuguaguuuacgaugcgaaauuugagaaacaacucgggcaaauaaugcuuuuaauccuauguaccagucaaauacuacucaugcgaacaacaugggcacuaugugaaucuauaacuuuagcaacgggaccacuaaccacccuuugggagggaucaccaggaaaauucuggaauacaacuauugcagucaguauggccaauauuuucagagggaguuauuuagcuggcgccggacuagccuuuucacuuaugaaaucacucggaggagggcgacgagggacuggagcgcagggggaaacauuaggagagaaauggaagcgacaacucaaucaauuaucaaaaagugaauuuaauacauauaaacguagugggauaauggaaguagaucgaucagaagcaaaagaaggacuuaagagaggagaaacuaccaaacaugccgugagcaggggaacugcaaaacuuagaugguuuguggaacguaaccucguuaaaccugaaggaaaaguaauagacuuagguugcgguagaggcggcuggucauacuacugugcugggcuuaagaagguuaccgaaguuaaaggauauacaaagggaggucccggacaugaagaaccuauuccaauggccacuuacggauggaacuuaguuaaacuacacuccgggaaggaugucuuuuucauaccaccugaaaaaugugacacucuauuaugcgacaucggcgaaucuucaccaaacccgacuauagaagagggccguacauugagaguguugaaaaugguggaacccugguuacgugggaaucaauuuuguauuaaaauauuaaaucccuauaugccuucaguuguggagacacuagaacaaaugcagcgcaaacacggagggauguugguacggaacccauugucaagaaacagcacacacgaaauguacugggucucauguggaacaggcaauauaguaucagcggugaauaugacuucucgaauguuacucaacagauuuaccauggcccaucggaaaccaacuuaugagcgagauguggauuuaggggcgggaacaagacaugucgcaguagaaccugaaguagcaaaucuggauauaauuggacaaagaaucgagaauauuaaacaugaacauaaaucgaccuggcauuacgacgaagauaauccauauaagacaugggcuuaucaugggucauaugaaguaaaaccaagcggcagugcaucaucuaugguaaauggcguggugaaacuacuaaccaaaccaugggacgucauaccuaugguaacccaaauagcaaugacagacacgacgcccuucggccagcagagagucuucaaagagaaaguagacacgcgaacgccaaaagcuaaacgugguacggcgcaaaucauggaagucacagcgaaguggcucugggguuuucuaagccgaaacaagaaaccaaggauauguacucgggaagaguucacgagaaagguaagaagcaaugccgcaauaggugcuguguucguagacgaaaaucaauggaacagcgcaaaagaggcuguggaggaugaaagauuuugggauuuggugcaccgagagcgagaacuccauaaacaaggaaaaugugccacaugcgucuauaacaugaugggaaaaagggagaagaaauugggagaguucggaaaagccaagggaagccgagccaucugguacaugugguuaggcgcccguuucuuagaguucgaagccuugggguucaugaacgaggaucauugguuuagcagagaaaauucauuaaguggaguggagggagagggucuacacaaacugggcuacauauuacgugauauaaguaagauaccuggcggaaauauguacgcagaugacacggcugguugggauacucguauaacugaagaugacuuacagaacgaagccaggauaaccgacaucauggagcccgaacaugcacuauuagccaagucgauauuuaaacuaacauaucagaacaaagugguaaggguucaaagacccgccaaaaauggaaccguaauggacguaauuucccgacgggaccaaagaggaucgggccaaguuggcacauauggcuuaaauacauucacaaauauggaagcacaauuaauaagacaaauggaaagcgaagggauauucagcccgagugaauuagaaacaccuaaccuagcggaacggguucuugacugguuggaaaaauauggaguagaaaggcucaaacggauggcaauaucaggagacgauuguguugucaaaccuauagacgaucgcuuugcuacagcacugaccgcuuuaaacgauaugggaaaaguaaggaaggauauaccacagugggaaccuaguaaaggauggaaugauuggcaacaaguacccuuuuguucucaccauuuccaucaauuaauaaugaaggauggacgugaaauaguaguuccaugccggaaccaagaugaacuugugggacgggcaaggguuucacaaggugcaggguggucacuacgugaaacggcuugucuuggaaaaaguuaugcacaaauguggcaauuaauguacuuucauagacgggauuugagauuggccgcgaacgcgauaugcucagcgguuccaguagauuggauacccacuucgagaacaacauggaguauucacgcacaucaucaauggaugaccacagaagacaugcuaaguguuuggaauagagucuggaucgaagaaaaucccuggauggaggacaaaacgcacauaucaagcuggggagacgugcccuacuuaggcaagagagaagaucaaugguguggaagucuaauaggucuuacagccagggcaacaugggcaacuaauauacaaguagcgauaaaucaaguacgucggcuaauagggaacgaaaauuaucuagacuacaugacauccaugaagagauuuaaaaacgaaucagaccccgagggugcucugugguag

SEQ ID NO: 21816 - RNA, 9879 nt, Artificial Sequence
  derived and/or modified CDS sequence (opt6) from DENV-1__JF937608__SS-prME
uccguuacuauguuauugauguuaaugcccacggcgcuugcauuucauuuaaccacucgugggggagaaccacauaugauagugucgaaacaagaaagagggaaaucacuccuuuuuaaaacuucagcaggggugaacaugugcacucuaauugcaauggaccuaggagaauugugugaagacacaaugacuuacaaaugccccaggauuacugaaaccgaaccagaugacguagauuguuggugcaaugcaacagauacauggguuacauaugguacaugcucccaaacuggcgagcaccgacgagauaaaagauccguagcauuagcgccacacgugggcuuaggucuagagacacguaccgaaacauggaugucuagcgaaggugcauggaaacaaauacaaaaaguagaaaccugggcacugcgucaccccggauucacgguaauugcacucuuucuagcacacgcuaucggcacgucuaucacucaaaaagggauaauuuuuauucuauugaugcuuguuacgccgucgauggcuaugcgcugugucggaauagguucuagggacuucgucgaggguuuaucuggcgcaacauggguagauguaguucuagaacaugggaguugugucacaaccauggcgaaagacaaacccacacuagauaucgaacuucuuaaaacugaaguuacuaaucccgcaauccuaaggaaacugugcauagaagcaaaaauaaguaauaccacuacggauucccguugcccaacucaaggcgaagcaacgcuuguugaggagcaagaugcuaauuuugucuguagacggacuuucguggaucggggauggggcaauggauguggacuauucgguaaagguucucuaauaacaugugcuaaauucaaauguguaacuaaacuugaagggaaaauaguccaauaugaaaaccuuaaauauuccguaauuguaacaguacacacuggagaucagcaucaagucgguaaugagucaaccgaacacggaacuacagccacuauuaccccgcaagcgccaacgacugaaauacaauuaacagauuauggugcgcucacauuagauuguuccccaagaacuggcuuagacuucaaugaaaugguucuguugacaaugaaagaaaaaucaugguuaguucacaaacaaugguucuuggaucucccgcucccuuggacaucaggcgcaucgacgucucaagagaccuggaaccgucaagauuuacuggugacuuuuaaaacagcucaugccaagaaacaagaaguggucguguuagguucucaggaaggugcuaugcacaccgcacuaacuggugcuacagagauacagacaucagguacaacgacuauuuuugcaggccacuuaaaaugcaggcuuaaaauggacaaacuuacuuuaaaagguaugucauauguuauguguacaggaucuuuuaaauuggagaaggaagucgcagaaacacaacacggcacaguauugguacaaauuaaauaugagggcacagaugcuccuuguaagauuccuuuuagcacacaagaugaaaagggugucacccaaaauggacgucucauuacagccaauccuaucguaacagauaaagaaaagcccguaaauauagaagcagaaccaccauuuggagaaucuuauauugucauuggagcaggcgaaaaagcauuaaaauugaguugguuuaagaaagguaguucuauagggaaaauguuugaggcuacagcuagaggggcaagacggauggcaauacucggugauacugcuugggacuuugguaguaucggaggaguguuuacaagugugggcaaacucguacaccagauauuuggaacagcauaugguguacuauucucaggcgucucauggaccaugaaaauuggcaucgguguauuauugaccuggcuuggauuaaauuccagaucaacgagucuguccaugacauguauagccguagggcuaguaacacuauaucucggcguuaugguacaagcggacucggggugcgugauaaauuggaaaggacgagaacuaaaaugugguucuggcauuuuuguaacaaacgaaguccacaccuggacugagcaauacaaauuccaagcggauucuccaaagagacugagugcagcaauugggaaagcaugggaagaaggcgucugcggaauacgaagugcuacaagauuggagaauauuauguggaaacaaauuucgaacgaauuaaaucacauauuauuagaaaacgacaugaaguucaccguuguuguaggagacgucgcagguauccucgcccagggaaagaaaaugauacguccacagccgauggaguauaaguauuccuggaagucaugggguaaagcaaagauuaucggagcugauguucaaaauaccacauuuauaauagauggaccaaacacuccagaauguccagaugaccaaagagcauggaacaucugggaaguagaagacuacggauucgggauuuuuaccaccaauauauggcuaaagcugagggacaguuauacacagguuugugaccaucgguugaugucagcagcaauaaaagacaguaaagccguacacgccgacaugggcuacuggauagaaucagagaaaaaugagacauggaagcucgcuagagcaucuuucauagaagugaaaacauguaucuggccgaagucucacacuuuauggucaaauggcguacuggaaucugaaaugauuauaccgaaaauuuaugguggaccgauuucccagcauaacuaucgaccugguuacuucacacaaacagcaggacccuggcauuugggaaaguuggaacucgauuuugaucuaugugaaggaacgacaguaguuguagacgaacauugcgggaacaggggaccaagccuuaggacuacuacuguaacugggaagauaauacacgaaugguguuguagaaguugcacgcuaccaccauuacgauuucgaggagaagacggguguugguaugggauggaaauccguccaguuaaggaaaaagaagaaaaucucguuaaaagcaugguauccgcaggaucuggugaaguagacucauuuagucuaggccuacuauguauaagcauaaugauagaggaaguuaugaggaguagauggagcagaaaaaugcuaaugacagggacauuagcugucuuuuuauuacuaauaaugggacagcuuacauggaaugaucugauaagacuuuguauuaugguaggggccaacgcaagugauagaaugggcaugggaaccaccuaucuggcgcuuauggcuacauuuaaaaugagaccaauguuugccgugggacugcucuuucgaaggcuaaccucuagggagguauugcuauuaacaauaggauuaucacuuguagcgucaguugaguuaccaaacaguuuagaagaauugggagauggauuagcaauggguauaaugauauuaaaauugcuaacugauuuucaaagccaucagcuaugggcaacccugcuaucucuaacuuuuauaaaaacuacauuuuccuuacauuacgcauggaagaccauggcaaugguguuaagcauugugucauuauuuccauuaugcuuaagcacuacaagucaaaagaccacuugguugccuguucuacuugggagucugggaugcaaaccccuuacgauguuccucaucgcagagaauaaaauuugggguagaagauccuggccgcugaacgaaggcauaauggcagugggaauuguaucuaucuuauuaucaucccugcuaaagaaugacguaccguuagccgguccuuuaauagccggagggaugcuaauugccuguuaugucauaucgggaaguucagcagaccuaaguuuagaaaaagcagcugaaguauccugggaagaggaagccgaacauaguggagcaagccauaauaucuuaguggaaguacaagacgacgggacaaugaaaauuaaagaugaagaaagagaugauacauuaacaauccuacuaaaagcaacauuauuagcuguaucaggaguauauccuuuauccauaccagcaaccuuauuugugugguauuuuuggcagaaaaagaaacaacgcucaggugugcuaugggacacgccaagcccaccugagguggaaagggcgguucuagaugacggaauauacaggauaaugcaaagaggacuguugggccgcucucaagucggagugggugucuuucaagaaaacguuuuccauacaauguggcauguuacucguggagcaguacuuauguaucaagguaagagauuagaaccgucgugggcaucggucaagaaagaucuaauuucauaugggggcggauggagacuacaagguucuuggaacaccggagaagaaguacaaguaauagcuguagagcccggcaaaaacccuaaaaauguacaaacaacaccagggacuuuuaaaacuccagaaggugaaguuggcgccauagcauuagauuucaagccaggcacgucuggaaguccuauaguaaaucgugaaggaaagauagugggacucuacgggaauggcguagugacaacuagcggcacguacgugagugcaauagcacaggcuaaagccucacaagaggggccuuugccugaaauugaagacgagguauuccgcaagagaaaucuaacaauuauggacuugcacccaggaagcggcaaaacgaggcguuaucuacccgcgauuguaagggaagcuauaaagagaaagcuacgaaccuugauccuugcaccaacaaggguaguagcauccgaaauggcggaagcacuuaagggcaugccaauaagauaccaaaccacugcaguuaaaucagaacacacuggaaaggaaauuguagauuuaaugugucaugcaacuuuuacuaugcgccuacuaaguccaguccgaguaccuaauuauaacaugaucauuauggacgaggcacauuuuacugacccaagcaguauagcugcaagaggcuacauaucgacaagggucggaaugggcgaagcggcagcaauauuuaugaccgcuacaccuccaggaucgguagaagccuuuccacagucaaaugcagugauacaagacgaagaacgcgacauuccugaacgcagcuggaauaguggcuaugaauggauaacagacuucccaggaaaaacgguaugguucgugccuucaauaaaaucaggaaacgauaucgcuaauugucuccguaaaaaugggaagaggguaauccagcuuucuagaaaaaccuuugauacggaauaccagaaaacuaaaaauaaugacugggauuauguagucacuacagauauuagcgaaaugggggcuaauuuuagagcggauagaguaaucgacccaaggagaugucuaaaaccuguaauucuaaaagacggcccagaaagaguaaucuuagcagguccuaugccuguuaccguagccucagcugcgcaaaggagaggacgaauuggacgcaaucauaacaaagagggugaucaauauauauacaugggucaaccccuuaauaaugacgaagaccacgcacauuggacugaagcaaaaaugcucuuggacaacauuaacacaccggaagguauaauaccagcacuguucgaaccggaacgagaaaaaucugcagcgauagacggagaauauagacuuagaggagaggccagaaaaacauuugucgaacugaugaggagaggggauuuaccaguauggcuuagcuauaaaguggcgagugaggguuuucaguacucugauagacgcuggugcuuugauggggaacguaacaaucaaguauuggaagaaaauauggauguugaaaucuggacgaaagaaggggaaagaaagaaacucagaccaagaugguuagaugcuaggaccuauucugacccauuggcacugagagaauuuaaagaguucgcagccggucggcgaucaguguccggcgaucucauacucgaaauagguaaguugccacaacaccuaacacaaagggcccaaaaugcacuugacaauuuaguaauguuacauaauucugaacaagggggucgggcauauagacaugcaauggaagaacuaccugauacaauugagacacugauguuacuggcacucaucgcaguacuuacuggaggcguaaccuuguucuuuuuaagugguagaggauuaggaaaaacaaguauuggauugcuaugcguaauggccucaucuguucucuuguggauggcauccgucgaaccacacuggauugcagccucuauaauacucgaguucuucuuaaugguauuguugauccccgagcccgaucggcaaagaacgccgcaagacaaucaacucgcuuacgucgucauaggauuauuauuuaugauucuaacaguugccgcaaaugaaauggggcuuuuggaaacuacaaagaaggaucuugguauaggacauguagcuguagggaaucaucaucacgcagcuauguuggaugucgaucuucacccagcgucugcauggacguuauaugcgguugcgacgacgauaauuacacccaugaugcgucacacaauagaaaacaccacagcgaacauuagcuugacugcaauagcuaaucaagcagcuaucuuaaugggccuugauaaaggauggccaauaagcaagauggacauugggguuccacuuuuagcauuaggcugcuacucccaaguaaauccgcucacuuuaaccgcggcaguuuuaauguugguugcacauuacgcaauuauagguccagguuuacaagcaaaagcgacaagggaggcucagaaaaggaccgcggccggaauuaugaaaaaucccaccguugaugguauaguagccauugaucuggacccaguaguauaugacgcaaaguucgagaaacaauuagggcagauaauguuauugauucuuugcaccucacaaauauuauuaaugagaacaacuugggcgcucugugaaucuauaacauuggcaacgggaccacucacaacgcuuugggagggauccccaggaaaauuuuggaacaccacaauugccguaucaauggcaaacauuuuucgcggaaguuaccucgcgggugcuggucuagcauuuucgcucaugaaaucacucgguggagggaggcgggggacaggcgcucagggggaaacacugggugaaaaauggaaacggcaguuaaaucaauuguccaagucugaauuuaacacuuauaaaagaagugggauuauggaagucgauagaucagaagcgaaagaaggacucaagagaggcgaaacaacgaaacaugcgguaaguagaggcacagcaaaacuaagaugguucguugagagaaauuuagucaagcccgaaggaaaagugauagacuugggauguggacgaggcggaugguccuauuauugugcaggacuaaagaaaguaacugaggucaaggguuacaccaaaggggguccgggucaugaagaaccgauacccauggcaacauacggauggaauuuagucaaacuucacucaggaaaggauguguucuuuauaccucccgaaaaaugugauaccuuauuaugugacauaggagaaagcucgccgaauccaacuaucgaggaagggagaacacuacgcguucugaaaauggucgaaccuuggcugagagguaaccaauucugcaucaaaauacucaaucccuauaugcccucagucguagaaacccuagaacaaaugcaacgaaaacacgguggcaugcuuguaagaaauccuuuaagucguaauucuacccaugagauguacuggguuucauguggaacaggaaacauaguuagcgcugucaauaugacgagucgcauguuacucaauagauucacgauggcccaccgaaaaccuacuuaugaaagggaugucgaucuuggcgcggggacaagacauguagcgguggagcccgagguggccaauuuagauauaauaggucaacgaauagaaaacauaaaacaugaacacaaaucuacauggcauuaugacgaagacaauccuuacaaaacgugggccuaucaugggucuuaugaaguaaaaccguccggauccgcaucaagcauggucaaugguguaguuaaacuauuaaccaaaccuugggauguaauuccuaugguaacucaaauagccaugacggauacaacaccauuugggcaacaacgaguuuucaaagaaaaaguugacacccguacuccaaaagcuaaacggggaacagcucaaauaauggaaguaacagcuaaauggcuaugggguuuccuuucacgaaacaagaaacccagaauaugcacccgugaagaguucacgaggaaaguuaggaguaaugcugcuauaggagcuguauuuguggacgaaaaccaauggaauagcgcuaaagaagcuguagaggacgagagguucugggacuuaguacauagagaaagagaacuccauaaacagggaaaaugcgcuacuugugucuacaauaugaugggaaagagggaaaagaaacugggggaguucgggaaagcuaaaggaagccgugccauuugguacaugugguuaggggcaagguucuuagaguuugaggcuuuaggauuuaugaaugaagaccacugguucucgagagaaaauagcuuaucggggguagaaggagaggguuugcauaaacugggauauauccucagggauauuucgaagauuccuggagggaauauguacgcagacgauacugcagggugggauacuaggauaacagaagacgaucuucagaaugaagcaagaauaacagauauaauggagccagaacaugccuuacuugccaaguccaucuucaaacuaacauaucaaaauaaagugguucgggugcaaaggccggccaaaaauggaacaguuauggauguaauuagucgaagggaucaaagagguagcggacaaguugguacauacggucuaaauaccuuuacaaauauggaggcacaauuaauccgccagauggaaucagaagggauauuuaguccguccgagcuagaaacccccaaccuugcugagagaguacuagauugguuagagaaauacggaguagaacgucuaaaacggauggcaauaucgggugacgacugcguggucaaacccaucgacgacagauucgccacugcguuaacagcacuaaaugauaugggaaagguuaggaaagacauuccucaaugggaaccaagcaaaggguggaacgacuggcagcaaguaccguuuuguagucaccacuuucaccaacuaauuaugaaagaugggagagagauuguaguacccuguagaaaccaagaugaacucguagguagggcucggguaagucaaggagcugguuggagcuuacgagaaacagccugccuaggaaagagcuacgcacaaauguggcagcugauguauuuucauaggcgugaccuaaggcucgccgcuaacgccaucugcuccgcagugccaguggacuggauuccaacaucuagaaccacaugguccauacacgcacaucaccaguggaugacgacugaagauaugcuaucgguguggaaucgaguguggauugaagaaaacccauggauggaagauaaaacucauauaagcuccuggggcgauguaccuuaucuggguaaaagagaagaucaauggugcggaagccuaauaggacugacagcucgagccacaugggcuacaaauauacaaguugcaauaaaccaaguaaggaggcuaauugguaaugaaaauuauuuagacuacaugacaaguaugaaaagguuuaaaaaugaaagcgauccagaaggugcuuuaugguga

SEQ ID NO: 21817 - RNA, 9879 nt, Artificial Sequence
  derived and/or modified CDS sequence (opt6) from DENV-1__GU131739__SS-prME
aguguaacaauguuacucauguuaaugccaaccgcauuagcauuccaccuaacaacgagaggaggagaaccacauaugauuguuuccaaacaagaaagaggaaaaucuuuacuauucaaaacaucagcaggagucaauauguguacccuaauagcgauggacuuaggagaauugugugaagacacaaugaccuauaaauguccgagaauuacagaaacugaaccggaugacguggacugcugguguaaugcaacagacacguggguaacuuacgguacaugcucacaaacuggugaacaucgaagagauaaaagauccguagcucucgcaccgcauguaggacuaggauuagaaacccgaaccgagacauggaugucgucagaaggggcguggaaacagauucaaagagucgaaacaugggcguuaagacacccaggcuuuacgguuauugcuuuauuuuuagcucacgcgauaggaacaaguauuacacaaaaagggauaauuuucauauuacuaaugcuaguaaccccuaguauggcaaugcguuguguggguauaggaucacgcgacuuuguagagggacuaucgggugcaacauggguagacgugguauuggaacacgggucgugcguuacaacaauggcuaaagacaaaccaacauuagacauugaacuucugaaaacugaaguaacaaaucccgccguuuuacguaaacucuguauagaagcuaaaauaagcaauacuacuacagacaguagauguccaacucaaggggaagcgacguugguagaagaacaagacgcaaauuucguaugucgcagaaccuucguagaucgcggauggggcaauggcugcgggcuuuucgggaaagggagucuaauaacgugugccaaauuuaaaugcguuacgaaauuagaagguaaaauuguacaauacgaaaaucuuaaauauagcguaauagucacuguacauacuggagaccaacaucaaguagguaaugaaucaacggagcacgggacaacugcuacuauaacaccacaagcuccaacuacggaaauacagcugacagauuauggugcccucacacuagacugcagucccaggacuggacucgauuuuaacgagaugguccuucucacuaugaaagaaaaaucaugguuagugcauaaacaaugguuucuggacuuaccgcuuccuuggacgaguggggccuccaccucacaggagacguggaauagacaagauuuauuagugacauucaaaacugcacaugccaagaaacaagaaguugucgucuuagguucccaagaaggagcuaugcacaccgccuuaacaggagcaacugagauacaaacgucugggaccacaaccaucuucgcaggucauuuaaaaugucgucuaaaaauggauaaauuaacuuuaaaaggaaugucguacgucauguguacagguaguuuuaaauuagagaaagaacuugcugaaacacaacacggaacugugcucguacaaauuaaauacgaggguaccgacgcaccguguaagauuccguuuuccacacaagaugagaaaggggugacacaaaauggccguuuaauaacagccaacccaauagugacggauaaggaaaagccugucaauauugaagcugaaccaccuuuuggugaaucuuacauuguaauuggugccggugaaaaagcacuaaaauugaguugguuuaaaaagggcucuagcauaggaaaaauguuugaagccacugcuagaggugcgagacguauggccauuuugggcgacacggcaugggauuuuggaucgauaggaggaguguuuacaucaguugggaaacuuguucaccagauauucgggacggcguaugggguacuauuuucaggaguuagcuggaccaugaagaucgguauaggaguuuuacuaaccuggcucggucuuaacaguagaucgacaagccuaucaaugacauguaucgccguuggucucguaacccuauaucugggagucaugguacaggcugacucgggaugcguaauuaacuggaaagguagggaguugaaauguggaucaggaauauuuguaacuaacgagguacauaccuggacagaacaauauaaguuucaggcagauuccccgaaacggcuuagugcugccaucggaaaggcuugggaagaaggugugugcggaaucagaagugcuacuagacucgaaaacauaauguggaaacaaauuucaaacgaacuuaaccacauacuucuagaaaaugacaugaaauuuacagugguugucggugauguagcggguaucuuagcucaagguaagaaaaugauuagaccacaaccaauggaauacaaguauucguggaaaucguggggcaaggcuaagauaaucggggcagacguacaaaacacuaccuucauuaucgauggccccaauacacccgaauguccagacgaucagagggccuggaauauaugggaaguggaggacuaugguuucgggauauuuacuacuaauauauggcuaaaauuaagagauagcuauacacaaguuugcgaccaccgacuuauguccgcugcaauaaaggauucuaaagcagugcaugccgauauggguuacuggaucgagucggaaaagaacgaaacauggaaacuagcgagagcaucuuuuauugaaguuaaaacaugcauauggccaaaaucucacacucucuggagcaauggaguacuagaaagugaaaugauuauuccuaaaauauauggcggaccuauuucacaacacaacuaccguccagguuauuuuacccagacagcuggcccguggcauuuaggcaaauuggaguuagacuuugacuuaugugaaggaacgacagugguuguagacgaacacuguggaaaucgcgguccaucgcucaggacuacaacggucacaggaaaaauaauucacgaauggugcugcagaagcuguacccuuccuccuuugagauuucgaggagaagauggcugcugguauggcauggagauccguccuguaaaagagaaagaggaaaaucuugugaaaucaaugguaagugccggcaguggagaggucgacucauucucucugggauugcuaugcaucucuaucaugauagaggaaguaaugcgaucaagauggagccgaaaaaugcuuaugacagguacucuugcugucuucuuucuacuaauuaugggacagcucacauggaacgaucuuaucagacugugcauuaugguaggagcuaaugcaucagaucggauggguaugggaacuaccuaucuagcacuuauggcuacauucaaaaugcgaccaauguuugcggucggauuacuauuccgccggcuaacaucaagagagguacuauuacuaacuaucgggcuaucauugguggcaucggucgaacuuccuaauucguuagaggaguuaggagauggcuuagcaaugggcauaaugauauuaaaacuacucacagauuuucaaagucaccaauuaugggcaacacuuuuaucacuaaccuucauaaaaacaacuuuuaguuuacauuaugcauggaaaacaauggcgauggucuuaaguaucgucucauuauuuccguuguguuuaucaacuacuucgcagaaaacuacuugguuaccaguacuacucgguucauugggaugcaaaccauugacgauguuuuuaauagcagagaauaaaaucuggggaaggcgcagcuggccgcucaaugaaggcauaauggcaguagguauagugucaauucuucuuuccucguuacuaaagaacgauguaccucuagcuggaccauugauagccggaggaauguugauugcauguuaugugauaagugggucaagugcugacuugagcuuagaaaaagccgcagaggugucuugggaagaagaggcagaacauagcggagcaucccauaauauccuaguugaaguccaagacgauggaacgaugaaaauuaaagacgaggaacgugaugauacgccuacaauacugcucaaagcaacccugcuagcaguuaguggcguauacccucuaagcauacccgccacauuguuuguuugguauuuuuggcagaagaagaaacaacguucugggguuuugugggauacuccuucucccccagagguugaacgcgcgguacuugaugacggaauuuacagaaucaugcagcguggccucuuaggaagaucucaaguaggaguuggugucuuccaagaaaauguuuuucauacgauguggcacgucacaagaggagcaguacucauguaucaggggaaacgauuagagccaaguugggccucugucaagaaagauuuaauauccuauggggguggauggagauugcagggaucauggaauacgggagaggaggugcaggucauagcaguagagccgggcaaaaauccgaaaaaugugcaaacagcuccaggaacuuuuaaaacuccugagggagagguuggcgcaaucgcgcuggacuucaaaccaggaacaucagggaguccaauaguaaaccgagaaggaaaaauaguaggguuauauggaaauggggucgucacaacuucgggaacauaugucagugcgauugcccaagcaaaggcuucgcaagaaggaccguuaccugaaauugaagaugaaguuuuuagaaagcggaaucuaacuauuauggauuuacauccagguucggguaagacaagaagauauuuacccgcaauagugagagaagcuauuaaaaggaagcuacguacguugauuuuagccccuacacguguaguugcaucagaaauggcagaggcuuugaaaggaaugccgauaagauaccagacaacagcuguaaaauccgaacauacugguaaggaaauaguagauuuaaugugccaugcaacuuuuaccaugagguuacugagccccguucggguaccuaauuacaauaugauaauaauggacgaagcucacuuuacugauccuucuucaaucgccgcacgcggcuacauuucaaccaggguugggaugggcgaagcagcugccaucuucaugacagcgacaccaccagguucaguagaggcuuuuccgcagaguaaugccguuauucaagacgaagaaagagauauuccugaaagaaguuggaauagugguuacgaauggauuacagacuuuccaggaaagacuguuugguuuguuccgagcaucaagagugggaaugauauugcuaauugccucaggaaaaaugggaaacgcgugauccaauuaucuagaaaaaccuuugauacggaauaccaaaagaccaaaaauaaugauugggauuacguaguaaccacggauauaagcgaaaugggagcaaauuucagagcugacagaguaauagacccacgaagaugucucaagccaguuauccucaaagaugguccagaaagaguaauauuggccggucccaugccagucacagucgcaagcgcagcacaacgaagaggaaggauagggcgaaaucauaauaaggaaggagaucaauauauuuauaugggacaaccacuaaauaacgaugaagaucaugcacacuggacugaagcaaaaaugcuccuagauaacauaaauacuccagaaggcaucauuccagcuuuauuugagcccgaacgggagaaaucugcugcuaucgauggagaauaccgauuaagaggagaagcuagaaaaacguucguggagcugaugagaaggggugauuugccgguauggcugaguuauaagguagcaucugaagguuuucaauauucugacagaagauggugcuucgauggagaacgaaacaaccaaguguuagaagaaaauauggacguugagauauggacaaaggaaggagaaaggaagaaacuccguccaagguggcucgaugccagaacuuauucggacccacuagcuuuaagggaguucaaagaauuugcagcuggacgaagaucgguuuccggggauuugaucuuagaaaucgguaaauuaccacaacaccuaacacaacgugcacagaacgcguuagauaacuuaguuauguugcauaacucagagcaaggaggacgugcguaccgccacgcaauggaagaacucccugauacaauagaaacucuuauguuauuagcauuaauugcuguguugacaggcggggucacacuauuuuucuuaaguggccgcggguuaggaaagacaaguauaggauugcuaugcguaauggcuucuaguguacuauuauggauggcaucaguagaaccacauuggauagcagcgaguauaauucucgaauuuuucuugaugguucuccuaauaccugaaccggaucgccagaggacgccacaagacaaucaauuagcuuaugugguaaucggacucuuguuuaugauauuaacaguagcggcaaaugaaauggguuuguuagaaaccacuaaaaaggaccuaggaauaggacacguggccgucgaaaaccaucaccaugcagcgauguuagauguugaucugcaccccgcaagugcauggacucuuuaugcaguagccacuacuauaauuacaccaaugaugcgucauacuauagaaaacacaacugcaaauauuucauugacagccaucgcaaaucaggcagcaauauuaaugggcuuagauaaaggauggccgaucaguaagauggacaucggagugccauuguuggcguugggcuguuacagucaaguaaaucccuuaaccuugacagccgcaguacuuaugcuaguagcucacuaugcuaucaucggaccagguuuacaagccaaagcuacaagagaagcacaaaagaggacggcagcggggauuaugaagaauccgaccguugauggaaucgucgcaauugauuuagacccaguaguguacgacgcuaaguuugaaaaacagcuggggcaaauaauguugcugauacugugcacuucgcaaauucuacuaaugagaacuacuugggcucuuugcgaaucaaucacccuagcaacuggaccccucacaacgcugugggagggaucuccgggaaaauucuggaauaccacuaucgccguaucuauggccaacauauuuagaggaucuuacuuagccggugcgggauuagcguucucgcuuaugaaaagccuuggcggaggcagacgugguacgggagcucaaggugagacauugggggaaaaauggaaacgccaacuuaaccagcuaucgaaaagugaguucaacacuuacaaaagaucagguauaauggaaguagacaggucagaggccaaagaaggacuaaaaaggggugagacuacaaaacacgccguuagcagagggacugccaaacuccgaugguucgucgagaggaaucuaguaaaaccugaagguaaaguaauagacuuaggguguggaagagguggauggagcuauuauugcgcuggccuaaagaaagucacugagguaaaaggauacacuaaaggaggacccggacacgaagaaccgauaccuauggcaacauacggguggaaccuaguuaaacuacacucuggcaaggacgucuucuucaucccacccgaaaaaugugacacauuacuaugcgacauaggagaaucaucaccaaaucccacaauagaagagggaagaacccuacgagugcugaaaaugguagaaccauggcugcgaggcaaucaauuuuguauuaaaauuuuaaaccccuauaugcccucaguaguugaaacauuggaacagaugcaacggaaacacggaggaauguuaguaaggaacccuuuauccagaaacucuacacacgaaauguauuggguuaguuguggaacaggcaauaucgucucagcuguuaacaugacuucaagaauguugcuaaauagauuuacaauggcccaucgaaaaccuacauacgaacgagacguagaucuaggugcgggaacuaggcacguagcuguggaaccugaagucgcuaacuuggauauaauaggacaacguauugaaaacauuaaacaugaacauaaaucaacguggcauuacgaugaagacaaucccuauaaaacaugggcauaccacggaucuuacgaaguaaaaccaucagggucagcuucuucuaugguuaaugggguggugaaauuacuaacaaaaccuugggauguuaucccuauggugacgcagauagcaaugacagauacuacaccauuuggccagcaaagaguauuuaaggaaaaaguagauacacggacaccgaaagcgaaaagggguacagcucaaauaauggagguaacagcuaaguggcucuggggauucuuauccagaaacaagaaaccgagaauuuguacaagggaagaauuuacgagaaagguaagaucuaacgccgcaaucggcgcuguauuuguagaugagaaucaguggaacucagcgaaggaagcagucgaggacgagagauuuugggaccuugugcaucgugagagagaguuacauaaacaaggaaagugugcuacaugcguauacaacaugaugggaaaaagagagaagaaacugggcgaauuuggaaaggcaaaagguucuagggcaaucugguacaugugguugggagcacgauuucuugaauuugaagcacugggcuucaugaacgaagaccauugguuuagcagagaaaacucauuaucaggagucgaaggagaagggcuacacaaauuaggcuauauucuuagagacauuuccaagauaccugggggcaauauguacgcagacgacacagcaggcugggacacucgaauaacggaagaugauuuacaaaaugaagcaagaauuacagacauuauggaaccugaacacgccuuguuagccaaaagcaucuucaaauuaaccuaucaaaauaagguagugagaguacaaagacccgccaaaaaugguacgguuauggauguuauauccagacgcgaucaacgcgguucaggacagguaggaaccuauggauuaaauaccuuuaccaauauggaggcccaacugauaagacaaauggaaucagaaggcaucuuuucucccucugaacuagaaacuccaaaucuggcagagcgaguacuagauugguuagaaaaauaugguguugaacgcuugaaacgaauggcuauauccggugacgauuguguaguaaagccgauagaugacagauuugcaacagcucuaacugcacucaaugacaugggcaaaguaagaaaagacauuccgcaaugggaacccuccaagggauggaaugauuggcaacaggugccuuucuguucccaucauuuucaccaauuaauaaugaaagacggucgugaaauaguaguaccuuguagaaaucaggacgaguuaguaggacgugcacgagugagucaaggcgcaggauggucacuucgggaaaccgcuugucuaggcaaaaguuaugcccagauguggcaauuaauguauuuucaccgacgugauuugcguuuagcagcuaacgcgauaugcucagcaguaccaguagauuggauacccacgucaagaacaacuuggucgauccacgcucaucaucaauggaugacaacggaagauaugcuuagcgucuggaacaggguauggauagaggaaaauccguggauggaagauaaaacacacaucaguuccuggggugacgucccauaccuagguaaacgugaagaucaauggugcggcucacugauuggguugaccgcaagggccaccugggcaacuaacauucaaguagcaauuaaucaagugagacguuugaucggaaaugaaaauuauuuagauuacaugacgucaaugaaacgcuuuaaaaaugaaagcgauccggagggagccuuaugguga

SEQ ID NO: 21818 - RNA, 9879 nt, Artificial Sequence
  derived and/or modified CDS sequence (opt6) from DENV-1__GU131740__SS-prME
aguguaacuauguuguuaaugcugaugccuacggcacuagcauuucaccuaacuacacgugggggugaaccacacaugauaguuuccaaacaagaaagggggaaaaguuugcuuuucaaaacuucugcaggaguuaauauguguacacucauugcaauggacuuaggagaauuuugcgaagauacaaugaccuacaaauguccaagaauuaccgaagcggaaccugaugacguagauuguugguguaaugcaacagauacauggguaacauacggaacuuguagucagacaggagaacacagacgagacaaaaggucaguugccuuagccccgcacguuggauuaggauuagaaacaagaacggaaaccuggauguccucagaaggugcauggaaacaaauccaaagggucgaaacaugggcucuacgacaucccggguucacugucauugcacuauucuuagcacaugccauuggaaccaguauuacacaaaaaggaauaauauucauauuacuaaugcucgugaccccuagcauggcuaugcgcuguguagguauuggaagucgcgacuucguugaaggauuaucaggugcaacuuggguggacguuguuuuagaacacggauccuguguaaccacgauggccaaagauaaaccaacccuagauauugaauuacuuaaaaccgaagugacaaauccagcggugcuuaggaaauuaugcaucgaagcaaagauuaguaacaccacaacagauucaagguguccaacacaaggagaagcaacucuaguugaagaacaagaugccaacuucguaugccguagaacuuuugucgaucggggaugggguaacgguugcggccuauuuggaaaagggucucuaauaacuugcgcaaaauucaaaugcgucacgaaauuggaagguaagaccgugcaguaugaaaacuuaaaauauagcgugaucgugacuguccauacgggagaccagcaucaaguaggaaacgaaagcaccgaacacggaacuacugcaacaaucacaccacaggccccaucaacugaaauucaacuaaccgacuauggagcccuuacccuggauugcucgccaaggacgggucuagauuuuaacgaaaugguucugcucaccaugaaagagaaaagcugguuaguucauaaacaaugguuuuuggaucucccuuuaccuuggaccuccggggcaaguacaagucaagaaacguggaaccgaaaggaucuccuaguuacuuuuaaaacagcacaugccaagaaacaagaaguaguaguauuaggaagccaggaaggagcgaugcauacugcacucacgggagcaacggaaauacaaacaagcgguacgacaacaauauucgcagggcaucuuaaaugccgacuaaaaauggauaaguuaacccugaaaggcaugagcuauguuauguguaccgggagcuuuaaacuugaaaaagagguugcagagacucagcauggaacaguccuuguacaaauuaaauacgaaggaacagacguuccaugcaaaauucccuucucaacgcaggaugagaagggaguaacgcaaaacggucgucuaauaacagcgaaccccauagucacugacaaagaaaaaccaguaaauaucgaagcagaaccuccauucggggaaaguuauauugucauaggggcuggcgaaaaagccuuaaagcuaucaugguucaagaaaggaucaucaaucggaaaaauguuugaagccacugcaagaggugccagacggauggcaauacuaggagauacugcaugggauuucggcagcauugguggaguauucaccucuguuggaaagcugguacaucagauauucggaacagcauauggcguuuuguuuagcggaguaaguuggacuaugaaaaucggcaucggaguauuguuaacauggcuaggauuaaauagucggaguacaaguuuauccaugacuuguaucgcggucggguuagugacguuguauuuaggugugaugguacaagcggacagcggaugcgucauaaacuggaaaggccgggaauuaaaauguggaagugggauauucguaacuaaugaaguacauacuuggaccgagcaauauaaguuccaagcugauuccccaaaacgcuuaucagccgcuauuggcaaagcgugggaagagggaguauguggaauccgaucugcgacuaggcuggagaacaucauguggaaacagauaagcaaugaauuaaaccauauauuauuggagaaugauaugaaguucacgguuguaguaggcgacguagcaggcauacuagcacaggggaagaaaaugauaagaccacaaccaauggaauacaaauacagcuggaaauccugggguaaagcuaaaauaauuggugcagauguacagaauacaacuuuuauaauugauggacccaauaccccagaauguccagacgaucaaagagccuggaauauaugggagguagaagauuacggauucgguaucuuuacuacuaauauauggcugaaacuaagagauucauauacucagguaugugaucauagauugaugucagcagcaauuaaggauucaaaagcgguucaugcugauaugggguacuggauagaauccgagaaaaaugaaacauggaaauuagcaagagcaucauuuauagaggucaaaacuuguauuuggccuaagucacauacgcuuuggucuaaugggguauuagaaucagaaaugaucauaccgaaaauauauggcgguccaauaucacaacacaauuauagaccuggauauuucacgcagacggcuggaccauggcaccuugggaaguuagaacuugacuucgauuuaugugaagggacaacugugguagucgaugaacauuguggcaauagagguccaagucugagaacaacuacaguaacagguaagauaauacacgaauggugcuguagaagcuguacuuugccuccgcuucgauuuaaaggcgaagaugggugcugguacggaauggagauuagaccaguaaaagaaaaggaagagaaucuagucaaaaguaugguuagugcggguagcggugaaguagauaguuuuagcuugggucuauuauguaucucaauuaugaucgaggaagucaugcguucucgauggucacgaaaaauguuaaugacagggacguuagcagucuuuuuccugcuuauaaugggacaauuaacauggaaugaccugauacgacuauguauaauggugggugcuaacgcaucugaccgcaugggaauggguacuacguaucucgcacucauggcaaccuucaaaaugaggccuauguuugcggugggucuuuuauuuagacgccuaacgagucgcgaagucuuacucuugacgaucgguuugucauuaguugcuucagucgaguuaccgaacagucuugaagaguuaggugacggauuagcaaugggcauaaugauucuaaaauuacuaacugauuuccagucacaccagcucugggcaacuuuacucagcuucacauuuauaaagaccacauuuaguuuacacuaugcguggaagacuauggcuaugguguugaguauaguuucauuauucccacuauguuuaagcaccacaucacagaaaacuacuugguuaccagugcuccuuggcagcuuaggcuguaaaccauuaacaauguuuuuaauagccgaaaauaagguauggggacggaaaucuuggccacuaaaugaagguauaauggcaguaggaauuguuucaauacuccuaaguucuuuacucaaaaacgauguaccucuugcaggaccacuaauagcaggcgguauguuaauagcuugcuaugucauaagcgggaguuccgcagaccuaucucuggaaaaagcugccgaaguaucaugggaagaggaagccgaacauaguggggcaucgcauaauauucuugucgaaguacaagacgacgggacaaugaaaauaaaagaugaagaacgagacgacacuuuaacaauauuacuuaaggccacauuauuggcaguuuccgggguauauccgcuguccauacccgcaacacucuucguaugguauuuuuggcaaaagaagaaacaacgaagcggcguguuaugggauaccccguccccuccugaggucgagcgagcagucuuggacgacgguaucuauagaaucaugcaaagaggccuccuagguagaagucaagugggaguagggguuuuucaagagaauguauuucauacaauguggcacgucacaagaggagcagugcuuauguaccaggggaaaagguuagaacccucaugggcaagugucaagaaagacuuaauuucauacgggggaggcuggagauuacaaggaucauggaauaccggagaagaaguacaggucaucgccguagaaccaggcaaaaaucccaaaaauguacaaacagcgccuggcaccuucaaaacgagcgagggggagguaggagcgaucgcucuugacuucaaaccaggaacuagcggguccccgaucguuaaccgagagggaaaaauaguaggauuguacggaaacgguguagugaccacgucaggaacauauguauccgccaucgcccaagcaaaagccagccaggaaggaccuuuacccgaaauagaagaugaaguguuccgaaaaagaaaucucacgauaauggacuuacauccugguagcggaaaaaccagaagauaccuuccagcgauagucagagaagccauaaaaagaaaguuacgaacguugauauuagccccuacaagaguaguagcauccgagauggcagaagcucuaaagggaaugccaauccgcuaucagacaaccgcgguaaaaagcgagcacacaggaaaagaaaucguagaccuuaugugccaugcuacuuucacuaugagacuuuuaucuccagugagagugccgaauuauaauaugauaauaauggaugaagcccauuuuacagacccaucauccauagcagcucgugguuauaucucaacgagaguggggaugggcgaggcugccgcgauauuuaugaccgccacgccaccgggaagcauggaagcguucccacaaucaaaugcggugauacaggacgaggaacgggacauaccugaaagaucguggaauaguggcuacgaguggauuacagacuuuccagggaagacaguaugguucguaccaaguauaaaauccggcaacgauauugcaaauugcuuaaggaagaacgguaaacguguaauccaauuaucaaggaaaacauucgauacugaauaucagaaaacgaagaauaaugauugggauuauguugucacgacagauauuagcgaaaugggugcgaacuucagagccgaucgaguaauugauccacggagaugccucaaaccggucauucuaaaagauggcccagagcggguaaucuuagcaggaccuaugccggucacuguggcgucggcggcacaacgucgggguaggauaggucggaaucauaacaaagaaggggaucaauauauuuacaugggccaaccuuuaaauaaugaugaagaucacgcucacuggacagaggcaaaaauguuacuugauaacauaaacaccccagaaggaauuauuccagcguuauuugaaccagagagggagaaaagcgcagcuauagacggcgaauaccgcuuacggggcgaagcaaggaagacauuuguagaauuaaugcguagaggggaccuaccagucuggcucaguuauaaaguagcuucggaggguuuccaauacuccgaccgaagguggugcuucgauggagagaggaauaaucagguucuagaagaaaacauggauguagaaauauggacgaaagagggggagagaaagaaacuaagaccuagguggcuagacgcuagaacauacucugacccccucgcacuacgcgaguuuaaagaguuugccgcgggcagacgaucgguaaguggggauuuaauacucgaaauaggcaaacuuccacagcaccugacacaacgagcucagaaugcccuagauaaucuugugaugcugcacaauucugagcaagggggcagagcguacagacacgcgauggaagaacuacccgacacuauagaaacauuaaugcuauuagcauuaauagcuguccuuacagguggaguaacccuauucuuucuaucggguagagguuugggaaaaacaucuaucggauuacuaugcguaauggccucuuccgucuuauuauggauggccucagucgaaccccauuggauagcagcgucaauaauacuggaguucuucuuaaugguacuguuaauuccagagccugaccgucagcggacaccacaagacaaccaacuggcauaugucgugauagguuuacuauucaugauacucacaguagcagcuaaugagauggguuuauuagaaacuacuaagaaagaccucgggauagggcacgcggcaguagagaaucaccaucaugcagcgauguuagacguugaucuacacccagcauccgcauggaccuuguaugcaguagcuacuacgauaauaacaccgaugaugcgacacacuauugaaaacacuacugccaauauuucccuaacugccauagcaaaccaggccgcuauuuugaugggacuugacaaaggguggccaauaagcaaaauggacauagguguuccauuacuugcacugggaugcuacucgcaagucaauccauuaacauuaacggccgcaguauugauguugguugcgcauuaugcaauaauaggaccaggguuacaagcgaaagcaacucgugaagcucaaaaacgaacagcggccgguaucaugaaaaacccaaccgucgacgguauuguggcgauagaccuagacccugucguuuaugaugcaaaauucgaaaagcaauuaggucaaauaaugcuacuuauucuuuguacaucgcagauacuucuaaugcguacuacuugggcgcucugcgaaagcauuacuuuggccacuggaccauuaacuacuuuaugggaagguagcccgggaaaauuuuggaauacuacuauagcagugagcauggcuaauauauuuagagguagcuaucuugcuggugcgggucuggcuuuuaguuuaaugaaaucacucggcggaggcagaaggggaacaggagcacaaggagaaaccuugggagagaaauggaaaagacaacuuaaucaauugagcaaaucagaguucaauacauacaaacguuccggaaucauggaaguagaccgaucagaagccaaagagggguugaaacguggagaaacuaccaaacaugcugugucaagaggcacagcaaaacuccgaugguuuguugaacguaaucuaguuaaacccgaagguaaagugauugacuuaggauguggaagaggcgguuggucauauuacugugcaggguuaaagaaagugacagaaguaaaaggguacacaaaagguggaccggggcaugaagaacccauaccaauggcaacuuacgguuggaauuugguuaaacugcacuccggaaaagacguauucuuuauucccccggaaaaaugugauacacucuuaugugauauaggcgagaguucuccaaauccaacuauagaggaaggcagaaccuuacgcguauugaagaugguagaaccgugguugagaggaaaccaauuuuguauuaaaauacucaauccauauaugccuucuguaguugaaacauuagagcaaaugcaaaggaagcauggcggcauguuaguccggaaucccuuaucuagaaauuccacccacgaaauguacuggguaaguugcggcacaggaaauauaguaagcgcagucaacaugacgucaagaaugcuacuuaaucgcuucaccauggcacacaggaaaccgacauacgaacgugauguagacuuaggagcagguacaagacauguugccguugaaccagaaguagcaaauuuagacauaaucggucagagaauagaaaauauaaagcaugaacacaaaucaacuuggcauuacgacgaggacaauccuuacaaaacuugggcguaucacggaucauaugaagucaaacccagugguagugcaucuucgaugguaaauggaguggucaaacuguuaacgaaaccaugggauguuauaccuaugguaacccagauagcgaugacugacacaacgccauucgggcagcaacggguuuucaaagagaagguugauacuagaaccccuaaggccaagagaggaacggcucaaauaauggagguaacagcaaaguggcucuggggguuucuuucaagaaacaaaaagccucgaauuugcacaagagaggaguuuacacguaaaguaaggucuaaugccgcaauaggcgcuguauucguagacgagaaucaauggaacucugcaaaagaagcaguugaggacgaacguuuuugggaucucguucaucgugagagggaacuccauaaacaggguaaaugcgccacauguguguacaacaugauggguaaaagagaaaagaaacuaggagaguucggaaaagcuaaagguucacgcgccauuugguauaugugguuaggugccagauucuuagaguucgaagcauuaggcuucaugaaugaggaccacugguucucacgggagaacucucuaagcggaguggagggagaaggauuacauaaacuaggguauauuuuacgagacaucucaaaaaucccgggagguaauauguacgccgaugacacugcuggaugggacaccaggauuacagaggaugauuuacaaaaugaagcaaaaauuacggacauaauggaaccggagcaugcucuauuagccaaauccaucuucaaauugacguaucagaauaagguuguaaggguacaaagaccagccaaaaaugggacaguaauggaugucauaagcagaagagaucaaagagguucuggucaaguagguacuuauggccuaaacacuuuuacgaauauggaagcucaauugauacggcaaauggaauccgaaggaaucuucucaccuucagaacuagaaacuccgaauuuagccggucggguuuuagacuggcuggaaaaacaugguguugaacgccuaaagcgaauggcaaucucaggagacgauugugucguaaagccaauagaugauagauucgcgacagcauuaacugcacucaaugacauggguaaaguaagaaaagacauuccccaaugggagccaucaaaaggauggaaugacuggcaacaagugccauuuugcucacaucacuuucaucaguuaauaaugaaagauggcagagaaaucguuguaccuugcagaaaucaagacgagcuagugggacgugcaagaguaagucagggagcaggauggucacuuagagaaacagccugucuggguaaaucauaugcacagauguggcaauuaauguauuuucacagaagagauuuaagacuugcugcuaaugcaaucugcagugccgucccaguugauugggugccuacaucaaggacaacuuggaguauacaugcacaucaucaauggaugaccacugaggacaugcuguccguauggaauagaguauggauagaggaaaacccauggauggaggacaaaacacauaucucaucguggggagacguuccguaucuagguaaacgagaggaucaaugguguggaucacuuauaggacuaacugccagagcuacaugggcuacuaauauccaaguugccauaaaccagguacgacgguuaauaggcaaugaaaauuaucuggauuauaugacgagcaugaaacgauucaagaacgaaucagaucccgaaggggcgcuuugguaa

SEQ ID NO: 21819 - RNA, 9879 nt, Artificial Sequence
  derived and/or modified CDS sequence (opt6) from DENV-1__GU131741__SS-prME
ucgguaacuaugcuucuaauguuaaugccaacggcccuagcauuucauuugacuacccguggaggugaaccacacaugauaguuucuaaacaagagagaggaaaaagucuauuauuuaaaaccagugcuggaguuaauauguguacucuaaucgcuauggaucuaggagaauuuugugaagauacaaugacguacaaauguccgagaauuacagaagcugaaccggaugacguagacuguugguguaaugcaacagauaccuggguuacuuacggaacaugcucacaaacuggggaacaucgcagggacaaacgauccguagcucuagcaccucauguaggauuaggguuagaaacgaggacagaaacauggaugaguagcgaaggugccuggaagcaaauucaaagaguugaaaccugggcauugcgacaucccggguuuacugugauugcacuguuuuuagcacacgcgauuggaacaucgaucacacaaaaaggcauaauuuuuauuuugcucauguuaguuacaccaagcauggcuaugagauguguaggaauaggcagcagagauuuuguagaaggucuguccggagccacguggguagaugugguuuuagagcacggcagcuguguuacaacgauggcgaaggacaagccaacacuagauauugaauuacucaaaacagaagugaccaauccugcaguucuaaggaaacuauguauugaagcuaaaauaucaaauaccacaacugauucgagauguccaacccaaggagaagcgacguugguggaagaacaagaugcgaauuuuguuuguaggcguacuuuugucgaucgaggauggggaaauggaugugggcuuuucggaaaagguucguuaauaacaugugccaaauuuaagugugugacuaaacuugaggguaaaauaguucaauaugaaaaucuaaaguacagcgugauugucacuguccauacuggagaccaacaucaaguaggaaacgaaucuacagaacacgguacaacagccaccauaacaccacaagcuccuaguacagaaauccaacucacggacuacggagccuuaaccuuggauuguucucccagaaccggccuagacuucaacgaaaugguccuacugacgaugaaggaaaaguccugguuaguacacaaacagugguuucuagauuuaccuuuaccauggacaaguggaguaaguacgucacaagaaacauggaauaggaaagaucuauuaguaacuuucaaaacagcucaugcuaagaaacaggaaguuguuguauuaggaagccaagaaggggcaaugcauacugcacuuacgggagccacagaaauccaaacaagcggaacuaccacaauuuucgcaggacaccuuaaaugucgccuaaagauggacaaacucacuuugaaaggaaugucauacguuaugugcaccgguagcuucaaguuagagaaagaagucgcugaaacccaacaugguacagugcugguucaaauuaaauaugaagguacagacgccccaugcaaaaucccuuuuuccacgcaagacgagaaaggcguuacacaaaauggaagauuaauaacagcaaacccgauaguaacagauaaagaaaagccaguuaacauugaagcagaaccacccuucggagagucguauaucgucaucggugcuggugaaaaggcuuugaaauuaagcugguucaagaaaggaucaaguauaggcaagauguuugaagccacagcucguggggcgcggagaauggccauacuaggugauacagcgugggacuucgggucaauaggaggaguguucacuucgguaggaaagcuaguucaccaaaucuuuggcacggcuuacggugugcuauuuucaggggugucuuggacaaugaaaauugguauaggaguauuacuuacauggcuagguuuaaauaguagaagcacaucauugucgaugacaugcaucgcugugggccugguaacguuguauuugggugugauggugcaggccgacucgggcugugucauaaauuggaaaggccgggagcucaagugugguuccggaaucuuuguuacaaaugaaguccauacauggaccgaacaauacaaguuccaggcagauucuccuaaacgucuuagugcugccauuggcaaagcaugggaagaaggaguuuguggaauacgaagugcuacaaggcuagagaacauaauguggaagcagauuucgaacgaguugaaucacauacuauuggaaaacgauaugaaauuuacgguagucguaggagacguagcaggcauacuggcacaaggcaagaaaaugauacguccucaaccaauggaguacaaauacucauggaaaucuuggggaaaagcaaaaauaauaggagcggaugugcaaaauacgaccuuuauaauagacggacccaacacuccagagugcccagaugaucaaagggcauggaacauuugggagguagaagauuauggauuugggaucuuuacuacuaacauaugguuaaagcuacgugacucauacacccagguaugugaucaucggcucaugagugcugccauaaaagacaguaaagcgguacacgccgacaugggauauuggauagagagcgagaagaacgagacuuggaaacuugcuagagcaucauuuauugaaguuaaaacgugcauuuggccgaaaucacauacuuuauggucaaaugggguauuagaaucugaaaugauaauuccuaaaaucuacggagggccaauuucccaacacaauuaccgacccggauacuuuacacaaacagcaggaccuuggcaucuggggaaacucgagcuagacuuugauuuaugugaagggacaacaguaguagucgaugaacauugcggaaaucgcggaccaaguuuaagaacaacgacgguuacagguaaaauaauucaugaaugguguuguaggucuugcacacugccgccauuacguuucaaaggggaggauggauguugguacggcauggaaauuagaccaguaaaagaaaaggaagaaaaccuaguuaagucaaugguuucagccggaaguggggagguugauagcuucucucugggacuccuauguauaucgauuaugauagaagaaguaaugcgaucccguuggucgagaaaaaugcuuaugacaggcacacucgcaguauucuuucuccuaauaaugggacaauuaacguggaaugaucuaauucgacuauguauaauggucggagcaaaugcaucagacaggauggguaugggcaccacguacuuagcuuugauggcgacuuuuaaaaugaggccaauguuugccguuggucuauuguuucgacgccuaacaucaagagagguuuuacuguuaacaauaggacucagccuuguggcaaguguugaauuaccgaacagucuagaagaacugggugaugguuuagccaugggaauaaugauucuaaaguugcucacggauuuccaaucacaucagcucugggcgacucuccuuagccuaacauuuaucaagacuacauucucacuccacuaugcauggaaaacuauggccaugguuuuaucuauagugagccuauucccuuuguguuuaucaaccacgucucagaagacuacaugguuaccuguucuguuaggaucacuaggauguaagccucucacaauguuccucauagccgaaaauaaaauaugggguagaaagucuuggccguugaaugaaggaaucauggcaguaggaauagucucaauccuauuaagcucuuuacucaaaaaugacgugccguuagcuggaccucuuauagcuggaggcaugcugauugcuuguuacgucauuuccgguucaucagcagacuuaagucuugaaaaagccgcagaagucuccugggaagaagaagcugaacacucuggagccagccauaacauuuuaguagaaguucaagacgacgggacgaugaaaauaaaagaugaagaaagagacgauacuuuaaccauacuccugaaagccacauuacuggcgguaucggggguauacccgcuaaguauccccgcaacuuuauuuguuugguauuucuggcagaagaagaaacaaagaaguggcguucucugggauacaccaaguccuccagagguagaacgagcgguacucgacgacggaauauauagaauaaugcaacgaggucuacucggccguagucaaguaggaguaggaguguuucaagaaaauguauuucacacaauguggcacguaacuaggggugcaguacuaauguaucaagguaaacgauuagagcccucgugggcaucggucaagaaagaccuaauuaguuacggaggugguuggagacuccaaggaucguggaacacaggcgaggagguucaaguuaucgcggucgagccggguaaaaaucccaaaaacguacaaacugcuccuggaaccuucaaaaccagcgagggcgagguaggcgcaauugcuuuagauuucaaacccgguacaucgggcagucccauaguuaacagagaagggaaaaucguaggcuuauacggaaacggugucguuacuacuuccgguacguacguuucggcuauugcgcaagccaaagcgucccaagaagguccccuaccagaaaucgaagaugaaguauuucguaaacgaaaucuuacaauaauggauuuacauccagggucagggaagacucgccgcuauuuaccugcgaucguuagggaagcaauaaagcgaaaauuacguaccuugauauuagcucccacgcgaguaguggcuucugaaauggcugaagcucucaaagggaugccaauacgauaucaaacuacugcaguaaagucagaacacacaggaaaggaaaucguugauuugaugugucacgcaacauuuacuaugagacuucuuucaccaguacgcguucccaauuauaauaugaucauaauggaugaggcacauuuuaccgaucccucaucuauugcugcucgagguuauauauccacucgagugggaaugggcgaggcagcagccauauuuaugacagcaacuccaccgggaagugucgaggcuuucccucagaguaaugcaguaauccaagaugaagaacgagauauaccagaacgaagcuggaacagcggauaugaauggaucacagauuucccgggaaaaacaguuugguucguacccucgauaaaaagcggcaaugauauagcaaauugccucagaaagaacggaaaaagaguuauucaguugucgagaaagacuuuugacacagaguaucagaaaacgaaaaauaaugauugggauuacgugguaacaacugacaucucugaaaugggcgccaauuucagagcugacagaguaauagacccgcgaaggugucuaaaaccaguuauauuaaaagacgguccagaaagaguuauauuagcaggaccaaugccuguaacuguggcguccgcagcccagagacgggggcgaauaggcagaaaucacaauaaggaaggagaccaauauauauauaugggacaaccuuugaauaaugacgaagaucaugcacauuggacagaagcgaagaugcugcuggauaacauaaacaccccggaaggaauaauuccggcacuauucgaacccgaacgagaaaaauccgcugcaaucgauggggaauaucgacuaagaggagaggcaagaaaaacguuuguagaauuaaugcgaaggggagaucucccagucugguugagcuauaagguagcaucugaaggauuccaguauagcgauagaagaugguguuucgacggugaacgaaacaaucagguucuagaagagaauauggauguagaaauauggacuaaggaaggagagagaaagaagcuaagaccaagauggcuggacgcgaggacuuauucugauccguuagcucuaagagaauuuaaggaauuugccgcaggucgcaggaguguuucaggagaccuaauuuuagaaauaggaaaauuaccacagcaccuaacgcagcgcgcucaaaacgcuuuagauaauuuaguaaugcuacauaacuccgaacagggugguagggcauacagacacgcaauggaggaauugccugauacgaucgaaacguuaaugcuucuagcucuuauugcuguuuuaacggguggugugaccuuauucuuucuaagcgguagaggguuaggcaagacgucuaucggauuauuguguguaauggcuucaagcguccuauuauggauggccaguguugaaccgcacuggauugcagcaucuaucauuuuggaauuuuucuuaaugguauuauuaauucccgaaccagaccgccaacgaacaccucaggacaaccaguuagcuuacguaguuaucggauugcuauuuaugauacuaaccguagcagcgaaugaaaugggacuacuagaaacuacaaagaaggauuugggcauaggacauguugccguagaaaaccaucaccaugcagcuauguuagacgucgauuuacauccagcuucggcguggacacuuuacgcuguagccaccacaauuauuacuccgaugaugcgacacacgauagaaaacacgacugcaaauauaagucuaaccgcaauagcuaaccaggccgcaauuuuaaugggauuagauaaaggguggccgauaucaaaaauggauauaggcguuccacucuuagcacuaggauguuauagccaaguaaauccuuugacauuaacugccgcaguacuaaugcuaguugcacauuacgcuaucauaggccccggguugcaagcuaaagcaacaagagaagcccagaaaaggaccgcugcugguauaaugaagaauccaacgguugaugggauugucgcuauagauuuagacccaguugucuacgacgcaaaauuugaaaaacagcuaggucaaauuauguuauugauacucugcacgucacagauacuacugaugagaaccacaugggcucuaugcgaaucgauaacccucgcaaccggaccucuaacaacucuuugggaaggaucaccagguaaauuuuggaauacgacaauagccgucucuauggcuaauauauuccgugggagcuaucuagcuggugccgggcuagcguucucccucaugaaaaguuuaggugguggcagaagaggaacgggugcacaaggugaaacacuuggagaaaaauggaaaagacaauuaaaccaacuuucaaaaucugaauuuaauacuuauaaaagauccggaauuauggaaguugaccgauccgaagcaaaagaagggcuaaaaaggggagaaacaaccaaacacgcuguaaguagaggaacagccaaauuacgaugguucgucgaacggaaccuagucaaaccugaaggaaaaguuaucgacuuggguugcgguaggggcgguuggagcuacuauugcgcaggacugaagaaaguuacggagguaaaaggauauacaaaggguggaccaggacaugaagaaccuaucccaauggcgacauaugguuggaauuuaguuaagcugcacaguggcaaagauguauucuuuauaccaccugaaaaaugcgauacucuauuaugugacauuggcgagagcucgccaaauccgacaauagaagaaggaaggacuuuaagagucuugaaaauggucgaaccaugguuaagagggaaucaauucugcauaaaaauccucaacccuuauaugccuucgguaguagaaacacuagagcaaaugcaacguaagcaugguggaaugcucguccgaaauccuuuaucaagaaacucgacacaugaaauguauugggugucuugugguaccgguaacaucguaagugcugucaacaugaccagucggaugcuuuuaaauagauuuacuauggcucaccgaaaaccaacauacgagagagauguagaucuaggggcuggaacaagacacgucgcagucgaaccugaaguagcgaaucuugacaucauuggucaaagaaucgaaaauaucaaacacgaacauaaaaguacauggcauuaugaugaagacaauccauauaagacaugggcuuaucacgggucauacgaaguaaagcccucaggaucggccagcagcaugguaaacggaguaguuaaauugcucacaaaaccuugggaugucauaccgauggucacucaaauagcuaugacagacaccacgccuuuuggacaacagagaguauucaaggaaaagguugauacgagaacaccuaaggccaaacgagguaccgcacagaucauggagguaacugcuaaaugguugugggguuuucuaucacggaauaaaaagccuagaauauguacucgugaagaguucacuaggaaaguaagaaguaacgcugccauaggggcgguauucguagacgaaaaucaauggaacucagcaaaagaagcagucgaggacgaacgauucugggauuugguucaucgugaaagagaacuucauaaacaaggaaagugugcuacuugcgucuauaauaugaugggcaaaagagagaagaaacuaggcgaauuugguaaagcuaaagggucuagagcaauaugguacaugugguugggcgcacgcuucuuggaauuugaagcacuuggauucaugaaugaagaucauugguucucuagagaaaauagucuuucgggaguugaaggcgagggacuucauaaauugggcuacauacuacgugauaucuccaaaauuccaggaggaaacauguacgcggaugacacugcaggcugggacacccgaauaacugaagaugaccuccaaaacgaggcaaaaaucacagacauaauggaaccugaacaugcuuuguuagcgaagucaauauuuaaacuuacuuaucaaaacaaagugguuagaguacaacgaccugcaaagaauggcacaguaauggauguaaucuccagaagggaccaacgaggcucggggcaaguugggacuuacggcuuaaacaccuucacuaauauggaggcacaacuaaucaggcaaauggaaucagagggcauauuuagcccuucagaauuagaaacuccaaauuuggcaggacggguauuggauugguuagaaaagcauggaguagaacgacuaaaacguauggcuauaaguggcgaugauugcgucgucaaaccgauagacgacagguuugcaacugcuuuaacggcucuaaacgauauggggaaaguuaggaaagacauaccacagugggagccuucgaaagguuggaaugauuggcaacaaguuccauuuuguucgcaucauuuucaucagcuuauaaugaaggaugggcgagagauuguuguuccaugccgaaaccaggacgagcuagucggcagagcuagaguaucacaaggggcuggcuggucgcuaagagagacagcauguuuaggaaaaucauacgcgcaaauguggcaacuaauguauuuucaucgccgugauuugcgcuuggcugcaaacgcuauuugcucagcuguaccaguagauugggugccgaccucgagaacaacauggucuauacaugcacaucaucaauggaugaccacagaagauaugcuaaguguuuggaauagaguauggauugaagagaacccguggauggaggauaaaacgcauauaucgagcuggggagacguaccguauuuagguaaaagagaagaucaauggugcggaucguuaauaggccucacggccagagcuacuugggcaacaaauauucaagucgcaauuaaccagguuaggcguuuaaucggaaaugaaaacuaucuagauuauaugacaaguaugaagcgcuucaaaaacgagagcgaccccgaaggggcucuaugguag

SEQ ID NO: 21820 - RNA, 9879 nt, Artificial Sequence
  derived and/or modified CDS sequence (opt6) from DENV-1__GU131743__SS-prME
uccgugacaaugcugcugaugcucaugccaacugcuuuagcauuucauuuaacgaccagaggaggugaaccucacaugaucguaucuaaacaagaaagaggaaaaagucuguuauuuaaaacaucggcgggugugaauauguguacccuaauagcuauggauuuaggugaacucugugaagacacgaugaccuacaaaugcccacgcaucaccgaaacugaaccugacgauguggauugcugguguaaugcaacagacacauggguaacguacggaaccuguucacaaaccggggagcaucgacgagauaaaagaagcguagcauuagcgccacacguggggcuaggauuggagacccgcacagagacauggaugaguucggaaggagcauggaaacaaauacagcgaguggaaacuugggcauugcgucacccaggauuuacggucaucgcuuuguuucuugcucaugcaauuggaacuucgauaacgcaaaaaggaauaauuuuuauacuacuuaugcuaguuaccccaucaauggcgaugcguugcgucgggauagggaguagagauuuuguugaaggucuuaguggagcaacaugggucgaugucguuuuggagcauggaucgugcgugacuacaauggccaaagacaaacccaccuuagacauugaacuucuaaaaaccgaaguaaccaauccugcagucuuacgaaaacuaugcaucgaagcaaagauaucuaauacuaccacagauucccguuguccaacacaaggagaagcuacucuaguagaagaacaagacgccaacuuuguaugccgucggacguuuguagauagaggguggggcaauggaugugguuuauuugguaaggguagccucaucacuugugccaaauuuaaaugcguuacaaaguuagaaggaaagauaguacaauaugagaaccuaaaauacuccguaauugucacuguacacacuggagaucaacaucaaguggguaaugaaucaacagaacacggcacaacagcgacaaucacgccucaagcgccaacaacugagauucaauugacggacuauggcgcguuaacuuuggacuguagcccuagaacuggacucgacuuuaaugaaaugguauugcuaacgaugaaagagaaaucauggcuuguacacaagcaaugguuuuuggaucuuccguugcccuggacgagcggugcaaguacgagucaagagacauggaauagacaagaucuucuaguaacauuuaaaacagcgcacgccaagaaacaagaaguaguagucuuagguagucaagagggcgccaugcauacagcuuuaacaggugcaacggaaauccagacgagcgggacuaccacaauauuugcggggcacuuaaaaugccggcuaaaaauggacaaauuaaccuugaagggaaugucauacguuauguguacagggucauucaaguuagagaaggaaguagcugaaacacagcauggcacaguuuuaguacaaauuaaauaugaaggcacugacgccccaugcaaaauaccuuucucaacacaggacgaaaagggcgucacccagaacggcagauuaauuacugcaaacccaauaguuacggauaaagaaaaaccaguaaauauagaagccgagccacccuucggagaaaguuacauuguuauaggagcuggagaaaaggcuuuaaaacucuccugguuuaaaaagggaucaucaaucgguaagauguuugaagcaacagccaggggugcacguagaauggccauacuuggagauacugcuugggacuucggaucuauaggagggguauuuacauccguaggcaaacucguucaccaaauuuuuggcacugcguaugguguucuauuuaguggaguuucuuggacaaugaagauaggaauugggguuuuauuaacuugguuaggauuaaauucaagaagcacuucacugucuaugacaugcaucgcagugggccuagugaccuuauaucucggcgugauggugcaggccgauagcgguugcguaauaaacuggaaagguagggaguuaaaauguggaucagguauauuuguaacuaaugagguucacacauggacugaacaguacaaguuucaagcugauaguccuaagcggcuuuccgcggccaucggcaaagccugggaagaaggggugugugguauucgaagugcuacccgucuagaaaacauaauguggaaacagaucucuaacgagcuaaaccauauccuuuuagaaaaugacaugaaauuuaccguaguaguaggagaugucgccgggauucuagcacaagggaagaaaaugauuagaccgcaaccuauggaauauaaauacucuuggaaaaguugggggaaagcaaaaauaauaggagcggauguccaaaauacuacguucauaaucgacggaccaaacacgccggaguguccagaugaucaaagagcauggaauauuugggaaguugaagacuacggcuuugguauauucaccacaaacauauggcucaaauugcgcgauaguuauacacaaguaugugaccaucgccugaugucagcggcaaucaaagacaguaaagcuguacaugcugauaugggauacuggauagaaagcgagaagaacgaaacauggaaauuagcuagagcaucuuuuaucgaaguaaagacaugcauauggccuaaaagucacacacuguggagcaauggaguacuagaaucagaaaugaucauucccaaaaucuauggagguccuaucagccaacauaauuacagaccuggcuacuucacccaagcagcaggacccuggcacuuaggaaaauuagaacuugacuuugauuuaugcgaagguacaacuguagucguugacgaacauugugguaacagagggccaucuuuacggacaacgacuguaacugguaaaauuauucacgaaugguguuguagaaguugcacccuuccuccgcugagguuuagaggagaggauggauguugguacggaauggaaauccgaccaguuaaagagaaggaagagaacuuagugaaaaguaugguuagugcugguucgggagaaguagauaguuucagcuuaggauuauuauguauuucuaucaugauagaggaggucaugagaucaagauggucacgcagaauguuaaugacagguacucuggcaguauuuuucuuauuaauaaugggccaacuuacguggaacgauuuaauuaggcuauguauuauggucggagcgaacgcaucagauaggaugggaauggggacaacuuaucuggcauugauggcuacguuuaagaugcgaccaauguuugcagucggacuacuauuccgcagauuaaccaguagagagguucuauuguuaaccauaggucugagcuugguggcaaguguagaacuaccuaauucauuagaagaauuaggagacggccuagcuaugggaaucaugaucuugaaacuauugaccgauuuucagagucaucaguugugggcaacuuuauugagcuuaacuuucauaaagacaacguucucguugcauuacgcauggaagacuauggcaaugguauugagcauaguaaguuuauuuccauuauguuugaguacaacuagccagaaaacuacaugguuaccaguacuucucgguucauuagguuguaaaccucuaacaauguuucugauugcggaaaauaaaauauggggaagaagaucuuggccucucaacgaaggaauaauggcggucggcauugucucaauuuuauuaagcucguuacugaagaacgauguaccauuagcgggaccguuaauugcuggcgguauguuaauugcaugcuauguuauaagcggaucaucagccgaucucucauuagaaaaggcggcugaggucaguugggaggaagaagcggaacacucaggagcuucucacaauauauuagucgaaguacaggacgaugguaccaugaaaauaaaagaugaggaaagagacgacacacucacuauucuacugaaagcuacauugcuugcgguaucaggaguauauccccuguccauaccagcuacuuuauuuguuugguauuucuggcagaagaagaaacaaaggagcggaguccuuugggauacuccaagcccuccugaggucgaacgagcagugcuagaugaugguauuuaucgaauuaugcaacgaggucuucuaggaagaucgcaaguggguguugguguauuccaagaaaauguauuccauacaauguggcauguuacucggggcgccguacugauguaucaaggaaaaagauuagaaccaagcugggcaucagucaagaaagaucuuauuucguacggagggggauggagacuacaggguucauggaauacaggagaagagguccagguaauagcuguugaacccggaaagaaccccaaaaaugugcaaacagcaccagggaccuucaaaacgccagagggcgaagugggugcuauugcucuugacuucaaaccugggacaucaggaucucccauagugaacagagaagggaaaauagucggauuauauggaaauggaguugugacaacaucggguacuuaugucucugcuauugcacaggcgaaagcaucccaggaaggaccgcucccagagauagaggaugaaguauuccguaaacguaauuugacuauaauggauuugcauccuggcucuggaaaaacuaggcguuaucuaccggcuauuguaagagaggcgauaaaaagaaaacuucguacacuuauacuggcuccaaccaggguuguugcaagcgaaauggcugaagcauugaaaggaaugcccauaagauaucagaccacugcaguuaaaucggaacacacgggcaaagagauagucgaucuaaugugccaugcgacauucacuaugagauuauugucaccaguaagaguaccaaauuauaauaugauaauaauggacgaggcacauuuuacagauccuagcaguauagcugccagaggauacauaagcacaagaguuggcaugggagaagcugcagccauauucaugacggcgacgccaccugggucuguagaggcauuuccucaaagcaaugccguaauccaagaugaagaacgcgauauuccagaacguucuuggaacucagguuaugaauggauaacagauuucccagguaaaacaguaugguuugucccgagcauaaaaaguggaaacgauaucgcuaauugucucaggaaaaaugguaagagggucauccaauuaucucgaaaaacuuuugauacugaguaucagaaaacaaagaauaaugacugggauuacgugguaacuacagacauuagugaaaugggugcgaacuuuagggcggaucgaguaauagacccccgaagauguuuaaaaccagugauucuuaaagacggaccugaacguguaauacuagcgggaccaaugccaguuacaguugcuucugccgcucaaagaaggggccgaauaggucgcaaccacaauaaagaaggggaucaauacauauauauggggcaaccguugaauaacgaugaagaucacgcacauuggacggaagcgaagaugcuccucgauaacauaaacacacccgaaggaauaauaccagcgcuauuugaaccagaaagagagaagucggcagcgauagacggggaguauaggcugcguggggaggcccgaaaaacauuuguagagcugaugcgccggggugauuuaccagucuggcuuaguuauaaagucgcaagcgagggauuucaauacucugacagacgauggugcuuugauggggaacggaauaaccaaguauuagaagaaaacauggauguagaaauuuggacaaaagaaggagaacgaaagaaacucagaccuagauggcucgacgccagaaccuauucugauccgcuagcacugagagaguuuaaagaguucgccgccggaagacguucuguuagcggcgaccuaauuuuagaaauaggcaaauuaccacaacauuuaacccaaagagcgcagaaugcucuugauaaccuaguaaugcuacacaacuccgaacaagggggacgcgcguaucgacaugcaauggaagaacuuccagauacuaucgaaacacucauguuauuagcuuuaaucgccgugcuaacaggcggaguaacguuguuuuucuuauccggcagaggacuagguaaaacaagcauaggauuauuauguguuauggccaguucaguucuacuguggauggcaucaguagaaccacauuggauugcugcaaguauaaucuuagaguucuuucuaaugguguuacuaauuccugaacccgacaggcagcguaccccacaagacaaccaguuggcguacguuguaauaggcuugcuuuuuaugauacuaacuguugcagccaacgagaugggccuauuagaaacgacuaaaaaggacuuagguauaggacacgucgcagucgaaaaccaucaccacgcagccauguuagauguagaucuucauccagcuagugcuuggacuuuauacgcaguagccaccacuauaaucacuccaaugaugcggcauacaauugaaaauacuacagccaacauaucuuuaacagcaauugcaaaucaggccgcaauacuuaugggacuagauaaaggauggccaauaucaaaaauggauaucggcgucccccuacuugcucuaggaugcuacagucaaguaaacccgcugacgcuuacagccgccguacuaaugcuagucgcacauuacgcgauuauaggaccaggucuacaagccaaggcaacgcgagaagcucaaaaacgcacagcagccggaauaaugaagaacccgacaguagaugguaucguagcaauagaucuugauccaguuguauacgacgcaaaauucgagaaacaauugggacaaauuauguugcuuauauuauguacgucgcagauccuccuaaugcgcacaaccugggccuugugcgagucaaucacguuggcaacuggaccuuugaccaccuugugggaaggcucaccugggaaauuuuggaauaccacaauagcaguaucgauggccaauauauuuaggggaucauacuuagcuggcgcaggauuagcauucucgcuaaugaaaucguuaggcggagggagaagaggaacgggggcacagggggaaacauugggagaaaaauggaaacgccaacuaaaccaacuaaguaaaucagaguuuaauacguauaaaagaaguggcauaauggaaguggaucguucugaagcaaaagaaggucugaaaaggggugagacuacaaaacaugcgguaaguagaggaacggcaaaauugagaugguuuguagagagaaaccucguaaaacccgaggguaaaguaauagacuuaggguguggacguggcggguggucauauuauugugcuggacucaagaaagugacggaagucaaaggauauacaaaagguggcccaggucaugaagaaccgauuccaauggcaacauacggauggaaccuaguaaaauugcauuccgggaaagacguauuuuucauaccucccgaaaagugcgauaccuuauuaugugauauuggugagucaucaccaaacccaacuauagaggaaggucggacucuacgagugcucaaaaugguggagccauggcugcgcggcaaucaguuuuguauuaagauucucaaucccuacaugccaaguguagucgagaccuuagagcaaaugcaaagaaaacauggggguaugcuuguuaggaauccucucaguagaaauucaacccacgaaauguauuggguuucaugcggcaccgguaauauaguuagugcaguaaauaugacaucuagaauguuacugaacagguuuaccauggcccaccguaagccaacguacgagagagauguagaccuaggugcaggaacgagacauguugcaguagaaccugaaguugcaaaucuagauguaauaggacaacgaauagaaaauauaaagcaugaacauaaauccacauggcacuacgaugaagauaauccuuauaaaacuugggcuuaccauggaagcuaugaaguaaagccaucgggaucugcuucaucgaugguaaacggcguaguaaaacuacuuacuaaaccaugggauguuauaccgaugguaacacaaauagcgaugacagauacaacaccauuuggucaacaacgaguauuuaaagagaagguggauacacgaacaccuaaggcgaagagaggaacagcacaaauaauggagguaaccgcaaaaugguuaugggguuuccugagcagaaauaagaagccucgaauuuguacacgagaagaguuuaccagaaaaguuaggaguaacgcggcaauuggugccguuuucguugaugaaaaucaauggaauagugccaaggaggcaguugaagacgaacgauuuugggaucuagugcauagagagcgggaauuacauaaacaagguaaaugcgcaacauguguauauaauaugaugggaaaacgcgagaagaaacucggcgaguuugguaaagccaaaggcucccgagccaucugguauaugugguuaggugcucgauuccuugaguuugaggcauugggauucaugaaugaggaccacugguucagucgagaaaauagucucagcggcgucgaaggcgagggacuacauaaauuaggcuauauacuacgcgauauuaguaagauaccuggagggaauauguacgcugaugauacugcugguugggauaccaggaucacagaggaugaccuacagaaugaggcaagaauaacggauaucauggaaccugaacacgcccuacuagcaaaaagcauuuucaaguuaacauaucaaaauaagguaguuaggguacagcgacccgcgaaaaauggaaccguaauggaugucauuucacguagagaccagcgcggaucaggacaaguuggaacguauggacuaaauacuuuuacgaacauggaagcucaacuaauaaggcagauggaaucugaaggaauauuuaguccaagcgaauuagagacaccaaaccuggccgaaaggguuuuggauuggcuaggaaaguacggaguagagagauuaaagcguauggccaucagcggcgaugacugcguagucaaacccauugaugaccguuuugccaccgcauuaacggcguuaaaugauaugggaaagguacgaaaggacaucccacaaugggaaccgucaaaaggcuggaacgacuggcaacagguaccauucugcucacaccacuuucaccaacugauaaugaaagauggaagggaaauugugguuccaugccguaaucaggaugaauugguggguagagcgagagugagccaaggagcaggguggucuuuaagagagacagcaugucucggcaaaaguuaugcccaaauguggcaacugauguacuuccauaggagggaucuucgguuagcagcuaaugcaauuuguucggcaguaccgguugacuggauaccaacuucccgaacuacuuggagcauacaugcacaucaccaauggaugacaaccgaagauauguugucaguuuggaaccguguauggauagaggaaaacccguggauggaagauaagacacauauaagcaguuggggagauguuccauaccuuggaaaaagagaagaucagugguguggcagcuuaauaggccuuacggcucgcgcaacaugggcuacaaauauacaaguugcaauuaaccagguacgaagauuaauagguaaugaaaacuacuuggacuauaugacaaguaugaagcgauuuaaaaaugaaucugauccagaaggugcauugugguga

SEQ ID NO: 21821 - RNA, 9879 nt, Artificial Sequence
  derived and/or modified CDS sequence (opt6) from DENV-1__JN093516__SS-prME
agcgugacgauguuauuaauguuaaugccuacagcucuggcauuccacuuaacaacucguggaggagaaccccacaugauaguaucaaaacaagaaagagguaaaucacuauuguucaaaacaucugcaggcguaaacauguguacuuugauagcgauggauuuaggcgaguucugcgaggacaccaugacauauaaauguccccgaauaacagaagcagaaccggaugauguugauuguugguguaacgccacagauacuuggguaacauacggcacauguucucaaacuggagaacaccgccgagacaaaagaucgguggcacuagcgccccacguuggacugggucuugaaacgcgcacggaaacguggaugagcucggagggagcuuggaaacaaauccaaaagguagagacuugggcccuccgccauccuggauucacuguaaucgcuuuguuuuuagcacaugcaauugguacgucaauaacccaaaaggggauaaucuuuauauuguuaaugcugguuacuccgaguauggcaaugcguugcguagggaucggauccagagauuuuguugagggauuaucaggagcaacauggguggacguuguccuagaacauggcaguugcgucaccacaauggcaaaagauaaaccaacuuuagauauugaauuauuaaaaacggaaguuacaaacccagcuguuuuacgcaaauuaugcauugaagccaaaauauccaacacgacuacagacucucggugcccaacucaaggcgaagcaacauuaguagaagaacaagaugccaauuucguuuguagaaggacauuuguagaccgagggugggggaauggauguggccuuuucggaaaagguucucucauaacgugugcaaaauuuaaaugugucacaaaauuagaaggcaaaaccgugcagcaugaaaaucugaaauacuccgucauuguaacuguucauacuggcgaccaacaucagguugguaaugaaaguacagaacacgggacaacagcaacgauuaccccacaagcuccuucuacagaaauacaacuuacugacuauggagcacugacacuggacugcucuccaagaaccggcuuggacuucaacgagauggugcuguuaacaaugaaagagaagucauggcuuguacauaaacagugguuccuggauuuaccuuuaccauggacgucuggcgcgaguaccagucaagagacuuggaaucgaaaagaucucuugguuacuuucaaaacggcacaugccaaaaagcaagagguaguuguucuuggaucacaagagggcgccaugcacacagcgcuaacaggugcgacagaaauccagacaaguggaacuacuacgauuuuugcagggcaucuuaaguguagguugaagauggacaaacuuacacuaaaagguaugagcuacguuaugugcacuggaaguuuuaaauuggaaaaagagguagcagaaacacaacaugggacgguacuuguacagauuaaguaugaaggaaccgacgcaccuugcaaaauacccuucagcacacaagaugaaaagggugucacacaaaacgguaggcuaauaacggcaaauccuauuguaacugacaaggaaaaaccgguuaauauagaggcagaaccacccuucggagagucauauauaguaaucggugccggagaaaaagcacugaaacuaagcugguuuaaaaaggggucaaguauagguaaaauguucgaagcuacgacuagaggagcaagaagaauggcaauauuaggugacacagcaugggauuucgggucaauaggcggaguguucacaucuguaggaaaauugguacaccagauauuuggcacggcuuacggcguacuguucucaggaguaagcuggaccaugaaaauagguauaggaguucuacuuaccuggcuuggacucaacucacgaagcaccagcuuaucuaugacuugcaucgccguaggucuugugacuuuauauuugggaguaaugguucaagccgacucuggaugcguuauuaauuggaaagggagagaauugaaauguggcucuggaauauuuguuacaaaugaaguucauaccuggacugaacaauacaaguuucaagcugauagcccgaaaagauuaagcgcggcaauuggaaaagcgugggaagaagguguaugcgggaucagaucugccaccagacuagagaauauuauguggaaacaaauaaguaaugaauuaaaucacauucuucuagaaaaugauaugaaguuuaccguugucguaggagacguggcagguauauuagcccaaggaaagaaaaugauacguccacagccaauggaguauaaguacagcuggaaaagcuggggaaaagcgaagauuauaggugcagauguacaaaacacgacuuucauaauugacggaccuaauacacccgaaugcccagaugaucagagagcguggaacauaugggaaguggaagauuaugguuuuggcaucuuuacuaccaacauaugguugaagcucagggacucuuacacucaaguaugcgaucaucgacuuaugagugcagcaauuaaagacucaaaagcuguacaugcagauaugggcuauuggauagaaucugaaaagaaugaaacuuggaaauuagcaagagcaucguucauugaggucaaaacuuguauauggccaaaaucgcauacucuuuggagcaacggcguacuagaaagcgagaugauuauaccgaaaaucuacgguggaccaauaucgcaacacaacuauaggccuggcuauuuuacccaaacggcugggcccuggcaccuugguaaauuagaacuagacuucgaccuaugcgaaggaacaacuguggucguugaugaacacuguggaaaucgcggacccucguuacgaacaacuaccguuacuggaaaaauaauacaugaaugguguugcagaaguugcaccuuaccuccacucagauucaaaggugaagauggcugcugguauggcauggagauucgaccugucaaggaaaaggaagaaaacuuggucaagaguaugguauccgcgggaucaggagaaguagauaguuucucgcuuggcuuacuaugcauaucaauaaugauagaagaagugaugagaucacgauggucacguaaaauguuaaugaccggcacccucgcaguguucuuuuugcugauaaugggacaguuaacuuggaacgauuuaauccgccuguguauuaugguuggagcaaaugcaucugaucggauggguauggguaccacauauuuggcuuuaauggcuacauuuaaaaugcgaccaauguuugccguaggguuacuauuuagaagguuaacuucacgagaaguuuuacuuuuaacuauaggacuaucacucgucgcaagugucgaacucccaaauucguuagaagaauuaggugacggccuagcaaugggaauaaugauacuuaaguuauuaacagacuuccaaucucaucaauuaugggccacauugcuuucuuuaacauuuauaaaaacaacuuuuucauuacauuaugcuuggaaaaccauggcgaugguauugucaaucguaagucuauuucccuuaugcuuaucaacaacaagccaaaagacuacaugguuaccaguuuuacucggcagccuaggguguaagccuuuaacaauguuccuuauagccgaaaauaaaaucuggggccguaagaguuggccguuaaaugaaggaauuauggcuguagguaucguuucaauucuucugaguucacuacuuaaaaaugauguuccccuagcugguccguuaauagcuggagguaugcugaucgcauguuauguuauuagcggcucaucugcugaucugagcuuggagaaagcagcugaaguuagcugggaggaagaagcugaacauaguggggcgagucacaauauccuaguagagguacaagaugaugguacuaugaaaauaaaggacgaagagagagaugauacauuaacgauccuacuuaaggccacuuuauuagcaguaagugguguguauccgcuuaguauaccagcaacauuauuuguaugguacuuuuggcaaaagaagaaacaacguagcgguguuuuaugggacacaccaucaccaccugaaguagaacgagccguacuagaugaugguauauauagaaucaugcaacguggacuucuugguagaucucaaguugggguaggaguauuccaagaaaauguuuuucauaccauguggcauguuacgagaggggccguuuuaauguaucaaggaaaaagauuggaacccucgugggcuucagucaagaaagacuugauauccuacgguggaggcuggcgucuccagggcagcuggaacaccggugaagaagugcagguuauugcaguggaacccgguaaaaaucccaaaaacguacaaacagcuccuggaacauuuaaaaccuccgagggggaggugggagcaauagcauuagacuuuaaaccaggaaccuccggaagcccaauagugaaucgcgaaggaaagauaguuggucuauauggaaauggugucgugacgacuucagggacuuaugucagcgccauagcccaagcaaaggcaagucaagaaggaccccugccggaaaucgaagaugaaguauuuaggaaacgaaaucuaacaauaauggaucuacauccaggaucugggaaaacaagacgguaucuucccgcaauaguaagagaagcgauaaaacgaaaauuaagaacacuaauacuggcuccuacucggguaguugcuagugagauggcagaagccuuaaagggaaugccgaucagauaccaaacaacugccguaaagucugaacacaccgguaaagaaauaguagaccucaugugucacgccacguucacaaugcgguugcucucuccuguccguguacccaauuauaauaugauuauuauggacgaagcucacuuuacugacccaucuucuauugcggcccgaggguacauauccacccgcguuggaaugggcgaagcagccgcgauauuuaugaccgcaacaccuccaggguccguagaggcuuuuccucaaucuaaugccguaauucaggaugaagaacgagauauacccgaacgaaguuggaacucaggcuacgaauggauaacagacuuuccgggaaaaacagucugguuuguaccuaguauaaaauccggcaaugauauugcaaacuguuuaaggaaaaacggaaaacgaguaauucaacuuucacgaaaaacuuuugacacugaauaccagaaaacuaaaaauaaugauugggauuacguggugacuacugauauaagcgaaaugggggccaauuuuagggcugaccgggugauugauccuaggaggugcuuaaagccagugaucuuaaaggauggucccgaaagagucauauuagcggggccgaugccagugaccguugcuucagcugcgcaaagacgaggucgcauagguagaaaucauaacaaagaaggcgaccaauauaucuauaugggacaaccccuuaauaaugaugaagaucacgcacauuggacugaggcgaaaaugcuucuugacaacauaaauacuccggaaggaauaauucccgccuuauuugagcccgagcgagagaaaagcgcagcgauugacggugaauaccgacuacgcggugaagcuagaaaaacguuuguagaauugaugagaagaggagaucugccuguguggcucucauauaaaguggccagugaaggauuccaauauucagauagacguugguguuucgauggugaaagaaacaaucaagucuuagaagaaaauauggacguggagauauggacuaaggagggugaacguaaaaagcuaagaccuagguggcucgaugcgagaacauacucugauccguuggcgcuccgggaauuuaaagaguuugcagcuggaaggagaagcguaucuggcgaucuaaucuuagaaauaggaaaacuaccucaacaccuaacccaaagagcgcaaaaugcauuagauaaccuggugauguuacacaauagugagcaagggggucgcgcauaccgccacgcaauggaagaguuaccugauacaauagaaacccuuaugcucuuggcauugauagcuguccugaccgggggaguaacucuuuucuuccugucuggaagggguuugggcaaaacaaguauuggucuauuauguguaauggcaucuucggcuuugcuguggauggcgagugucgaaccccacuggauugccgcaaguauuauauuagaguucuuuuugaugguccuacucauuccagaaccugauagacaaaggacaccgcaagauaaccaguuggcauacgucguaauuggccuacuauuuaugauccucacaguugcugcaaacgagauggggcuguuagaaacuaccaagaaagaccuaggaauaggccauguggccguagaaaaccaucaccaugcaacaauguuagauguugaucuccauccagcuucggcauggacucuauacgcaguggcaacaacaaucauaacuccaaugaugcgccacacaauugaaaauaccacugccaauaucagcuuaacagcaaucgccaaccaagccgcuauauuaaugggacucgacaaaggguggccaauaucaaaaauggacaucggcguuccacucuuagcacuagguuguuacucgcaggucaaucccuuaacuuuaaccgcggcaguguugaugcuuguagcucauuaugcaauuauaggaccuggucuacaagcuaaagccacccgagaagcacaaaaacgaacagcugcagggaucaugaagaauccuacaguggacggcauuguggcuauagacuuagacccugugguauacgaugcuaaauucgaaaaacagcuugggcaaauaaugcuuuugauacuuugcacaagccaaaucuuacugaugagaacuacaugggcucuuugugaaaguauuacgcuggcaacaggaccgcucacgacauuaugggaagggaguccgggcaaguucuggaauaccaccaucgcgguaucaauggcgaauauauuccguggaaguuaucuggcuggcgcuggcuuagcuuuuucccucaugaaaagucuaggugggggcagaagggguacaggugcacaaggugaaacacuaggggaaaaauggaaacgucaguuaaaucaacuaucaaaaucugaauuuaauacauacaaacgaagugggauaauggaaguugaucgaucugaagcuaaagagggacuuaaaagaggagaaacgaccaaacaugcagugucaagagguacugcaaaauuacgaugguucgucgaacguaacuuagucaaaccagagggaaagguaauagaucugggaugugguagggguggauggagcuauuacugcgcagggcuaaagaaaguaacugaaguuaagggauauacuaaaggagguccaggucaugaagaacccauaccaauggcaacuuaugguuggaaccuaguuaaauugcauuccggaaaggauguauucuuuauaccacccgaaaaaugcgauacgcuauuaugugauauuggcgaaucaucaccuaacccgaccauugaagaaggaagaacauuaagaguguuaaaaaugguugaaccaugguuaagagguaaccaauuuuguauuaagauuuugaacccauauaugcccucugugguagaaacgcuggaacaaaugcaaagaaaacacggcggaauguuaguuaggaauccacucaguagaaauagcacucacgagauguacuggguaaguuguggaacuggaaauauaguaagugcaguuaauaugacgagccgcaugcuauugaaccgauucaccauggcacaucguaaaccuacauacgaaagagacguggacuuaggagcuggaacuaggcaugucgccguugaaccggagguagcuaacuuagauaucauaggucaacgcauagaaaacauaaaacacgaacauaaaaguaccuggcacuacgacgaagauaaccccuacaaaacuugggcguaccacgguucuuacgaaguuaagccgaguggaucagccagcaguaugguuaauggaguaguaaaacuauugacuaaaccaugggauguaauucccaugguaacucaaauagcaaugacggacaccacaccauuuggacaacaacguguuuuuaaagaaaaaguggacacaagaacaccuaaagcgaagaggggaaccgcgcaaauaauggaggugacugcaaaauggcuuuggggguuuuuaucccguaauaaaaagccacgaauaugcaccagagaagaauuuacaagaaaaguucguucaaaugcugcgauaggugcaguguucguagacgaaaaucaguggaacucugcaaaggaagcuguagaagaugagagauuuugggacuuaguccaccgggaaagagaauuacauaagcaagggaaaugugcuaccugcgucuauaauaugaugggcaaaagggagaagaaauuaggggaauuuggaaaagccaagggaucuagagccauuugguacauguggcuuggugcccgguuccuagaauuugaggcccuugguuucaugaacgaagaucacugguucaguagggaaaacucacugagugggguugaaggugaaggucuucauaaauugggcuauauccuuagagauaucucaaagauaccgggcgguaauauguaugcagaugauacagcugguugggacaccagaaucacagaagaugaucugcaaaacgaggcaaaaauaacagacauuauggaaccagagcaugcgcucuuagcaaaaagcauuuuuaaacuaacuuaucaaaauaaaguuguccgaguccaacgaccagccaaaaauggaacaguaauggacguuaucagcagaagggaccaacgugguucuggacagguggguaccuaugguuugaauacguuuacuaacauggaggcgcaauuaauaagacaaauggaauccgaagguauauucaguccuucggaauuagagacaccaaacuuagcagggagaguguuggacuggcuugaaaaacauggaguugagaggcucaaacguauggcuauaucaggagaugacuguguagugaagccuauugacgaucgcuuugcuacggcacuaacagcuuugaaugauaugggaaaaguaagaaaagauauuccacaaugggaaccguccaagggcuggaacgauuggcaacaaguaccguucuguagucaucauuuucaccagcuaauuaugaaggauggaagagaaauagucguaccuuguaggaaucaagaugaacucguugggagagcacgaguaagccagggugcuggcuggucauuacgggaaacagcaugucuaggaaaauccuacgcgcagauguggcaacuaauguauuuucacaggagagacuuacgccucgcggcgaaugcuauaugcucagccguucccguggaguggguuccuacaucgagaacuacuugguccauacacgcccaucaucaguggaugaccacagaggauaugcuaucaguuuggaaccgaguuuggauugaagaaaaucccuggauggaagauaaaacgcacauaucuuccuggggugacguaccuuacuugggaaaaagagaagaucaguggugcgguucucuuauagguuugacagcccgagcaacaugggcuacuaauauccaagucgccauuaaucagguaagaagauuaauagggaaugaaaauuauuuggauuauaugacgaguaugaaacgauuuaaaaaugagagugacccagaaggugcacuaugguga

SEQ ID NO: 21822 - RNA, 9879 nt, Artificial Sequence
  derived and/or modified CDS sequence (opt6) from DENV-1__GU131746__SS-prME
ucuguuacaauguugcuuaugcuaaugccgacugcauuggccuuccaccucacaacacguggaggagaaccucacaugaucguuucaaaacaagagagaggaaaaucguuauuguuuaaaacaagugcugguguaaauauguguacccucauagcaauggacuugggggaauuaugcgaggauacuaugacuuauaaauguccccgaauuacagaaacagaaccugaugauguagacuguugguguaaugcaaccgacaccugggugacuuaugguacauguagccaaaccggugaacauagaagagacaaacggucgguugcuuuggcaccacaugucggucucgggcuggagacaagaacggaaacauggauguccagugagggggcuuggaaacaaauacaacgaguggagacaugggcauugagacauccuggauucacaguaauugcguuguuuuuagcacacgcuaucgggacuucuauaacacaaaaagguauuaucuucauacuuuugauguuagucaccccgagcauggcaaugcggugcgucggaauagguucacgagacuucguugagggacugucaggagcgacauggguagacgugguauuagaacacgggaguugcguaacaacgauggccaaagacaaaccgacucuagauauagaacuucucaaaacagaggugacaaaccccgcuguacucaggaaacuguguaucgaagcuaaaauuucgaacacuacuacugauagucgauguccgacucaaggagaagcgacccuaguugaggaacaagaugcaaacuuuguauguagacgaaccuucguggauagaggcugggggaacgguuguggcuuauucgggaaaggaagccuaauaacgugugcuaaauuuaaaugcguuacgaaacuugaaggaaaaauaguacaauaugaaaauuuaaaauacuccgugauaguuacuguccacacaggugaccaacaucaagucgguaacgaaaguacagaacacgggacaaccgcuacuaucacaccccaagcaccuaccaccgaaauccaacuuacagacuauggagcauugacccuugauuguagcccuagaaccggauuagauuuuaaugagauggucuugcuaacaaugaaagaaaaaucuuggcuaguacauaaacaaugguuucuagaucuuccacuaccuuggacgucuggagcgucuacgucacaggaaacauggaaucgacaagauuuauuaguaacguuuaaaacggcacaugccaagaaacaagaaguuguaguauuaggaucacaagaaggagcaaugcauacggcccucacuggugcuacggaaauccaaacaucgggaacuacaacaauuuucgcaggccacuuaaaaugucgguuaaaaauggacaaacucacuuuaaaagggaugucauauguaauguguaccgguucauuuaaacuagagaaagaacuugccgaaacacaacaugggacaguauuaguucaaauaaaauaugaaggcacugaugccccaugcaaaauuccauuuucgacacaagacgaaaaagguguuacgcagaaugguagacuaaucacagcaaacccuauugugacagauaaagagaaacccgucaacauagaggccgaaccaccauuuggagagucauauaucguaauuggugcaggagagaaagcgcugaaacuuaguugguuuaagaaagggucgucaauaggaaagauguucgaagcaaccgcgcggggagcucguagaauggcaauauugggagacacugcaugggacuucgggaguauuggcggcguguucaccaguguugggaagcuagugcaccaaauauucgggacggccuauggaguccuuuucagcggcguaagcuggacgaugaaaauuggcauaggaguccuucuuacuuggcucggacugaacucaagaucgacaagccugaguaugacauguauagcagugggccuaguuaccuuauaucuagguguaaugguucaggccgauuccggguguguuauuaauuggaagggaagagaauugaaaugcgggagcgguauauuuguaaccaacgaaguacacacuuggacugaacaguacaaauuucaagcugauagucccaagagauuaucagcggcgauaggaaaggcaugggaagaaggagugugcggcauacgcucagccacaagacucgaaaauauaauguggaaacagauaucaaaugaacugaaccauauucuucuagagaaugacaugaaauuuacaguuguuguuggugacguagccgggauuuuggcacaagguaaaaagaugauaaggccccaaccgauggaguauaaguacucauggaaaucaugggguaaagccaagaucaucggcgccgacguacaaaacacaacguuuauuauugaugguccuaacacacccgaaugcccggacgaucaacgggccuggaauauuugggaaguugaggacuacgguuuugguaucuuuaccacgaacaucuggcuaaaauuaagggauaguuacacucaaguaugcgaccaucgacugaugucggcagcaauaaaagauaguaaagcgguucacgccgauauggguuacuggaucgaaucugagaagaacgaaacuuggaaauuggcaagggcgucguuuauugaaguaaaaacauguauauggccaaagucacacacucuuuggucaaauggcguucuagaaagcgagaugaucauuccaaaaauuuacggaggaccgauaucccaacauaauuauagaccagguuacuuuacucagacugcaggacccuggcacuuaggaaaguuagaacuagauuuugaccuaugcgaagggacuacaguugucguagaugaacauuguggaaaucgugggccaucucuacguacaacgacagucacugguaaaauaauacacgaaugguguugcagaucuuguacuuugcccccauugagguuucggggcgaagacggcugcugguaugggauggaaauaaggccugugaaagagaaagaagaaaauuuaguaaaaaguaugguuagcgcagguuccggagagguugacuccuucucacuuggguuauugugcauaagcaucaugauagaagaagugaugcguucgagauggagcaggaaaauguuaaugacaggaacuuuagcgguauucuuuuuauugauuaugggacaauugaccuggaaugaucucauucgucuaugcauaaugguaggcgcgaaugcaucagaccgaaugggcauggggacuacguacuuggcauugauggccaccuuuaaaaugcggccgauguuugccguuggccuacuauuccgaagguuaacaagucgagaaguuuuacuacuuacgauuggauuaagucuugucgcaucgguagaauuaccaaauucguuggaagaauugggugauggcuuagcaauggggauaaugauccuaaaacuuuugaccgauuuccaaucacaccaacugugggcgacauuacuaucgcugacguucauuaagacaacuuuuagucuucauuacgcauggaagacuauggccaugauacuuaguauaguuagucuuuucccuuuaugucucuccaccaccagccagaaaacuacguggcuucccguauugcugggcucauuaggaugcaaaccgcucacaauguucuugauugcggaaaauaaaauauggggaagaagaucguggccccucaacgaaggcauaauggcaguagguauagugucaauccuacucuccucccuacuuaaaaaugacguaccacuggcaggacccuuaauugcugggggaaugcuaauugcuuguuacguaauaucugguaguagugcagaccucagucuagaaaaagcagcagaaguuaguugggaagaggaagcagagcacaguggugcgucucauaacauauuaguagaaguacaagaugacggaacaaugaaaauaaaagaugaggaaagagaugacacacuaacgauucuuuugaaagcuacguuacuagcggugucuggagucuacccucuaucaauaccagcaacgcuauuuguuugguauuucuggcaaaagaagaaacaacgaagcgguguuuuaugggauacuccaaguccaccagaagucgaaagagcaguauuagaugauggaauauauagaauuaugcagagagguuuauuagggaggucacaaguagguguaggaguauuucaggagaacgucuuccauacaauguggcacguaacgcgaggggcaguuuuaauguaucaaggaaaacgucuugaaccgucaugggccagugucaagaaagaccuaauauccuacgggggaggauggagacuacaaggauccuggaacacuggagaagaaguucaaguaauagcaguagagccuggcaaaaacccgaaaaauguacaaacugccccaggaacauuuaaaacucccgaaggagagguaggcgcgaucgccuuagauuuuaagccgggaacauccggauccccaauaguuaacagggaaggcaaaauaguugguuuauaugggaauggcgugguaacaacaucagguacauacguaucagccauagcacaagcaaaagcgagccaggagggaccauuaccugaaaucgaagaugaaguuuuccgcaaaagaaauuuaacaauuauggauuugcaucccggcucagggaaaacaaggagguaucuaccagccaucgucagagaagcgauaaagagaaagcuaagaacuuuaaucuuggcuccaacgcguguagucgcgucagaaauggcagaagcucuaaaaggaaugccaauaagguaucaaacuacggcuguaaagagcgaacacacaggaaaagagauuguugaucuaaugugucacgcgacauucacuaugcgauuacuaaguccgguaaggguuccaaauuauaauaugauuauaauggaugaggcacauuuuacggacccgucuagcaucgccgcuagaggcuauaucucaacacgaguuggcaugggugaagcugcggcgauauuuaugacugcgacaccuccaggaaguguggaggcuuuuccucaauccaacgcaguaauccaagaugaggaacgggauauaccagaacgaucauggaauagcggauacgaauggauaacugacuuuccugggaagacuguaugguucgugcccagcauuaaaucuggaaacgauauagcgaauugcuuacguaaaaacgggaaaagagucauacaacuaagucgaaaaacuuucgauacagaauaucagaagaccaaaaacaaugauugggauuauguaguaaccacagacauuagugaaaugggagcaaauuuuagagcugauagaguaauagauccuagaaggugcuugaaacccguaauauuaaaagaugguccagagcgaguaauauuagccggaccuaugccagucacggucgcuagcgcagcucaaagaagaggaaggauaggaagaaaucauaacaaagaaggcgaucaauauauauauaugggucaaccgcuaaacaaugacgaagaucaugcacacuggacagaagcuaagaugcuuuuagauaauauuaacacuccugaagguauaauuccggcucuguucgagccggaaagggagaaaagcgcagccaucgacggagaauaucgacuacgcggugaggcccguaaaacguuuguagaauugaugagaaggggugauuuaccgguaugguugaguuacaaagucgcaucggaaggguuccaguacucagauagaagaugguguuuugacggugaacgaaauaaucaaguauuggaagaaaauauggacguagaaauauggaccaaggaaggugagaggaagaaacucagaccaagaugguuagaugcacggacauacucagauccgcuggcacuaagagaauuuaaggaauuugccgcuggccgcagaagcgugagcggagauuugauuuuagagauagguaaacuaccucaacaucugacacaaaaagcucaaaaugcccuagauaacuuaguaaugcugcauaacucggaacaaggaggcagagccuauagacaugcaauggaggaauuaccugauaccaucgaaacccuuauguuacucgcacucauagcaguacuaacagggggugucacccucuucuuucuuucagguagaggcuuaggaaaaacaaguauaggauugcuguguguaauggcgucgucaguguuauuauggauggcuagcguggagccccauuggauagcagccucuauaauucuagaauuuuucuugaugguucuucuuauaccagagccggauagacagaggacaccacaggauaaucaguuagccuacgugguaauaggguugcuuuucaugauacuaacgguggcugcgaacgaaaugggccuucuugaaacuacgaagaaagauuuagggauaggccacgucgcuguggaaaaccaucaccaugccgcaaugcuagacguagaucugcauccagcaucugcuuggacauuguacgcugucgccacgaccauuaucacaccuaugaugaggcauacuauagaaaauaccacagcaaauauaagucuaacagccaucgcgaaucaagccgcgauauuaaugggguuggauaaaggauggccuauaagcaaaauggauauuggugugccucuucuagcacuaggaugcuacagucaaguuaacccuuugacuuuaaccgcugcaguucugauguugguagcacacuaugccaucauaggacccggccuacaggccaaagcaacuagagaagcacagaaaagaacggcagcugggauaaugaaaaauccaacagucgacggcauaguggcgauagauuuagauccaguaguauacgacgcaaaauucgagaagcaauuaggacaaaucaugcuacucauucuaugcaccucccaaauucucuugaugagaacuaccugggcucuuugugaaagcauaacucuagcuacgggaccacuaacaaccuugugggaggguucaccggggaaguucuggaacacgacuauagcagugucaauggcaaauauauuccgagguaguuauuuagcgggggcuggauuagcuuucucuuugaugaaaagucuagguggagggaggcgagggacuggugcgcagggagagacacuaggcgaaaaguggaaacgacaauuaaaucagcucucaaaaucugaauuuaauaccuauaaaagaucaggcauaauggaaguggaccgaucugaggcaaaagagggcuuaaagagaggagaaacuacgaaacacgcgguuucaagaggaacagcuaaauugagaugguuuguugaaagaaaucuagugaagccugaggggaaaguuaucgaucuuggaugcggacgagguggcuggucauacuauugugcuggauugaagaaaguaaccgaaguuaaggguuauacgaaagggggucccggucaugaagaaccaauaccgauggcgacguacggguggaaccuaguaaaauuacauucaggaaaagauguauuuuucauucccccagagaaaugugauacauuauuaugugauaucggggaaaguagcccgaauccuacaauagaagaaggaagaacccuuagaguacuaaagaugguggaaccuuggcucaggggcaaccaauucuguauaaagauccuaaauccguacaugccauccguaguugaaacacuggagcaaaugcaacgaaaacacggcggaaugcuaguacggaauccgcuguccaggaacaguacucaugaaauguauuggguuaguuguggcacagguaauauuguuucugcaguaaacaugacuucccgaaugcuacuaaaucgauuuacaauggcacauagaaaaccgacguacgaacgugauguggaucuaggagcaggaacaagacacguugcaguugaaccugaaguggcaaacuuagacaucauagggcaacgaauugaaaauauuaaacaugaacauaagaguacuuggcacuacgacgaagauaauccauauaaaacgugggcuuaucauggcucuuacgaaguaaaaccgagcggaucagcguccaguaugguaaauggaguaguuaaauuauuaacaaaaccgugggauguuauuccaaugguaacccaaauagccaugacagacacgacaccauuuggucaacagcguguauucaaggaaaaaguggacacaagaacaccaaaagcuaaacgagggacagcccaaauaauggagguaacugcuaaaugguuauggggcuuuuugucgcguaacaagaaaccaagaauaugcacgcgagaagaauuuacacggaaaguacguagcaaugcagccauaggagccguauuugucgacgaaaaucaauggaauagugccaaagaagcaguugaagaugaaagauuuugggaucuaguacaucgagaaagagaauugcacaaacaagguaagugugccaccuguguauauaauaugauggggaaacgagagaagaaauuaggcgaauuuggaaaggcaaaagggucucgagcuaucugguauauguggcuaggggcuagauuccuggaauuugaggccuuagguuuuaugaaugaagaucauugguuuuccagagaaaauagccuuaguggaguagaaggagaagggcuucauaagcuaggguacauauugagagacauaucaaagaucccagguggcaacauguaugcggaugauaccgcggguugggauacacgcauuacagaagacgaucuacaaaaugaggccaggauaacagauaucauggagccugaacacgcuuuauuggcuaaauccauauuuaaguuaacguaccaaaauaaggucguaagaguccaacgaccagccaagaacgggacuguaauggauguaauuagccgacgagaccaaaggggaucaggacagguagggacuuauggcuuaaacaccuuuacuaauauggaagcgcaauugauaaggcaaauggaaagcgaaggcauauucucuccuucggaacuugaaacaccuaacuuagcugaaagaguccuugauugguuagaaaaauacgguguugaaagauugaagagaauggccauaucgggagaugacuguguaguuaagccgaucgacgaccgauucgcuacagccuuaaccgcacuaaacgauaugggaaaaguccguaaagauaucccgcaaugggaaccgucaaaagguuggaacgacuggcaacaaguaccguuuuguagucaucauuuccaucaacuaaucaugaaggacgguagagaaauugucgucccauguagaaaccaagacgagcucguaggucgagcuagaguuucgcagggcgcuggaugguccuuaagagaaacugcgugucucggaaaaagcuacgcacaaauguggcaacuaauguauuuucacaggagagauuuacgauuagcagcgaaugcaauauguagcgcaguaccgguagacuggauacccaccucuaggacgacuuggagcauacaugcgcaucaccaauggaugacgacugaagauaugcuuagcguauggaauaggguauggauagaagaaaauccguggauggaagacaaaacgcauauaucaucguggggagacgucccuuauuuaggcaaaagggaggaccaauggugcggcagcuugauaggccuaacagcccgagcuacgugggcaaccaacauccaaguggccaucaaucaaguaaggcgucuaaucgguaaugagaacuaucuagauuacaugacgucaaugaaacgauucaaaaaugagucugaccccgaaggagcucuaugguaa

SEQ ID NO: 21823 - RNA, 9879 nt, Artificial Sequence
  derived and/or modified CDS sequence (opt6) from DENV-1__JF937609__SS-prME
ucagugacaauguuguuaaugcugaugccuacagcguuagcguuucaccuaacgacucgaggcggugaaccucacaugauugucaguaaacaagaaagaggaaaaaguuuguuauuuaaaacaucugcgggagugaacauguguacucucauugcuauggaucuaggagaauuaugcgaagacacuaugacauauaaauguccacgaauuacagaaacggaaccagacgacgucgauuguuggugcaacgcgacugauacuuggguuacauacgguacaugcucgcaaaccggggaacaucgaagagauaaaagaaguguagcacucgccccacaugucggccuaggccucgaaacacgcacagaaacuuggaugaguuccgaaggggcguggaaacaaauucagagaguugaaacaugggcgcuacgacacccaggauucacugucauagcauuguuuuuagcacaugcgauaggaacaucaauaacccaaaaaggaauaaucuuuaucuugcucaugcuaguaacaccgucaauggcuaugcguugugugggaauaggaagucgagauuucguugaaggguuaaguggagcaaccuggguagaugucguauuagaacacgguucuugcgugacaacaauggcaaaagacaaaccuacuuuagauauugaacugcuuaaaacagaaguuacgaauccagcuauuuuaagaaaauuaugcauagaagcgaaaauuaguaauacgacaaccgauucccgauguccaacacaaggagaggcaacuuuaguagaggaacaagaugcuaauuucgugugcagaagaacguuugucgauagaggaugggggaauggauguggucuguuugguaaaggcagcuuaauuacuugcgcaaaguuuaaauguguaacaaaguuagagggcaaaauaguacaguaugagaauuuaaaauauagcgugauaguaacuguucauacaggcgaucaacaucagguaggcaacgaaucaacagagcaugggacaacggccacuauaacaccgcaagccccgaccacugaaauccaauuaacagauuauggagcacucacguuggauugcagcccaaggaccggcuuagacuucaacgagaugguccuacucacuaugaaagagaaaagcugguuaguacauaagcaaugguuuuuagaccuuccacugccauggacaaguggcgcaaguacuucacaagaaaccuggaacagacaagaccuccuagucacuuuuaaaaccgcacaugcgaagaaacaggaagucgucguacuagguucucaagagggugcaaugcauacugcucuaacuggugcaaccgaaauccaaacaagcggaacaacgaccauuuucgccggacauuugaaguguagacuaaagauggacaaacuuacauugaagggcaugucuuacguaaugugcacaggaucguuuaaauuagaaaaagaaguagcagagacgcaacaugggacuguccuaguucagaucaaauaugaaggaacagacgccccaugcaaaauuccauuuucuacgcaagaugaaaaagguguaacacaaaacgggagauuaaucacggcaaauccgaucguaaccgacaaagaaaaaccaguuaacauugaagcugagccgccauuuggugaguccuacauaguuauaggugccggagaaaaggcguugaaauuaucaugguucaagaaagggaguucaaucgguaaaauguuugaggcuacugcucgcggugcucgccggauggcaauuuuaggugacacugcaugggacuuugguucuauagggggcguauucacaaguguagggaaauuaguacaucaaaucuuugguacugcuuacggcguucuauucucaggaguuaguuggacaaugaagaucggaauugguguacuccuuacauggcucgguuuaaauucaaggucaacgagccuaagcaugaccuguauugcaguuggccucgucacccuuuaccugggaguaaugguacaagcagacucuggaugugugaucaauuggaaaggucgugaguugaaguguggguccggaauauucguaacuaaugaaguacacaccuggacugaacaguacaaauuccaggccgauucuccuaagagguuaucugcagcuauaggaaaagcaugggaggaaggaguauguggaauaagaagugcuacccgucuggaaaauauaauguggaaacagauuaguaaugaauuaaaucacauucuuuuagagaacgacaugaaguuuacaguaguaguaggagauguagcgggaauuuuagcacaagguaaaaagaugaucagaccacaaccaauggaauauaaauacuccuggaaaaguuggggcaaagccaaaauuaucggggcagacguccaaaauaccacauuuauaauagauggaccaaauacaccggagugcccagaugaucaacgggcguggaacauaugggaggucgaagacuaugguuuugggauuuucacaacaaauauauggcuaaaacugagagauagcuacacacagguuugugaucacagauugaugucggcagcuaucaaagacucaaaagccguacaugcagacaugggauacuggauagaaucggagaaaaaugaaaccuggaaauuagcuagagcauccuuuauagagguuaaaacauguaucuggccgaaaucgcacacccuuuggucaaacggaguguuagaauccgaaaugauaauuccgaagauauauggggguccaauuucgcaacauaacuaccgaccuggcuacuucacgcaaacagcaggaccuuggcaucuaggaaagcucgaauuagacuucgaucucugugagggcacaacagucguuguagacgaacauugcggaaauagagguccaagucuccgcacuacuacuguaacgggcaagauaauacacgagugguguugucgcucguguacucuucccccacuuagauucagaggcgaggauggauguugguacgguauggagauaaggccagugaaagaaaaggaagaaaaucuugucaagaguaugguuucagcaggauccggugaaguugauaguuuuagcuugggacuucuuugcaucucaaucaugauugaagaaguuaugagaaguagguggaguaggaaaaugcucaugacugguacgcuagcuguauuuuuacucuuaauaaugggacaacucacauggaacgacuugauaagacuauguaucaugguaggggcaaaugcaucagaccggaugggaaugggcacaacauauuuagcacucauggcuacguuuaaaaugcgcccuauguuugcaguuggguuacuuuucagacgacucacaucacgggaaguacuacuuuuaaccauagguuuaaguuugguagcaucuguggaacucccaaauaguuuagaagaacucggcgacggguuggcaauggguauaaugauauuaaaauuauuaacugauuuccagagucaucaauuaugggccacucugcugagucugacguucauaaaaacaaccuuuucuuuacacuaugcauggaaaaccauggcaaugguauuaaguauaguuagccuauuuccccugugcuuauccacaacaagucagaaaacuacgugguuaccugucuuauugggcucucuaggauguaaaccucugacuauguuuuugauagccgaaaauaaaauauggggaaggagaucuuggccauuaaaugagggaauaauggcaguaggaauaguaucaauuuuguuaucuucacuccuuaagaaugacguuccucuagcggguccuuuaauugcaggagguaugcuuauugcguguuaugugauaagcggcaguagcgcugauuuauccuuagaaaaagcagcugagguuucaugggaggaagaagcugaacauucaggagcaucucacaacauauuaguugaaguucaagaugaugguacaaugaaaauaaaagacgaagaacgugacgauacgcuuacaauuuuauuaaaagcaacauuguuagccgucucgggcgucuauccccuuucaauaccugcaacucuauucguaugguauuuuuggcaaaagaagaaacagcguucugggguguugugggauacaccaaguccucccgagguugaacgcgcaguccucgaugaugggauauaccguauuaugcaacggggacuacuaggcagaucucaggucgggguagguguuuuccaagaaaacguauuccauacuauguggcaugugacucgcggagcaguauuaauguaccaggguaaaagauuggagccaucaugggcgaguguaaagaaagauuuaauaagcuacggagguggguggagauuacaaggaucuuggaacacuggagaagaaguacaagugaucgcuguugaacccgguaaaaaccccaaaaauguccagaccacuccugguaccuuuaaaacgccagagggagagguuggugcuaucgcacuagacuuuaaacccggcacaagugguucuccuauagugaauagggaagggaaaauagugggccuuuacggaaaugguguaguaacaacaaguggaacauaugucucagcuauagcacaagcaaaagcaucucaggaagguccacuuccagaaauagaagaugaggucuuucgaaaaaggaaucuaacaauaauggaccuacacccgggcucaggcaaaaccagacguuauuugcccgccauaguuagagaagcgauaaaacgcaaacuacggacauuaauccuagcaccaaccaggguaguagcaucagagauggcagaagcgcuaaaagguaugccaauaagguaucaaacgacagcgguaaagucagagcauacgggaaaggagauuguggacuugaugugucaugcaacuuucacuaugagauugcuaucaccagugaggguuccuaauuacaacaugauaauaauggaugaagcucauuuuacagacccuaguucaauagcagcacguggauauauaucaacacgaguaggaaugggugaagcugcugcaauuuuuaugaccgccacuccaccgggaucaguagaagcauucccacaaagcaaugcuguaauccaagaugaagaaagagauauaccagagagaucauggaacucagguuaugaauggauaacagauuuuccagguaaaacgguaugguuuguaccuagcaucaaaucagguaaugauauugcaaacuguuuacggaaaaaugggaagagagugauacaacuauccaggaaaacguuugauacugaauaucagaagaccaaaaauaaugauugggauuauguaguaacuacagauauuagcgagaugggggcaaauuuccgggcggauaggguaauagacccacgcagaugucucaaaccggucauucuaaaagacgggccggaaagaguaauucuugcaggaccaaugccaguuacaguugcgucagcggcgcaacgaagagggaggaucgguagaaaccacaauaaggaaggggaucaauacaucuauaugggucaaccuuuaaauaacgaugaggaucacgcacauuggacugaagcaaaaaugcucuuagacaauauaaauacaccagaagggauaaucccagcauuauucgaaccagaacgggaaaaauccgccgccauagauggcgaguacagacuaagaggugaagcacggaaaacauucgucgaacugaugcgcagaggagauuuaccagucugguuaaguuacaaaguagcaagcgaaggauuccaauauagcgacagaagauggugcuuugauggugaaaggaauaaucaaguguuagaagaaaauauggacgucgaaauuuggacaaaagaaggagagcguaagaaauugcgaccuaggugguuagaugcacgcacguacucggauccacuagcuuuaagagaauuuaaagaguucgccgcaggacguagaucggucucuggugaccuuauccuagaaauaggaaaguuaccucagcaucuuacccaaagagcacagaacgcucucgauaauuuaguuaugcugcauaacucagaacaaggaggucgagcuuacagacaugcaauggaagaacugcccgauacaauugaaacauuaaugcuucuugcacuaauagcuguauuaacuggaggaguaacucuauuuuuccuguccggaaggggccuagguaaaacaucuauugguuuacuaugcgugauggcuaguucuguauugcuauggauggcaucuguagaaccucauuggaucgccgccaguaucauucuugaguucuuucugaugguacuauuaauaccagaaccugaucgacaaagaacaccccaggauaaucaauuagcguacguaguuauaggguugcuuuuuaugauacucacuguugcagcaaacgaaaugggccuuuuagaaacgacaaagaaagaucuagguauaggucauguugcaguagguaaccaucaucaugcagcuaugcuagauguggauuuacacccggcaagugcauggacacuauaugcuguugccaccaccaucauaaccccaaugaugcgucauacaauugaaaauacuacagcuaacauuucucuuaccgccauugcaaaucaggcggcaauacucaugggucuagacaaaggcuggccaauaaguaaaauggauauagguguaccuuugcuagcguuaggauguuacagccaaguaaauccucugacauuaacagccgcaguauuaaugcuuguugcgcauuaugcuauuauugguccuggacuucaagcgaaagccacgcgagaagcgcagaaaaggacagcagcugguauaaugaaaaacccgacaguugauggcauuguggcgauugacuuagacccaguaguguacgaugcgaaguucgaaaaacaguuaggucaaauuaugcuuuuaauauuauguacuagccagauccuacuaaugagaacgacgugggcauuaugcgaaucaaucacacuggcuacaggaccccuuacaacucugugggaagguaguccggguaaauucuggaauacaacuauagccguaucaauggcaaauauauuuagaggaucauaucuggcuggagccggacuagcauucagcuuaaugaaaagccuuggaggagggaggcgagguacgggugcacagggcgaaacacucggugagaaauggaaaagacaauugaaccaauuaucaaaaagugaauuuaauaccuauaaaaggagcggaauaauggagguugaccgaucugaagcgaaagaaggccucaaaagaggugagacuaccaaacaugcaguaucccguggcacugccaaauuaagaugguuuguugaaaggaaccuagugaagcccgagggaaaaguaauagaucugggaugcggacgaggcggcuggucauacuauugcgcugggcuaaagaaaguaacugaagugaaaggauauacuaaaggugguccuggucacgaagaaccuauucccauggcaacauaugguuggaauuuagucaaacuacauucaggaaaagauguguuuuucauuccuccugaaaagugugacacacuauuaugcgacaucggcgagucaaguccgaacccaaccauagaggaaggucguacguuacgaguccuaaaaaugguagagccuugguugagaggaaaccaauuuuguauaaaaauacuaaauccuuacaugccaagugugguggaaacauuagagcaaaugcaacgaaaacacggagguaugcuagugaggaacccuuugagcagaaacuccacacaugaaauguauugggugucaugugggaccggaaauauaguuucagcagucaauaugacaaguaggauguuacuuaaucgauuuacaauggcacaccgaaaaccaacuuacgaacgagacguagauuugggagcagguacucgacauguugcaguggaaccugaaguagcgaauuuagacauaauugggcagcguauagaaaacaucaaacacgaacauaagucuacuuggcauuacgaugaagauaacccauauaaaacaugggccuaucacggcucauaugagguaaaaccuuccggcucagcaaguagcauggucaacggcguuguuaaacuauuaacgaaacccugggacgugaucccuaugguaacgcagaucgccaugacagacacuacuccauucggacaacaaagggucuuuaaggagaaaguagauacccguacaccaaaagcuaagcgugguacggcccaaauuauggaaguaaccgcgaaaugguuguggggauuuuuaucaagaaauaaaaagccacgcauuuguacgagggaggaguuuacaagaaaaguaagaucuaacgccgccauuggcgcaguuuuuguagacgaaaaucaauggaacucggcuaaggaagccguggaagacgaacgauuuugggaucuuguacaccgagaaagggagcuacauaagcagggcaaaugcgccacuugcguauauaauaugaugggcaagagagagaagaaacucggagaguucgguaaggcaaaaggaucccgagcaauuugguauauguggcugggagcaagguuucucgaauuugaagcacuaggguuuaugaacgaagaucacugguuuagcagagaaaauucacugagugguguugaaggagaaggauugcauaaauugggauauaucuuaagagacauuucgaaaauuccugguggcaauauguaugcagacgauacugcagguugggauacuagaauuacggaagacgaucuacaaaaugaagccagaauuacugauauaauggaaccagaacaugcauuauuagcacguagcaucuucaaacuaacauaucaaaauaagguaguuagaguacaacguccggccaaaaacgggacuguuauggaugugauaucaagacgggaucaacgcgguagcggacaaguaggaacauacggcuuaaacacauucacaaacauggaggcacagcuuauaagacaaauggaaagugaaggaauauuuucuccaucugagcuugaaacacccaaucuggcagagcguguacucgauuggcuagaaaaauacgggguagaaagauuaaaaaggauggcuaucagcggcgacgauugcguaguuaagccaauagacgaucgguucgcgacagcccugacagccuugaaugauaugggaaaaguacgaaaagacauaccacagugggagccaucuaaaggauggaaugacuggcagcaaguuccauucuguucgcaucacuuucaucaauugaucaugaaagacgggcgagaaauuguaguacccuguaggaaccaagaugaacugguaggacgggcgcgaguuucacaaggugccggguggagccugcgagaaacagccugucucggaaaaucuuaugcacagauguggcaauuaauguauuuccaucgucgggauuuacgccuagcugccaaugcgaucuguuccgcugugccaguagacuggauaccuacuucucgaacuacguggaguauacacgcacaucaucaguggaugacaacagaggacaugcuaagcguuuggaauaggguauggauugaggaaaacccuuggauggaggauaagacacauaucucaagcuggggcgacgugccauaccuaggcaaacgagaagaucaauggugcggcagccuuauuggauuaacggcgagggcgacgugggcaaccaauauucagguggcuauaaaucaaguccgaagacuaauagggaacgagaacuaucuggauuauaugacuucaaugaaaagauuuaaaaaugaaagcgacccugagggggcucuuugguga

SEQ ID NO: 21824 - RNA, 9879 nt, Artificial Sequence
  derived and/or modified CDS sequence (opt6) from DENV-1__KF921949__SS-prME
agcguaacgaugcugcuuauguugaugccgacugcacucgcauuucacuuaacuacuagaggaggagaaccucauaugauuguuucuaaacaagaaagagggaaaucauuauuguuuaaaacuucagcugguguaaauaugugcacauuaauagcaauggaucuuggagaacuuugugaagacacgaugacauauaaaugucccagaauaacggaaacagaaccugaugauguagauugcuggugcaaugccacugauacuuggguaacauaugguaccugcagucagacgggugaacaucgacgugacaaaagguccgucgcuuuggcaccgcacgucgggcuugguuuagaaacacgaacugaaacuuggaugucaagugagggugcauggaaacagauccaacggguagaaacaugggcacuaagacauccagguuucacaguaauagcacuauucuuagcacaugcaauugguaccuccaucacacagaaaggcauuauuuuuauacucuuaaugcuaguaacaccaucuauggcaaugagaugcguagggauuggaagucgggauuuuguugaaggucucucuggagcuacuuggguagauguaguuuuggaacauggaucauguguaacaaccauggcaaaagauaaacccacccuugauauagaacuauuaaaaacugaagucacaaauccagcaguuuugagaaaacuaugcauugaagcaaaaauaaguaacacaacaacagacuccagaugccccacccaaggagaggcuaccuuagucgaagaacaagacgcaaauuuuguuugucgccgaacauuugucgauagagguuggggaaacggcuguggacuauucgguaaagguagccuuauuacuugcgcaaaguucaaauguguuaccaaauuagagggaaagaucguccaauacgaaaaucuaaaguauucuguuauaguuacaguucauacgggugaccaacaucaaguagggaaugaaaguacggagcauggaacaacugccacuauaacaccucaggcaccgacuacugaaauacaacucacagacuacggagcccucacacuggauugcaguccuaggacuggcuuagauuucaacgaaaugguucugcuaacaaugaaggaaaaaucaugguuggugcacaagcagugguuucuagaucuuccuuuaccguggacaucaggugcaucuacuagccaagaaacauggaauaggcaagauuuguugguuacguuuaaaaccgcucaugccaagaaacaagagguaguaguguuagggucccaggaaggugccaugcauacagccuugacaggagcaacugaaauccaaacuucagggacuacaaccaucuucgcgggccaucuuaaauguagacuuaaaauggauaaacuaacacuaaagggaaugaguuaugugaugugcacugguaguuucaaauuagaaaaagaaguugcugaaacucaacacggaacgguauuaguccaaauaaaauaugaagguacagaugcuccauguaaaaucccauucucaacacaggaugagaaagguguaacucaaaaugggcgauuaauuacggccaauccgauagugacagacaaagaaaaaccggugaacaucgaagcagaaccgcccuuuggggagucauacauaguaauaggggccggcgaaaaagcacuaaaauugaguugguuucggaaagguagcucuauuggaaaaauguuugaagcaaccgcaaggggagcacggagaauggcaauucuaggggauacggcuugggauuuuggcucaaucggaggagucuuuacaucuguaggaaagcuaguacaucagauuuucggaacagccuauggcguuuuauucagcgggguaucuuggacaaugaagauugggauuggagugcuuuugaccugguugggacuaaauucacguagcacgucccucagcaugacuuguaucgccguaggucuagugacuuuguauuuagggguaaugguacaagcagacaguggaugugucauuaacuggaagggaagggaacuuaaauguggcaguggaauauucguaacuaaugaagugcacacauggacagagcaauacaaguuccaagcggauucaccuaaacgguuaagugcggcaauaggaaaggcaugggaggaagguguaugugggauucgcucugcaacucggcuggagaauaucauguggaaacagauuuccaacgaguuaaaucacauauuacuagagaacgacaugaaauucacaguagugguuggggacguuacgggcauucuugcucagggaaagaaaaugauuagaccacaaccaauggaguacaaauauaguuggaaaucauggggaaaagccaaaauaauaggagcagacguccagaacacaacauuuaucaucgauggaccaaauacacccgaaugccccgacgaucaaagagcauggaauauaugggaagucgaggauuauggauuugggauauucacaacaaacauuugguugaaauuaagagauagcuacacgcaaguaugcgaccaccgcuuaaugagcgcagcaauaaaagacuccaaagcaguucacgcggauaugggauacuggaucgaaagugagaaaaacgagacuuggaaacuugcccgugcguccuuuaucgaagucaagacuuguauauggccgaaaagucauacacuaugguccaauggaguacuagaaucagaaaugauaauaccgaagaucuaugggggaccuauaucucaacacaauuacagacccggguauuuuacacaaacggcgggaccguggcacuuagguaaauuagaauuagauuuugaucuaugugagggaaccacagucguuguugaugaacauugcgguaauagaggcccaucacuacguacaaccacagucaccgggaaaauaauccacgaauggugcugccguucaugcacacuaccgccauugagauuuagaggagaggacgguuguugguauggaauggaaauaagaccuguuaaagaaaaagaagagaaucuaguaaagucuaugguaagugcugguuccggagaaguagauuccuuuagucuagggcuucuauguauauccauuaugauagaggaaguuaugcggucacgauggucaagaaaaaugcugaugacgggaacacuagcgguauuucuacuauugauuaugggucagcuuacauggaaugauuuaauaagguuauguauaauggugggagcaaacgccucagauagaauggguaugggaacuaccuaccuggcccuaauggcuaccuuuaaaaugcgaccaauguuugccguuggauuacuuuuccgacggcuaacaagucgugaagucuuacuccuuacuauuggacuaucuuuaguggcuucaguagaguuaccaaacucauuagaagaauugggugauggacuagcuauggggauuaugauucuaaaguuguuaacggacuuucaaagucaccaauuaugggccacauuauuaucacuuacauuuauuaaaacuacauucucuuuacacuacgcguggaagaccauggcaaugguacuaucaauaguaaguuuauuuccccuaugcuuaaguacaacuucacagaagacuacuuggcuuccaguacuuuugggaucauugggcuguaaaccguuaacgauguuucuuauugcagaaaacaagauaugggguagaagaaguuggccguuaaaugagggcauuauggcggugggaauaguauccauuuugcugaguucacuacugaaaaacgauguucccuuagcagggccacuaauugcgggugguaugcucauugcaugcuacguaauuucgggaaguucagcagaccuuagccuugaaaaggcagcagaagugucaugggaagaggaagcagaacacaguggugccagucauaauauacucguagaaguucaggacgacgguacgaugaaaauaaaagacgaagaacgugacgauacacuaacaauucuucuaaaagcgacauuacuugccgugucaggcguguacccucuuucuauccccgcgacuuuauucguuugguacuuuuggcaaaagaagaaacaacgcucaggagucuugugggacacgccgucaccaccagaagucgagagagcgguacuagaugacggcauuuaucggauuaugcaaaggggucuucuaggaagaucacaagucgguguuggugucuuccaagagaauguauuccauacaauguggcacguaacuagaggugcaguauugauguaccagggaaaaagacucgaaccaucaugggcaagcgucaagaaagaucugauuaguuauggagguggauggagauuacaaggcucuuggaauacaggcgaggaaguacaaguuauagccguugaaccgggcaaaaacccaaagaauguucaaaccgcaccaggaaccuuuaaaacaccagagggcgaaguuggggcgauugcccuugauuucaagccaggaacaucaggaaguccaauaguaaacagagaaggaaagaucguagggcuguacggaaacggcgucguaacuacaagcgguacauaugucucagcaauagcacaagcgaaagcaagucaagaaggcccuuuaccagaaauagaagacgaaguuuuucgaaaacggaacuuaacaauuauggaccuucacccuggaucugguaagacaagaagauacuugcccgcaauagugcgugaggcuauuaagaggaaguugcguacgcuaauccuagcaccuacgagaguagucgcaagugaaauggcagaagcauuaaaggggaugccgauaagauaucaaacaacggcuguaaaaagugaacauacgggaaaagaaauaguagaccuuaugugucaugcuacauucacaaugagauugcuaucgcccguucggguuccaaauuauaauaugaucaucauggacgaggcucauuuuacagacccgucaucuauugcagcaaggggauacauuucuaccagaguaggaaugggagaagcugccgcuauauuuaugacagcaacaccuccaggcagugucgaagccuuuccacaauccaacgcugucauacaggacgaggaacgugauaucccagaacgcuccuggaauagugguuaugaauggauaaccgacuucccgggaaaaacggucugguucgucccaaguauuaaaagcggaaaugacauugcaaacugcuugaggaaaaaugguaaaaggguaauacaguugucucgaaaaacauuugauaccgaauaucagaaaacgaagaacaacgacugggauuacguaguaaccacugauauaucggaaaugggugcaaacuuucgugcagauagaguaauagacccucgcagaugccugaagccagugauccuaaaggauggaccagaaagggugauccuagcuggaccgaugccagugacagucgcaucugccgcacagaggaggggacgcauuggaagaaaccauaacaaagaaggugaucaauacauauauauggggcagccgcucaauaaugacgaggaucaugcucauuggacagaagcuaagaugcuauuagacaacauuaacacaccagaaggcauuauacccgcacuuuucgaaccagaaagagagaaaucugcugcaauugacggcgaauacagguuacgcggugaggcuagaaaaacguuuguagaguugaugagaaggggugaccuaccuguauggcugucauauaaaguugccagugaaggauuccaguauagugaccgccgaugguguuuugauggagagagaaauaaccaaguuuuagaagaaaacauggauguggaaauauggacaaaagagggugagagaaagaaacuacgaccacgaugguuagacgcgagaacauauuccgauccucuugccuuacgugaguucaaagaguuugccgcagggcgccguagugucucgggagauuuaaucuuagagauagguaaacuuccacaacaucugacacagagggcgcagaacgcauuagacaaccuaguaauguuacacaacuccgaacagggagggagggccuaccgacaugccauggaagaauuaccugauacaauagaaacuuugaugcuccuugcauuaaucgcuguucuaacagguggaguaacccuuuucuucuugucagguagaggauuaggcaaaacaucaauaggacugcuuuguguaauggcuucaagugugcuuuuguggauggcaagcgucgagccccauuggaucgcugcgucuauuauccuugaguucuuuuugaugguguuauuaauuccugaaccugaucgacaacgaacgccucaagacaaucaacuagcauauguugucauaggccuacuuuuuaugauacuaaccguagcagcuaacgaaaugggacuuuuagaaacuacuaaaaaggauuugggaauaggacacgucgcaguugagaaccaucaucacgcugcgaugcuggacguagaucuacacccggcuucggcuuggacacuauaugcaguagcuaccacuauuauuacgcccaugaugcgacauacaauagaaaauacaacggcaaacauuuccuuaacugcaauugccaaucaggcggcuauuuugaugggauuagauaagggcuggccuauaaguaaaauggauauaggagucccucuguuagcauuagguuguuauucacagguuaacccacuuacacucacggcagcuguauuaaugcuuguagcccauuacgcaauaauaggacccggguuacaggccaaagcuacgcgagaagcucaaaagaggacggcagcuggaaucaugaagaacccaacgguagauggcauuguggcuauagaucuugaccccguaguguacgacgcaaaauuugaaaaacaacuuggccaaauaauguuacucauacuauguaccagucaaauucucuuaaugaggacaaccugggcauuaugugaaucaauuacauuagcaacaggaccucucacaacucuaugggaagguucaccaggaaaguuuuggaauacuaccauagcgguaagcauggcgaauauauucagagguucauauuuagcaggagcaggguuagcguuuucacucaugaaaagccugggcggaggacggcgugguacgggagcccaaggcgaaacucugggagaaaaguggaagagacaguugaaucaacuuaguaaaagcgaauuuaauaccuauaagaggagugggauuauggaaguagaucguucagaagccaaagaagguuuaaaaagaggagaaacaacaaaacacgcaguuucgcggggaacagcaaaacuacguugguucguugaacggaauuuagucaaacccgaggguaaaguuauagaccuaggauguggaagaggagguuggaguuauuauugugccggacuaaagaaaguuacggagguaaaaggauauacaaaagggggaccaggacacgaggaaccaaucccuauggcaacuuauggauggaauuuaguuaaacuccacagcggcaaagacguauuuuucaucccaccagagaagugugacacuuuauuaugugacauaggcgaaaguucuccgaauccgacuaucgaagaagggagaacucuucgcguccuuaagaugguagagccaugguugagaggaaaucaauucugcaucaaaauccucaacccuuacaugcccucaguuguagaaacauuagagcagaugcagagaaagcauggugguauguuagugcgaaacccacuaagcagaaauagcacacaugaaauguauugggugagcuguggaaccggcaauauuguuucugcagucaacaugacaagucgcaugcuacuuaauagauuuacuauggcccaucguaaaccaaccuaugaacgcgaugucgaucuuggggcaggaacaagacacguagcagucgagccagaaguugcuaacuuggauauuauaggucaaaggauugaaaauaucaaacaugaacacaaaagcacauggcauuaugacgaagacaacccauauaaaacaugggcuuaucacggaagcuacgagguuaaaccgucuggaucagcuuccaguauggugaauggaguaguaaagcuauugacgaagccgugggauguaauaccaaugguuacacaaaucgcuaugacugauaccacaccauucggacaacagaggguuuucaaagaaaaagucgacacucgcacuccaaaagccaaacguggaacagcacagauaauggagguaacugccaagugguuaugggguuuucucaguaggaauaagaaaccgcgaauauguacuagagaagaguuuacuaagaaaguaagaagcaaugcugcaauaggugcuguguucguagacgaaaaucaauggaacucagcuaaggaagcaguugaggacgaaagauucugggauuuaguacaccgggaaagagaauuacauaaacaaggcaagugugcuacaugugucuauaauaugaugggaaaaagagagaagaaauugggugaguucggcaaggcuaaagguaguagagcaauaugguacauguggcucggagcaagauuuuuagaauuugaagcucuuggguuuaugaacgaagaucauugguuuucgcgugaaaauucccucucuggcguggaaggagaaggcuugcacaaauuaggguauauauuacgagauaucaguaagaucccaggggguaacauguaugcggaugauaccgcuggaugggauacaagaauaacagaagacgaucugcaaaaugaagccagaaucacagacaucauggaacccgaacacgcucuauuggcaaaaaguauauucaaacuuaccuaucaaaauaagguaguaagaguucaacguccagcgaagaauggcacaguaauggacguaaucagucggcgcgaccagcgaggaagcggacagguaggaacauacggacuaaauacuuuuacaaauauggaagcccaauugaucaggcagauggaaucggaagguauauuuucaccuagcgaacuugaaacaccgaaccuagcagagagaguauuagauuggcuagaaaaauaugggguugaaagacuaaagcgcauggcaaucucaggggacgacuguguuguaaaaccaaucgacgauagauuugcaacagcacuaacagcgcuaaaugauauggguaagguccgaaaagauauuccucagugggaaccaagcaagggauggaaugauuggcaacaaguuccguucuguagucaccauuuccaucaacuuauuaugaaagauggaagagaaauaguaguccccuguagaaaccaggacgaauugguuggacgagcuagggugagucaaggugcaggguggaguuuacgugagacagcuugucucggaaaaucuuaugcucagauguggcaguuaauguacuuccauaggagagaccuaaggcuagccgcuaaugcuauauguagcgcagucccuguggacuggauaccaacaucucguacuacguggaguauacacgcucaccaccaguggaugacaacagaagacauguugucaguauggaauagaguuuggauugaagaaaaucccuggauggaagauaagacucauauuucaaguuggggagacguuccauauuuaggaaaaagagaagaucaguggugugguagucucauaggguugacagcgagggcuacaugggcuacuaacauacaaguugcgauaaaucaggugcgacgguugauugguaaugaaaacuaucuagacuauaugacaucgaugaaacgguuuaaaaaugaaucagacccagagggggcccuaugguaa

SEQ ID NO: 21825 - RNA, 9879 nt, Artificial Sequence
  derived and/or modified CDS sequence (opt6) from DENV-1__GU131747__SS-prME
agcguaacuauguugcuuauguuaaugccaacugcguuagccuuucaccuaacaacacgcggaggagaaccacacaugauugucagcaaacaagaaaggggaaaaucguuguuauuuaaaacuagcgccggugugaauaugugcacauugauagccauggaucuaggagaauuaugugaagauacaaugacuuacaaauguccuagaaucacagaaacugaaccugacgauguugacugcugguguaaugcaacagauacuuggguaacguacggaacauguucccaaacuggagaacacagaagagauaaaagaucaguggcauuagcuccacauguuggucucgguuuagagaccaggaccgagacuuggaugagcucagaaggagcguggaaacaaauccaacguguagagacuugggcucucagacauccggguuuuaccguaauugcuuuauuucuugcacaugcaauagguacuucaauaacucaaaaaggaauaauauuuauacugcuaauguuagucacgccaagcauggccaugagauguguagggauaggaucaagagacuuuguggaggggcuuucuggugcaacguggguggaugucguauuagaacacgggaguuguguaacgacaauggccaaagauaaaccaacauuagacauugagcuauuaaaaacugaaguaacuaacccggcagucuuaagaaaacuaugcauugaggccaaaauaaguaauaccacuacggacaguaggugcccuacccaaggagaagcaacucuagucgaggagcaagacgcaaauuuuguuugucgucgcacauuuguugacagagguuggggaaauggcugcggacuauuuggcaaaggcucauugauuacgugugccaaauuuaaaugugucacgaaauuagaggguaaaauuguucaauacgaaaauuuaaaauacaguguaauuguaacuguccauacgggugaucagcaucaaguaggaaaugaauccaccgaacacggcacgacagccacgauaacuccccaagccccaacaaccgaaauccaacuaacugauuauggagcucuuacguuagacuguucaccuaggacgggucuugacuuuaaugagaugguucuguuaacaaugaaagagaaaagcugguuaguccacaaacagugguuuuuagauuugccuuuaccauggacuucaggagcaaguacaucucaagaaacauggaauagacaggauuuguugguuacauuuaaaacagcgcacgcuaagaaacaagaaguaguagucuuagguucgcaagaaggagccaugcacacagcauugacaggugccacagaaauucaaacuucggggacuacaaccauuuuugcaggacaucucaaguguagauuaaagauggacaaauuaaccuuaaaaggaaugagcuacguaaugugcacaggcagcuuuaagcucgaaaaagaauuagcagaaacacagcaugguacugugcuagugcaaauaaaguaugaagggacggaugcuccgugcaaaaucccauucucuacgcaagacgaaaaggguguuacucaaaacgggcgacuaauaacggccaauccuauuguaacagauaaagagaaaccagucaauauugaggcugagccacccuuuggagaaucuuauauaguuauaggugcaggagaaaaagcucuaaagcuauccugguuuaagaaaggaucgucgauaggaaagauguuugaggcaacugcaaggggagcucgucguauggcuauauuaggagacacagcuugggacuucgggaguauaggugguguauuuacaucagcaggcaaauugguacaucaaauauucggaacagcuuaugggguauuauuuucggggguaucguggacaaugaaaauuggaauuggcguacuacuaaccuggcuuggucuaaauucaaggagcacaucccuaagcaugacuuguauugcaguuggccuaguaacucuuuaccucggagugaugguacaagcggacucuggaugugucauaaauuggaaaggaagagaauuaaaguguggaaguggaauauuuguaaccaaugaaguacacaccuggacugaacaauauaaauuccaagcagauuccccgaagaggcuuagugcagcaauaggaaaagccugggaggaagguguuugcggcauucguucggcgacucgacuugaaaauauuauguggaaacaaauuucgaaugagcuuaaccauauccuucucgaaaaugauaugaaauuuacuguggugguaggggacguagcagggauacuagcacaagggaagaaaaugauccgaccucaaccaauggaguacaaauauaguuggaaaucauggggaaaagcuaaaaucauaggggcagauguucaaaacaccaccuuuauuauugauggacccaauacacccgaaugcccagaugaccaacgugccuggaauauaugggagguagaagauuaugguuuuggaauuuuuacaacuaacauuuggcugaaguugcgugauucauauacgcaagugugugaucacagauugauguccgcagcaauuaaagauucaagagcgguucacgcggacauggguuacuggauagaaucggagaaaaacgaaacuuggaaauuagcucgcgcgucauuuaucgaggugaaaacauguaucuggccuaaaucgcauacgcuuugguccaauggaguucuugagagugaaaugaucauaccgaaaauauacggugguccuaucucucaacauaauuauagaccagguuauuucacucaaaccgcgggucccuggcaucuaggaaaacuugaauuagauuuugauuuaugcgaaggaacgacuguaguaguagaugaacauugcgguaauaggggaccaucauugagaacaacgacaguuacagguaagauaauacacgaauggugcugucggucuugcacgcuaccuccuuugcgauuuagaggggaagacgguuguugguauggaauggaaauucgacccgucaaagaaaaagaggagaacuuagugaaaaguaugguaucggcaggcagcggagaaguugacucauucucccuuggauuacuuugcaucucuauuaugauugaagaagucaugaggucaagauggucucggaaaaugcuaaugacaggcacuuuggcuguauuuuuccuacuaauaaugggacaacugacauggaacgaccuaauuagacuguguauaauggucggggcuaaugcuucagacagaauggguaugggaacaacauacuuggcacugauggccacuuuuaaaaugaggccgauguuugcagugggacugcuauucagacgacugaccagucgggaaguguuauuacuuaccauuggucuuucuuuagucgcaucaguugaacugccaaauucacuggaagaauuaggugacggcuuagcaauggggauuaugaucuuaaaguugcuaacggauuuucaaagucaccaacuaugggcaacguuauugaguuuaaccuucauaaaaacaacuuucuccuugcauuaugcauggaagacgauggcaaugguauugagcaucguuagucuguuuccgcuuugccuuucaacgacuucucagaaaacaacgugguuaccaguauuucuagguaguuuaggauguaagccguuaacaauguuucuuauugcagaaaacaaaauuuggggcagacgcucauggccucucaaugaaggaaucauggccguaggaauugugucaauucucuuaucaucuuuacucaaaaaugaugugccuuuagcaggaccuuuaaucgcaggcgguaugcugauugcauguuacguaauaucgggauccagugccgaucuaucucuagaaaaagccgcagagguuagcugggaagaagaagcagaacauucaggcgcaucacauaauauacucguagaagugcaagaugauggcaccaugaaaauaaaagacgaagagagagacgauacacuuacggucuugcucaaagccacacuuuuagcagucagcggaguauauccauuaucgaucccugcuacccuuuucguaugguauuucuggcagaagaagaaacaaagaucaggaguauuaugggauaccccaucaccacccgaaguggagcgggcgguauuagaugaugggauauauagaauuaugcaacguggacucuuagguaggagccaaguaggugugggaguuuuucaagaaaauguguuccacacaauguggcacguuacaagaggggcuguccuuauguaucaaggaaaaagacuugaaccgagcugggcaagugucaagaaagauuuaauaucauauggagguggguggaggcuacaagggagcuggaacacaggggaagaaguacaaguuauugcuguagaaccgggcaaaaaccccaaaaacguacaaacugcacccggcacauucaaaaccccagagggcgaagucggagccaucgcauuagacuuuaaaccaggaaccagugggagucccauugugaacagagaagggaagaucgugggccuuuacgggaacgguguugugacaacaucagggacauauguaucagccauugcucaagcaaaggcgucgcaagagggaccuuuaccugaaauagaggaugagguguuccgcaaacgcaaccucacgaucauggauuuacacccagggucggguaaaacaaggagauauuugccagcaaucgucagagaggcuauaaagagaaaacuaagaacauuaauucuggccccuacucgaguugucgcauccgaaauggcggaagcucuuaagggcaugccuauccguuaucaaacaacagcggucaaaagugaacauacgggaaaagagaucguagacuuaaugugucacgcuacauuuacaaugagacuacuaucuccuguucgaguuccaaauuacaacaugauaauaauggaugaggcacacuuuacagacccaaguuccaucgcugcacgagguuacauuucuacgagaguagggaugggggaggcugcggcaauauuuaugacugcaacuccuccagguaguguagaagcauucccacagucaaaugcaguuauccaagaugaagagagagauauacccgaacguucauggaauagugguuaugaauggauuacagacuuuccgggaaaaacugucugguuugugccgucaauaaagucggggaacgauaucgcaaacugcuugaggaaaaauggaaaacggguuauacaacuaucccguaaaacuuuugacacugaauaucagaagacaaagaauaacgacugggauuacguggugacaacugacauaagugagaugggagccaacuuuagagcagaccgaguaauagacccgcgacguuguuuaaaaccagucauuuuaaaagauggcccugaacgagucauauuagcaggcccaaugccuguaacaguugcaucagcagcacagaggagaggacgaaucggcagaaaccacaacaaagaaggugaucaauacauuuauaugggucaaccauuaaacaaugaugaagaucacgcucauuggacugaagcgaaaauguuauuggauaauaucaacacgccagaagggaucauuccggccuuguuugaaccggaaagagagaaaagugcagcgauugacggggaguacagacuuagaggcgaggcgcgaaaaacguuuguagaacugaugcgacguggugaucuuccaguuuggcuuucauauaaaguagcaucagagggguuccaguacucugacagaagaugguguuuugacggagaaagaaacaaucagguucucgaagagaauauggacguggaaaucuggacaaaggagggcgagcguaaaaagcuaagaccccgcugguuggacgcgagaacauacagugacccuuuggcucuacgagaauuuaaagaguuugcggcggggagacguucgguaucaggugaucuaauauuggaaauagguaaauuaccacaacaccuuacccaacgcgcacagaaugcuuuagauaaucuaguaaugcuacauaacagugaacaaggagggcgggcauauagacacgcaauggaagaacuaccggauacaaucgaaacguuaauguuacucgcuuuaauagcugucuuaacagggggaguaacauuauucuuucucagcgguagaggacuaggcaaaacgagcaucggacuauuaugcguaauggccucaaguguuuuacuauggauggcgucgguagaaccgcauuggauagccgcuucuauaauccuugaguucuuucuaaugguccuucuaauuccagaaccagauagacaaagaacuccgcaggauaaucaguuagcauauguaguuauuggacuccuauuuaugauacugacuguagcagcaaaugaaaugggccuacuagaaacuaccaagaaagaucuuggaauagggcauguagcaguggagaaccaucaucaugcagcgauguuagauguugaccuacacccggccagugcguggacccucuaugccgucgcaaccacaauaauaacgccuaugaugcgucauacaaucgaaaauacuacugccaauauaaguuugacagccauagcuaaccaggcggcuauuuuaauggguuuagauaagggcuggccuaucaguaaaauggauauaggcguuccucuacuugcgcuaggguguuacagccagguaaauccucuaacacucacagcugcaguccuaauguuaguugcacacuaugcuaucauuggaccagguuuacaagcuaaggcaacuagggaagcucagaaaagaacagccgcagggauuaugaaaaaccccacaguagauggaauuguagcaauugauuuagaccccgucgucuaugacgcaaaauuugagaaacaauugggccaaaucaugcuauuaauacuuuguacuucacaaaucuuauuaaugagaaccacuugggcccuaugugaaagcauaacucuagcgacuggaccucucacuacucucugggaggguuccccgggaaaauucuggaauacaacuauagcugucaguauggcaaauauauucagggguucguaucuagcuggugcaggguuagcauuuucccuuaugaaaucacuuggagggggcagacgagguacuggugcacaaggugaaacauuaggggaaaaauggaaaagacaacugaaccaauuaucaaaaagcgaauuuaauacguacaaaagaagugggauaauggaaguugauaggucagaagcaaaagaaggccuuaaaaggggcgaaacgaccaaacaugcgguuagcagagggacagcuaaauugcgaugguucguggagcgaaauuugguaaaaccagagggaaagguaauugaucugggcugugguaggggaggcuggucuuacuacugugcaggauugaagaaagugacagaagugaaaggcuauacuaaaggcgguccaggacaugaagaaccuauaccaauggcuacauauggguggaauuuagugaaacuccacucugguaaagauguauucuuuauacccccugaaaaaugcgacacacuacuuugugauauaggugagaguaguccaaauccuacaaucgaagaaggaaggacuuuaagaguauugaaaaugguagaaccauggcuucgaggaaaucaauuuugcauuaaaauauuaaacccauacaugccuucagugguagaaacacuagaacaaaugcagcgcaagcacggaggaauguuggugagaaaucccuugagccguaacucaacacaugaaauguauugggugucaugugggaccggaaacauaguguccgcagucaauaugacaucuagaaugcuauuaaacagauuuacaauggcucaucguaaaccaacauaugaaagagacguggaccuaggugcuggaacacgacauguagcaguugagccagaagucgcuaaccuugacauaaucggucaaagaauugaaaacauaaaacacgaacacaaaaguacauggcauuacgaugaagacaacccguauaaaacgugggcguaccaugguaguuaugaaguuaaacccuccgguucagcaucuagcaugguaaauggugucguuaaguugcuuacaaaaccgugggauguaauaccaaugguaacccaaauugccaugacagauacaacaccuuuuggacaacaaagaguauuuaaggaaaaaguggacacuagaacaccuaaagccaagcgagguacagcucaaaucauggaagucacagcaaaaugguuauggggcuuccuaagcagaaacaagaaaccgagaaucuguacuagggaagaguucacaaggaaaguaaggaguaaugccgcaaucggagcaguauuuguugaugaaaaccaauggaauagugcaaaagaggcagucgaagacgagcgguucugggaucuuguucauagagagagagaacuccauaaacaggguaagugugccaccuguguuuauaacaugaugggaaaacgagagaagaaauuaggcgaguucggcaaggcgaaagggucgcgcgccauaugguacaugugguuaggagccagauuuuuggaauuugaagccuuaggguuuaugaaugaagaucauugguucagccgcgaaaauucauuauccggaguggaaggagaaggacuucauaaacuugguuauaucuuaagggauauuagcaagauccccgggggaaacauguaugcagacgauacagccgggugggacacaagaauaacagaagaugacuuacaaaaugaagcacgaaucacugacauaauggaaccugaacacgcgcuucuagcaaaaucgauauuuaaguugaccuaccaaaauaaaguaguucgaguucaacgaccagccaaaaauggcacaguuauggauguaauaucuagaagggaucaacggggcucgggccaaguuggaacauauggguuaaauacguucaccaacauggaagcacaacuaauacgacaaauggaauccgaggguauauuuucccccagcgaacucgaaacuccgaaccuugcggaacgaguacuagauuggcuagaaaaacaugggguugaaagauuaaagagaauggcaauuaguggagaugauuguguuguaaaaccaauagaugauagauuugcaaccgcucugacugcccugaaugacaugggaaaaguucgcaaagacauuccacaaugggaaccaucaaaaggcuggaaugacuggcagcagguaccguucuguucacaccacuuucaucaguuaauuaugaaagauggaagagaaauuguaguaccuugucguaaccaggaugagcuaguuggcagagcuagaguaucgcaaggugcaggauggucucugcgcgaaacagcuuguuuaggaaaaagcuacgcccagauguggcaauugauguauuuucaccggcgcgacuuacgcuuagcagccaacgcgauuugcagcgccguaccaguugacuggauaccaacuucucguacaacauggaguauacaugcacaccaccaguggaugacuacugaagacaugcuaucaguauggaauagaguauggauagaggagaacccauggauggaggauaaaacucauaucaguaguuggggugacguuccauaccucgguaaacgugaagaucaguggugugguaguuuaauaggucuaacagcucgugcaacuugggcaacaaauauacaaguagcaauuaaccagguuaggcgauugauagggaacgaaaauuaccuugauuacaugaccaguaugaaacguuucaagaacgaaagugacccggaaggggcgcuaugguga

SEQ ID NO: 21826 - RNA, 9879 nt, Artificial Sequence
  derived and/or modified CDS sequence (opt6) from DENV-1__GU131748__SS-prME
ucggucacuaugcuauucauguuagugccaacugccuuagcuuuccaccuuaccacccgcggaggggaaccucacaugaucguaucaaaacaagaaagagggaaaucacucuuauuuaaaaccuccgcaggaguaaauauguguacauuaauagccauggaucuaggagaauuaugugaagacaccaugacauauaaaugcccgcguauaaccgaaacagaaccggacgauguggauuguuggugcaaugcaacggacaccuggguaaccuaugguacauguucccaaacuggagaacacaggagagauaaacggucggucgcccucgccccacauguugggcuuggauuagaaacgagaacagaaacauggaugucauccgaaggagcauggaaacaaauccaacgaguggaaacgugggcacugaggcaccccggcuucacagugauugcauuauuucuagcacaugccauugggacaucaauaacucaaaaagggaucaucuuuauauugcucaugcuaguaacacccagcauggcgaugcgaugcgucggaauuggcucccgcgauuucgucgaaggauugaguggagcuacauggguugacguaguuuuagaacauggaucgugugucacgacgauggccaaagauaaacccacacucgauaucgaauuacuaaaaaccgaagugacuaaccccgcuguguuacgaaaacucuguauugaagcgaaaauaucaaacacaacaaccgacagcagauguccaacacagggagaagccacgcuaguggaagaacaagacgcaaauuuuguguguaggagaacauuugucgaccgugggugggggaaugguugcggguuauuuggaaaaggaucuuuaauaacgugugcaaaauuuaaauguguuacaaaauuggaaggcaaaauaguacaauaugagaauuuaaaauacagugucauuguuaccguacauacgggugaccaacaucaaguuggcaacgagucaacagaacaugguacgacagcuacaaucacaccccaagccccuacaaccgagauacaacuuaccgauuauggagccuugacacuagacuguucaccacgaacuggacuggauuuuaaugaaaugguacuucucacgaugaaagagaaauccugguuaguacauaaacaaugguuccuggauuuaccauuacccuggaccaguggagcaaguacaagccaagaaacauggaauagacaagaucuguugguaacauucaaaacagcucaugcgaagaaacaggaaguaguaguccuagggagccaagaaggugcuaugcacacugcacuuacuggcgccacugaaauacagacaagugggacaacaacaaucuuugccggccacuuaaaauguaggcuuaaaauggacaaauuaacacuuaaagguaugucuuacguaaugugcacugggucuuuuaaauuagaaaaagaaguugcagaaacacaacacgguacaguacuugugcaaauaaaauacgagggaacagacgcaccauguaaaauacccuucuccacacaagacgagaaaggagucacucaaaacggacguuugauaacugcgaauccaauaguuacugauaaagagaaaccuguaaacauagaagccgagccaccuuucggggaaucauacauugugauaggcgcuggagagaaagcauugaaauuaucuugguuuaagaaaggaaguaguauugggaaaauguucgaggcaacagcaagaggagcaaggcguauggccaucuugggagauacagccugggauuucggaaguauagggggaguguuuacaaguguaggaaagcuaguacaucaaauuuuuggaacagcguauggaguccuguuuuccgguguaucauggacaaugaaaauaggaauaggaguacuacuuaccuggcucggucuaaacucaagaucuacaucucuaucuaugaccuguauugcgguuggacugguuacauuauauuuaggaguaaugguacaagcggacucaggcuguguaauaaacuggaaaggucgagagcuaaaaugcgguaguggcauauuuguaacaaacgaaguacacacauggacagagcaauauaaauuucaggccgauucgccaaaacgucuuagcgcagcuauaggaaaggcuugggaagaagguguuuguggaaucagguccgccacucgacucgaaaauauaauguggaagcagauuucgaaugaauuaaaucauauccuacuugaaaaugacaugaaguuuacugucguagugggcgauguagcugggauccucgcgcagggcaagaaaaugauacggccucaaccaauggaauacaaguacuccuggaaaaguugggggaaagcaaaaauaauuggugcggauguacaaaauacuacauucauaauagauggacccaauacuccugaguguccagaugaucagagggccuggaauaucugggaaguagaggauuauggauuuggcauauuuacuacaaauauauggcuuaaacuaagagacagcuauacacaaguuugcgaccaccgcuuaaugucugcggcuaucaaggacucuaaagcaguucaugccgauaugggauauuggauugaaagugagaaaaaugaaacauggaaguuggccagagcaucguuuauugaagucaaaacaugcauuuggcccaaaucacacacuuuauggucaaacgggguccuagagagcgaaaugauaaucccuaaaauauaugguggacccauaucccagcauaauuaucggccaggauacuucacacaaacggcgggucccuggcaccugggaaaacuagaacuugauuucgaucucugcgagggaacgacuguagucguagaugagcacugcggcaaucgcggcccuucucuacgaacaacaacaguuacaggaaaaauuauacaugaaugguguuguaggagcuguacccucccgccacugcgauuccgcggagaagacggaugcugguauggaauggagauacgaccugugaaggaaaaagaagaaaauuuagucaaaucuaugguaucagcagguucuggagaggucgauucguuuuccuuaggucuauuaugcaucucgauuaugaucgaagaggugaugagaagucguuggucucggaaaaugcuaaugacaggaacacuagcaguauucuuucuauugauuaugggucaacucacauggaaugaccuaauucguuuauguauuaugguuggagcgaacgcuagcgacaggauggguauggguacgacuuaccuugcguuaauggcaaccuuuaaaaugcggccgauguuugcggugggacuauuauucaggaggcuaacgucaagggaaguacuauuauugacuauuggauuaaguuuagucgcgagcguagaguuaccaaauucacuagaagaguuaggggacggcuuggcaauggguauaaugauccugaaauuguuaacugauuuucaaucucaucagcuaugggcaacauugcuuucauuaacauuuauaaaaacaaccuuuaguuugcacuaugcuuggaaaaccauggcgaugguuuuauccauaguauccuuauucccccuguguuuaucaacaacaagucagaaaacgacaugguuaccuguacuauuggguucguuaggaugcaaaccauuaacgauguuuuugauugccgaaaauaagaucuggggcagaaggagcuggccucuaaacgaaggaauaauggccguaggcauuguaaguauacuguuaaguucauuacuaaagaaugacguucccuuagccggaccauugauugccgguggcauguugauugcgugcuacguaauaucagggucaagugcggauuuaaguuuagagaaggcggccgagguaucgugggaagaagaagcagagcauucaggagcuagucauaacauuuuggucgaaguucaagacgauggaaccaugaaaauaaaagaugaggaacgugacgauacacugacuauccuguuaaaagccacccuauuagcuguuucggguguauauccauuauccaucccagcuacuuuauucguauggcacuuuuggcagaagaagaaacagagaagcggagucuuaugggauacuccaucaccgccugagguugaaagagcuguucuagaugacgggauuuacagaauaaugcaacgaggucuuuugggacgcucucaaguaggagucggaguauuucaagaaaacguuuuucacacaauguggcacguaaccagaggugcuguccuaauguaccaagguaagcgauuggaaccaucuugggcuucagucaagaaagaucuaauuucguauggcggaggcuggcgucuccaagguuccuggaacacuggugaagaaguccaaguuauugcuguagaaccuggcaaaaauccgaaaaaugugcaaacagcuccaggcacauucaaaacacccgaaggugaaguaggagccaucgcgcuagauuuuaaaccuggcacaucuggaucaccaauaguuaauagagaagggaaaauaguaggacucuauggaaauggaguugugacuacaucugguacguauguaagugccaucgcacaggcuaaagcaagucaggaagguccauuaccagaaaucgaagaugaagucuucagaaaaagaaaucuaacaaucauggauuuacacccugguuccggaaaaacuagaagauaucuacccgcgauuguaagagaggcgauaaaaaggaaauuaaggacguuaauauuggcacccacaagaguuguagcaagugaaauggcugaagcacuaaagggaaugcccauccgauaccaaaccacugcuguuaagucagaacacacugguaaggaaaucguggauuugaugugccacgcgacauuuacuaugcgccucuuaucaccaguuagaguuccuaacuauaauaugauaauuauggaugaagcucauuuuacagauccaucgucaauagcagcacguggcuauaucucuaccagaguuggaaugggcgaagcugcagcaauauucaugaccgcaacgccaccaggaucaguugaggcuuuuccucaaucaaacgcuguuauacaagacgaagaaagagauauaccagaaagaaguuggaacucagguuaugaauggauaacggauuuuccaggaaaaacaguuugguucgucccaaguauaaaaagcgguaacgacauugcaaauugccuaagaaagaauggcaaacgcgucauccagcucucaaggaaaacuuuugauacggaauaccagaaaacgaaaaacaaugauugggauuaugucguaacgacugauauaagugaaaugggagcgaacuuccgcgcggaucguguaaucgauccgcgaagaugucuuaaaccaguaauacuuaaagacggucccgagcguguaauuuuagcggggccaaugcccguuacaguagcuagugcagcacaaagaaggggccgaaucggccguaaucacaauaaagagggagaucaauacauauauauggggcaaccacucaauaacgaugaagaccacgcacauuggaccgaagcaaaaaugcuauuagauaacauaaauacgccugaaggcaucauuccugcacuauuugagccagaacgggagaaaagugccgcgauugacggagaauauagacuaagaggggaggcucgaaaaacauuuguugaauuaaugagaagaggagacuuaccaguuugguuguccuauaaaguggcuucagaaggauuccaguacagugaucgccgaugguguuucgauggagaaaggaauaaucaagucuuagaagaaaacauggauguagagaucuggacgaaagagggagaacguaagaaacuuagaccaagaugguuagacgccagaacauauuccgauccacuugccuugagagaauuuaaggaauuugcugcgggccgacggaguguuucuggggaccucauuuuagaaauuggaaaguuaccccaacaucuuacacaaagagcacagaaugcccuugacaaccucguaaugcuucauaauucagagcaagguggaagggccuacagacaugccauggaagaacuuccagauaccauugaaacgcucaugcuacucgcucuaauugcgguacuaaccggagguguaacacuuuucuuuuuaagcggacggggacuugguaaaacuucaauagggcucuuaugugucauggcaaguuccguguuauuauggauggcaucuguagaaccucacuggauagcagccaguaucauuuuggaguucuucuuaauggugcuuuuaauaccagaaccugaucgccagagaacuccgcaagacaaucaacuggcuuacguugucauuggauuauuguuuaugauuuuaacaguggcagccaaugaaauggguuuacuugagacaacuaagaaagaucugggaauaggccauguagcuguugagaaucaucaccacgcugcaauguuagauguugaucuccauccggccucugcauggacacuauaugcugucgcgacaacuaucauaaccccgaugaugagacacacuauagagaauacuacagcaaauaucagcuuaacggcuauugccaaucaagcggccauucugaugggucuagacaaagguuggccaauaagcaaaauggauauuggugugccuuugcucgcgcuuggcugcuauucacaagugaacccacuuacacuuacugcggcaguucugauguugguagcacauuaugcaaucauuggacccggacuucaagccaaagccacacgagaggcacaaaaacgaacggccgcagguauuaugaaaaauccaacugucgacggaauugucgcaauugacuuagacccugucguauaugaugccaaauucgagaaacaauuaggacaaauaauguuauuaauuuuauguacaagccaaauuuuacuaaugcguacaacuugggcacugugugaaagcaucacccuagcaacggggccauugacgacuuuaugggaggguucaccugguaaauucuggaacaccaccauugccguaucaauggcaaauauauuccgagggucuuacuuagcgggagcgggacuggcguucagucuaaugaagucacuaggugguggaagacguggaacuggugcucaaggagaaacucucggugaaaaauggaaaagacaacucaaccaauuaucaaaauccgaguucaacacauacaaacgguccgggauaauggaaguagaucgaucagaagccaaagaaggacuaaaacguggagaaacgacaaaacaugcaguaagucggggaaccgccaagcugcguugguuuguagagagaaaccuaguaaaaccagaaggcaaaguaauagaucuaggcugcggcagaggaggauggaguuauuacugcgccggacuaaagaaagugacugaaguaaaaggcuacaccaaaggcgguccgggacaugaggaaccaauaccaauggcaacauauggauggaaucuuguaaagcuccacagcgguaaagacguguucuuuaucccaccagagaagugcgauacacuuuuaugugauauaggagaaucaucgcccaauccuacgauagaggaggggagaaccuuacgagugcuaaaaauggucgagccuuggcuaagagggaaccaauuuugcaucaaaauacuaaacccauauaugccaaguguuguggaaacucuugaacaaaugcaaaggaagcacggagggauguugguaaggaauccacuuucuagaaauucuacccacgaaauguacuggguaucaugugguacgggaaacaucguaagcgcaguuaauaugacgucgcgaauguuacucaacagauucaccauggcacacagaaagccaacuuacgaaagagacgucgauuugggagcaggcacucgacaugucgcagucgaaccagaaguagcaaaccucgauauaauaggucaaagaauagaaaauaucaaacacgagcauaaaagcacauggcauuaugaugaggacaacccuuauaaaacuugggccuaucauggcaguuaugaggugaaacccagcggcucagccucuucuauggucaauggcguagugaaauuacuuacaaagccgugggauguuaucccaaugguaacacaaaucgcgaugacggacacuacucccuuuggacaacaacguguuuucaaagaaaagguugauacccgcacaccaaaggcaaaaagagguacagcucaaauuauggaagucacugcaaaaugguuguggggauuucuaagucggaauaaaaagccgaggauauguacccgagaggaauuuacacgaaaaguacguaguaacgcagcaaucggggcaguauucguugaugaaaaucaauggaacucagcuaaagaagcgguagaggaugaaagauuuugggaucugguacauagagaaagggaacugcauaagcaaggaaagugugccacuuguguguauaauaugaugggaaagagggagaagaaauuaggcgaauuuggaaaagcaaaagguucgcgagcuauaugguauaugugguuaggagcuagauuccucgaguuugaggcccuaggguucaugaaugaagaucacugguucaguagagaaaacucgcuaaguggggucgaaggagaaggucugcauaagcucggauauauauuaagagauaucucaaaaauaccaggagggaacauguacgcugaugauacagcugguugggacacgagaauaacagaagaugauuuacagaaugaagcacguauaacugacauaauggaaccagaacacgcacuauuggcgaaaaguaucuuuaaacuaacauaccaaaauaaggucgugcggguccaaagaccagcgaaaaaugggacagucauggacgucauaaguagacgagaucaaagaggguccggacaagugggcacauacggacugaauacauuuacaaauauggaagcacaacuuauucgucagauggaaagugaaggaaucuucucccccagugagcucgagacaccaaaucuagcugagaggguucucgauuggcuggaaaaauauggggugaaaagacuuaaaagaauggcaauuaguggcgacgacuguguaguaaagccaauagacgauagauuugcaacugcccuaaccgcccuaaaugauaugggcaaggugaggaaagacauaccucaaugggaaccuaguaaagguuggaaugacuggcaacagguaccguuuuguagucaucacuuucaccaacuaauaaugaaagauggaagagaaauaguaguaccauguagaaaucaggaugagcuaguagguagagcgcgcgugucccaaggcgcaggauggagucuaagagagacugccuguuuagggaaguccuacgcacaaauguggcaacuuauguauuuccaucgucgugacuuaaggcuugcagcuaaugcaauuugcagcgcggugccgguagauuggauuccaacuucucgcacuacguggaguauacaugcucaucaucaauggaugacuacggaagauaugcucucugucuggaacaggguguggauugaagaaaauccauggauggaagauaaaacccauauaucaucauggggagacgugcccuauuuagguaagcgggaggaucaguggugcggcaguuugauuggacugaccgcccgagcaacaugggcaacgaauauucagguagcuaucaaccaaguaagacgucuaauaggcaaugaaaauuaucuagauuacaugacaagcaugaagagauucaaaaacgagagugacccugaaggagcacucugguaa

SEQ ID NO: 21827 - RNA, 9879 nt, Artificial Sequence
  derived and/or modified CDS sequence (opt6) from DENV-1__GQ868615__SS-prME
ucugugacuaugcuguuaauguuaaugccaacugcccuagcuuuucaucuaacaacgcgaggaggggaaccucacaugauaguuaguaaacaagaaaggggaaaaucauuauuguucaaaacuagcgcuggagucaacaugugcacacuaauagcaauggacuuaggugaacuaugugaagauacuaugaccuacaaauguccaaggauaacagaaacugaaccugaugauguugacugcugguguaaugccacggauacguggguaacuuaugguacauguucacaaacaggagagcaccgacgagacaaaaggucaguugcccuugcuccccauguuggacuuggauuggaaacccgcacggaaacauggaugucuucagaaggagcauggaaacaaauacaaaggguugaaacuugggcauuacgucacccuggguuuacaguaauagcacuauuucuggcacaugcuauugguaccucuauaacucaaaaaggaauaauauucauucuguuaaugcucguuacuccuaguauggcgaugagguguguagguauaggaaguagagacuucguagaaggacuaucaggagcaacauggguugauguaguucuugaacauggaucauguguaacaacaauggcaaaagauaaaccuacguuagauauagaacuucucaaaaccgaagucacuaacccugcuguguuaagaaaauuaugcaucgaagcaaaaauuucaaauacaacaacggauucaagaugucccacgcagggcgaagcgaccuuagucgaagaacaagacgccaacuucguaugccguagaacuuuugucgaccgggguuggggcaacggguguggcuuguuugguaaaggcaguuuaaucacuugugcuaaauuuaaauguguuacgaaacuugaaggaaaaauaguucaguaugaaaaucucaaauauaguguaauaguuaccguacauacaggugaucaacaucaaguugguaacgaaucgacggaacaugguacaaccgcaacaauaacaccacaagcgccuacaacagaaauccaauuaacagauuauggggcguuaacacuagacugcaguccuagaacgggacucgacuucaaugaaauggucuugcuaacuaugaaagaaaaauccugguuggugcacaaacagugguuucuugaccuaccacucccuuggacaaguggugccagcaccucccaagaaacauggaaucgacaagaccuauuaguuaccuuuaaaacagcacaugcaaagaaacaagaaguagucguuuugggaagucaagaaggugcgaugcauacagcauugacgggugcuacagaaauacaaaccagcgguacaacaacaauauuugcuggucaccuaaaaugcagacuaaaaauggacaaacuaacacucaaagguaugucuuacguaauguguacagguucauucaaauuggagaaagagcuggcagaaacacagcauggcacgguguugguacagauuaaguacgaagguacggacgcaccauguaaaauaccuuucucaacacaagaugaaaaaggcguuacucagaauggaagguuaauaacagcaaauccaauaguuacggacaaagaaaaaccagugaauauugaagccgaaccucccuuuggugaaaguuauauaguaauuggcgcaggggaaaaagcguuaaagcuaucaugguucaagaaaggaucuucaauuggaaaaauguucgaagcaacugccagaggggcucgaagaauggcaauacucggugauacagccugggauuuugguucgauuggugguguauuuacuucaguagguaaauuagugcaccaaauauuuggcacugccuauggcgucuuguucuccggcgugagcuggacuaugaaaauugguauaggaguacuacucacauggcucgguuuaaauucuagaucaacaagccuuagcaugacuuguauugcaguggguuuagucacacuuuaccuggggguaaugguucaagccgacucaggcugcguuaucaauuggaaagggagggaauuaaaaugcggcucuggaauauucguaacaaaugaaguacacacuuggacagaacaauauaaauuccaagcggacagcccuaagaggcugucugccgcaauaggaaaggcaugggaagagggagucugugguauuaggucugcuacaagacucgaaaacauaauguggaaacagauaucuaacgaguuaaaucauauacuacucgaaaaugauaugaaauucacuguugucguuggcgacguagcggguauacuagcccaaggcaagaaaaugauaaggccacaacccauggaauacaaauacucauggaaaaguugggguaaagcgaaaaucaucggagcagacguacaaaauaccacauucauaauagauggaccaaacacuccugagugcccugaugaucaacgcgcguggaauaucugggaaguugaagacuauggauucggaauuuucacaacaaauauuuggcuuaaacuccgagauagcuacacucaagugugcgaucaccgacuaaugucagccgccauaaaagauucuaaggcaguacaugcugacaugggguacuggaucgaaagugaaaagaacgaaacauggaaauuagcuagagcuaguuuuauugaaguaaaaacauguaucuggccaaaaucacacacacuuuggagcaauggcgugcuagagucagagaugauuauuccuaaaauauacggaggaccaauaucucaacauaauuaucgcccgggauauuucacgcaaacugcaggaccauggcacuuagggaagcuggaguuagacuuugaccuaugugaggggacuacagucguaguugacgaacauugcggaaaucguggcccuagucuuagaacaacgacggucaccggaaaaauuauacaugaaugguguuguagaucuugcacacugccgccauuacgcuuuagaggcgaagauggaugcugguacggaauggaaauacgucccguaaaagagaaggaagaaaaucucgucaaaaguauggugagugccggaucgggagaaguagauucauucucccuaggcuuauuauguauuuccaucaugaucgaggaaguaaugcgaucuagauggucacggaaaauguugaugaccggcacacucgcgguauucuuucuauuaauuaugggacaacuaacuuggaaugaccugauucgcuugugcauuauggugggagccaaugcgagcgauaggaugggcaugggaacuacauacuuggcucuuauggccacuuuuaaaaugagacccauguucgcagugggacuauuauuucgacguuugacaaguagagaaguucuauugcucaccauaggucugucucuuguugcaucgguugaacuacccaauagcuuagaagaauuaggugauggucuagcgaugggaaucaugauauugaaauuauuaaccgacuuccagagccaccaguuaugggcaacucuucuaagucucacguucauaaagacuacuuucucacuacauuaugcauggaaaacaauggcaaugauacuguccauaguuagucuguuuccguuauguuuaucaacgacgucacaaaagacuacaugguuaccgguacuacucggaagccuagguuguaagccccugaccauguuucucauugccgagaacaaaauaugggguagaagaucauggccuuugaaugaggggauuauggcgguaggaauuguaucuauucuuuuaagcaguuuacucaagaaugauguaccgcuugcgggaccauugauagccgguggaauguuaaucgcaugcuacguaauuucuggaucaucggccgaucuaagccuagaaaaggcggcugagguaaguugggaggaggaagcagaacauucaggugcaucacauaacauccuagucgagguacaggaugauggcacuaugaaaauaaaagaugaagaaagagaugauacuuuaacuauccuacucaaagcaacuuuauuagcuguuuccgggguuuacccguuaaguauacccgcaacguuguucgugugguauuucuggcagaagaagaaacagcgcaguggaguauugugggacacuccgucgccuccagaaguggaaagagcaguacuagaugaugguauauaucgaauuaugcaaagaggacuccuuggacgcagucaagugggaguuggaguauuccaggaaaacguauuccauacaauguggcaugucacucguggugcuguucucauguaucaggguaaacgucuagaacccuccugggccucugugaagaaagauuuaauuucauaugggggcggcuggcgauugcaaggaagcuggaacaccggcgaagaaguccaaguuauagcgguagaaccaggcaaaaaccccaaaaauguacaaaccgcaccagguacauuuaaaaccccggaaggagaaguaggggcuauagcguuggacuuuaaaccuggaacguccgguaguccuaucguuaacagagaaggaaaaauaguuggucuauacgggaaugguguagucacuacaaguggaacguauguaucagcgauagcacaagcaaaagcaucccaggaaggucccuuacccgaaauugaagaugaaguguuucgaaaacgcaacuuaacaaucauggacuugcacccagggagcggaaaaacaagaagguauuugccagcaauaguacgcgaagcaauuaaaagaaaacuacgcacucuuauauuggccccgacgcgagugguggccucagagauggcggaagcacuuaaaggaaugcccauuagauaucaaaccacggcugucaaaucagaacauacaggaaaagaaauaguagaucucaugugucacgcgacguucacaaugcgccugcuaagcccaguaagggucccaaauuauaacaugauaaucauggacgaagcgcacuuuacugacccguccucaaucgcggcuaggggcuauauuaguacuagggucgggaugggagaggcggcagcaauauucaugaccgcaacaccacccggcaguguagaagccuucccgcagucaaacgcaguaauacaagaugaggaacgagauauucccgaaagaucuuggaacuccggauacgaauggaucacggauuuucccgggaaaaccguaugguuugucccaaguauaaaaagcggcaacgacaucgccaacugucuacguaaaaauggcaaaagagugauucaguuaucgagaaaaacguucgacaccgaauaucagaaaacgaaaaauaaugauugggauuaugugguaacuacagacaucagcgaaaugggggcaaauuuucgugcagacagaguaaucgauccaagacgaugucucaaaccuguaauacuuaaagauggaccagaacgugugauccucgcggguccaaugccuguaacgguugcuagugcugcacaacgacgggguagaauaggccgcaaccauaacaaagagggugaccaauacauuuauaugggacagccauuaaacaaugacgaggaccaugcgcauuggacagaagcgaaaauguugcuagacaauauaaacacuccugaaggaauuauccccgcucucuuugagcccgagagggaaaaguccgcugcaauagauggugaauauagacuuagaggugaagcaagaaaaacauucguagagcuuaugaggagaggagauuuaccugucuggcuuagcuauaaaguugcuagugaggguuuucaguauucagauagacgaugguguuuugauggcgaaaggaauaaucaagucuuagaggaaaauauggauguagaaaucuggaccaaagaaggagaaagaaagaaacuacgaccacgauggcuggaugcacgcacuuacagcgacccgcuagcauuacgagaguucaaagaauuugcggcaggaagaagaagcguaaguggggaucuuauuuuagagauugguaaauuaccacaacaucucacacaaagagcucaaaaugcacuagacaaucuaguuaugcuacauaauucagaacagggugguagggccuaucgacaugccauggaagaauuaccagauacaauugaaacccuaauguuacuagcauuaaucgcugugcugacaggagguguaacauuauuuuucuuaucuggccguggguuagggaaaacuucuaucgggcuuuuauguguuauggcuucgucaguacuccuguggauggcgucaguugaaccgcauuggauugcggccaguaucauucuagaauuuuucuuaaugguauuacuuauaccagagccagacagacaacggacaccacaagacaaccaauuagcauaugugguaauaggguuauuauuuaugauauuaacagucgcugcuaaugaaaugggccuuuuggagacgaccaagaaagauuuaggaauaggacacgucgcugucgaaaaucaucaucaugccgccaugcuagauguagaccuacaucccgcuagcgcguggacguuguaugccguagcaacgacuauaauuacaccgaugaugaggcauacuauagaaaauacaacggcaaauaucucacuaacagcuauagcuaaccaagccgcaauacuaaugggacuggauaagggauggcccaucucgaagauggacaucggagugccacuuuuagccuuaggcuguuacucucaaguaaauccacuuacauugacagcggccguguuaaugcucguggcccauuacgcuauuauuggacccgggcuacaagcaaaggcaacaagagaagcgcaaaaacguacggccgccgggauaaugaaaaaucccacaguagacgguauuguugcuaucgaccucgacccaguaguuuacgacgcuaaauuugaaaagcagcucggucaaauuauguuguuaauucuuugcacgucgcaaauacuguuaaugaggaccacaugggcgcucugugaaaguauuacccuugcaacaggaccacuaaccacucuuugggaagguucaccagggaaauuuuggaacacuacuauagcgguaaguauggcaaauauuuuccgagguagcuauuuagcgggugcaggcuuagcauuuucauuaaugaaaucgcucgggggagguaggagagggaccggagcacagggugaaaccuuaggagagaaauggaaaagacagcuaaaccaauugaguaaaucugaguucaauacauacaaaagaagcggcauuauggaaguugacaggagugaagcgaaagaaggauugaaaaggggagaaacuacuaagcacgcaguaagcagaggaaccgccaaguuacgaugguucgucgagcgaaauuuagugaagccagaaggcaaagucauagauuugggauguggaagaggagguuggucauacuauugcgcuggauugaaaaagguuacggaaguaaagggauacacuaagggaggaccagggcaugaagaaccuauaccaauggcaaccuacggauggaaucuaguaaaacuacauagugguaaagauguauucuuuauacccccggaaaagugugacacacuucuaugugacaucggagagagcaguccgaaucccaccauagaagaaggcagaacauuaaggguacucaaaaugguagaaccuuggcugagaggaaaucaauuuuguauaaaaauacucaauccuuacaugcccucgguggucgaaacacuagaacagaugcaacgcaagcauggaggcaugcuaguaagaaacccgcucucaagaaauaguacgcacgaaauguacugggugagcugugguacuggaaauauagugagcgcaguaaauaugacgagucgaauguuacuaaaccguuuuacaauggcacacagaaaaccuacauacgaaagggacguagaucuaggagcaggaacaaggcacguugcaguugaaccggaaguagccaauuuggacauuauuggacaaaggauagaaaauauuaagcaugaacacaaaucaaccuggcacuaugaugaagacaauccuuacaaaaccugggccuaucacgguucauacgaaguaaagccuuccggaagugcuucuagcauggugaaugggguaguaaaacuucuaacaaaaccaugggaugucaucccaauggugacucaaauagcuaugacagauacaacaccuuucgggcaacagagaguauuuaaagaaaaaguagacacgagaacaccuaaagcaaagcgaggaaccgcacaaauuauggaaguuacugcaaaauggcuuuggggauucuuaagcagaaauaagaaaccacgcauauguacuagagaagaguuuaccagaaaagucagaaguaaugcggcuauaggcgcagucuucguagaugaaaaucaauggaauagugccaaagaagccguugaggacgaaagauuuugggacuugguacaucgggagcgugaacuacauaaacaagggaagugugcuacuuguguauacaauaugaugggaaagcgagagaagaaauuaggagaauuuggcaaagcuaaaggaaguagagcuauaugguauaugugguuaggagcaagauuccuagaguucgaagcgcucggguucaugaaugaagaucacugguucucaagagaaaauucguuaaguggugucgaaggggagggacuacauaaauuaggauauauauuaagagacauaucgaaaauacccggaggaaauauguacgcagacgauacagcagguugggauacuagaaucacugaggacgaccugcaaaacgaagcacgcaucacugauauaauggaaccugaacacgcgcucuuggccaaaucaauuuucaaacuaacauaccaaaacaaagucguacguguacaacgaccagccaaaaacggaacaguaauggacguaaucucaagaagagaccaacggggaagcggccaagucggaacuuacggccugaauacauuuacgaauauggaagcucaacuaauacggcaaauggagagcgaagguauauuuuccccaucggaguuagaaacgccuaacuuagcugaaagaguacucgauuggcuggaaaaguaugggguggaacguuuaaagagaauggccaucaguggcgaugauugcguuguuaagccaaucgacgacagguuugccacggcacuaaccgcacuuaaugauauggguaagguaaggaaagauauaccgcaaugggaaccaaguaagggguggaaugauuggcaacaaguucccuuuuguagucaucauuuccaucaacucauaaugaaggauggucgggaaaucgucgugccgugucgaaaccaagacgaacugguaggucgugcgagaguaagccaaggagcagguuggucacuuagggaaacugcuugucucgguaaaucauacgcacagauguggcaacuuauguauuuucaccguagagaucuccgccuugcagccaaugcuauauguucggcaguaccaguugauuggaucccuacuucacgcacuacauggucaauucaugcgcaucaccaguggaugaccaccgaagauaugcuuucaguauggaacagagucuggauagaagaaaacccuuggauggaagauaagacucacauaagcucuuggggugauguuccuuaucucggaaaaagggaagaccaaugguguggaagccuaauuggacuaacagcccgcgcgacaugggcaacgaacauacaaguugcaauaaaucaaguaagaagauuaauugggaaugaaaauuacuuagauuauaugaccucuaugaaaagguucaaaaaugaaagcgauccggaaggggcacuaugguaa

SEQ ID NO: 21828 - RNA, 9879 nt, Artificial Sequence
  derived and/or modified CDS sequence (opt6) from DENV-1__GU131749__SS-prME
ucaguuacaauguuauuaauguuaaugccaaccgcacuggcuuuccauuuaacuacacgugguggagaaccucauaugauaguaucaaaacaagaaagaggaaaaagucuguuauucaaaacaagcgcagggguaaacauguguacauuaauagcuauggauuuaggcgaguuaugugaagauacaaugacuuacaaauguccacgaauaacggaagcagagccugaugauguagacuguuggugcaacgcgacagacacguggguuacuuacgggacgugcagucaaacaggggaacaucgucgcgagaaaaggagcgucgcauuagcaccacauguuggacucggacuagaaacaagaacagagacuuggauguccucggaaggagcauggaaacaaauacaacgcguagagacaugggcauuacgccauccaggcuucacagucauagcacuguucuuggcgcaugcaauaggaacaaguauaacacaaaaaggaauaaucuuuauauuguuaauguuaguaacaccaucaauggccaugagauguguagguaucggaagcagagacuuugucgaagggcuuucaggagcgacuuggguugacguagucuuagaacaugguaguuguguuaccacgauggcaaaagacaaaccuaccuuagauauugaguuacuaaaaaccgagguuaccaauccugccguuuugcgcaaauuauguaucgaggcuaaaauaaguaacacaacuaccgauagucguuguccuacccaaggagaggccacauuaguugaagaacaagaugccaacuuugucuguaggagaaccuuuguagaccgugggugggggaaugggugcgguuuauuuggaaaagguagcuuauuaacaugugcgaaauuuaaaugcguaacgaaacuagaaggcaaaauuguacaauacgaaaacuugaaauacucagugauugucacgguacauacaggcgaucaacaucaaguggguaaugagagcacagaacauggaacaacggcaacaauaacuccacaagcgcccacaacagagauacaacuaacagauuauggcgcgcuaacacucgacuguaguccgcgaaccggauuggauuuuaaugaaaugguacuacuaaccaugaaagagaaguccugguuggugcauaaacaaugguuuuuagaccuaccucuaccuuggacaucaggggcaagcacaagucaagaaacauggaaucgucaggaucuauuagugacuuuuaaaacagcacaugccaagaaacaagagguuguagucuuagggucucaggagggggccaugcauacggcauuaaccggugcaaccgaaauucagaccucagggaccacaacaauauuugcagggcauuuaaaaugcaggcugaaaauggauaaacuuacguuaaaaggaauguccuacguaauguguacggguagcuucaaauuggaaaaagaaguugcggaaacacaacaugguaccguccuaguacaaauuaaauacgaaggcacugaugcaccauguaagauaccguucucaacucaagaugaaaaaggagucacucagaaugggagacucauaacagcuaacccaauaguaacugauaaggagaaaccuguaaauaucgaagcggaaccuccauucggagaaucuuauauuguaaucggagcgggugagaaggcuuugaaacugaguugguuuaagaaagggucaucgaucgguaaaauguucgaggccaccgccagaggugcaaggcguauggcaauccuaggggauacugcaugggacuuuggcucuauugguggaguuuuuacaucaguagguaaacuugugcaccaaaucuuugguacugcuuaucgagugcuauuuucuggcguaucauggacgaugaaaaucggaauaggaguucuauuaaccuggcuaggauuaaauucgagaucaacgucacuuucaaugaccugcauagcggucggucuugugacucucuaccuugguguuaugguacaagcagauucaggaugcguuauaaauuggaaaggucgugagcucaaauguggaucagguauuuuuguuacaaacgaaguucauacauggacggaacaguacaaauuccaagcagauucaccuaaaagguuaagugcugcuauugguaaggcuugggaagaaggggucugcggaauacggucagcgacccgauuggaaaauauaauguggaaacaaauuucaaaugaguuaaaucauauccuccucgaaaacgacaugaaguuuacugucguuguuggggacguggcagggauccucguccaagguaagaaaaugaucagaccgcaaccaauggaguauaaauacaguuggaaaagcuggggaaaagcaaaaaucaucggugcugauguacaaaauagcacuuuuaucauugauggacccaacaccccugaauguccugaugaucaaagagcauggaacaucugggagguugaggauuacgguuuuggcauuuuuacuaccaacauauggcuuaaacuucgggauaguuauacucaagugugugaccauagacucaugagugcagcgauaaaagauucaaaggcaguucacgcggauaugggauauuggauagaaagugagaaaaaugaaacauggaaacuugcacgagcaucauucauagaaguuaaaacgugcauuuggccaaaaucacauacucuauggagcaaugggguccuagagucugaaaugauaaucccaaaaauacacggcggcccaauaagccaacauaauuauagaccgggauacuuuacucaaacugcagggccauggcaccuaggaaaauuagaauuagacuuugaccuuugugaaggaacgacgguaguggucgacgaacauuguggaaaccguggcccaucuuuaagaacgacaacugucacgggaaagauuauucaugaaugguguugcagaucgugcaccuuaccuccauuacgauuuagaggggaagauggaugcugguaugggauggagauaagaccugucaaagaaaaggaagaaaauuugguuaagucuaugguaagugcaggcucgggagagguagacucauuuucuuuagggcuccuauguauaucaaucaugaucgaagaagucaugagaucucguuggucucgaaaaaugcuuaugacuggaacguuggcaguauucuuucuccuaauuaugggacaauugacguggaacgauuugauucgacuauguauuaugguuggugcaaaugccuccgaccguauggguaugggaaccaccuacuuagcauuaauggcuacuuuuaaaaugagacccauguuugcaguaggacuucucuuuaggcgccugacgucacgggaaguucuuuuauuaacaauaggccuuagucugguagcuucaguugaauuaccaaauucauuagaggaacugggugacgggcucgcaaugggaauaaugauacucaagcuauuaaccgauuuucagucauaucaacuaugggcaacgcuuuuaucccuaacuuuuauuaaaacaacuuuuucccuucacuaugcauggaaaacuauggccaugguacuuucuauuguguccuuauucccacuaugcuuaaguacgacgucgcaaaagacuacaugguuaccaguauuacuggguucgcuagguuguaaaccacucacaauguucuugauagcggagaauaaaauaugggggcgaaaaucauggcccuugaacgaagggauaauggcuguuggaauuguaucaauucuacugucuagccuccuaaagaacgauguaccacucgcugguccccuaauugcugggggcaugcuuaucgcgugcuauguaauaaguggcaguucggccgaucugucguuggagaaagcggcugagguaaguugggaagaagaagcugagcacagcggagccagucauaacaucuuaguagaaguacaggaugacgguacgaugaaaauaaaggacgaggagagggaugauacacuaacuauauuauugaaggcaacucuacuagcaguauccgggguuuauccauugaguauuccagcaacucuauucguauggcauuuuuggcagaaaaagaaacaacgaucugggguccugugggauaccccuucuccuccggaaguugaacgcgcuguacuagaugauggcauauaucgaauaaugcagcgugggcuccuggguagaucgcaaguaggaguaggcguauuccaagaaaacguuuuccauacaauguggcauguuacucggggcgccgugcuaauguaucagggaaaaagguuggaaccaucuugggcauccguaaagaaagaucuuauaaguuauggagguggguggcgguuucaagguucauggaauacuggagaggaaguacaaguuaucgcugucgaaccaggcaaaaauccuaaaaacguacaaaccgcaccaggaacguuuaaaacaccugaaggugagguaggugcuaucgcgcuggauuucaaacccgggaccucagggucgccaauagucaauagggaaggaaagauagucgguuuauauggaaacgggguaguaacgacuucaggaacuuaugugucagcaaucgcccaagcuaaggcuagccaagaagguccacuuccagaaauugaagaugaaguuuuuagaaaaagaaaucuuacuauaauggauuuacacccuggguccggcaaaaccaggagguaucucccagcuauaguucgcgaagcaauaaaaagaaaacuccgaacacuuaucuuagcaccaacaagagugguggccucagaaauggccgaggcacuaaaaggcaugccaauaagguaucaaacaacugcuguaaaauccgagcacacaggaaaggaaauaguagaucucaugugucacgcuacuuucaccaugcgccuacuuucuccagugcgggugcccaauuauaauaugauuauaauggacgaagcacauuucacugaccccaguucaauugccgccaggggguacaucagcacgcggguugguaugggagaagcugcagcaauauuuaugacugcaacgccgccagggucgauggaggcuuuuccacaaucaaacgcagugauccaggaugaagaaagagauauaccggagagaucuuggaauaguggguacgaauggauaacugacuucccugguaaaacgguaugguucguaccaucaauuaaggcagguaacgauauagcaaauugcuuaagaaagaaugguaaacgaguaauccagcuaagucguaagacuuucgauacagaauaccagaaaaccaaaaacaacgacugggauuauguaguaacaacagauaucagcgaaaugggcgcaaauuuccgcgcugauagaguuauugacccucguagaugucuaaaacccgugauacuuaaggacgguccagaaaggguaauuuuggcagguccaaugccagugaccguggcaucggcugcucaaagacgcgggcguauaggccgcaaccauaauaaagagggugaccaguauauauacaugggacaaccguugaacaacgacgaagaucaugcacacuggacagaagcgaagauguuacucgauaacauaaauacuccagaagguauuauaccagcucuauucgaaccggagagagaaaaaucugcagccauagacggugaauauagauuaagaggugaagcacgaaaaacauuuguugaauuaaugagacggggagaccuaccaguuugguugucauauaaagucgccuccgaagguuuucaauauagugaucgucguugguguuuugauggcgaacgaaauaaccaaguccuagaagaaaacauggaugucgaaauauggacaaaagaaggagaacggaagaaacugaggccuagguggcuugaugcuagaacuuauagugauccacuagcacuacgagaauuuaaagaguucgcagccggaagaagaaguguaucaggagaccuuauucuagaaauaggaaaacuaccucagcaucucacccaaagagcccagaacgcacuugacaacuugguaauguuacauaacucagaacaagguggacgugcauaccgccaugcuauggaagaauugcccgauacgauugaaacacuaauguuauuagcacucauugcagugcugacaggcgggguaacgcuguucuuuuugaguggaaaagggcuagguaaaacaagcaucggcuuauuauguguaauggcuucuucaguucuuuuguggauggcaagcguagaaccgcauuggauagcagcuaguauaauucuagaguucuuuuuaaugguacucuuaauccccgaaccagaucgacaacgaacuccacaagauaaccaauuggcauauguuguaaucggacuccuuuucaugauacuaacagucgcagcaaacgaaaugggguugcucgaaacuacuaagaaagaccuugguauuggacauguagccguagaaaaccaucaucaugcagcaaugcucgacguugauuuacaucccgccucagcauggacuuuauaugcuguagcuacaacaauaaucacucccaugaugcgacauacgauugaaaauacgacugcuaauaucaguuugacugcuauugcaaaucaagcugccauccucaugggauuagacaaaggcuggccuauuagcaagauggauauugggguaccguuauuggcauuaggaugcuacucacaggucaauccucuaacauuaaccgccgcuguucuuauguuaguagcucacuacgcaauaauaggaccugggcuacaagcuaaagccacccgagaagcacagaaaagaacagcagcggguaucaugaaaaacccaacaauagauggaauagucgcuauugacuuagacccaguagucuacgaugccaaauuugagaaacaacuaggucaaauaauguugcugauccuaugcacaagccaaauauuacuaaugagaacaaccugggcguuaugcgaaucgauaacacuugcuacugguccacuaacaacauugugggaagguagccccgguaaguuuuggaauacuacaauugcuguuaguauggcgaauauauucaggggcucauaccuagcuggugcuggucuugccuucagccuaaugaaaaguuuaggggguggucgacgcggaacaggcgcgcaaggagaaacucuuggugaaaaauggaaacgacagcuuaaucaauugucaaaaagcgaguuuaauacauauaagagaucuggaauaauggagguagauagaagugaagcaaaagaggggcucaaacguggagagacaaccaaacaugcuguuucaagggggacagcaaaacuaaggugguucguagaaaggaauuuggucaagccugaaggaaaagucaucgaccuaggauguggucgaggcgguuggucauauuauugugcaggacucaagaaagucacagaaguaaagggguacacgaaaggugguccuggucaugaggaacccaucccaauggcaacauauggauggaacuuagucaaauugcacuccgguaaagauguauuuuucauaccgccugaaaagugugauacuuuacuaugugauauaggcgagagcuccccuaauccaaccauagaggaagguaggacccucagaguauuaaaaaugguagaaccgugguuaagagguaaucaauucuguaucaaaauuuugaauccuuacaugccuucgguuguugagacauuagaacaaaugcagaggaaacauggagggaugcuuguuagaaacccguuaagccgcaauucgacgcacgaaauguacuggguaagcugcggcacugguaauauuguauccgcuauuaacaugacaucgcggaugcuccuuaaccgguucacaauggcucacaggaagccaacauaugaacgagauguugauuuaggugcgggaaccagacauguagcaguagagccugaaguggccaaccuugauaucauagggcaaagaauugaaaacauuaaacacgagcauaaaagcacauggcauuaugaugaagauaauccauauaaaacuugggcguaccacgggaguuacgaaguaaagccuuccggaucagcgucaucaaugguuaaugggguuguuaaauuacuaacgaaaccaugggauguuauaccaaugguaacgcaaauagcaaugaccgacaccacaccuuuuggacagcaacgagucuuuaaagaaaaaguagauacaagaacacccaaagcuaaaaggggaacagcacaaaucauggaaguaaccgcaagaugguuauggggcuucuuaucgaggaauaaaaagccgcgaaucuguacaagagaagaauuuacucgaaaaguacgaagcaaugcugcuauaggagccgucuuuguggaugaaaaccaguggaauagugcuaaggaagccguagaagaugacagauucugggaucucguucaucgagagcgggagcuacacaagcagggaaaaugcgcuacuuguguauauaacaugauggguaaaagagaaaagaagcucggagaguucgguaaagcuaaaggaagcagggcuaucugguauaugugguugggggcgagguuucucgaauuugaggcauuagguuucaugaaugaagaucacugguucagcagggagaauagucucucaggaguugaaggagaaggucuccauaaacuaggauauauucuuagagacauauccaaaauaccugguggaaauauguaugccgacgauacggcaggaugggacacaaggauuacagaagaugaucuacaaaaugaagcuaaaauaacagacauuauggaaccagagcaugcauuauuagcaaagaguauuuuuaaauugacauaucagaacaaaguaguuagagugcagaggccagccaaaaacggaacagugauggacguuauuagcagacgggaccaaagaggcagcgggcaaguaggaacauauggguuaaauacauuuacaaauauggaagcucagcugauucggcagauggaaucagaagggauuuuccuaccuaacgagcucgagacuccaaauuuagcaggacgagugcuagauuggcuagaaaaauauggugucgaaagauuaaaacggauggccaucaguggugacgauugcguaguaaagccaaucgacgacagauuugcaacugcacuaacagcacucaacgauaugggaaaaguaagaaaggacauuccucagugggaacccucgaaaggcuggaacgacuggcaacaaguacccuucuguagucaucauuuccaucaacugauaaugaaagauggacgugaaauuguugucccauguaggaaucaagaugaacuuguuggaagggcacgaguaucucagggcgcuggguggucccuccgagaaacugcaugccuaggcaaaaguuaugcacaaauguggcaauuaauguauuuccacaggagggacuuaagauuagcugccaaugcgauuuguucggcuguucccguugacuggguaccaacgucucgaaccacuuggucaauacaugcacaucaccaguggaugacaacugaagauaugcucaguguguggaauagaguguggauugaagaaaacccguggauggaggacaaaacacgaaucucaaguugggaagauguuccauaucuagguaagcgcgaagaucaauggugcggaucgcuaauaggucuuacugcaagagcaacgugggcuacuaacauacagguugcuauaaaucaaguaaggaggcuaauugguaaugagaauuauagcgauuauaugacgucaaugaagagauucaaaaacgaauccgaaccagaaggagcuuuaugguaa

SEQ ID NO: 21829 - RNA, 9879 nt, Artificial Sequence
  derived and/or modified CDS sequence (opt6) from DENV-1__GU131750__SS-prME
agcguaacaauguugcugaugcuaaugccaacugcuuuagccuuccaucucacuacacgcgguggagagccgcacaugauagucagcaaacaagaaagagguaaaagccuauuguuuaaaacgucagccggaguuaauaugugcacauuaauagcgauggaucuaggagaguuaugugaagacacaaugacguacaaauguccuagaaucacugaaacggaaccggaugacguugauugcugguguaacgcaacugauaccuggguuacauacggaacuuguagucaaacgggagagcaucgcagagauaaaagaucagucgcuuuggcaccccaugugggucuaggauuagaaacucguacggaaacauggaugucguccgaaggugcauggaaacaaauacaacgaguugagacuugggcguugagacacccagguuuuacuguaauagcacuauuccuagcacacgcgauagggacuuccaucacgcaaaaaggcaucauauucauccuuuugauguuaguuacgccaucgauggcaaugagaugcgucggcauaggaucaagagauuucguugaaggacuaagcggagcaacuuggguugaugucguacuagagcacggaucgugcguaacaacaauggcgaaggauaaacccacuuuagacauagaauugcuaaaaacggaaguaacgaacccagcaguauuaagaaaacuuuguauagaagcuaaaauaagcaacacuacaacugacaguagaugucccacgcaaggugaagcaacacuuguagaggaacaagacgcaaauuuugucugucggcggacauucguagacagaggauggggcaacggcugcggauuauuugguaaagggucacugauaacuugcgccaaguuuaaaugcgucacuaaacuugaagggaaaauuguacaauaugaaaacuugaaauacaguguaaucgucacagugcauacgggggaccaacaccaagucggaaaugaaaguacugaacacggaacaacagccacaauaacaccgcaagccccaaccacagagauacagcuaaccgauuauggagcacuaacgcuagacuguaguccaagaacaggccuagacuucaaugaaaugguccucuuaacgaugaaagaaaaauccuggcucguccacaagcaaugguuccucgauuuaccacuuccguggacaagcggagcaucuacgagccaagaaacauggaaccgucaagacuugcuagucaccuucaagaccgcacaugcgaagaagcaggaaguagucguuuuaggaucgcaagagggcgcaaugcauacagcucugacaggggcgacagaaauacaaacauccggaacaacuacuauuuucgcaggccaucugaaauguagacuaaaaauggauaaacugacucuaaaagguauguccuacguaauguguacagggucuuuuaaacucgagaaagaagucgcagaaacacaacaugguacgguauuagugcaaauaaaauaugaggggacugacgcuccaugcaagauuccauuuucaacacaagacgagaagggagugacucaaaauggacguuuaauuacagcaaauccuauaguaacagacaaagagaagccggucaauauagaagcagaaccgccuuucggagaaaguuacauaguuauaggcgcuggagaaaaagcauuaaaacuuaguugguucaaaaagggaagcucgauuggaaaaauguuugaagcuacggccaggggagcacgccgaauggccauccucggagauaccgcuugggacuuugguucuauuggaggagucuuuacaucgguuggcaagcuaguucaccaaauuuucggaacggcguauggcguccuuuucucuggugugucauggacgaugaagauugguauugguguauuguugacguggcuuggucuaaacaguagguccacaucauuauccaugacuuguauagcuguuggacuuguuacacucuacuuaggagucaugguccaagcagacaguggaugugugauaaacuggaaaggacgcgaacuaaagugcggaucaggcaucuuuguuacaaaugagguacacacauggacagaacaauauaaauuccaagcggauucacccaaaagauuaucugcagcgauaggaaaagcaugggaagaagguguaugugguaucagaagugcuaccagauuagaaaauauaauguggaaacaaaucagcaacgagcuaaaccacauacuacuagaaaacgauaugaaauucaccguuguuguaggugacgucgcaggaauuuuagcacaagguaaaaagaugauuagaccacaaccaauggaauauaaguacucguggaaaaguugggggaaagccaaaauaaucggggcggacguacaaaauaccacuuuuauaaucgauggaccuaacacuccugaauguccggacgaucaacgcgcuuggaacauuugggaaguagaagauuacggauuugggauuuucacgaccaacauauggcuuaaacuaagagauuccuauacgcaaguaugugaccaccgucuuaugagugcagcgauaaaagauagcaaggccgugcacgcggauaugggguauuggaucgaaucggaaaagaaugaaacauggaagcucgcgagagcaucauuuauagaaguaaaaacguguaucuggccaaaaagccauacccuuuggucaaacgggguacucgagagcgaaaugauaauuccaaaaauuuaugguggcccuauaucucaacauaacuaucgaccaggcuacuucacacaaacugcagguccauggcaucuggguaaauuagaauuagauuuugacuugugugagggaacgacagucgugguggacgaacacugugguaaucggggcccuucauuacgaacuacgacugugacuggaaaaauaauucaugaaugguguugccguaguuguacacugccuccauugcgauucagaggcgaagaugguuguugguauggcauggagauucgaccuguaaaagaaaaagaagaaaaucuagugaaaucgaugguaucagcggguucgggcgagguagauuccuuuagccucggacuuuuguguauaaguauuaugauagaagaaguaaugcggagucgauggucaaggaaaauguuaaugacugguacacuugcuguauuuuucuugcuuauuauggggcaacugaccuggaaugauuuaauuagauugugcauuauggucggugccaacgcuucagauagaaugggaauggggacaacuuaucucgcacugauggcaacuuucaagaugagaccaauguuugcgguaggauuguuguuucgccgucuaacaucgagagaaguauuguuguuaacgauaggguuaucauuaguggcuagcguugaacuacccaacucacuagaagaacuaggggaugguuuagcuauggggauaaugauacucaaacuuuuaaccgauuuccaaucucaucaauuaugggcaacgcuucugagccuaacauuuaucaagaccacauuuucauuacacuacgccuggaagacgauggcgaugguucucuccauuguuucgcuuuucccacuaugccuuagcacaacaucacagaaaacuacaugguugccuguuuuacuuggaaguuuaggcuguaaaccauuaacaauguuucucauagcggaaaacaaaauauggggaagacgaucuuggccgcuuaaugaaggcauaauggcuguagguauagugucaauucuacuaucauccuuacucaaaaaugauguuccgcucgcaggaccauuaauagcgggagggaugcucauagccuguuacguaaucuccggaucgagcgcugauuuauccauagagaaagcagcugaaguaagcugggaagaagaagcggaacauuccggugcaagccauaauaucuuagucgaagugcaagacgauggcacuaugaaaauaaaagaugaggagcgggaugacacccucacaauucuacugaaagcuacauuauuagcagugaguggcguuuauccccugaguauaccagcaacuuuauucguuugguacuuuuggcagaagaagaaacaaagauccggcguguuaugggacacaccaucaccaccugaaguagguagagcaguucucgacgacggaaucuaccgcauaaugcaaaggggacuguugggcagaucucaagucggaguagggguauuucaagagaacguguuccacacgauguggcacgucacucgaggagcuguccugauguaccaaggaaaaagauuagaaccuucuugggcauccgucaagaaagaccuaauuucauacggcgguggauggcgccuucaaggaucauggaacacaggagaagaaguacaaguaauagcuguagaaccgggcaaaaaucccaaaaauguucagacagcacccggaacauuuaaaacaccggaaggugaagucggcgcuauagcauuagacuuuaagccaggcacauccggcagcccaauuguuaauagagaaggaaaaauaguuggacuuuacggaaauggaguuguuacuacgucugguacuuauguuagugcuauagcccaagcgaaagcaagucaagaaggaccgcugccagaaaucgaagacgaaguauucaggaagaggaaucuaacaauuauggauuuacauccagggagcggaaaaaccaggcguuaccuuccugccauaguaagagaggcaauaaagcgaaaacucagaacacuuauacucgcuccgacgaggguuguugcuagcgaaauggcggaggcuuugaaaggaaugccaauccgauaucaaacuacagcuguuaagagcgaacauacagguaaagaaauaguagaucuaaugugucacgcgacguucaccaugagacuacuuagcccaguaagaguacccaacuacaauaugaucauaauggacgaggcacauuuuaccgacccuagcaguauugcagcaaggggcuauauaucgacaagagugggaaugggagaagccgcugccauuuuuaugaccgccacacccccaggaagcguugaagcguucccacagucuaaugcugugauccaagaugaagaacgcgauauuccugaacgauccuggaacuccggguaugaguggaucacagauuucccuggaaaaacuguaugguuugugccaucuauaaaaagcgggaaugauauagcaaauugucuaaggaaaaacggcaaaagaguaauucaacuuucaaggaaaacguuugacacagaauaucagaaaacaaagaacaaugacugggacuauguggucaccaccgauauaagugaaaugggggccaauuuuagagcugacaggguuauagacccucguagaugccuaaaaccgguuauuuugaaagauggaccagaacgggugauauuggccggccccaugccuguaacagucgcaucagccgcucaaagacgaggacguauaggucgaaaucauaauaaagaaggagaucaauauauuuacauggggcaaccauuaaacaaugaugaagaucaugcgcacuggacggaggccaaaaugcuucuugacaacauaaacacgccugagggaaucaucccagcgcuauuugaaccugaaagagagaagagugcagcuauagacggugaauacagauugcgaggagaggcucgaaaaacauuuguugagcuaaugagaaggggagacuuaccuguauggcucucguacaagguugcaagcgaagguuuucaguacucagaccgaagguggugcuucgacggggaaagaaacaaccaaguucuugaagaaaauauggacguggagauauggacuaaggagggugagagaaagaaauugcggccgcguuggcuggacgccagaacauauagugauccacuggcccugcgagaguucaaagaguuugccgcgggccggagaucagucucgggagauuugauccuagaaauuggcaaauugccacagcacuugaugcaaagggcacaaaacgcauuagacaaucugguaauguuacacaacucugagcaaggaggacgagcguacagacaugcuauggaggaauuaccagacaccaucgaaacgcugauguuguuagcccugauagcugugcuuacaggaggagugacgcuauucuuuuuaagcggaagaggcuuaggaaaaacaagcauuggacuuuugugugucauggccucuaguguuuuacuauggauggccucaguagaaccucacuggauugcagcuaguauaauauuggaauuuuucuuaaugguguuacuuauuccagaaccugaucggcagaggacuccacaagauaaucaacuugcauacguaguuaucggacuccuuuuuaugauauuaacuguugcugccaaugaaaugggauuauuagaaacgacaaagaaagauuugggcaucgggcauguagcugucgaaaaccaucaucaugcagcaaugcuagacguagaccuucacccagcaagugccuggacgcuauacgccguugcaacaaccauaaucacaccuaugaugcggcauacgaucgagaacaccaccgcaaauauaucuuuaacagcuauagcaaaccaagcagcaauacugaugggauuagauaaagguuggcccauaaguaaaauggacauugguguuccacuucucgcuuuaggauguuauucacaaguaaaccccuuaacauuaacugcagcgguauuaaugcuaguagcucacuaugcuauaauugggccagggcuacaagcaaaagcaacuagagaagcacagaaaagaacagcggcuggcauaaugaaaaacccaacaguagauggaauuguggcaauagaccuagauccuguaguguaugaugcuaaguuugagaaacaauuaggccaaauaauguuguuaauacuuuguaccucucaaauuuugcugaugcguaccacgugggcauuaugugaaucaaucacccuagcaacaggaccauugacuacacuuugggaagggucgccaggaaaguuuuggaauacuacuauagcuguuucgauggcuaacauauuuagagggaguuauuuagcaggggcaggacucgcuuuuucauuaaugaaaucccuuggagggggcaggcgaggcacuggugcccaaggagagacauuaggggaaaaguggaaacgucaacugaaccaacucucaaaaucagaauuuaauacuuacaaacgcuccggaauaauggaaguagaccgcagugaggcaaaagagggacuaaaacgcggagaaacgacaaagcaugccguaagucggggaacugcaaaguuacguugguucgucgaaaggaaccuaguuaaaccggaaggaaaaguuauugacuuagguuguggacguggagguuggaguuacuacugcgcaggacuaaagaaggucacagagguaaaagguuauaccaaaggugguccuggccaugaggagcccauuccgauggcaacauaugguuggaaucuagugaaauuacauagcggaaaagauguauucuuuauaccaccugaaaaaugcgacacauuauuaugcgauauaggggaaagcaguccaaauccaaccauagaggaaggcagaacccuccguguuuugaagaugguagaaccaugguuaaggggaaaucaauucugcauaaaaaucuugaacccauauaugccauccguaguggaaacauuagagcagaugcaacgaaaacauggggguauguuaguucgaaauccgcuuaguagaaacaguacgcaugaaauguacuggguaagcugugguacaggaaacauagucagcgcaguaaauaugacaagucguaugcuacuaaaucgguucacaauggcccauagaaaaccaacauaugagagagauguugaucuuggggcaggaaccaggcauguagcuguggaacccgagguagcgaaccuugauaucauuggucaaagaauugaaaauauuaaacacgaacacaagucaacauggcacuaugaugaagacaaucccuacaaaacaugggcuuaccacggaucuuaugagguaaaaccaagugguucggcgucaucaaugguaaauggugugguaaaacuauugacaaaaccgugggacgucauaccuaugguaacccaaauugcaaugacggacacgacgccguuuggacaacaacgaguauucaaagaaaaagucgacacccgaacuccgaaagcgaaaagggggacugcucaaauuauggaaguaacagcuaaguggcuauggggauuuuuaucaagaaauaaaaagccacgaauaugcacaagggaagaauuuacacgaaaaguaagaucgaaugccgcaaucggugcuguuuucguugacgagaaucaguggaacucugcaaaagaagcuguagaagaugagagguucugggaucugguccauagagagagagagcuacauaaacaagguaaaugugccacaugcguuuacaacaugaugggaaaacgugaaaagaaacuaggggaauuuggaaaagccaaagguucgcgugcuauuugguacauguggcuaggcgccagauuuuuagaauuugaagcauuaggguuuaugaaugaagaucacugguuuuccagagaaaacagucuuuccggaguagagggugaagggcuacacaaacuggguuacauuuugcgggauaucagcaaaauuccuggagguaauauguaugcugacgacaccgccggaugggauacacgaaucacagaagaugaucuacaaaacgaagcaagaauuacagacacaauggaaccggaacaugccuuacuggccaaaucuauuuucaagcugacguaccagaauaaggucguacguguucagcgaccagccaaaaacgggaccguaauggacguaauaagucgaagagaccaacgaggcuccggucagguaggcaccuacggucuaaacaccuuuacaaauauggaggcacaauuaauccgucaaauggaaucagaagguauauuuucaccgagugaguuggagacccccaaucucgcggaacggguauuagacugguuagaaaaauauggaguagaaagacucaaacgaauggcaauaaguggcgacgauugcguugucaaaccuauagacgacagauuugcuacagccuugacugcucugaacgacaugggcaaaguacguaaagauaucccgcagugggaacccaguaaagguuggaacgauuggcaacaaguuccauuuugcucgcaccauuuucaucaacugauaaugaaagacggcagagaaauaguagucccuugccgaaaucaggaugaacuuguagguagagcaagaguaucucaaggagcagggugguccuuacgggaaaccgcgugccuugguaaaucuuaugcacaaauguggcagcugauguauuuccauagaagagauuuacggcuagcggcuaaugccaucuguagugccgucccggucgacuggauaccaacuuccagaacuaccuggaguauacaugcgcaccaucaauggaugacuaccgaagacaugcuuucuguuuggaaccgugucuggauagaagaaaauccauggauggaagauaaaacacauauaaguucguggggagauguuccguaucuuggcaaaagggaggaccaauggugcggaucacucauagguuuaacagcuagagcuacgugggcgacaaacauccagguagcaaucaaccaaguacgaagacuaaucggcaaugaaaacuaucuugacuacaugacguccaugaaacgauuuaaaaaugaaucagacccagaaggugcucuaugguag

SEQ ID NO: 21830 - RNA, 9879 nt, Artificial Sequence
  derived and/or modified CDS sequence (opt6) from DENV-1__GU131751__SS-prME
uccgucaccauguugcuuaugcucaugccaaccgcauuggcauuccaccuaacaacacgcgggggugaaccucacaugauuguaucaaaacaagaacgaggcaaaucuuugcuuuucaaaaccagugcagggguaaacaugugcacauuaauugcgauggaccuaggugaauuuugugaggacacaaugacauauaaaugcccacggauaacagaagcggaaccugaugacguagacugcuggugcaaugcuacggacacgugggucacuuauggcacaugcucucaaacaggggagcaccgcagggauaaaagaucaguugcauuggcuccacaugugggacuuggacuagaaacuagaacugaaacauggaugucaucagaaggagccuggaaacaaauucaaagagucgaaacgugggcacugcgacauccaggguuuacagucauagcuuuguuuuuagcgcacgcaauagguacaaguauaacccagaaagggauaauauucauauuacuaaugcucgugacccccucgauggcaaugagaugcguaggaaucgggagucgagacuucgucgaaggguuaucaggagcuacauggguggacguugucuuagagcaugguaguugcguaacaaccauggcaaaagauaaacccacccucgacaucgaauuauuaaaaacugaagucaccaauccugccguuuuacggaaacucuguauagaggcgaaaaucaguaacacgacuacggauucccggugcccaacccaaggagaagcaacauuggucgaggaacaagacgcuaauuuugucugcagacgaacuuuuguugauagaggaugggguaauggcuguggacuuuuuggcaaaggcagcuuaauaacaugugcgaaauucaaauguguaacgaaauuagaagguaaaauuguacaauacgaaaaccuaaaauauagugucaucgucacaguacauacaggcgaucaacaucaaguuggaaaugaaaguacugaacauggaacuauagcaacaauuacuccgcaagcaccaucaacagagauucaacuaacggacuacggagcauuaacacuugacuguucaccaagaacaggauuggauuuuaacgaaaugguauuauuaacaaugaaagaaaaaucuugguuaguacacaaacaaugguuucuggaucuaccguuaccauggaccaguggagcuucaacgucucaagagacuuggaauagacaggauuuacuuguuacuuucaaaaccgcacaugcgaagaaacaagaaguaguagucuugggcucacaagaaggagcgaugcacaccgcauuaacuggagcgaccgaaauccaaacaucaggcaccacaacuaucuucgcaggucaccucaaauguagguugaaaauggacaagcucacguuaaaagguaugucuuauguaauguguacaggaucguucaaacucgaaaaagaaguagcagaaacgcaacacgguacaguacuuguucaaauuaaauaugaaggcacagaugcucccuguaaaauaccuuucucuacccaggacgaaaaaggaguaacacaaaauggaagacuaaucacagccaauccaauuguaacagauaaagaaaagcccguuaacaucgaagccgagccaccauuuggagaaucauacaucguaauaggagcgggagaaaaagcacuaaaauuaaguugguucaagaaagggaguagcauugguaagauguucgaagccaccgcaagaggcgcgagaaggauggcaauucuuggagauacagccugggacuucggaucaaucgggggaguuuucacuucaguugggaaauuagugcaucaaauauuugguacggcguacgguguauuauucucuggugugaguuggacuaugaaaauaggaauaggcguccuacuaacuuggcuaggauuaaauucuagaagcacuucacugucgaugaccugcauagccgucggauuaguaacuuuauacuuaggaguuauggugcaagcagacagcgggugugucauaaauuggaaaggccgcgaauuaaaauguggaagcggcauauuugucacgaaugaaguacauacauggacagagcaauacaaauuucaagcagacaguccuaaaagacucagcgccgcaauuggaaaggcaugggaggagggcguaugcggaauaagaagcgcgacuagguuagaaaacauaauguggaaacaaauaucuaaugaauuaaaccacauccuauuagaaaaugacaugaaguuuaccguaguugugggcgauguagccgguauauuggcccaagguaagaaagucauucggccucaaccaauggaacauaaguauaguuggaaaaguugggguaaagcgaaaauaauaggcgcggauguacaaaauacuacuuucauaauugaugguccaaauacgccggaguguccagaugaucaaagagcauggaauauaugggaaguggaagauuauggauuuggcauauucacaacuaacaucugguugaagcugcgggauucauacacacaagugugcgaccaucguuuaaugucagcugcuauucgagauagcaaagcgguacaugcagauaugggauauuggauagagucagagaaaaaugagacauggaaauuggcaagagcaaguuucauagagguaaagacauguaucuggccgaagucacauacucuauggaguaauggaguccuugaaagcgaaaugaucauacccaagauuuauggcggucccauaucgcaacauaauuaccgacccggguacuuuacacaaaccgcugguccuuggcacuuaggaaaacuagaacuagacuucgaccucugugagggaaccacagucguagucgacgaacauuguggaaaucgaggcccaucucuaagaacgacaacaguuaccggaaagauaauucaugaaugguguugucggucauguacuuuaccgccacuaagguucaagggagaggauggaugcugguaugguauggaaaucagaccuguaaaagaaaaagaagagaaucuaguuaaaucaaugguuucagcuggaucaggggaaguagacucauuuucucuuggccuguuauguaucaguauaaugauagaagagguuaugaggucuaaauggucacggaaaaugcugaugacaggcacacucgccguauucuuucugcucauuaugggucaauuaacuuggaaugauuuaauaaggcuuugcauaaugguaggagcaaaugcaucagaccggauggguauggguacuaccuacuuagcauuaauggccacguuuaaaaugcgucccauguuugcagucggucuccuauuccguagauugacauccagggagguuuuacuacuaacaauuggacucagucuaguagccucaguugagcuaccuaauagucuugaggaacuaggagacggucuugcaaugggaauaaugauucucaaacuauugaccgacuuccaaucucaucaguugugggcaacucuauugucacuaaccuucauaaaaaccaccuuuagucuacacuaugccuggaagaccauggcuaugguucuaaguauaguaucauuauuuccguuaugcuuaucuacgacaagccagaaaacgacauggcuccccguccuucuuggcucauuaggauguaaaccacugaccauguuuuugauagcggaaaauaagauauggggcagaaagagcuggccacuaaaugaagggauaauggccgugggcaucgucaguauuuuauuaucuucauugcucaaaaacgacguuccacuagcgggcccccuaauugcaggaggcauguuaauagcaugcuauguaauaagcgguucaagcgcagaucucucuuuagagaaagccgccgaaguaaguugggaggaggaagcagaacacagcggagcuucccacaauauccucguugaagugcaagaugaugggaccaugaaaauaaaagacgaagagagagaugauacccuaacaauucucuugaaagcuacguuacuggcgguaucuggaguuuacccucuuucuauaccggccacacuauuuguuugguacuucuggcagaagaagaaacaacgaucugggguauuaugggacauaccgagcccaccugaaguggaaagagcugucuuggacgacgguauauacagaauuaugcagagaggccugcucggacguagucaaguaggugucggcguuuuccaagaaaauguauuucacacuauguggcauguuaccagaggagcaguucuaauguaucaggguaaaagauuagaaccgaguugggcaucuguuaagaaagacuuaauuucauauggaggaggguggagguugcaagggagcuggaacacuggugaagaaguucaagugauagcaguagaaccugggaaaaaucccaaaaacguucaaacagcucccggcacauucaaaacaagcgagggugaggucggggcaauagcgcuugacuuuaaaccaggaacaucagggaguccuauagugaauagggaagggaaaauagucggacuguacgguaauggaguagugacaacgucugguacauacguaucagcaauagcgcaagcuaaggcuucccaggaaggaccuuugccggaaauagaagaugaaguauuuaagaaacgaaaucucacuauaauggaucuacauccagguucuggcaagacgcgaagauauuuaccugccauuguucgugaagcaaucaagcgcaaacuuagaacauugauucuugcgccaaccaggguuguagccagcgaaauggcggaagcguuaaaaggcaugccaauacgauaucaaacaacugcgguaaaaucugaacacacgggaaaggaaaucguagauuuaaugugucacgcgacguuuacaaugagauuauuaucaccuguaaggguaccgaauuacaauaugaucauuauggaugaagcucacuucaccgauccaagcucaauugcugcacguggauauaucucuacaagggucggaaugggggaggcagcagcaauuuuuaugacugcuacaccaccuggauccguagaagccuuuccucaaucaaaugcaguuauucaggacgaagaacgagauauaccggaaaggagcuggaacucuggcuacgaauggauuacugauuucccaggaaaaacaguuugguucguccccaguaucaaaucaggaaaugacauagcuaauugccuacguaaaaaugggaagcguguuauacaacucagcaggaaaacguucgauacagaguaucagaaaacuaagaauaaugauugggacuaugugguuacaaccgacauuucagaaaugggagcuaacuuucgcgcagaucgugucaucgauccgagaagauguuuaaaaccaguuauuuuaaaagauggcccugagcguguaauucuugccggaccgaugccggugacaguugcuagugcagcucaacgaagaggacgaauagguaggaaucauaacaaagagggagaccaauauauauacaugggacaaccccugaauaacgacgaagaccacgcucauuggaccgaggcaaaaaugcuauuagauaauauuaacaccccagaaggaauuauaccagcccuauucgagcccgaaagagaaaaaucagcagcgaucgauggagaauauagguuaaggggugaagcucgcaaaaccuuuguggaacucaugcgacguggcgaucugccaguauggcuauccuacaaaguagcuagcgaagguuuccaauauucagaccgcagaugguguuuugauggcgaaaggaauaaccaaguuuuagaggagaauauggacguugaaauuuggacaaaagaaggagagaggaaaaaguuacgcccuagaugguuagaugcucgaacauauagugauccucuugcccugcgcgaauuuaaagaauuugccgcaggucgucguagcgucucgggcgauuuaauucucgaaauagggaagcugccacaacaucuaacacaaagggcccagaaugcacuugacaacuuagucaugcuacacaacagugagcaaggcggccgagccuaccgucacgcaauggaagaacuaccagacacgaucgaaacucuaaugcuauuggcccuaauagccguauuaacgggaggugugacacucuucuuucugaguggccguggacuaggaaaaacuagcauuggcuugcuauguguaauggcaaguuccgugcuucuuuggauggcuuccguugagccacacuggauagcagccagcauaauacucgaguucuuuuuaaugguguuacugauaccagaaccagauagacaacgcacgccccaggauaaucaacuagccuaugugguaauagggcuuuuguuuaugauucuaacuguugcagcuaaugaaauggggcuucucgagacgaccaagaaagaucuugguauaggacacguugccguagagaaucaucaucacgcagcaaugcuggacguagacuuacauccugccagcgcauggacacuauaugcaguugcaacaaccauaauuacaccaaugaugagacauacuauagaaaacacaacagcuaacauuaguuugacagcuaucgcaaaccaagcugcaaucuuaaugggauuagauaagggguggccgauaucgaaaauggauauaggaguaccguugcuggcauuaggauguuauucgcaagucaauccuuugacuuuaacggcgacaguauugauguuggucgcgcauuacgcaauaauugggcccggauugcaggcaaaagcaacgcgagaagcgcaaaagagaacagcugcugggauaaugaagaaucccacuguugauggcauagucgcaauagaccuagacccuguaguauacgaugccaaauuugaaaaacaacucggacaaauaaugcuucuaauuuuauguaccucgcagauacuucuuaugaggacgacaugggcguuaugugaguccauuacacuagccacuggaccucuuacaacucucugggaaggaucuccagggaaauuuuggaauacaacuauagcuguuucuauggcuaauaucuuucgggguagcuauuuagcaggagcaggccucgccuucucucuaaugaaaucauugggaggugggcguagagguacuggugcacaaggagaaacgcuaggagaaaaauggaaaagacaacuaaaucaacucucaaaaagcgaauuuaauaccuauaaacggucugggauaauggaaguagauagaagugaggcaaaagaagguuuaaaaagaggcgaaaccacgaagcaugcaguaucaaggggaacugcgaaguuaaggugguuuguagagcgaaaucuaguaaaaccggaagguaaagucauagaucuugggugcgguagagguggguggucauacuacugugcuggacuaaagaaaguaacggagguaaaaggauacacuaaaggcgggccugggcacgaagaaccaauacccauggcuacuuacggauggaaucuuguuaaacuacacaguggcaaagacguauuuuucauaccgccagagaaaugcgacacucuacuuugugacauaggggaaucaucaccuaacccgacaauagaagagggacgaacgcuaagagucuuaaagaugguugaaccuuggcucaggggcaaucaguuuugcaucaaaauucucaauccauauaugcccaguguaguagaaaccuuagaacaaaugcaacguaaacauggagguaugcuuguucgaaacccacucucaagaaauucaacacacgaaauguauugggugagcugugguaccggaaacauaguuuccgcgguaaauaugacaagucgaauguuacucaacagauucacaauggcccauagaaaacccaccuaugaaagagauguggaccuaggagcaggaacuaggcauguggccguugagccugaaguugcaaaucucgauaucauuggucaacgcauugaaaauauaaagcaugaacacaagaguacuuggcacuacgaugaagauaacccauauaaaacaugggcauaccaugggaguuacgagguaaaaccguccgguucagcuaguagcaugguaaacggagugguuaaacuguugaccaagccaugggauguuauaccaauggucacacaaaucgcaaugacagauacaacccccuuuggucaacaacgggucuucaaagaaaaaguugacacgagaacuccuaaagcgaaacguggaaccgcucaaauuauggaaguaacagccaaauggcucuggggauuuuuaaguagaaacaagaaaccucggauuugcacacgagaagaauuuacaaggaagguucgaucaaacgcagcuauuggagcgguauucguagacgaaaaucaguggaacagcgcgaaagaggcuguggaagaugaaagauuuugggauuuaguccaucgagaaagggaauugcacaaacagggcaaaugcgcaacaugcguauauaauaugauggguaagagagagaagaaacuaggcgaauuuggcaaagcgaaaggaagccgagcaauaugguacauguggcucggagcuagauuucuagaauuugaggcgcucggcuuuaugaaugaagaccacugguuuucucgagaaaacucacugucaggaguagagggagagggacuacauaaacuggguuauauacuuagggauauaaguaaaauuccuggagggaauauguaugcagaugauacagcaggaugggauacucguauaacagaggacgauuuacaaaacgaagcgaaaauuacagauauuauggaaccagaacaugcacuauuagcuaaaucuauauuuaaauugaccuaucaaaacaaaguaguccgcguacaaagaccugcgaagaacggaacggucauggaugugaucagucgacgggaucaaaggggcagcgggcaaguagguacguacggauuaaauaccuucaccaauauggaggcgcaauugauacgacaaauggaaucggaaggcauauucucuccgucagaauuggaaaccccgaaucuagcaggucgcguauuagacuggcuugaaaaauaugggguggagagauuaaaaagaauggcaauaucaggugacgauugcgucgucaaaccgauugaugaucgguucgcaacagcauugacagcauuaaaugauauggggaaaguuaggaaagacaucccacaaugggaaccgucaaaaggcuggaacgacuggcaacaaguacccuucuguucacaucacuuccaucaacuaauaaugaaagacgggcgcgaaauaguagugccuugcagaaaccaagacgaguuagucggaagggcccguguaucacagggcgcgggaugguccuuacgcgaaacggccugccuggguaagucauaugcacagauguggcaauuaauguauuuccauagaagagaccucaggcuugccgcaaacgcaauauguagcgcggugccugucgauuggguaccaacaucgcguaccaccuggucuauacaugcucaucaucaauggaugacaacugaagacaugcuuucgguauggaaucgaguauggaucgaagaaaauccauggauggaagacaaaacacacaucucuaguuggggagacguucccuaccuggguaaaagagaggaucaauggugcggcucacuaauuggacucacagcuagagcaaccugggcaacuaauauacaagucgcuauaaaccaagugaggagauuaauuggcaaugaaaacuauuuagacuauaugacauccaugaaaagauuuaaaaaugaauccgauccagaaggugcauuaugguga

SEQ ID NO: 21831 - RNA, 9879 nt, Artificial Sequence
  derived and/or modified CDS sequence (opt6) from DENV-1__GU131753__SS-prME
ucaguaacaaugcuuuuaaugcuaaugcccaccgcauuggcuuuccauuuaacaacucgaggaggggaaccacauaugauuguaaccaaacaagaacgagguaaaucacugcuuuuuaaaacgagugcaggggucaauaugugcacucuaaucgcuauggauuuaggcgaacucugcgaagauacaaugacuuacaagugcccuaggauuacagaagcagaaccugacgauguggacuguugguguaaugcaaccgauacguggguaacauaugggacauguucucaaacuggagaacaucgaagagacaaaagaagcguagcacuagcgccucaugugggucuaggcuuagaaacacguacagaaacauggauguccucagaaggcgcuuggaaacaaauucaacgaguugaaacuugggcauugaggcauccaggauuuaccgucacagcgcucuuucuugcacacgcaauugggacgaguauuacacaaaaaggaaucaucuucauccucuuaaugcuuguuacaccaaguauggcaaugcguuguguaggaaucggcucacgggacuucgucgaaggcuuaucgggcgccacauggguugauguaguauuagaacaugguagcuguguaacaacgauggccaaagauaaaccuacgcuugauaucgaauuauuaaaaacagaaguuacaaauccagccguucugagaaaacuuugcauugaagccaaaauuucaaacacaacaacugacuccagauguccaacacagggagaagcgaccuuaauggaagaacaagacgcaaauuuuguauguagacgcacauucgucgaccguggaugggggaauggcuguggucuauucggaaaaggcucacuuauaacuugugcaaaauucaaaugcguuacaaagcucgaagguaaaauuguucaauaugaaaaucuaaaauauagcguaauagugacgguacauacgggagaucagcaccaaguaggaaacgaaucuacugaacauggcacuaccgcuacaauaacuccacaagcaccaacuucagaaauacaauugacagauuacggggcuuuaacauuagacuguagcccccgcacaggucucgauuuuaacgaaaugguauuguuaacuaugaaagagaagucuuggcuggugcauaaacagugguuucuagaccuacccuuaccguggacaaguggggcuuccaccucacaagaaacuuggaaccgucaagaccuuuuagugacuuucaaaaccgcucaugcgaagaaacaagaaguugugguacuagggucucaagaaggagcaaugcauacugcacuaacaggagccacagaaauucaaaccagcggaacgaccacuauuuuugcaggacaucugaaauguagguuaaaaauggacaaacuuacacuaaaaggaaugucguacgucauguguacagguaguuuuaagcuagaaaaagaaguugcagaaacccaacacgguacuguccuaguacaaaucaaguaugaaggaacagaugcuccuugcaaaauuccauucucuacucaagacgaaaagggaguaacccagaauggaaggcucauaaccgcgaacccaauaauuaccgauaaggaaaagcccguaaauauugaagcggaaccuccguucggcgaaucauacauagucaucggugcgggggaaaaagcacuuaaacugagcugguucaaaaagggaucaucuauagggaaaauguuugaagcuaccgcacggggugcuaggcgaauggccauacugggagacacugcaugggauuuuggauccaucgguggcguauuuacgucaauaggaaaauugguacaucagauauuugguacagcguacgguguuuuauuuagcgguguaagcuggacuaugaaaauuggcauaggaguauuauuaacauggcucggucuuaauagccguucaacaucgcuaucuaugaccuguaucgccguaggacucgugacauuguaucucggcguuauggugcaggcggauuccgggugugugauaaacuggaaaggacgagaacuaaagugugggucaggaaucuucgugacgaacgagguacauacauggacugaacaguauaaauuccaggcagacaguccaaaaagauuaagugcagcuauuggaaaagccugggaggaaggcgucuguggaauacguucugcaacacgguuagaaaacaucauguggaagcaaauaucgaaugaacucaaucacauuuuacuugaaaacgacaugaaguuuacaguaguagugggcgacguuguugguauccuggcucaagguaaaaagaugauacgcccccagccgauggaacacaaauacaguuggaagaguuggggaaaggcaaagauuaucggugcggaugugcaaaauacuacguucauuauagacggcccuaacacgccagaaugcccggacgaccagcgggcauggaauauuugggaaguagaagauuacggauuuggaauauuuacaacuaauaucugguuaaaaaugcgcgauagcuacacucaaguaugcgaccauagacugaugucagccgccauuaaagacaguaaagcugugcaugcggauaugggcuacuggauagaaucggagaaaaaugaaacguggaaacuagccagagcaucauuuauagaaguuaaaaccuguaucuggccgaagucccauacauuguggucaaacgguguauuggaaagugaaaugauaauacccaaaaucuacggagguccuauuucacaacauaauuauaggccuggcuacuucacgcaaacugcugguccauggcaucucggaaaacuggaacuugauuucgaccuaugcgaaggaacgacagugguggucgaugagcacugcggaaauaggggaccgagccuacggaccacuacgguaacuggaaaaauuauacacgaaugguguugcagaaguugcacauuaccaccuuugagauuuaaaggagaagacggcuguugguacggaauggaaauacguccgguaaaggaaaaagaagaaaacuuagugaaaaguaugguaagugcugguuccggagagguugauaguuuuaguuuaggacuuuuaugcauaucuauuaugauagaagaagucaugagaagccgcuggucaagaaaaauguuaaugacgggaacucuugcaguguucuuacugcuaaucaugggucaauuaacauggaaugauuugauacguuuaugcauuaugguuggcgcuaacgcaucagacagaauggggauggguaccacauaccuggcgcugauggccacuuuuaagaugagaccaauguucgcagucggacuacuguuuaggaggcuaaccuccagggaaguacuuuuacuaacuaucggucuaagucuaguggcuagugucgagcugccaaacucucuagaagaacuaggugauggguuagcaaugggaaucaugaucuugaaauuacuaacugacuuucagucucaucaacuaugggcaacauugcuaaguuuaacauuuauaaaaacuacacucucauugcacuaugcauggaagacuauggcaaugguucuaaguauaguuucauuaauaccacucugcuuaucaacaaccucacagaaaacuaccuggcuuccuguucuacuuggaaguuuagguugcaagccacucacuauguuuuuaauagcagaaaacaagaucuggggacgaaaaucguggccacugaacgaaggaauuauggccguaggggucguaaguauuuuauuaaguucguuacuuaagaacgacguuccacuugcagguccacuaaucgccgguggaauguuaauagccuguuauguaauaagcggcuccucugcagaucugucacuagaaaaagcagcagagguauccugggaagaagaagcagagcauaguggagcuagccauaacauuuuaguagaaguacaagacgauggaacaaugaagauuaaagaugaggagcgagaugauacauugacuauccuauugaaggcaacccuuuuagcagucucggguguauauccucugucaauuccagcuacucuauuugugugguauuucuggcagaagaagaaacaaaggagugggguacuaugggacacaccaucaccgccagaaguagaaagagcuguccuagaugauggaauauaucgcauuaugcagcggggucugcugggacgaucucagguaggagucggagucuuccaagaaaacgucuuccacacuauguggcauguuacaagaggagccguguuaauguaccaagggaaaagacuugaacccaguugggcaucggucaagaaagauuuaauaucauacggaggaggguggcguuuacagggcucguggaauaccggcgaagaagugcaagugauagcaguugagccaggcaaaaauccuaaaaacgugcaaacagcaccaggaacuuuuaaaacuccagaaggugaaguaggugcaaucgcucuggacuucaagccgggaacuagcgguuccccaauagucaaccgagaggguaaaauaguaggacuauacgguaacggaguaguaacuacaagcggcacuuauguuagugcaauagcucaggcaaaagcaagucaagaagguccucuuccggagauugaggacgagguuuuucgcaaacgaaauuugacgauuauggaucuucacccaggguccggaaagacuagacgguauuugccggcaaucguccgagaagcaaugaaaagaaaauuaagaacucucaucuuggcaccaacaaggguuguagcuucagaaauggcagaagcauuaaaagguaugccuauaagauaucaaacaacagcaguaaagucagagcauacagguaaagagauaguugauuuaaugugccacgcaacguuuacgaugaggcuucucucuccaguccgggugccaaauuauaacaugauaauaauggaugaagcucacuucacggacccgucaaguauagcugcacguggguacaucucaacaagaguaggaaugggggaagcagcagcuaucuuuaugacagcgacuccacccgguucagucgaggccuuuccacagagcaaugccguaauacaagacgaagaaagagauauaccugaaaggucuuggaacucuggauacgaguggaucacagacuuucccggcaagacagugugguucguaccaucuauaaaaucagguaacgauauagcaaauuguuuaagaaagaauggaaaacgaguaauccaauugucuaggaaaacuuuugauacugaauaccagaaaacuaaaaacaacgauugggauuaugucgugacaacugacaucucagaaaugggagcuaacuuucgagcagauagaguuauagauccucguagaugccuaaaaccaguaauccuaaaggacggaccugaacguguaauccuggcuggaccaaugccgguaacaguggcaucagcugcacagcgucguggaaggauagguagaaaucacaauaaggaaggggaucaauauauauacauggggcaaccguuaaauaaugaugaagaccaugcacacuggaccgaagcgaaaaugcugcuagacaacauuaauacaccugagggcaucauaccagcauuguuugagcccgaacgcgaaaaauccgcagcaauugauggggaguaccguuugcgaggagaagcgagaaagaccuucguggaacuuaugcgaagaggugaccuuccuguuugguuaaguuauaaaguugccagugaaggcuuccaguacagugacagaagauggugcuuugauggggaaaggaacaaccagguuuuggaagaaaauauggacgucgaaauauggacuaaagaaggggaaagaaagaaauuacgaccucguuggcuagaugccagaacauacagugacccacucgcuuuaagagaauuuaaagaguucgcagcaggcagacgaagcgucaguggagauuuaauauuagaaauugggaaguugccacaacaucucacgcaaagagcacagaaugcucuugauaaccuugucaugcuacacaauucagaacaagguggaagggcuuaccgccacgcaauggaagaacuaccagacacuauagaaacuuuaaugcuacuugcuuuaauagcaguacuaacaggaggcguaacucuauuuuucuugaguggaagaggcuuaggaaaaacgaguauaggccucuuaugcguuacagcaucgucagucuuauuauggauggcaucaguagaaccacauuggauugccgcaaguauaaucuuagaguucuuuuuaaugguacuauuaaucccggaaccugacagacaaagaacaccucaagacaaccaacuagccuauguaguaaucggacuuuuauuuaugauucuuacgguugcggcuaacgaaauggggcuccuugaaacgaccaagaaagacuuaggcauugggcacguagcagucgaaaaucaccaccacgcuacgauguuagauguagaccuucauccugcuagugccuggaccuuauaugcaguagcaacuacaauuauuacuccuaugaugagacauacaauagagaacacgaccgccaauauaagucuaacagcaauagcuaaucaggcagcuauuuugaugggguuggauaagggauggccgauuucuaagauggauauaggugucccguuacucgccuuaggcugcuauagccaagucaauccucuuacguuaaccgcagcuguacucauguuaguggcacauuaugcaauaauuggccccggguuacaagcaaaagcgacuagagaagcacagaaaaggacagcagccggaauaaugaaaaaucccacgguagacggcauuguggccauagaucuugauccaguuguuuacgaugcaaaguuugaaaagcagcuuggucaaauaauguuguugauccuuuguacaagucaaauuuuauugaugagaacaacaugggcccucugugagucgaucacucuagcuacaggaccucuaacgacccucugggaaggaagcccggguaaauucuggaauacaaccauagcaguuaguauggccaauauauuuagagguucuuauuuagccggugcaggauuagcuuuuuccuuaaugaaaucguugggcggugguagacguggcacuggagcccaaggagagacacugggagaaaaauggaaacggcaauugaaucagcuaaguaaaucagaguucaauauauacaagagaucagggauaauggaaguagaucgcuccgaagcgaaagagggguuaaaacgaggugagacaacuaaacacgcaguaagccggggaacagcaaaauugagaugguuuguugagaggaauuuaguaaaaccugaaggaaaggucauugaccuagguugugggaggggaggcuggaguuauuauugugcgggccugaagaagguuacagaaguaaaaggauauacaaaaggaggaccugggcaugaagaacccauaccgauggccacuuacgguuggaaccucguaaagcuacauucgggaaaagauguauucuuuacaccuccugaaaaaugugauacauugcuaugcgauaucggggaaaguagcccaaauccuacuauugaagaaggaagaacucuacgagucuuaaaaaugguagaaccauggcuaaggggaaaccaauucuguauuaagauacugaauccauauaugccgucaguuguagagacgcuagagcaaaugcaacgcaaacacggaggaauguuaguucggaacccauuaucgagaaacaguacacacgaaauguacuggguuucuugugguacaggcaacauaguuagugcgguaaauaugaccucaaggauguuacuaaaucgcuuuaccauggcucacagaaaaccgacauaugaaaaagacguagaccuuggugcggguaccagacacguagcuguagagccggagguagcuaauuuagauauuauuggacagaggauagagaauauuaaacaugaacacaagucuaccuggcauuaugaugaagauaacccuuauaagaccugggcguaccacggcaguuacgaaguaaagccaaguggaucggcaagcucaaugguuaacggcgugguaaaacuucugacuaaacccugggauguaauuccaauggugacccagauagcgaugacagauacaacaccauucgggcagcaaaggguauuuaaagaaaaaguggauacuagaaccccaaaagcaaagagagguaccgugcaaauaauggaaguaacggcacgauggcuuugggguuuucugucuagaaacaagaagccuagaauuugcacuagagaggaguuuacccgaaaaguaaggucaaacgccgccauuggagcggucuucgucgaugaaaaucaauggaacucugccaaagaggcaguagaagacgaaagauucugggaucuggucaaaaaggaaagagaauuacacaagcaaggaaagugugcaacaugcgucuauaauaugaugggaaaaagagaaaagaaacuaggggaguucgguaaagcuaagggaagucgagcgauaugguauaugugguuaggagcuagauuuuuggaauuugaagcauuagguuucaugaaugaagaucauugguuuucuagagaaaacucgcuuaguggcguugaaggugaagguuuacauaagcucggcuauauauuacgcgacauauccaagaucccuggugguaauauguaugcagaugauacagcuggaugggauacacgcauaacugaagaugauuuacagaacgaagcaaagauuacugauauuauggagccagaacaugcgcuacuugcgaccucaauuuuuaaacuuacguaucaaaauaaagugguaagaguacaacgacccgcuaagaacgggacuguaauggacguaauaucgcgaagggaccaacgugguaguggacaaguagguacauacgguuugaauaccuucacaaauauggaagcgcaacuuauuaggcaaauggagucagaaggaauauuuuuaccuagcgaacuggagacaccgaaccuugcagaaagaguauuugauuggcuagaaaaauauggaguggagaggcugaaaagaauggcuaucagcggcgaugacuguguuguaaaaccgauugaugacagguuugcaaccgcucucacagcucuuaacgauaugggaaaaguaagaaaggauaucccccaaugggagccaucuaaagguuggaaugauuggcagcaaguuccuuucuguucgcaucacuuucaccagcuuauaaugaaagacggacgagaaauuguagugccauguagaaaccaagaugaacucgucggaagggcgaggguuucucagggcgcaggauggaguuugcgcgagacugcuugucuaggaaaaaguuaugcacaaauguggcaacucauguacuuucauagaagggacuuacgucuugcagcaaaugcaauuuguucugcugugccuguagauuggguacccacaucaagaaccacuugguccauucaugcgcaucaucaauggaugacuacggaagauauguuaucaguuuggaaccgagucuggauugaagaaaauccuuggauggaagauaagacacauguaucaagcuggggugaugucccauacuuagguaaaagggaagaccaguggugugggucguuaaucggguuaacggcaagggcaacaugggcuucuaacauacaaguagccauaaaccaaguacgacgcuugauaggcaaugagaauuaccuugauuacaugacgucuaugaaaagguuuaagaaugaaggagauccggaaggggcacuuugguaa

SEQ ID NO: 21832 - RNA, 9879 nt, Artificial Sequence
  derived and/or modified CDS sequence (opt6) from DENV-1__GU131754__SS-prME
ucggugaccauguuguuaaugcuuaugccgacggcgcuggcauuucaucuaacgacacgcgggggagaaccgcauaugauagucaguaaacaagaacgcgggaaaagucuuuuauuuaaaaccagugcuggaguaaauaugugcacacugauugcaauggaucuaggggaauuuugugaagauacuaugacauauaaauguccaaggauuacagaagcagaaccugaugacguagacugcuggugcaacgcaacggacacguggguaaccuacgguacuuguagucaaacuggagaacaucgaagggacaaacgaagcgucgcacuugcaccacaugugggauuaggauuagaaacaagaacagaaacuuggaugagcagugaaggggcuuggaaacaaauucaaaggguugaaacuugggcacugcgccaucccggauucaccguuauagcauuauucuuggcacaugcaauaggaacaucaauuacucaaaaagggauuauuuucauauuacucauguuagugacgccaagcauggccaugagauguguaggaauuggaagcagagauuucgucgaaggucugagcggagcaacuugggucgaugugguacuugaacacggaagcuguguaacaacaauggccaaagauaaacccacacucgacauugaauuacuuaaaacagaagucacaaacccagcuguccuccggaaauuauguauugaagcaaaaauuucuaacaccacuaccgauagucgauguccaacacaaggagaggcaacucuggucgaagaacaagaugcaaauuucguuuguagaagaacauucguugauagggggugggguaacggauguggauuauucgguaaaggaucgcucauaacaugugccaaauuuaaaugugucaccaaauuggaagguaaaaucguacaauaugaaaaucuaaaauauaguguaauugucacaguucauacaggagaucaacaccaaguaggaaacgaaucaacugagcaugggacgacagcuacuauuacaccacaagcaccaaguacugagauacaauugacggauuacggugcgcuaacgcuugauuguaguccgaggacaggacuagacuuuaacgaaaugguauuacuaaccaugaaagagaaaagcuggcucguccacaaacagugguuucuagaccugccauuaccauggacaaguggagcauccaccucccaggaaacauggaaccgacaggaucuauugguuacauuuaaaaccgcacacgcaaagaaacaggaagucguuguacuaggaucgcaagaaggcgcaaugcauacugccuuaacuggagcuaccgaaauacaaacuucagguacuacaacaaucuuugcuggucaccuuaaauguagauuaaaaauggauaaacugacauuaaagggaaugucauaugugaugugcacaggaaguuuuaaauuagaaaaggaaguugcagaaacacaacacggaacuguacuggugcaaauaaaauaugaaggaacugaugcaccguguaaaauaccauucucuacucaggacgaaaagggaguaacucagaauggacgauuaauaaccgcaaacccaauaguaaccgauaaggauaaaccaguaaacauagaggcggaacccccuuuuggagagucauauauaguaauuggcgccggugagaaagcgcucaaauuaucaugguuuaaaaagggaucuuccauuggaaaaauguucgaagcaacugcuaggggcgcaagacgcauggcaauucucggugauacugcuugggauuuugggucuauagggggaguauuuacgucaguaggcaagcuaguacaucaaauuuuugguacagcguacggaguccucuuuaguggaguuucguggacuaugaagauugguauaggcguuuuauuaacgugguuagggcuaaauucacgaaguacaucuuuaaguaugacuugcauugccguuggauuaguuacucuuuaucuaggaguaaugguacaggcugacaguggguguguuguuaauuggaaggguagagaacuaaaauguggaagcggcauuuucguaacuaacgaagugcauacauggacagaacaguacaaauuccaagcagacagcccaaaacgacucuccgcugcaauuggaaaggcaugggaggagggcguauguggaauccgaagugcuacgcgucuugaaaauauaauguggaaacagauuucgaaugaacucaaucauauucuacucgaaaacgacaugaaguuuacgguuguuguaggagauguagcaggaauacuugcgcaaggcaagaaaaugauuagaccacagccuauggaguauaaauauucuuggaaaaguuggggaaaagcuaagauaaucggagcagauguucagaauacaacauuuauaauagacggaccaaauacgccugaguguccagacgaccagcgcgcauggaauauuugggaaguagaagacuacggcuuuggcaucuuuacgacuaauaucuggcuaaaacuucgagacagcuauacgcaagugugcgaccaucgucuaaugucugcagcgaucaaagauagcaaagcagugcaugcugauaugggauacuggauagagucggagaaaaaugaaacauggaaacuggcuagagcgaguuuuaucgaaguaaaaacguguaucuggccaaaaucucauacgcuuuggucaaacggaguacuggaaucugagaugauaauccccaagaucuauggaggaccuauuucucaacacaauuaccgcccaggauacuuuacccaaacugcgggccccuggcacuuaggcaaacuugagcuagacuucgauuuaugugaaggaaccaccguagugguagaugaacauugcgggaaucgaggccccagucucagaacaacuacagucacagguaaaaucauucacgaauggugcugccgaaguuguacucuuccgccccucagauuuaaaggcgaagauggguguugguaugggauggagauaaggccaguaaaagaaaaagaagaaaacuuagucaaaucgaugguuucagcaggaucgggagaaguagacucauuuucauuagggcuuuugugcaucaguauuaugaucgaagagguaaugcguucacgguggucuaggaaaauguuaaugacgggaacauuagccguguucuuucuauuaauuaugggccaacuaaccuggaacgaucuuauacgcuuaugcauaauggugggagcgaaugcaagcgacaggaugggcaugggaacgacuuacuuggcccucauggcgacguuuaagaugcgcccuauguuugcaguuggacucuuguucagacgccucacaucacgggaaguccuucuucuuacuauaggcuuaucccuuguugcuucuguagaacugccaaauucacuggaagaacuaggugauggauuagccaugggaaucaugauauuaaaauuacugaccgauuuucagagccaccagcugugggcaacgcucuuaucacucacuuucaucaaaacuacuuucucauuacauuaugcauggaaaacgauggcaaugguacuuuccaucguaagccuguuuccgcucuguaugaguacgacaucucagaaaacuacgugguugccuguucuauuaggaucgcuagguuguaaaccauuaacgauguuucucauagcagagaauaagaucuggggacgaaaaagcuggcccuuaaaugaaggaauuauggcaguaggaauaguaucaauucuauugaguucgcugcugaagaaugauguaccauuagcggggcccuuaauagcuggcggaaugcucauagcguguuacgucauaaguggcucgagcgcagaucuaucacuagaaaaagcagcggaaguuagcugggaagaggaagcugaacauucaggugcaucgcacaacauauuaguugaaguucaagaugaugguacaaugaaaauaaaagacgaagagagagaugauacucuaaccauccuucuuaaagcgacguuacuugcagucucaggaguauacccucuuagcauuccugcuacauuauucgucugguauuucuggcaaaagaagaaacaaagaucaggagugcuaugggauacaccaucaccaccggaaguagaaagagccguacuagaugacggaauauauaggauaaugcaaagaggacuacuugguagaagucaaguagggguagggguguuccaagaaaauguauuccacacaauguggcacguuacucggggcgcuguguugauguaucagggaaaacgucuugaaccaagcugggcuagcgugaagaaagacuuaauaucauacgggggcggcuggcgacuacaagguucauggaauacgggcgaagaaguacaaguuauugcaguugaacccggcaaaaaccccaaaaauguacagacagcuccuggaacauuuaaaaccucagaaggugaaguaggagcuauagcauuagacuucaagccuggaacaucaggaucgccaauaguaaaucgugaaggaaaaaucguggggcuguauggcaacgguguugugacuaccucaggaacuuauguuucugcgaucgcgcaagccaaagcgucucaagaaggcccucucccagaaauagaagacgaaguauuuaggaaaagaaauuuaaccaucauggauuuacacccuggaaguggaaagacccgacgcuauuugccugcaauaguacgagaagcuauaaaaagaaaguuaagaacucuaauauuagcaccaacaagaguggucgcuagugagauggcagaggcgcuuaaggggaugccaauaagauaucagaccacggcggucaagagugaacacacggguaaagagauaguugaccugaugugucaugcaacauuuacgaugcgauuacuuuccccaguuagaguaccgaacuacaauaugaucauaauggaugaagcccauuucaccgacccuuccucuaucgcugccagggguuacauaucuacaaggguaggcaugggagaagcggcagcaauauuuaugacggcaaccccaccaggaagugucgaagcguucccgcaguccaaugccguaauccaagaugaagagagggacaucccagaacgaucuuggaauagcggauacgaguggauaacagauuuucccgggaagaccguaugguuugucccgaguauuaagaguggaaacgacaucgccaauugccuaaggaaaaaugguaaaagaguuauacaguuauccagaaaaacuuuugacacggaguaucagaaaacuaagaacaaugacugggauuacgugguuacaacugauauuucagaaaugggagcgaauuuuagagccgaucgagucauagauccgcgucguuguuuaaaacccgucauacugaaagaugggcccgaacgggugauauuagcaggaccuaugccuguaacagucgcaagcgcagcgcaaagaagaggacguauuggaagaaaucauaauaaggaaggagaucaguauguguauaugggucagccccuuaacaaugacgaagaucaugcacauuggacugaggccaaaaugcuacuugauaacauaaacacgcccgaagggaucauaccggcacuauuugagcccgaaagagagaaaagcgcagcuaucgacggggaauaucguuuaagaggagaagcaagaaagacuuucgucgaauuaaugcggcgaggagacuuaccgguguggcuuucuuacaaaguggcauccgaaggauuccaauauuccgacagaagaugguguuucgauggggagcguaauaaucagguccucgaagaaaauauggacgucgaaauauggaccaaggaaggggaacggaagaaacuacgcccaagaugguuagaugccagaacauauuccgacccacucgcgcuacgggaauuuaaggaguuugcagcaggcaggagguccgucucgggagacuuaauauuagaaaucggcaaacugccacaacaucucacgcaacgcgcacagaaugcauuagauaaccugguaaugcugcauaauucugaacagggagguagagcuuauaggcacgcaauggaagaauuaccagacacuauagaaacgcuuauguugcuggcccuaauugcuguauuaaccggaggagucacuuuguucuuuuuaucaggcagaggccuuggcaagacaaguaucggucucuuaugugucauggcaaguagcgcauuacucuggauggcuaguguggaaccacauuggauugcugccaguauaauacuggaauuuuuccucauggugcucuugauaccagaaccagauagacagaggacuccccaggauaaccagcuagccuauguuguuauagggcucuuguucaugauucuaacagucgcugcaaaugagaugggccuacuagaaaccaccaaaaaggauuuaggaaucggccauguugcaguugaaaaucaccaucaugcggcuaugcuagauguagaucuacaucccgcuucggcauggacacuauaugcaguugcaacaacaauaaucacuccgaugaugcgacauacaauagaaaacacaacagcgaauauuucguugacagcaauugcaaaccaagcugcuaucuuaauggguuuggauaaaggauggccgaucuccaaaauggauaucggagucccacuacuagcucugggcugcuauucccagguaaacccauugacucuuacggcggccguacuuaugcuaguagcacacuacgcgauaauugggccuggauuacaagcaaaagccacaagagaagcacaaaagcgaacggcugcugguauuaugaaaaacccuacaguagacgguaucguagcgauugaucucgauccugugguuuacgaugcaaaauuugaaaagcaacuaggacaaauaaugcuuuuaauucuuuguacaucacaaauacucuuaaugcgaacuacuugggcucucugugaaaguauaacccuagcgacagguccuuugacaacguuaugggaagguuccccuggaaaauuuuggaacacgaccaucgccgucaguauggcaaauauauuccgaggaucuuauuuagcaggagcgggacuagcauuuagcuuaaugaaaucacuagguggcggacgcaggggaacaggagcccaaggcgagacacucggugagaaguggaagagacaguuaaaucaauuaucgaaaagugaguucaauacuuauaaacgaucagguaucauggaaguugauagaucagaagccaaagaaggacuaaaaaggggugaaaccacuaaacacgcgguuuccagaggaacagcaaaacuaagaugguucguugaaagaaaucuuguaaaaccagaagguaaaguuaucgaucuagguugcggucguggagguuggucuuacuauugugccggacuuaagaaagucacggaaguaaaaggauauacaaaagggggaccagggcacgaagaaccuaucccgauggcuacuuacggauggaacuuagugaaacugcacucagggaaagacguguucuuuauuccaccagaaaagugugauacacuauuaugugacauaggagaaaguucaccaaauccuaccaucgaagaaggcagaacccugagaguccuaaaaaugguugaacccugguuacgagggaaucaauuuuguaucaaaaucuuaaauccuuauaugccaucgguaguugaaacucuggaacaaaugcaaagaaaacauggaggaaugcuuguaagaaauccacuaucucgcaauucaacacacgaaauguauuggguuucuugcgggacagguaauauagucagcgcagugaacaugacaucaaggaugcuucucaauagauuuacaauggcacaucgaaagcccacuuaugaaagggacguggacuuaggagcugguacaagacacguugcaguagaaccagagguugccaauuuggauauaauuggucagcgaaucgagaauauaaaacacgaacauaaaucaacuuggcauuaugacgaagauaauccauauaagacaugggcuuaucaugguuccuaugaaguaaaaccuucgggauccgccucgaguaugguuaaugguguuguaaaacuuuuaacaaaacccugggacgugauaccaaugguaacgcagauagcgaugacagacacaacgccguucggacaacaaaggguauucaaagaaaaaguugauacaagaaccccuaaagcuaaacgggguacagcacaaauaauggaagucacagcaaagugguuauggggauuuuugucaaggaauaaaaagccucgaauuuguacucgagaagaauuuacgaggaaaguccgaucaaacgcagcuauaggagcagucuuugucgacgaaaaccaauggaacagcgccaaagaagccgucgaagaugaacgcuuuugggaucuaguucaucgugaaagagaauuacauaaacagggcaagugugcaacuugcguuuauaauaugauggguaaaagggagaagaaauuaggagaauuugggaaggcgaaaggcuccagagcaaucugguacaugugguuaggugcacgguuccucgaguucgaggcuuuaggauucaugaacgaagaucauugguuuagccgugaaaacucccuaucgggugucgaaggagaaggucuacacaagcuaggauacauccuaagagacauuagcaaaauuccaggcggaaauauguacgcagacgauacagcagggugggacacucguaucacugaggaugaucugcaaaaugaagcaaaaauuaccgauauaauggaaccggagcaugcgcuguuggccaaauccauauucaaacucacauaccaaaauaaagugguacggguccaacgacccgccaaaaauggcacggucauggacguaauaucgcgaagagaucaacgagguaguggacaggugggcaccuauggcuuaaacacauuuacgaacauggaagcacaauuaauuagacagauggaaucggaagguauauucaguccaucagaacuagaaacuccuaaucuugcaggacguguucuugacuggcuagaaaagcacggagucgaacguuugaagcgaauggcaaucaguggagaugacugcguaguuaaaccaauugacgacagauuugcuacggcuuuaaccgcacucaacgauauggggaagguaagaaaagauaucccgcaaugggaaccuaguaagggauggaaugacuggcaacaaguuccauucugcagucaccauuuccaucaauugauuaugaaagauggcagggagauaguugucccauguaggaaucaggaugaauuagucggcagagcuagagugucacagggugcuggauggucacucagagaaacggcaugccuuggaaagagcuaugcacagauguggcaauuaauguauuuucauagaagggacuuaagacucgcagcuaaugcgauauguucagcaguuccaguagacuggguaccuacaaguaggacgacauggucaauucaugcucaccaucaauggaugaccacagaggacauguuaaguguauggaauagaguguggaucgaagaaaauccauggauggaagauaagacacauauaucguccuggggagacguaccauauuuggguaagagagaagaccaaugguguggcucacuaauagguuugacugcacgggcaacaugggccacaaauauacaaguagcaaucaaucaaguccguagguuaauagguaacgaaaauuauuuagacuauaugacgucaaugaagcgauuuaaaaacgaaagugacccagaaggugcauuaugguga

SEQ ID NO: 21833 - RNA, 9879 nt, Artificial Sequence
  derived and/or modified CDS sequence (opt6) from DENV-1__GU131755__SS-prME
ucggugacuaugcuguuaaugcugaugccgacagcccucgcguuucacuuaacaacgcgugguggagaaccccauaugaucgugucaaagcaagagcgaggaaaauccuuguuauuuaaaacuagugcgggaguaaauaugugcacuuuaauugcaauggacuuaggcgaacuuugcgaagauacuaugaccuauaaaugccccaggauuacagagacugaaccugacgauguagacugcuggugcaacgcaacagacaccuggguaacguacgguacaugcucacaaaccggcgaacaucgacgagauaaaagaagcguagccuuagcaccacauguugggcuuggacuagaaacucggacggaaacguggaugucaucagaaggcgcguggaaacaaauucaacgcguagagacaugggcgcugagacaucccggcuuuacagucauagcucuauucuuagcacacgcaauugggacaucuauaacucaaaaaggaauuauuuucauacuucuuaugcuagucacuccgaguauggccaugcgauguguuggaauagguagccgggauuucguugaggggcuuucgggugcgaccugggucgauguaguuuuggaacaugguucaugcguaacgacaauggccaaagauaaacccacccuagauaucgaacuacuuaaaacagaggucacgaauccugcagucuugagaaaguuauguauugaagcuaagauuucaaacacuacaacagauucaagaugcccgacucagggagaagcaacucugguggaagaacaagacgccaauuucguguguagacgaacauuuguggaccggggguggggaaacggaugcggcuuguuuggaaaaggcucauuaaucacuugugcaaaauucaaaugcguuacaaaacuagaagggaaaauuguacaguaugaaaaccuaaaauauagcguaauagugacuguccauacuggagaccaacaucaaguuggcaacgagucaacagaacacggaaccacggcgacaauuacgccacaggcacccacuacagaaauccaacuaacagauuacggagcacuuacucuagacuguaguccgaggacaggacuugauuucaaugaaaugguucuauugaccaugaaagagaaaucuuggcuuguccauaaacagugguuuuuagaucuuccauugcccuggaccucaggagcgaguacaucucaagaaaccuggaauagacaagauuuacuagucacauucaaaacagcacaugcgaaaaaacaggagguugucguuuuggggucacaggaaggagcaaugcacacagcacuuacuggggcaacagaaauacaaacaaguggaacaacaacaauuuuugcuggccaucugaaaugccgccuuaaaauggauaagcugacuuuaaggggaaugucauauguaauguguacaggaagcuucaaauuagaaaaagagguugcagaaacacaacacggaacaguucuaguccagaucaaauaugagggaacagaugcccccugcaaaauuccguucucaacucaagacgaaaaaggagucacucaaaacgguaggcuaaucacugcaaacccuauaguaaccgauaaagaaaaaccagugaauaucgaagcugagccaccauuuggggaaaguuauauaguaauaggugcaggagagaaggcucuuaaguuaucuugguucaaaaaagguucaagcauagguaagauguuugaggccacagcaagaggagcacgcagaauggcuauacuaggagauacugcaugggauuucgguagcauuggaggaguauuuacgagcguaggcaaauuaguucaucagauauuugggacggcauacgguguguuguuuucaggcguguccuggacuaugaagaucgguauagggguauuacuaaccuggcuaggcuuaaauucacgauccacuuccuuaucuaugacaugcauugcaguaggauuaguaacacuuuaccuaggcguuaugguacaagccgauuccgguugcguuaucaauuggaaaggacgagaauuaaaaugugguucugguauauucguaacuaacgaagugcacacauggacagagcaauacaaguuccaagcggauagucccaagcgauuaucugcagcuauuggaaaagcaugggaagagggagucugugguauaaggucggcaaccagacuagaaaacauaauguggaaacaaaucucaaaugaacugaaccauauauuauuagagaaugauaugaaauuuacgguuguagucggagacguagcaggaauuuuggcacagggcaaaaagaugauaagaccucagcccauggaauacaaauauucauggaaaucuugggguaaagcgaaaauuauaggcgcagacguccaaaacacuaccuuuauuauagaugguccaaacaccccugaauguccagacgaucagcgugcauggaacauaugggaaguugaagauuauggguuuggaauauuuacuacaaauauaugguuaaaacuaagagacagcuauacucaagugugugaccauaggcuaaugagugcagcgauaaaagauagcaaagcgguacacgcagauaugggauacuggauagaaucagaaaaaaaugagacauggaaauuagcaagagcaucauucauagaggucaaaacuuguauauggccaaagagccacacauuguggaguaauggaguucucgaaucagagaugauaauacccaaaaucuacgguggaccaauaagccaacauaauuaucgaccaggauacuuuacccagacggcaggcccuuggcauuugggcaaauuagaacuggauuucgauuuaugcgaagguacgacaguagucguugacgaacauugugggaacagagggccgagccuccgaaccacaacaguaaccgguaaaauuauucaugaguggugcuguagauccuguacauugcccccauugagguuucggggagaagacggcugcugguaugggauggaaaucagaccgguuaaagaaaaagaagagaacuuagucaaauccaugguaucggcaggauccggagagguggauaguuuuucgcucgggcuucucugcaucucgauaaugaucgaagaagucaugcgguccagauggagcaggaaaauguuaaugacaggaacucuagccguuuucuuuuuguuaauuaugggacaauuaaccuggaaugaucuuauccgccucugcauaauggugggagccaaugccagugaccgcauggguauggguacuaccuaccuagcauugauggcaacauuuaagauaagacccauguucgcuguuggacuucuguucagacggcuaacaucgcgggaaguccuauuacuaacaauuggcuugucguugguugcaucaguggaauuaccaaacucucucgaggaacuuggugauggauuagcaauggguauaaugauucuuaaguugcuuacugauuuucaaucucaccagcuaugggcuacauuacuuucacuaacauuuauaaaaacaaccuuuucccuacauugugcguggaagacaauggcgauggugcuaucgaucguauccuuguucccauuaugucuuucuaccacaagucaaaaaacgacaugguuaccagugcuauuaggaagucuuggguguaaaccccuaacaauguuccuuauagcugagaacaaaauauggggacguagaucauggccacuuaacgaaggaauaauggcaguugggauaguuucgauacuacuaaguucucuacuuaaaaacgaugugccuuuagcagguccacugaucgccggaggaaugcugauagcuuguuauguaauauccggcaguucagcugaucuaucccucgaaaaggcugcugaaguaagcugggaggaagaggcugaacacagcggcgcaucgcacaacauauuaguggaggugcaagaugacgggacuaugaaaauaaaagaugaagaacgagacgauacuuuaacuauauuauuaaaagcaaccuuguuagcaguaucaggaguauacccauuaucaauaccugcaacucuauucguaugguauuucuggcagaaaaagaagcaacguucagguguacucugggauacgccuagcccaccagagguagaacgagcaguacuugaugacggaaucuacagaaucaugcaaaggggacuauuggggcguucacaagucgguguaggaguauuccaagaaaauguauuccacacaauguggcacgugacucggggugcaguccuuauguaccagggaaaaaggcuggaaccguccugggcuucugugaagaaagauuuaauuagcuacggcggagguuggagauuacaaggcucauggaauacaggagaagaaguucaaguaauagcaguggagccuggcaaaaauccgaaaaaugugcagacugcuccugggacauucaagacacccgagggcgaagugggggccaucgcauuggauuucaagcccgguacaagcgggaguccaaucguaaaccgggaagguaagauuguaggacuauaugguaauggagugguuacuacaucaggaaccuauguguccgcgauagcccaagcaaaagcuagccaggaagguccacucccagaaauagaggacgaaguauuuagaaaaaggaacuuaacaauuauggaccuacauccugggagugguaagaccagaagauaucuuccagcuauagucagagaagccauaaaacgaaaacuacguacacuaauacuagcaccuacgaggguuguagcaucagaaauggcagaagcacuaaaaggaaugcccauuagauaucaaacaacggcaguaaaaucagagcauacgggaaaggaaauaguggaucuuaugugccaugcuaccuuuaccaugcggcugcuaucaccaguccgugucccaaauuacaauaugaucauuauggacgaagcccauuuuaccgauccuucgucaauagccgcaaggggauauaucucgaccagaguaggcaugggagaagcagcagcuauuuuuaugacagcaacgccgccaggaaguguagaagcguucccacaauccaaugcugugauacaagaugaagaaagggacauuccagaaagaaguuggaauaguggauacgaauggauaaccgacuuuccuggaaaaacgguaugguuuguucccucuauuaaauccgguaaugauauagcaaauugccuaagaaagaauggaaaaagaguuauacaacucucuagaaagacguucgacaccgaguaucaaaaaaccaaaaacaaugauugggauuacguaguuacgaccgauaucagcgaaaugggagcaaauuuccgagccgaccggguaauagaccccagacgcugucucaagccaguaauauuaaaggaugguccggaacgaguaauuuuagcuggaccaaugccugugacagucgcgagugcagcccaacgacggggaagaauagguaggaaucacaacaaagaaggggaucaguacauauauaugggucaaccuuuaaacaaugaugaggaucaugcacauuggacagaagcgaaaaugcuucuagacaauauuaauacaccugaagggaucauuccagcauuauuugaaccugagcgggagaaauccgcagcaauagauggcgaauaccgccuuagaggcgaagcuagaaaaaccuucguugaacuaaugagacgaggugauuuaccuguguggcuauccuacaaaguugcaucugaagguuuccaauauagugauagaagaugguguuucgacggugaaagaaacaaccaagucuuggaagaaaauauggacguugaaauauggacaaaggaaggagagcguaaaaaacuuagaccccgaugguuagacgccagaacauauagcgacccacuagcucuaagagaguucaaagaauucgcagcaggaagaaggucagugucaggugacuuaauucuugaaauaggcaaauuaccacaacauuugacucaaagagcccaaaaugcgcuagauaauuuagucauguuacacaauucugaacaaggugggcgcgcuuaccgacaugcaauggaagaauuaccggacacgauagaaacgcucauguugcuugccuuaauagcaguacuaaccggcggaguaacuuuauuuuuccuguccggacgagguuuggguaaaacaagcaucgguuuauuaugcguaauggcgucaucugugcucuuguggauggcaagcguagagccucacuggauugcugccucaauaauuuuagaauucuucuuaaugguauuacuaauaccugaaccugacaaacaaagaacuccucaagacaaucaguuggcauauguaguuaucggccuacuauuuaugauacugacuguugcagccaaugaaaugggccuacucgaaacaacaaaaaaagaccuugggauagggcauguggccguagaaaaccaccaccacgccgcuaugcuagacguagaucuacauccggccucugcguggacauuguacgcuguugcaacuacgauuaucacccccaugaugcgccauacaauagaaaauacuacagcaaauauuucacuaacagccauagccaaucaagcugcuauucugaugggccucgauaaaggauggccgaucucaaagauggacaucgggguaccuuuauuagcacuaggaugcuauucucaagucaacccccuaacuuugacagcagccguacuuauguugguggcucacuaugccauuauagguccaggucuucaagcuaaagcaaccagggaagcccaaaaacgaacugcggcaggaaucaugaaaaauccaacuguggacgguauaguugcaauagaucuugacccaguagucuacgaugccaaauuugaaaaacaacuaggucaaaucauguuauuaaucuuaugcacuagccaaauacuauuaaugagaaccaccugggcgcucugugaaucuaucaccuuagccacaggaccuuuaacaacguuaugggaaggaucaccaggaaaauuuuggaacacaacuauagcaguguccauggcaaauauuuuucgcgggagcuaucuagcaggagcaggauuagcauuuucacuaaugaagagccuuggugguggaagacgcgggacuggcgcgcaaggugagacccuaggagaaaaguggaaaagacagcucaaucaguuaucuaaaagugaguucaauacuuacaaacgauccggaauaauggagguagaucguucagaagcaaaggaaggccuuaaaagaggagaaaccaccaagcaugcaguuuccagagggacggcaaaguuaagaugguuuguggaacgcaaucuagugaaaccggaggggaagguaauagauuugggaugugggagagggggguggucuuauuauugugcuggacugaaaaaggugacugagguuaaaggauauacgaaagguggcccuggucaugaggaacccaucccgauggcaacauauggauggaauuugguuaaacuacauagcggaaaagacguuuuuuuuauuccaccggagaaaugugacacguuauuaugugauauuggugaaucuucuccgaauccaacgauagaggaaggaaggacuuugcgaguacuaaaaaugguagaaccauggcuaagaggaaaucaguucuguauuaagauacucaacccauauaugccauccgugguagagacucuggaacaaaugcagagaaaacacggcgggaugcucgucagaaacccacucucacggaauucuacucaugaaauguacuggguuagcuguggcacaggaaacauuguaagugcuguuaauaugacuagcaggaugcuuuuaaaccgcuuuacuauggcccauagaaaaccuacuuacgaaagggacguagaucucggagccggcacaaggcauguggcuguugaaccagaaguggcaaacuuagacauaauuggacaaagaauagaaaauauaaaacacgagcauaaaaguacauggcacuacgaugaagauaacccuuauaaaaccugggcguaucacgggucuuacgagguuaagccgucggguagugcuaguucaauggucaauggcguuguuaaacuacuaacaaaaccuugggacgucauuccuaugguaacccaaaucgcgaugacggauacuacuccguucggucaacaacggguauucaaggagaaaguagauacacgcacaccuaaggcaaaacgcggcaccgcccaaaucauggaaguaacagcuaaauggcucugggguuuucuuaguagaaacaaaaagccuagaauuugcacucgagaggaguuuacucggaaagugagauccaaugcagcaauaggcgcgguguucauagaugagaaucaauggaauucagccaaggaagcgguagaagacgaacguuuuugggauuuaguccauagagaaagggagcuucacaagcaaggaaaaugugcaacuuguguauauaauaugaugggcaaacgugagaaaaaacuuggggaguuuggaaaggcaaaaggaagccgcgccauaugguacaugugguuaggagcaagguuucuagaauucgaagcauuaggcuuuaugaacgaagaucacugguuuaguagagaaaauucauuaagcgggguugaaggcgagggauuacauaaauugggguauauuuuaagagauaucagcaagauacccgguggaaauauguaugcagaugacacggcuggaugggacacccgcauaacagaggacgaucugcaaaaugaagcaagaauaacugacauaauggaaccagaacaugcacuacuagcgaagucgauauucaaauuaacauaucaaaacaaagugguucgcguucaaagaccggccaaaaauggaaccguaauggauguaauaucccgcagagaccagagagguuccgggcaagucggaacuuauggguuaaauacauuuacaaauauggaagcucaauuaauccgucagauggaaucggaaggaauuuucucaccgagugaacuggaaacaccaaauuuagcagaacguguauuagauuggcuagaaaaauaugggguagaaagguuaaaacggauggccauaucaggugaugauugugugguuaaaccaauagaugauagauuugccaccgcccuuacggcguugaaugauauggguaaaguaagaaaggacauuccgcagugggaaccauccaaagguuggaaugacuggcaacaggugccuuucugcagucaucauuuccaccaauuaauaaugaaggauggacgugagaucgucguaccuugcagaaaucaagaugaauuaguaggucgggcucgcguuagccaaggugcaggguggucacuuagggaaacggcaugucuagggaaaucauacgcacagauguggcaacuaauguacuuucauagaagagaucuccgauuagcagcaaacgcgaucugcagcgccgucccaguagauuggaucccaacuuccaggaccacguggucaauucacgcucaccaucaauggaugacgacagaagacauguuauccguguggaauaggguauggauagaagaaaaccccuggauggaggauaaaacacauauaucaagcuggggagauguucccuaucugggcaaaagagaagaccaauggugcggcucuuugauaggacucacagcucgugcuacaugggcaacgaauauacaagucgccauaaaucaaguacgaagauugauuggaaacgaaaauuaucuugauuauaugaccaguaugaaaagauuuaaaaacgaaucagacccugagggugcuuuaugguaa

SEQ ID NO: 21834 - RNA, 9879 nt, Artificial Sequence
  derived and/or modified CDS sequence (opt6) from DENV-1__GU131756__SS-prME
ucaguuacaaugcuuuugaugcuaaugccgacagcauuagcuuuucaucuuacuacuagaggaggagagccgcauaugauagugucaaaacaagagcgagggaaaucguuacuauuuaaaacaagcgcaggcguuaauauguguacucuaaucgcuauggaccuaggggaauuuugcgaggacacuaugacuuauaaauguccaaggaucaccgaggcagagccggaugacguugacuguuggugcaacgcuacggacacuuggguaacuuacgguacauguucucaaacuggcgaacauagacgggauaaaaggagcguugcacuagcuccacauguaggucuuggucuagagacucguacugaaacauggaugagcagugaaggugcguggaaacaaauacaacguguagaaacaugggcguuacgacauccaggguucacagucaucgcacuauuucuagcccaugcuauagguacaagcaucacacaaaaaggaauaauuuuuauacuauuaauguuaguaacuccaucuauggcgaugaggugcguagguauuggaagucgagauuuuguagaaggucuauccggggcgacauggguugauguuguauuagaacauggaaguugugucaccacuauggcaaaagauaaacccacguuggacaucgaguuacuaaaaacggagguaacaaacccagcaguauuaaggaaacuuuguauagaggccaaaauuucuaauacuacgacugauagucgauguccaacacaaggagaggcaacgcuaguggaagaacaggacgccaauuuuguuugucgaagaaccuucguggacagaggauggggcaauggauguggcuuauucggaaaaggaucuuugauuacuugcgcaaaauuuaaauguguaaccaaacuagaagguaaaauaguucaauacgagaauuuaaaauauaguguaauugucacgguacacacaggugaucagcaucagguugguaacgagaguacugaacacggaacaacagcaacaauuacgccacaagcuccaucuacagaaauucaauuaacugauuacggggcucugacguuggacuguaguccccgaacgggauuagacuucaaugaaauggugcuucuuacaaugaaggagaaaaguugguuaguccacaaacaaugguuuuuagacuuacccuuaccauggaccucaggcgcaagcacaucacaagaaaccuggaauagacaagauuuguuaguaacuuucaaaaccgcccacgcuaagaaacaagaaguuguuguuuugggcucacaggaaggcgcaaugcauacugccuuaacaggagccacggaaauccaaaccuccggaacuacaacgauuuuugcaggucaucucaagugcagacuuaaaauggacaaguuaacuuuaaaagguaugucauacguaauguguacagguucuuuuaaauuagagaaagaaguugccgaaacgcaacauggaacagucuuaguccaaauuaaauaugaagggacugacgcucccuguaaaauaccauuuucaacacaggacgaaaaaggaguaacccaaaauggcagauuaauaacggcgaacccuauugucacggauaaagagaagccagucaacauagaagcagagccgccuuucggagagucguauauaguaauuggagcaggagaaaaagcucuuaaauugucuugguucaagaaagguucgucaauaggaaaaauguucgaggcaacugcuagaggagcacgacguauggcuauucuuggagacacggcuugggacuuugguagcauaggcggaguguuuacaucaguuggaaaguuaguacaccaaauuuuuggaacugcauaugggguucuauuuaguggaguaagcuggacuaugaaaaucgguauuggaguuuuacuaaccuggcuuggauuaaauagcaggucaacgucccuguccaugacaugcaucgcgguaggcuuaguaacccuuuacuuagguguaaugguccaagcugauucugggugcguaaucaacuggaaaggaagggagcuuaaauguggcucaggaauuuuuguaacaaaugaaguacauacauggaccgagcaauacaaauuccaagcggauagcccaaaacggcuauccgcggccauagguaaggcuugggaagaaggaguaugcggaauacgaucagccaccagauuagagaauauaauguggaagcaaauauccaaugaauuaaaucacauacuguuagaaaaugauaugaaguuaacaguuguaguuggagauguggcaggaauccucgcacaaggcaaaaagaugaucagaccccaaccaauggaauauaaauauucguggaaguccuggggaaaagccaaaauaaucggcgccgaugugcaaaauacuaccuucauaauagacggaccgaauaccccggaaugcccggaugaucagagagcuuggaauauuugggagguagaggacuacggguucggaaucuucacaacaaauaucugguuaaaacuucgcgacagcuauacacaaguaugcgaucauaggcuaaugagugccgcuauaaaggauucaaaagcagugcaugccgacaugggauauuggauagaauccgagaaaaacgaaacuuggaagcuggcucgagccucauuuaucgagguuaaaacuuguauuuggccaaaaucacauacacuauggaguaacggaguguuagagagugaaaugauuauaccaaagauuuacggugguccuauaucccaacauaacuauagaccgggauacuuuacgcaaacugcaggaccauggcaucuaggaaaacuagaauuagacuuugaccugugcgaggguaccacaguaguaguagacgaacauugcgguaaucgagggccaucacugaggacuacaacaguuacaggcaaaauaauucaugagugguguugucguucauguacacuaccuccauugagauuuaaaggagaagacggauguugguacggcauggaaauacgaccugucaaagaaaaggaagagaaucuaguaaagagcaugguaagugcuggcucuggagaaguagacucguucucucucggauuauuaugcauaucaauaaugauagaagagguaaugcguaguagauggucgagaaaaauguugaugacggggacucuugcagcauucuuucuccucauuaugggacaacuuacauggaaugacuuaauucgcuuauguauuaugguuggcgcaaaugcuuccgacaggauggguaugggcacuacauauuuagcauuaauggcaaccuucaaaaugagaccuauguucgcuguugggcuguuauuucgaaggcuuacaucgagggaaguacucuuacucacaauaggauugucucuuguugcaaguguggagcuacccaacucuuuagaagaacuuggagacggcuuggcaaugggaauaaugauuuuaaaguuguuaacagauuuucagucucaucaauuaugggccacauuacuuagcuuaacuuucauaagaacaacuuuuagccuacacuaugcauggaagacuauggcgaugguacuaucgauuguaucacucuuuccgcuguguuuaagcacuacaagucagaaaaccacauggcuaccaguuuuauuggguucauuaggaugcaaaccccuuacaauguucuugaucgccgagaauaagauauggggaagaaagagcuggcccuuaaacgaagguaucauggcgguuggaauuguaucuauccuccuaucuucucuacuaaagaaugauguuccauuagcaggaccucuaaucgcagggggaaugcucauagccuguuacguaauaaguggaucguccgcugaucuaucacuagaaaaagcugcuguugucaguugggaagaagaggcagaacacaguggcgcuagucacaauauacuuguugaaguucaggaugauggaacaaugaaaauaaaggacgaggaaagggacgacacauugacaauccucuuaaaggcuacguuacuugcuguaagcgguguauauccauuaaguauucccgccacacuuuuugugugguacuuuuggcagaagaagaaacaaagaucuggcguauugugggauacaccuucgccaccugaaguagaaagagccguacuggaugaugguauauacagaauuaugcaaagaggucuccuaggaagaucgcaggucgggguuggcguguuucaagagaacguguuucauacaauguggcacgugacuagaggggccguucuaauguaucagggaaaacguuuagaaccuucaugggcuagugucaagaaagauuuaauauccuauggaggcggcuggcgucuacagggaaguuggaacacgggggaggaagugcaagucauagcgguagagccgggcaaaaaucccaaaaacguccagaccgccccugggacauuuaaaacgagcgaaggugaaguaggugcuauugcguuagauuuuaaaccugggacuagcgguucgccgauaguaaaucgugaaggcaaaaucguaggacuauacggaaauggcguaguuacaacaucaggcaccuauguaucagcuauagcgcaagcgaaagcgagccaagaggguccuuuaccugaaauugaggacgaagucuucaggaagcgaaauuuaacaaucauggaccuacacccgggaucgggaaaaacgcgaagauaucugccagcaauaguacgagaggcuauaaaaagaaaauuacgaacccuaauucuugcgccgaccagagugguagcgagugaaauggcagaggcgcuaaaagguaugcccauaagauaccaaaccacagcgguaaaguccgagcauacugguaaagaaauaguagauuuaaugugccaugcaacguucacaaugagauuauuaucuccaguucgugucccgaacuauaauaugauaauuauggacgaagcccacuuuacugacccaagcucaauagcggcaagaggcuauauuuccacaaggguagggaugggagaagcugcagcgauauuuaugacagcaacacccccugguagugucgaggcauuuccgcaguccaacgcaguaauccaagacgaagaaagagacauaccggaaagaaguuggaauaguggauacgaguggauaacagauuucccugggaaaaccguaugguuuguaccaagcauaaaaucaggaaaugacaucgcaaacugcuuaaggaaaaaugguaaaagaguaauucaacuuucacgcaagacauuugacacggaauaucagaaaacgaaaaauaaugacugggacuacguaguaacaacggacauuucugaaaugggugcgaauuuccgggcagauagagucaucgauccacgaaggugucuaaaaccugucauuuuaaaagauggaccggagagaguuauacucgcaggaccaaugccagugacagucgcuagcgcagcucaaaggcguggacgaauaggaagaaaucauaauaaggagggugaccaauauauuuauaugggacaaccacuaaacaacgaugaggaucaugcccauuggacagaagcaaaaaugcuccuggauaauauuaacaccccagaggguauaaucccagcgcuauuugaaccggaacgugaaaagagugccgcuaucgauggagaauaccggcuuagaggugaggcacgcaaaacauuuguagagcuuaugagaaggggagacuuaccagucuggcuaucauauaaaguagcgagugaaggauuucaauauagugaccgacgaugguguuucgauggugaacguaauaaccagguuuuggaggaaaacauggacgucgaaauuuggacgaaagaaggugagagaaagaaauuaagaccaagaugguuggacgcgagaacuuacagugacccacuugcccuccgagaguucaaggaauuugcugcggggcgacgaucaguguccggagaucucauucuagaaaucggaaaacuaccacaacaucuaacucagagagcucaaaaugcauuagauaacuuaguuauguuacauaauucagaacaaggugggagggcauauagacaugcuauggaagaacuuccugauacgauagaaacgcugaugcuccuugcacucauugcgguauuaaccggaggggucaccuuguucuuucugucaggcaggggucuagguaagacaagcaucggccuucuguguguuauggcaucaucuguucuguuauggauggcauccguagaaccucacuggauugcugcaucaaucauucucgaguuuuucuuaaugguucugcugauaccugaaccugaccgacaaagaaccccacaagacaaucaacuugcauauguaguuauaggacuguuauucaugauucucaccguugcagcaaacgagaugggacuacuagaaacuacuaaaaaggauuugggaauaggacauguagcaguagaaaaucaucaucaugcggcgauguuagacguugaccugcauccggcgagugcauggacuuuguaugcuguggcuacaacuauuauaacuccaaugaugcggcauacuaucgaaaauacuaccgccaauauuucacuuacagcaauugcgaaccaagcagcuaucuugaugggcuuggacaaaggauggcccauaucaaaaauggacauaggggugccacuacucgcgcuaggauguuacucacaaguaaauccauuaacacucacugcagcaguacugaugcuuguggcacacuaugcaauaaucggaccuggacugcaagcaaaagcaaccagagaggcacagaaaagaacggcugcgggaaucaugaaaaacccgacaguagacgggauuguggcaauugauuuagacccagugguauaugacgcuaaguucgaaaagcaacugggucaaauaauguuacucauacuuuguacaagccaaauucuauugaugaggacaacaugggcacuaugcgaaucgauaacauuagcuacugguccgcuaacaacucugugggaaggaaguccugggaaauuuuggaauacaacaaucgcagucucuauggcaaauauuuucagagguucuuacuuagcuggagcaggucuugcguucucacugaugaaaucguuaggaggagggcgaagaggcacuggagcacaaggggaaacacuuggcgaaaaguggaagagacaacuaaaccagcuuaguaaaagcgaauuuaauacguauaaaagaaguggcauuauggaaguagaccguagugaagcaaaggagggccuaaaaaggggugaaacaacaaagcaugcuguuaguagagguacagcgaaauuaaggugguuuguugaacgcaacuugguaaaaccugaaggcaaagucauugauuugggcuguggucguggaggcuggaguuauuauugugcgggccucaagaaaguuacagaaguuaaggguuacaccaaaggagggccugggcaugaggaacccauaccgauggcuacuuacggauggaaucucguaaaacuucauagcggcaaagaugucuucuuuauacccccugagaaaugugauacacuucuaugcgauauaggugaaucaucuccuaauccaacaauagaggaaggucgaaccuugcgugucuugaaaaugguagaaccaugguuacgugguaaccaauucuguauaaaaauccucaaccccuauaugccgagcguaguggaaacguuagagcaaaugcaaagaaaacauggaggaauguuaguaaggaacccacuuuccagaaauuccacucacgaaauguauuggguaucaugcggcaccggcaauauugugucagcaguaaauaugacaagcaggaugcuauuaaauagauucacuauggcccaucgaaaaccgaccuaugagagagauguugaucuuggagcaggaacuaggcacguugcagucgaaccggaaguugcuaaucuagauauaaucggacagcgaauugagaauauuaaacaugaacauaaaaguacguggcauuaugaugaagauaauccauacaaaacaugggcuuaccauggcaguuaugaagucaaacccagugguucugccagcucgaugguaaauggcgucgucaaacuccuaacuaaaccuugggauguaauuccaaugguuacucaaauagcgaugaccgauaccaccccauuuggucagcaaagaguauuuaaagaaaaaguugauacccguacuccaaaggcaaagagagguacggcacaaauaauggagguaacggcaaaauggcuuuggggcuuucuaucacgaaauaagaaaccacguauuuguacucgagaagaauuuacaagaaaagugagaucuaacgcagccauuggugcaguuuuuguggacgaaaaucaauggaacagugcgaaggaggcaguggaggaugaacgcuuuugggaucuugugcaccgcgaaagggaauuacauaaacaagggaaaugugcgacaugcguauacaacaugauggggaaacgagaaaagaaacugggugaauuugguaaagcgaaaggaucacgagcuauuugguauauguggcuaggggcgagguuuuuagaguucgaagcauuagguuuuaugaaugaagaccacugguucaguagagaaaacucacuaagcggcguagagggggaaggacuucacaagcuaggcuauauacucagggauauaucuaaaauuccuggaggaaauauguacgccgaugauacagcagguugggauacacgcauaacagaagacgauuugcagaaugaagcaaaaauuaccgacauuauggaaccggaacacgcauuacuugccaagucaauauuuaagcuaacguaccaaaauaaagucguucgaguacaacgaccugccaaaaacgggacugucauggacgucauuagucgucgagaccaaagaggauccggucaaguggggacguacggacuaaauacauuuacuaauauggaagcacaacuuauccgucagauggaguccgagggaauuuuuaguccaucagaacucgaaacgccaaaccuugcugguaggguccuugauugguuagaaaaacacggcguagaaagacuuaaaagaauggcuauaaguggagaugacuguguaguaaaacccauagacgacagauucgcuacagcacugacggcacugaaugacauggggaaaguucggaaggauaucccucaaugggagccgucgaaaggauggaacgauuggcaacaaguaccauucugcucucaccauuuucaccagcucauuaugaaggaugggcgcgaaauaguggucccaugcagaaaucaagaugaguuggugggacgugcgcguguaucucaaggagcagguuggucucuacgagagacggcaugucuaggaaaaaguuacgcucaaauguggcaauuaauguacuuucaucgaagggauuuaagacuugcagcuaaugccauuuguucggccguccccguugauuggguuccaacaaguagaacaacauggucaauccaugcucaucaucaauggaugacgacugaggauauguuaagcguguggaaucgaguguggauugaagaaaauccuuggauggaagauaaaacacauaucagcaguuggggagauguuccauaucuaggaaaaagggaagaucaaugguguggaagccucauuggucuaacagcaagagcaacgugggccaccaauauacaaguugcaauuaaucaaguacgacgauuauuagggaaugagaauuaccuagauuauaugacaagcaugaaaagguucaaaaacgaaagugacccagaaggagcgcuaugguaa

SEQ ID NO: 21835 - RNA, 9879 nt, Artificial Sequence
  derived and/or modified CDS sequence (opt6) from DENV-1__GU131758__SS-prME
aguguaacuaugcuauuaauguuaaugccaacugcucuagcauuucauuuaaccacucgagggggagaaccacauaugauaguaucaaaacaagaacgcggcaagagcuuacuauuuaaaacaucugcuggaguaaacauguguacucuaaucgcuauggaccuuggcgaauuuugcgaagauacaaugacuuauaaauguccaagaauuacugaagcagaaccggaugacgucgacuguugguguaacgcaacggauacuuggguaacuuaugguacaugcucucaaacuggugaacaucgcagggauaaaaggucuguagcguuggcgccacauguaggacuaggauuggaaaccagaacugaaacguggaugaguucagaaggagcuuggaaacaaauacaacgaguugaaacaugggcgcuuagacauccggguuucaccguaaucgcauuguucuuggcccaugcaauuggaaccaguaucacgcaaaaaggaauuauauucauucuucucauguuagucacuccguccauggcaaugagauguguugguauaggcucaagggauuuuguagaaggauuaucaggagcgacuuggguagacguaguguuagaacauggaucuuguguaacuacuauggcaaaagauaaaccaacacuugacauugagcuauuaaaaaccgaggugaccaacccugccguccuaagaaaauuguguauagaagcuaaaauuaguaauaccacaacagacaguagauguccgacacagggcgaagccaccuugguagaagaacaggacgcgaauuuuguaugcagaaggacauuugucgaucguggauggggcaacgguuguggacuuuuuggcaaaggcaguuuaauaacaugugccaaauucaaaugcgucacaaaacuagaaggaaaaacaguacaauacgaaaaucugaaauauucagugauugucacuguacacacgggagaccagcaucaaguaggaaacgaaaguacugaacacggaacgaccgcuacuauaacaccucaggccccuucaacagaaauccaauuaacugacuacggcgcuuuaacccuugauuguucgccaagaacugggcuggacuuuaaugaaauggugcuacuaacaaugaaggaaaaaucuugguugguacauaaacaaugguuuuuggaucuuccuuuaccguggacaucuggcgccucuacuucgcaagaaacauggaaucguaaagaucugcuaguaacuuucaaaacagcgcacgcuaagaaacaagaaguagucguauuaggaucccaagaaggagcuaugcacacagccuuaacaggagcgacggaaauucaaaccuccggaacaacaacuauuuuugcuggccaccuaaaauguagacuuaaaauggacaaacuaacacugaaaggaaugaguuauguuauguguacaggauccuucaaauuggaaaaagaaguagcagaaacacaacauggaacuguccuagugcaaauaaaguacgaagguacggacguuccaugcaaaaucccauucucaacgcaagaugagaagggaguaacacagaauggacgauuaaucacagcaaauccuauaguaacagacaaagagaaacccguaaauauugaagcagaaccgcccuuuggagagucguauauuguaauaggugcuggagagaaagccuuaaaguuaucgugguuuaagaaagggucguccauaggcaaaauguucgaagccacagcacguggggcaagaaggauggcaauacuuggcgacacagcuugggacuuuggcuccaucggaggagucuuuacaagcguuggcaagcuaguucaccaaauauucggaaccgcauacggugucuuauucucaggaguuucauggaccaugaaaauagggauugguguacuuuuaacuuggcuggguuuaaauaguagaucgacuucguuaucaaugacaugcaucgccguuggauuaguuacucuguauuuagggguaaugguacaagcagacaguggaugcgugauaaauuggaaagguagggaguuaaaguguggcaguggaauauucgucacaaaugaaguacauacauggacugagcaauauaaguuccaagccgacucaccgaaacgacuaucugcagcuauaggaaaggcuugggaggaaggggucugugggauucgcuccgcgacuagauuagagaauauaauguggaagcagauuucaaacgaguuaaaucacaucuuauuagaaaaugauaugaaauuuacuguaguaguuggagaugucgcaggaauacucgcucaagggaagaaaaugaucaggccgcaaccgauggaauacaaauauucauggaaaucgugggguaaggcgaaaaucauuggugcggacgugcagaacacuaccuucauaauagacggucccaauacuccugaguguccagacgaccaacgggccuggaauauaugggagguagaggacuauggauuuggaauuuuuacgacgaauaucuggcugaaauuacgagauucuuacacucaagugugcgaucaccgacugaugagugccgcgauaaaagacaguaaagcuguacaugcagacaugggcuauuggauagaaucagagaaaaaugaaacguggaaacuugcuagggcauccuuuauagaaguaaaaacguguauauggccuaaaagucacaccuuauggucaaauggcguucuugagagugaaaugauaauucccaaaauauacggcggacccaucucacaacauaacuacagacccggguacuuuacacaaacggcagggccauggcaucuggguaaguuggaacuagauuuugaucuaugcgaggguacgaccgucguaguagaugaacacugcggcaacagaggaccauccuugcgaacaacaacaguaacuggaaaaauuauucaugaaugguguugucgcagcuguacacugccuccauuacgauuuaaaggggaagaugguugcugguacgguauggaaauucgccccgucaaagaaaaggaagaaaauuugguuaaaucuauggucucagcagguucaggagaggucgauagcuucucacugggguuauugugcauuucaauuaugaucgaggaaguaaugcggagccgguggucacgaaagauguugaugacaggaacucuagccgucuuuuucuuacuuauuaugggucagcuuacuuggaaugaucugauuagacuuugcauuaugguaggcgcgaacgcaucagauagaauggggaugggcaccacuuaccuugcacugauggccacauuuaaaaugcgaccaauguuugcaguuggcuuacuuuuuaggagauugacgucuagagaaguguuacuucugacaaucgguuuaucguuaguugcuucuguagagcuuccaaauucuuuagaagaguugggugacgggcucgccauggguauaaugauccuuaaacuucuuacagauuuucaaucccaccaguuaugggcuacauuauugucuuucacuuuuauuaaaacaaccuucaguuuacacuaugcuuggaagaccauggcaaugguauuaagcaucguuuccuuauucccccuuuguuuaaguacaacaucucagaaaacgacuuggcuaccgguccuucuuggcucacuuggauguaagccacuuacuauguuucuaauugcagagaauaaaguaugggggcgcaaguccuggccuuugaacgaaggaauaauggccguagggaucgucucaauucuccuuaguagucugcucaaaaacgauguuccucuggcuggaccgcugauagcagggggcauguuaaucgcauguuaugugauuucaggaaguucugcagauuuaucuuuagagaaagcggcagaagucucaugggaagaagaagcagagcacagcggcgcaucccauaauauacucguagaagugcaggacgaugggacgaugaaaaucaaagacgaagaacgagaugauacauuaacuauauuacuaaaagcaaccuugcuagcgguaucagguguguauccguuaucaauuccagcaacacuauuuguaugguauuuuuggcagaagaagaaacaaagaucagggguacuaugggacacccccucacccccugaaguagaacgugcuguauuggaugauggaauauauaggaucaugcagcggggacucuuagggcggucucaggucggcguuggaguuuuccaagagaacgucuuucacacgauguggcauguuacuagaggagcaguucuuauguaucaaggaaaacgauuggaaccaucaugggcgucaguaaagaaagaccuaaucucguaugguggggguuggcguuuacaagguagcuggaacacaggugaagaaguucaaguaauugccguugaaccuggcaaaaaucccaaaaauguucaaacagccccugggacauuuaagaccagugaaggagaaguuggcgcaauugcuuuagacuuuaaaccagggaccucgggcucaccaauugucaauagagaaggaaaaaucgugggcuuauacgguaacggcguagucacaacuucuggaaccuaugucucagcgauagcacaagcuaaagcaucacaggaggggccauuacccgaaauagaagaugaaguauucagaaaaagaaaccucacgaucauggauuugcacccugguucaggaaaaaccagacgcuaccuaccggcgauuguccgugaagcgauaaaacguaaauuaaggacccuaauuuuggcacccacucgagucgucgcgucggaaauggcagaggcacucaaaggaaugccaauucguuaucaaacgacggcaguaaaaucugaacauaccggaaaagaaauaguugaucuuaugugucaugcaacguucacuaugagacucuuaucaccaguuagagugccaaauuauaauaugauaauaauggaugaggcccacuucacugauccaaguucaauagccgcgagagguuacaucucgacaagaguggggaugggagaggcugcagcaauauuuaugacagcuacuccucccggaagcguugaagccuucccucaaucgaaugcuguaauacaagacgaagaaagagauauaccagagcgauccuggaacucgggguaugaauggaucacagacuuuccugggaaaacuguuugguucguuccaucaauuaaguccggaaacgauauagcgaacugucucaggaagaauggaaaacgggugauacaacuuucaagaaaaacuuuugauacagaauaucagaaaacuaaaaacaacgauugggauuaugucguaacaacagacauuagugaaaugggcgcaaauuucagggcagacagagugauagacccgcguagauguuuaaaacccguuauacuaaaagacgguccugaaagaguaauauuagcgggaccuaugccaguuacugucgcaagugcagcucagcggagaggacguauaggacgcaaccauaauaaagaaggugaccaauacaucuacaugggacaaccacugaauaacgaugaagaccaugcacacuggacugaagccaagauguuacuagauaauauuaauaccccagaaggaauaaucccagcauuauucgaaccugaacgagaaaaaucagcugcaaucgacggcgaauaucgauuaagaggagaagcuagaaaaacauuugucgaguugaugaggagaggagaucuuccagucugguugucguauaaaguugcgagcgagggauuccaguauuccgaucgaagauggugcuuugacggcgagaggaacaaucaaguccucgaagagaacauggauguagaaauauggacuaaggaaggugagaggaagaaauuacgaccccgauggcuagacgcaaggaccuacucagauccgcuagcuuugcgagaguucaaggaauuugcugcaggaagaagauccguaagcggggauuuaauauuagaaauaggcaaauugccucagcaccuaacacagagagcucaaaacgcauuagacaaccugguaauguuacauaauuccgaacagggaggccgagcauacaggcaugcuauggaagaacuacccgauacgauugaaacauuaauguuguuggcacuaauugcaguacucacagggggaguaacguuauuuuucuugucaggaaggggcuuagguaaaacgucaauaggauuacuuugugugauggcaucuaguguuuuacuauggauggccucaguagaaccccauuggauagcugccucaauaauuuuagaauuuuuccuaauggugcuucuaaucccggaaccagacagacaaagaacuccacaagauaaucaauuggcauauguagucauuggacuuuuauuuaugauauuaacaguugccgcaaacgagaugggcuugcuggaaaccacgaagaaagaucuuggaauuggacacgcagcaguagagaaucaccaucacgcugcuaugcuagauguugauuuacauccugcuuccgcauggacuuuauaugcuguagccacaaccauaauaacacccaugaugcggcauaccauugagaauacaacugcaaacaucucacuaacggcuaucgcuaaucaagccgccauacucauggguuuggauaaaggcuggccgauauccaaaauggacauagggguaccauuacucgcucugggauguuacagucaaguaaacccgcuuaccuuaacggcagccguucucaugcugguggcgcauuaugcaauaauugggccaggucuucaagccaaagcuacucgagaagcgcaaaaacgaacagcagcagguauaaugaaaaacccgacuguggaugguaucgucgcaauagacuuagacccaguaguauaugaugcaaaauucgagaaacaauuaggccaaaucauguuacugauauugugcacaagucaaauauugcuaaugagaacaacaugggcacuuugugagucgaucacgcucgcgacugguccucuuacaacacugugggaaggaagcccaggaaaauucuggaauacgacuaucgcgguaucaauggcaaauauuuuucggggaucguauuuagcaggcgcuggacuggcauuuucccuuaugaaaucacuaggcggaggacguaggggcacaggugcacagggagaaacccugggagaaaaauggaaaagacaacuaaaccaacuaucgaaaagcgaguuuaauacauauaaaagaagcgguaucauggaagucgaccgaagcgaggcaaaagagggacugaaaagaggggaaacuacaaagcacgcaguaagucgagggacagccaaauuaagaugguucguugaacgaaauuuagucaaaccagaaggaaaagucauugacuuaggcuguggaagagguggguggucauauuauugcgcagguuuaaagaaaguaacggaaguuaaggguuauacuaaaggaggacccggacaugaagaaccaauuccaauggccacuuauggauggaaucuggugaaauuacauagcggaaaggauguuuucuucauaccuccagagaaaugugauacucuauuaugugacauuggagaaaguagucccaauccuacgauugaggaggggcguacauuacgaguuuuaaaaaugguagaaccguggcuacguggcaaucaguucuguauaaagauucuaaauccuuauaugccuucuguaguugaaacauuagaacaaaugcagagaaagcauggcggcaugcuuguucgaaacccucuaucuagaaauucaacacacgaaauguauuggguaucaugcgguacggguaauauaguaucagcuguaaauaugacgucaagaaugcuacuaaauagauuuacaauggcgcaccgaaagccuacuuaugaaagagaugucgacuuaggcgcugggacaagacauguagcaguugaaccagaaguagcaaauuuagacauuaucggacagcguaucgagaacauaaagcaugaacauaagucaacauggcauuaugacgaagauaacccuuacaaaaccugggcuuaucauggcucguaugaagucaagccaucggggagcgcaaguuccaugguaaaugguguggucaaacuucuuacaaaaccgugggacguaaucccuaugguuacacaaaucgcaaugacggauacaaccccauucggucagcaacgaguauuuaaagaaaaaguagacacacggacucccaaggcaaaacgcgggacagcucaaauaauggaggucacagcaaaaugguuguggggauucuugucuagaaacaagaaaccuaggaucuguacucgugaggaauuuacuagaaaaguacgcucaaacgccgcaauaggcgcagucuuuguagacgaaaaccaauggaacuccgcuaaggaagcaguagaagaugaacguuuuugggaccuuguacacagagaacgagagcuccacaaacaaggcaaaugugcgaccuguguuuauaauaugauggguaagagagagaagaaauuaggcgaguuuggcaaagccaaagguaguagggcaauaugguauaugugguugggggcacgguuucucgaguucgaagcucugggauucaugaacgaagaccauugguucucucgagagaacucucuaaguggcgucgagggagaaggacuacauaaauuaggauacauacugagagauaucucaaaaauccccggaggaaacauguaugcagaugauacggcugggugggauacccgaaucacagaagaugacuuacaaaaugaagcgaaaauaacagacaucauggaaccugaacaugcacuccuugcuaaaagcauauucaagcuaacauaucagaacaagguaguacggguucaacggccagccaaaaauggcacaguaauggauguaauaucgcguagagaucaacgggguucaggacaagucgggacauaugguuugaacacauucacuaauauggaggcucaguuaauuaggcaaauggaaucugaagggaucuuuaguccgagugaguuggaaacaccgaacuuagcugggagaguauuagauugguuggaaaaacaugggguggaaagauuaaaaagaauggcaauaucgggugacgacugugucguaaagccgauagacgacagauuugcgacugcguuaaccgccuuaaacgauauggguaaaguuaggaaagauauaccucagugggaaccuaguaaaggcuggaaugacuggcaacaagucccguuuuguucacaucauuuucaucaauuaauuaugaaagauggucgugaaauaguuguccccugcagaaaucaagaugaauuaguaggcagagcucgagucagccaaggagcaggguggucuuuaagggaaacugcuuguuuagguaagaguuacgcccagauguggcaauugauguacuuucacaggagagaccuacggcuggcugccaacgcuauuuguucagcuguuccgguggacugggucccuaccagcaggacaacuugguccauccaugcucaucaucaauggaugacaacagaggauaugcuuagcguguggaauagaguuuggauagaagagaaucccuggauggaggacaagacacacauaucaucauggggagacgucccuuaucuuggcaaaagagaagaucaauggugcgggagucuuauaggguuaaccgcucgagcaacuugggcuacuaauauucaaguagcaauaaaucaaguaagaagacuaauugguaacgaaaacuaucuagacuauaugacaagcaugaaacgcuuuaaaaaugaaucugacccagaaggagcgcuaugguaa

SEQ ID NO: 21836 - RNA, 9879 nt, Artificial Sequence
  derived and/or modified CDS sequence (opt6) from DENV-1__GU131759__SS-prME
uccguaacaauguuauugauguuaaugccaacagcacuugcauuucaucuaacaacgcggggaggagaaccgcacaugauugucucaaaacaagaacgagggaaaucuuuacuauuuaaaacaagcgcuggaguuaauauguguacuuuaauugcaauggaccuaggggaauuuugcgaagauacuaugacauauaaaugcccuagaauaacggaagcagaaccagacgacguugauugcuggugcaaugcgacugacacaugggucacauacgguaccuguucacagacgggcgaacaucguagagauaaaagauccguagcgcuugcaccacacgugggauugggacuggaaaccaggacagagacguggaugucaagcgaaggggcauggaaacaaauacagcgagucgaaacuugggcgcucagacaccccggauucacaguuauagcauuauuccuagcucaugcaauugguacgaguaucacccagaaaggcauuauauuuauauuauuaaugcuuguaacuccuucaauggcaaugcgguguguugggauuggaucuagagacuuuguagagggguugucaggugccacgugggucgacguuguuuuagaacauggcucauguguuacuacaauggccaaagacaaaccaacucuagacauugaauuauugaaaacggaaguaacaaacccggcuguauuacgaaaacuauguauagaagccaaaauauccaauacaacuacggacagucguugucccacacaaggugaagcuacguugguagaggagcaagaugcaaauuucguuugcagacgaaccuuuguggaccguggauggggaaauggaugugguuuauuuggaaaaggaucucucauuacaugugccaaauucaaaugugugacaaaauuggaagggaagacuguacaauaugagaauuuaaaauauucggucauaguaacgguacauacaggugaccagcaccagguaggaaacgaaucaacggagcauggcacgacggcaacgaucacaccccaagcuccauccacagagauacaauuaaccgacuauggugcgcucacucuagacuguucuccgcgcacgggacucgauuuuaaugaaaugguauuacuuacgaugaaggaaaagucuuggcucguccauaagcaaugguucuuagaucugccauugccauggacaucgggugcaucaacuucgcaagagacuuggaaccgaaaagaccuauuaguaacuuuuaaaacagcccacgcaaagaaacaagaaguugugguuuuagggucgcaagaaggagcaaugcauacagcccuuacaggagcaacagaaauacaaaccaguggaacgaccacuauauuugcuggacaucuaaaaugucgacuaaaaauggacaaauuaacgcuaaaagggaugagcuacgugaugugcacggguagcuuuaaacucgaaaaagaaguagcagaaacccaacaugggacaguccuaguccaaauaaaauacgagggcacugaugccccaugcaaaaucccuuucaguacucaagacgagaaagguguaacccagaauggccgauugauaaccgcaaaucccauaguaacugauaaagaaaaaccugucaauaucgaagcugaaccuccauuuggagaauccuauauuguuauaggugccggugaaaaagcauuaaaauuaaguugguucaagaaagggucgagcaucgguaaaauguuugaggcaacagcuagaggggcgagacgaauggcaauucucggggauacggcuugggauuuuggaucgauuggcggaguuuucacuagcgugggaaagcuaguacaccagauuuuugguacugcguacggaguucucuuuucuggaguuaguuggacaaugaaaaucgggauaggcguucuauuaacgugguuagguuuaaacucaagguccacaucucuauccaugacauguaucgccguuggauuaguuacucuuuauuuaggaguuaugguacaagcugauucuggaugcguaauaaauuggaaaggacgagaauuaaaauguggcuccgggaucuuuguuacgaacgaaguucauacuuggacagaacaguacaaauuucaagcagacaguccaaaaagauuaagugcagcaauaggcaaggccugggaagaaggggucugugggauacguagcgcgacccgacucgagaauauaauguggaagcaaauuaguaacgaauugaaccacauucuucuugaaaaugauaugaaauuuacugugguagugggggauguggcaggcauucucgcacaaggcaagaaaaugauucgaccacaaccgauggaauauaaauacucuuggaaaaguugggggaaagcuaaaauaauuggcgcugauguacagaauacaaccuuuaucauagauggaccuaacacuccugaauguccagacgaccaaagggcguggaauauuugggagguagaagauuauggguucggaaucuuuacaacgaacauauggcugaaacuccgagauagcuacacacaaguaugugaccauagauuaaugucagcggcaauaaaagacaguaaagcaguccaugcagauauggguuauuggauagaaucugagaaaaaugagaccuggaaacuugcacgggcuaguuucauagaaguuaagacgugcauuuggcccaaaucacacacauuauggagcaacggagucuuggagucugagaugauuauucccaagauauaugggggaccuauuucacagcacaauuacagacccggcuacuucacacaaacugcggggccauggcaccuuggaaaguuggaauuagacuucgaucuuugcgagggaacaacugucguuguugacgaacacuguggaaauagaggucccucacuacgaacaacuacuguaaccgguaaaaucauucacgaaugguguugcaggaguuguacacuaccaccacuccgauuuaaaggagaggacggauguugguacgggauggaaauuaggccuguuaaggaaaaggaagaaaaccucgugaaaucuaugguuucagcagggagcggcgagguugauucauuuagccuaggacugcuguguauuaguauaaugauagaagaagugaugagaucccguuggucacggaaaaugcucaugacaggcacccucgcaguguuuuucuuauuaauuaugggacaacuuacuuggaaugacuugaucagacuuugcauaaugguaggugcaaaugcuagcgaccgaauggggauggggaccacguauuuagcucuuauggccaccuuuaaaaugcgucccauguucgcaguuggacucuuauuuagacgguuaacuagccgugaaguacuauuacucacuauaggauuaucucuaguagcaucaguagagcuuccgaacucacuggaagaacuaggugacggccuugcaaugggaaucaugauccugaagcuguuaacagacuuucaaucacaucaauuaugggccacacuacuaucuuuuacauucauaaagacaacauuuucauuacauuaugcauggaaaacaauggcaaugguccuaagcauagugucauuauucccauuaugucuaaguaccacaagucaaaagacuacaugguugccaguuuuguuaggcagucuuggaugcaagccacuaacuauguuuuuaauugccgagaacaagguaugggggaggaaaaguuggccacuaaaugaagggaucauggcuguagguauuguaagcauacuacuuucuagucuauugaaaaacgacgugccacuagcggggccacugauagcugguggaaugcuaauugcaugcuacguaauaagugggagcagcgccgaucucagccuagaaaaggcugcagaaguaucgugggaggaggaagcugaacacucaggagcuucucauaauauucucguugaggugcaagacgauggcacuaugaaaauaaaggacgaagaaagagacgacacgcuuacgauauugcuaaaagcgacccuacuagcgguaucggguguguauccccuaucaauaccggcgacucuauuuguaugguacuucuggcagaagaagaaacaaagaagcgguguucuaugggauaccccguccccgccggaagucgaaagggcaguacuugacgaugguaucuacagaauuaugcagcgaggguuauuaggacguucacagguugggguugguguauuucaagaaaauguuuuccacacuauguggcauguuacaaggggugcaguauugauguaucagggaaaacgcuuggaaccaaguugggcaagcguuaagaaagacuuaauaagcuaugguggagguuggcgucugcaagggucauggaauacaggugaggagguucaaguaauagccguggagccgggaaagaaucccaaaaauguccagacugcuccuggcacauuuaaaacgagugagggugaaguuggggcuauagcccucgauuuuaaaccuggcacaucggguagcccaaucguaaaucgagaggggaaaauaguaggccuuuacggaaauggcguugugacgacaucaggaacauacguuagcgcaaucgcccaggcaaaagcaagccaagagggcccucuaccagaaauagaagaugaaguauuccgcaaaagaaaccuaacuaucauggauuuacauccaggaucugguaaaacacgaagauauuugccagcaauuguccgugaagcgauaaagagaaaacucagaacacucauuuuagcuccaaccagaguagucgccagugagauggccgaagcucuaaagggaaugcccauucgauaucaaacgacggcgguaaaaucggaacacacaggaaaagaaauaguugaucuuaugugucaugcuacauucacuaugcgauuacucucaccuguucgugugcccaacuacaauaugauuauuauggaugaagcccacuuuacagaccccucgucaaucgcggcaagggguuacaucucuaccagaguggggaugggagaagccgcagcuauauuuaugacugccacaccgccagguucagucgaggcauucccucaaagcaaugcggugauacaagacgaagaaagagauauuccugaaagaaguuggaacucaggauaugaauggauuacugacuucccggggaaaacaguaugguuuguuccaucuauuaaaagcggaaaugacaucgccaauuguuugcguaagaauggaaaacgagucauucaacuaaguagaaaaacauuugauacagaauaccaaaagacuaaaaauaaugauugggauuacguugucacaacggauauaagcgagaugggagccaauuuucgagcugaucggguaauugauccgagacgcugucuuaaaccaguaauccuaaaggauggccccgaaagaguaauacuagccggcccaaugccagugacaguagcgucagccgcccaacgacgaggucggauaggcaggaaucacaacaaagagggugaucaauacauuuauaugggacaaccccucaauaaugaugaagaccaugcacauuggacagaagcaaagauguuauuagauaauaucaacacaccagaaggaaucauuccagcauuauucgagccagaacgcgaaaaaucagcugcaauagauggagaguaccgacuuagaggagaagccaggaaaacauucguagaacucaugaggagaggugacuuacccguauggcucucacacaagguugcuucugaagguuuucaauacagcgaccgaagaugguguuucgacggcgaacggaacaaucagguguuggaggaaaauauggaugucgagauauggacaaaagaaggagaaaggaagaaauuaagaccaagguggcuagacgcgcgaaccuauucagaucccuuagcacucagagaauuuaaagaauuugcggcaggaagaagaaguguuucuggugaucuuauuuuagaaauaggaaaauugccccaacauuuaacccagcgggcacagaaugcauuagauaaucuuguuauguuacauaauucagaacaagguggaagggcguauagacacgcaauggaagaacuacccgauacaaucgaaaccuugauguuacuugcacugauugcaguauuaacaggaggagucacucuauucuuuuuaucaggaagaggauuggggaaaacaucuauugggcuauuauguguaauggcaucuucugugcuauuguggauggccucagucgaaccgcacuggauagcagccucuauaauauuagaauuuuuccuuaugguacuauuaauacccgagccagaucgccaacguacaccgcaagacaaucaacuggcuuauguuguuauuggcuuauuguuuaugauacuaacgguugccgcgaaugaaaugggccugcuugaaacuacuaagaaggaucucggaauuggccaugcugcgguugaaaaccaccaucaugcugcuaugcuggauguagaucuccauccggcuucugcguggacauuguacgcagucgcaaccacgauuaucacacccaugaugcgacacacaauugagaacaccaccgcuaacauaaguuuaacagcaaucgcuaaucaagcggccauacuaaugggucuagauaaaggguggccaaucucaaaaauggauauugggguuccccuguuagcacuuggauguuauagucaaguaaauccguuaacgcugacugcagcaguacuuaugcugguugcacauuaugcuauaauuggaccgggauuacaagcaaaagcuacgcgugaggcgcaaaagagaacagccgcuggaaucaugaaaaacccuacuguagacggaauuguagccauugaccucgauccuguaguauaugaugcgaaauuugagaaacaacuaggacaaauaauguugcuaauacuauguaccucucagauauuacucaugagaacgacuugggcgcucugcgaaucuauuacuuuggcaacaggaccucuaaccacauuaugggaaggaaguccaggaaaguuuuggaauacgacuauagcaguaucuauggcaaacauauuucggggcaguuaccuagcaggcgcagguuuagccuuuucacuuaugaagucuuuaggcgguggaaggagaggcacuggugcacagggggaaacguuaggugagaaguggaaaaggcaacugaaccaacugucgaaaucugaauuuaacacuuauaagagaagcgguaucauggaaguagaucgcuccgaagcuaaagaagggcucaaaaggggcgaaacuacaaagcaugcaguuuccagagguacagcgaaacuucguugguucguagaacguaaucucguaaaaccagaggggaaaguaaucgauuuaggguguggacgaggaggauggucuuauuacugugcuggacucaagaaagucacggaagugaaaggauauacaaaagggggcccuggccacgaggagccuauaccuauggcaacauauggauggaauuugguaaaauuacacaguggaaaagauguauucuuuaucccaccagagaaaugugacacacuacuaugugauauuggagagucauccccuaauccaacaauagaagaagguagaacguuacguguguuaaaaaugguagaaccaugguuacgcgggaaucaauuuugcauuaaaauccucaauccuuauaugcccucagucguagaaacgcuggaacaaaugcagcgaaaacauggugggaugcuaguucgcaauccgcuaucgaggaacaguacccacgaaauguacuggguauccuguggaacugguaauaucguuucagcaguuaacaugacaagcaggauguuauugaaccguuuuacuauggcacaucguaaacccacguacgaacgggauguagacuuaggagcuggcacaaggcauguagcaguggagccagaaguagccaaucuugacauaauuggucagagaauagagaauauaaaacaugaacauaaaagcaccuggcauuaugacgaggauaaucccuacaaaacgugggccuaucacggcucuuaugaaguaaaacccucaggaagugccucaucaaugguaaauggagugguuaaguuguuaacaaaaccuugggauguaauaccuaugguaacacaaauagcaaugacugacacaacaccauucggacaacaacguguuuucaaagagaaaguagacacaagaaccccuaaggcaaagagaggaacugcucaaaucauggaaguuacugcaaaauggcugugggguuuucuaucuaggaauaagaagccacguaucugcacucgcgaggaguucacucguaaaguuagaucaaacgcugccauuggagcgguauuuguugaugaaaaccaguggaauagcgccaaagaggccguagaggacgaaagauuuugggauuugguccaucgagaacgagagcuccacaaacaaggaaaaugugcaaccugcgucuauaacaugaugggaaagagagaaaagaaauuaggugaauuuggaaaagcaaaagguucuagagcgaucugguacauguggcuuggcgcaagauuccuugaauuugaagcauugggauuuaugaaugaagaucacugguuuucucgggaaaauucccugagcggcguugaaggcgagggcuuacacaaauuaggguacauauugagagauauauccaagauaccuggagguaacauguacgcggaugauacagcuggcugggauaccagaauuacagaagaugauuuacagaaugaagccaaaauuacugacauaauggaaccggagcaugcacuacucgcaaaaucaauuuucaaauugacauaucagaauaaagucguacgaguacaacgccccgcaaagaacggcacaguaauggacguaauuucaaggagagaucaacguggauccggacaaguuggaacauacggccuaaauacguuuacaaauauggaagcucaauuaauccgacaaauggaaagugaagguauauuuucucccagcgaauuagagaccccuaaucucgcugguagaguacucgacugguuggaaaaacacggaguugaaagauugaagagaauggccauuuccggggaugauugcguaguaaaaccuauugacgauagguucgcuacggcauugacugcucuuaaugacauggguaaaguaagaaaagauauaccacaaugggaaccuucgaaaggguggaacgauuggcagcagguuccguucuguagucaccauuuucaccaauuaauaaugaaagacggcagagaaauaguaguaccuuguagaaaccaagaugaguugguagggagggcgagaguaagccagggugcaggauggucauuacgagaaacggcaugucucgguaaaaguuacgcacaaauguggcaauuaauguauuuucaucguagagacuugagacuugcggcaaaugcaaucuguucagccguuccaguggauuggguuccuacaagucguacgacuuggucaauacacgcacaccaucaauggaugacaacagaagauaugcuaucuguuuggaaucgcguauggaucgaagaaaacccuuggauggaagauaaaacccacauuucaagcuggggagacguaccguauuuaggaaagcgugaagaccaaugguguggcucccuaaucgguuuaacggcgagagccacaugggcaacaaacauacaagucgccaucaaucagguaagacguuugauagguaacgagaacuaucuugauuacaugacaaguaugaagcgcuuuaagaaugaaucggauccugaaggagcucugugguaa

SEQ ID NO: 21837 - RNA, 9879 nt, Artificial Sequence
  derived and/or modified CDS sequence (opt6) from DENV-1__GU131761__SS-prME
aguguuacuauguuacucauguuaaugccgacugcccuugcuuuccauuugacaacuagagguggugaaccccacaugauagugucaaaacaagaaagggguaaaucacuccuauuuaaaacaagugcgggaguaaauauguguacccuaauagcgauggaucuuggagaacuuugcgaagacacgaugaccuauaaaugcccuagaauuaccgaaacagagccagaugacguugacuguugguguaacgcaacagauacauggguuacauacggcacaugcagccaaacuggagagcaucgcagagauaaacgaagcgucgccuuagcaccccauguugguuugggacuugagacaaggaccgaaaccuggaugagcucagaaggagcauggaaacaaauacaaagaguagagacaugggcccucaggcauccagguuucacaguaaucgcacucuuucuggcccacgcuaucggcacaucuauuacgcaaaaaggcauuauuuuuauccuccuaauguuaguaaccccauccauggccaugagauguguuggaauugguucaagagacuucguugaaggucuaucaggugcaacauggguggacguggugcuggaacaugggucguguguaacaaccauggcuaaagauaaaccuacauuagacauugaauuauuaaaaaccgaaguaacaaacccagcugugcuaagaaaacuauguauugaggcaaaaauaucuaacacaacaacggacagcagauguccaacacaaggagaagcgaccuuaguggaagaacaagaugccaauuucguaugucggagaacauuuguagaccgaggcugggggaaugguuguggucuguuuggcaaaggcucacuuauaacgugcgcaaaauuuaaaugcguaacuaaacuggaagguaaaauuguucaguaugaaaauuuaaaauauuccguaauaguuacgguacauacuggagaccaacaucagguaggcaaugaaucgacggaacaugguaccacagcgaccauaacaccacaagcuccgacuacagaaauacaauuaacagacuauggagcccugacuuuagacuguagcccaagaacuggucuggauuucaaugaaaugguauuacuaaccaugaaggagaagucgugguuagugcauaaacaaugguuucuugaccuucccuugcccuggaccucaggugcgaguaccagccaagaaacuuggaauagacaggauuuacuuguaacuuucaaaacagcacaugcuaagaaacaagaagucguuguacuuggaucucaagaaggggccaugcauacugcauugacgggggcaacagagauucaaacaucaggcacuacaaccauauucgcgggucaccuuaagugcaggcucaaaauggauaaacuuacacuaaaaggaaugucauauguuauguguacuggaaguuuuaaacuagaaaaggaauuggcugaaacucaacauggaaccguauuagugcaaauaaaauaugaggguacagacgcacccugcaaaauaccauuuagcacacaagacgaaaaaggcguaacacaaaacggcagauuaauuacagcgaacccuauagucaccgauaaagaaaagcccguaaacauugaagccgagccgccuuucggggaaagcuauauaguaauuggagccggcgaaaaagcguuaaaacuauccugguucaagaaagggagcucgaucgggaaaauguucgaagcuacagcuaggggugccagaaggauggcuauuuuaggagacacagcaugggauuuugguaguauugguggcguauuuacgagugucggaaaguugguccaucagaucuuuggaacggcguacgggguuuuauuuaguggcguuuccuggacaaugaagaucgggauuggugugcuauugacuuggcuaggacuuaauagucggucaacgucguuaucaaugacuugcauagcgguuggccuagugacguuauaccuuggcgucaugguccaggcagauucagguugcgugauuaacuggaaagguagagaacuaaaaugugguaguggaauuuuugugacaaaugaaguucauaccuggaccgagcaauauaaauuucaagcagauucgccaaagcgcuuaagcgcagcaauaggcaaagcaugggaagaagggguuugugggauaagguccgcgaccagguuagagaauaucauguggaaacaaaucaguaacgaacuuaaucauauuuuacuagaaaaugauaugaaauuuacaguaguaguaggggauguugcagguauacucgcgcaagguaagaaaaugauucguccucagccuauggaauauaaauacuccuggaagucauggggaaaagcuaagauaauaggugcagauguacagaauacaacguuuauaauugacgguccaaauaccccagagugucccgacgaucaaagggcauggaacauaugggaaguugaagauuaugguuucgggauauuuaccacuaauauaugguuaaaacuccgggacucguacacucaaguaugcgaucaccgucucaugucugcugcaauuaaggauuccaaagcaguccaugcagauauggguuauuggauugaaagcgagaaaaacgaaacauggaaacuugcaagagcgagcuuuaucgagguuaaaacgugcauuuggccuaaaucacauacguuauggaguaacggcguacucgaaagcgaaaugauuauuccaaaaauauacggcgggccuauaagucaacauaauuacagaccaggauauuuuacacagacagccgguccauggcauuugggaaaauuagaauuagacuucgauuuaugugagggaacaacggucguaguagaugagcauugcgggaauagagggcccucacuaagaacaacaacaguaacaggaaaaauaauacaugaaugguguugucgaaguugcacuuugccaccucuaagguucagaggcgaggaugggugcugguauggcauggaaauaagaccgguaaaagaaaaagaagaaaaccuagucaagucgauggucagcgcuggaucuggagaaguugacucauucagccuaggauuauuaugcauaagcauaaugauugaagaaguuaugagaucaagaugguccagaaagauguuaaugaccgguacacuagcugucuucuucuuacugauaaugggacaacuuacauggaaugacuugauacggcuguguaucaugguaggagcgaaugcuucagaucguaugggaaugggaacaacauacuuagccuuaauggcaacuuuuaaaaugcggccgauguuugcaguggggcuccuauuucgucgauuaacuucaagagagguuuugcuauugacaauaggguugucauugguugccaguguggaacucccaaacucuuuggaagaacuaggggacgguuuagcgauggggauuaugauccuaaaacuacuaacugauuuucaaagccaucaauugugggcuacguugcucagucugacauuuauuaaaacuacauucagucuccacuaugcauggaaaacaauggcaaugauuuuauccauagugucauuauuuccacuaugcuugucaaccacaucacagaaaacaacauggcugcccguacuacuuggaucccuagggugcaaaccguuaacaauguuccucauagccgaaaacaagauuugggguagacgaucauggccucuaaacgaagggauuauggcaguuggaauaguaucuauccuccuaucuagucuacuuaagaacgauguaccacucgcaggaccucuuaucgccggcggaauguugauagccuguuauguaauaucuggaucgucagcggaccuuagccuugaaaaagcagcagaggucucaugggaagaggaagcagagcacucaggugcaucgcauaacauccuaguagaggugcaagaugacgggacaaugaaaauccaagacgaggaaagagaugacacguuaacuauucugcugaaagcgacacugcuugcgguuucaggcguuuacccucugagcauaccggcuacauuauucguuugguauuuuuggcagaaaaagaagcaacggucaggaguuuuaugggacacacccaguccacccgaaguugagcgcgcuguccuugaugaugguauauacaggauaaugcaaagaggccuauuagggaggucacagguaggaguugguguauuccaagaaaauguuuuucauacgauguggcacguaacuagaggcgcaguacugauguaucagggaaaacgacuagagccuuccugggcaucuguaaagaaagauuugauaucauauggaggaggcuggagauugcaaggaucauggaacacaggugaagagguacaggugauagcgguagagcccgguaaaaauccuaaaaacguacaaacagcaccgggaacauucaaaacuccugagggagaaguaggagcuauagcccuagauuuuaaacccggaacgucaggaucuccuauuguaaaucgugaaggaaaaauaguaggauuauauggcaacgggguuguaacgacuuccggaacuuacguaagugcaauugcccaggcaaaggcuucacaagaggguccucuuccagaaaucgaagaugaggucuuuagaaaaagaaauuuaacaaucauggaucuccacccaggaucggguaaaacccgaagguaucuaccugcaauuguucgggaagcaauaaagcgaaaacuuagaacguugauauuagcaccaacaagaguaguugcaucugagauggcugaggcccuuaaagggaugccaaucagguaucagaccaccgccgucaaaucagaacacacugguaaagaaauuguggacuugaugugccacgccacauuuacuaugagauuauuaaguccaguccguguuccaaacuacaacaugauaaucauggaugaagcucauuucacagaucccaguucaauagcggcaagaggcuauaucaguaccagagucgguaugggugaagccgcagcaauuuuuaugacugcaacaccaccuggcaguguagaggcguucccacaaaguaacgccgugauacaagacgaggaaagggacaucccugagagaucguggaacuccgguuacgaauggauaacggauuuuccgggaaaaacuguaugguuugugccaagcaucaaaucagguaaugacauagccaauugccuacguaagaauggaaaacguguaauacaauuaagccguaagacauucgauacggaauaccagaaaacuaagaauaaugauugggauuacguagucacaacggauauaucagagaugggagcuaauuuuagggcagaccgagucauagauccucgacggugcuuaaaaccuguaauauugaaagacggaccagaacggguaauacuugcugggccaaugccuguaaccguugcaagcgccgcgcaacgacgaggucgaauaggaaggaaccacaauaaagagggugaccaauacauauauauggggcagccgcuaaacaacgacgaagaucaugcccacuggacagaagcaaaaauguuacuagacaauauaaacacaccagaaggaauaauuccggcauuguucgaaccagagagagagaagagugccgccauagauggcgaauacagauuacguggagaagcuaggaaaacauuuguggagcuaaugcgccgaggagaucuaccaguaugguuaucauacaagguugcuagugaaggauuucaauacucugacaggcgauggugcuucgacggagaacgaaauaaucaagucuuagaagaaaacauggauguagaaauuuggacaaaagaaggagaacguaaaaagcugagaccacgauggcuugaugcacggacauauuccgacccauuagcccuacgagaauuuaaagaauuugcugcgggucgaagaucuguuucgggagaccuaauacuggaaauuggaaaauuaccccaacaccuaacucaacgagcccagaacgcccuggauaaucucguaauguuacacaauuccgaacaaggaggucgagccuacagacacgccauggaggaauugccugacacaauugaaacacucaugcuauuagcccucaucgcuguauugacaggaggaguaacucucuucuuccuuagugguagagguuuagggaaaacuuccauagguuuacuauguguaauggcauccagcguccuguuauggauggcuaguguugagccacacuggauagccgcgucaaucauuuuagaguucuuucugauggucuuauuaauuccugaaccggaucgucaaagaacaccacaggacaaucaacuagcguauguuguaauuggacuguuguuuaugauuuuaacuguagcagccaacgagaugggguuauuagaaacuacuaagaaagaucuagguauuggucacguagccguagaaaaccaccaucacgcggcaauguuagacguggaccuacauccggcaucugccuggacauuguaugccguugcuacuaccauaauaacuccaaugaugaggcacacuauagaaaacaccacggcaaacaucucuuuaacagcuauagcaaaucaagcggcgauuuuaaugggccuagauaaggguuggccaauuucaaaaauggauaucggaguaccguuauuagcucuuggguguuacucacaaguaaauccgcuaacucucacagcugcuguacucaugcucguagcacauuacgcgauuauuggaccaggcuuacaagcuaaagcuacacgagaagcccagaaaagaacggcagcggguaucaugaagaaccccacaguggacggaauaguagcgauugauuuggauccaguggucuaugacgcaaaguuugaaaaacaauugggucagauaaugcuauuaauuuuaugcacgagccagauucuucugaugagaacaacaugggcuuuaugugaaaguauuacguuagcaacugggccgcuuacuacucugugggagggaucuccuggaaaauucuggaacacgacgauagcagugaguauggcgaauauauuuagggguucuuaccuugccggagcaggucuagcauuuagccuaaugaaaucucuaggaggaggacggcgggggaccggugcucaaggggagacccucggggaaaaauggaaacgacaguuaaaucaacuuagcaagagugaauuuaauaccuacaaacggucugguauaauggaaguagacagaucagaggcaaaagaaggauuaaaaagaggcgaaaccacgaagcaugcggucucgagagguacugcaaaacugcgcugguucgucgaaagaaacuuaguaaaaccagaagguaaaguaauugaucugggguguggcagagguggguggaguuacuauugcgccggcuugaagaaagucacagaaguuaaaggguauaccaagggagggccgggucaugaggaacccauaccaauggcaaccuauggauggaacuuggugaaauugcacucuggaaaagauguauucuucauuccaccagaaaaaugugauacccugcuuugcgauauaggugaaaguuccccaaacccaacuauagaggagggaagaacucuacguguuuugaaaaugguugaaccauggcuccgugguaaccaguuuuguauaaaaauauugaacccguauaugccaucuguuguugaaacgcuagagcaaaugcaaagaaagcacgguggcaugcucguucggaacccccuaucuagaaauucaacacacgagauguauuggguaaguugcggaaccggcaauauaguaucugcagucaauaugacgucucguauguuauugaauagauucacgauggcucaccgaaaaccaacauacgaaagggauguugauuugggagcggguacccgacaugucgcuguggagcccgaaguugcaaaucuggacaucauuggacaaagaauagagaauauaaaacacgagcauaaaucaacuuggcacuaugaugaagauaauccuuacaaaacuugggcauaccauggcaguuacgagguaaaaccuucggggagcgcaaguucuaugguuaauggaguaguaaaauuauuaaccaaacccugggacgucauuccgaugguuacacaaauagcaaugacagauaccacgccauuuggacaacaaagaguauucaaagaaaaaguagauacuagaaccccuaaggccaaaagagggacggcacaaauaauggaaguaacggcaaaauggcuuuggggcuuucugaguagaaauaagaaaccucgaauuugcacucgagaagaguucacaaggaaagugcgcucaaaugcagccauuggcgccgucuuugucgaugaaaaucaauggaacagugcgaaagaagcuguggaagaugaaagauucugggaucuagugcauagagaaagagaauuacauaaacaagggaaaugugcuacauguguguauaacaugaugggaaaaagagagaagaaacucggugaauuuggaaaagcaaagggcucucgagccauaugguauaugugguuaggagcaagauuuuuggaguuugaagcucuuggauuuaugaaugaagaucacugguuuucgagagaaaauucacuuucuggaguagagggcgaaggucuccauaaauugggguauauauuacgugauauuucgaaaauaccaggagguaauauguaugccgacgacacagccggcugggauacaagaauaacggaggaugaucuacagaacgaagcccgaauaacugacauaauggaacccgagcacgcucuuuuagcuaaaucaauauucaaacuaaccuaucaaaauaaaguaguacgaguacaaagaccagcuaagaauggaacagucauggacgucaucagcaggagagaccagagagguaguggacaagugggcacguacggauugaauacuuucacuaacauggaagcccaauuaauucgccaaauggaauccgaggggaucuucagccccucagaauuggaaacaccgaacuuggcagagagaguacuugauugguuagagaaauacggugucgaacguuuaaaaagaauggccaucucuggugacgauuguguaguaaaaccaauagacgauagguuugcuacggcauuaaccgcacuaaaugacauggggaaaguaagaaaagacauuccucaaugggaaccauccaaaggauggaaugacuggcaacaggucccuuuuuguagucaccauuuucaccaauuaauuaugaaagauggaagagaaauuguuguuccuugucgcaaccaagaugaauuaguagguagagcaaggguaagucaaggagcaggcuggaguuuaagggaaacagcaugccuaggaaaaagcuaugcgcagauguggcaguugauguacuuucacagaagagaucuccgucuggcggccaacgcaauaugcucugcagugccaguagauuggauaccaacgucaagaacaaccuggucaauacacgcucaucaccaguggaugacaacagaggauaugcuaucugucuggaauagaguuuggauagaagaaaauccuuggauggaagauaaaacccauauuaguaguuggggagauguaccuuaccuagguaaacgagaagaucaguggugcggcuccuuaauagguuuaacugcaagagcgacaugggcuaccaauauacagguagccauaaaucaggugaggcgacucauaggcaacgaaaauuaccuugauuauaugacaaguaugaaaagauucaagaacgaguccgauccagaaggcgcacuaugguga

SEQ ID NO: 21838 - RNA, 9879 nt, Artificial Sequence
  derived and/or modified CDS sequence (opt6) from DENV-1__GU131762__SS-prME
uccguaacaaugcuauuaaugcuaaugcccacagcguuagcuuuucaccuaacuacgcgagguggcgaaccccacaugauaguuucaaaacaagaaagagguaaaucucuccucuucaaaacuucagcaggcgugaacaugugcacauugauagccauggaccugggagaauuuugugaagauacaaugacuuauaaauguccgcguauaacagaagcugaaccggaugacguagauugcugguguaaugcaacagauaccuggguaacguauggcacauguagucaaaccggagaacacagaagagauaaaagaagcguggcgcuagcuccccacguaggauugggguuagagacaagaacagaaacguggaugucaagugagggagcauggaaacaaauacaacgaguagaaacaugggcuuuacgccacccuggcuucacaguaauagcauuguuuuuagcccaugccauagguacaaguauaacacagaaaggcaucauauuuauacuauuaaugcugguaacucccucuauggcaaugcgaugcguuggaauagggucaagggacuucgucgaaggauuaagcggggcaacuuggguggacgucguuuuagaacauggcagcugcgugacuacaauggcuaaagauaaaccaacguuagacaucgaacugcuuaaaaccgaaguaacaaauccagcagugcuaaggaaacuauguaucgaagccaaaauaucuaacacuacaacagacucgagaugcccuacccaaggggaagcaacauuaguagaagaacaggacgcgaauuucguuugcagacgcaccuucguagauagagguuggggcaauggauguggucuauuuggcaaagggucacucaucacaugcgccaaauuuaaaugcguuacaaaauuagaagguaaaauaguucaauacgaaaaucuuaaauacucagugauaguuacuguacacacgggcgaccaacaccaaguaggcaacgaaaguacagaacacggaacaaccgccacaauaacaccucaagccccaucaacagaaauucaacuaacugacuauggcgcgcuaacuuuagacugcagcccacgcaccggauuagauuuuaacgaaaugguauuauuaacuaugaaagagaaaaguugguuaguacacaaacaaugguuuuuagauuuacccuuaccauggaccucuggagcguccacaagccaggaaacauggaauagacaggaccuucuagugacuuuuaaaacugcucacgcuaagaaacaagaaguaguuguauuagguucucaggaaggcgcaaugcauaccgcgcucacgggggccacugaaauucaaacaagugguacuacuacuauuuuugcaggucauuugaaaugccgauugaagauggauaaauuaacacuuaaggguauguccuacguaauguguacgggcucuuuuaaauuggaaaaagaggucgcggaaacucaacaugguacagucuuaguucaaauuaaauaugagggaacggacgccccauguaaaauaccauuuucgacacaggaugaaaaagggguuacacagaauggucgacucauaacggcgaacccaauugucacagacaaggaaaaacccguuaauauugaagcagaaccaccguuuggagaaaguuauauaguuauuggagccggugaaaaggcccugaaacuguccugguuuaagaagggaucuaguauaggaaaaauguuugaagcgacagcaagaggggcccguaggauggcaauucuaggagauacugcgugggauuucgguaguauugguggcguauuuacgagcguuggaaaacuuguucaccaaaucuuuggcacugccuaugggguguuauucucagguguaaguuggacaaugaagaucgggauaggagugcuccuaacauggcuaggauuaaacagccggucaaugagucuaucgaugacuugcauugcuguaggcuuaguaacacuauacuuaggaguaaugguacaagcugauuccgguugcguaauaaauuggaaaggacgggagcuuaaaugcggaaguggaauauuuguuaccaaugaaguccacacguggacagaacaauauaaguuucaagcagacucaccaaaacgacugucggcugcuauaggaaaagcgugggaagaggguguuugcggaauaaggagcgcuacaagguuagaaaauaucauguggaagcaaauuucgaacgagcuaaaccauauccuauuggaaaaugauaugaaauucacugucguaguuggugauguagccggaaucuuagcacaagggaagaaaaugauacgaccacagccuauggaauacaaguauucauggaaaucaugggggaaagcaaagauaauuggugccgacguccaaaauacaacauuuauaauugacgggccaaacacgccagaauguccagacgaccaaagagcuuggaauauaugggaagucgaagauuacggauuugguauauuuacuacuaacauaugguuaaaacucagagacuccuacacucaaguaugugaccauagauuaaugucugcugcgaucaaggacaguaaagcugugcaugcagacaugggauauuggauagaaagcgagaaaaaugaaacauggaaacucgcgcgugcuuccuuuauugaagucaaaacaugcauuuggcccaaaucccauacuuuauggucgaaugguguauuagaaagcgaaaugaucauacccaagauauauggaggucccauuagucaacauaacuauagaccgggcuauuucacacaaacggcgggaccuuggcauuuagguaaacuugaauuagacuuugaccuuugugagggaacuaccguggugguugaugagcacuguggaaauagagguccuagucugaggacaaccacgguuacuggaaaaauaauacaugaauggugcuguagaucauguacacuaccaccuuugcgcuuuaaaggugaagacgguuguugguauggaauggaaaucaggccuguaaaggaaaaagaagagaacuuaguaaaaaguaugguaucagcagggucuggagaaguggauucuuuuaguuugggucuauuauguauaagcauaaugauagaggaggugaugagaucccgcuggucccgaaaaauguuaaugacugguacucuagccguguucuucuugcugaucauggggcaauuaacauggaaugauuuaauaagauuauguauaauggugggcgcgaacgcaucugaccgaauggguauggggacaacauacuuagcguuaauggcuacuuucaagaugcgaccuauguucgcugucgguuuacuuuuccggagguuaaccucuagggaaguacuguuauuaacuauuggauuaucgcuuguugcaucaguugaauuacccaauucguuagaagaauugggcgaugggcuugcaaugggcauuaugauauugaaauuguuaacagauuuucaaagucaucaauugugggccacacuuuuguccuuaacguucauuaaaacaacuuuuagccuccacuacgcuuggaaaacuauggccauggucuugagcaucguaagccuauuuccccugugcuuaagcacgacaucacagaaaacaacaugguuaccaguucuguuggggucauugggguguaaaccacuaacaauguuuuuaauagcugaaaacaaaauuuggggacgaaaaucuuggccacuuaacgagggaauuauggcgguaggaauaguaucuauacuauuaucaucgcuacuaaagaaugauguaccucuggcaggcccucuuauagcaggggguaugcuaauagcguguuaugucauaucggggagcucggcagauuuaagccuagagaaagcugcagaagucucuugggaagaagaagcugagcauucuggggcaagucauaauauccuaguugaaguacaagaugacgguacaaugaaaauaaaggaugaagaaagggaugacaccuuaaccauccuucuuaaagcaacacuuuuagcgguuucagguguuuauccacuuuccauucccgcuacacuauucuuaugguacuuuuggcagaaaaagaaacagcgaucaggcguucuuugggauacacccagcccacccgaaguugaacgagccgucuuagaugauggaauauauagaauuaugcaacgaggcuugcuaggaagaagucaaguagggguugggguauuucaagagaacguauuucauacaauguggcaugugacaagaggugcuguauugauguaucaaggaaaacggcuugagccaagcugggccucagucaagaaagaucuaauaaguuacgguggugguuggcgacuucaagguuccuggaauacuggagaagaaguacaaguuauugccgucgaaccaggcaaaaaucccaaaaauguacaaacagcgccuggcacuuuuaaaacuucugaaggugaaguaggggcgauugcgcuugauuucaaacccggaaccagcggaagcccaauagucaaucgcgaggguaagaucgugggauuauaugguaacggagucgucacaacaucuggaacguacguaagcgcaauagcccaagcaaaggcaucucaagaaggacccuuaccggagauagaggaugaaguauuuagaaaaaggaaccuaacgauaauggaucuccauccugguagcggcaaaacucgucgauacuugccggcuauaguuagagaagcaaucaagaggaaacuuagaacguuaauauuagcaccuaccagggugguagcaucugagauggcagaagcauugaaaggcaugcccauuagauaucagacuaccgccguaaagagcgaacacacugguaaagaaauagucgacuuaaugugucacgcgacauuuacaaugagacuauugucaccaguacgaguuccgaacuacaacaugaucauaauggaugaggcgcacuuuacagauccuucuucgauugcagcgcguggauacauuaguacacgcguaggaaugggagaggcagcugccauuuucaugacagcaacaccaccuggaucuguggaggcuuuuccccaaucuaaugcugucauccaagaugaagaacgagauauuccugaaagaucauggaauagcggcuaugaauggauuacagacuucccagggaaaacuguaugguucguaccaagcauaaaaagcggaaaugauauugcuaauuguuugaggaaaaauggaaaacgaguaauacaauugagcaggaaaacauucgauacagaauaucagaaaaccaaaaauaaugacugggacuauguuguaacaacugauauaucugaaaugggagcgaauuuccgagcagauagggucauagacccaagaagaugucugaaaccgguaauacugaaagaugguccggagcgggugauacuugccgguccuaugccaguaacuguagcaucagcggcacagagaagagguagaauaggaaggaaucauaauaaggagggcgaucaguauauauacaugggacaaccauuaaacaacgacgaagaccaugcacauuggacagaggcgaaaaugcuccuagauaauauaaauacaccugaagggauaauaccagcacucuucgaaccagagagggagaaaagugcagcuauagauggagaauaccgacugcguggagaggcucguaaaacguucgucgaacuuaugagaagaggagacuugccgguauggcuaaguuacaaaguagcaagcgaaggauuucaguauuccgaucgaagaugguguuuugacggugaaagaaauaaucaaguacuugaagaaaacauggauguugaaauuuggacuaaagaaggggagcggaagaaauugcguccccgcuggcuugacgcaaggguauauucugauccucucgccuuaagggaauuuaaagaauuugcggcggggcgacgaagugucagcggggauuugauacucgaaauuggcaaguuaccgcaacacuuaacacaacgcgcucaaaaugccuuagacaaucuuguuauguuacauaacucugagcaaggagguagagcauaccgacacgcaauggaagaacuucccgauaccauugaaacgcuaaugcuacuagccuuaauagccguauugacuggcggggucacuuuauucuuuuuaucaggaagaggacuagguaagacuucuauuggucuccuuuguguaauggcaucaucgguauuacuauggauggccaguguagagccucauuggauagccgcaucuaucaucuuagaguucuuuuugauggugcuucugauucccgaacccgacagacagaggacgccgcaagauaaccaacucgcauauguagucauaggauuacuauuuaugauauugacaguagccgcgaaugaaauggguuuacuagaaaccaccaagaaagauuuggguauagggcaugucgccguggaaaaucaucaucaugcugcaaugcucgauguagacuuacaucccgcgucugcguggacccuuuacgcaguugccacuacuauaaucacaccuaugaugcgacacacuauagagaacaccacugcaaacauaucccuaacagcaauagcuaaccaagcggcaauccugaugggauuggauaaagguuggcccauuagcaaaauggacaucgggguaccguuacuagcauuaggguguuauucacaaguaaauccuuuaacauugacggcggcugugcuuauguuaguugcacauuaugcaaucaucggaccaggacuacaagcaaaagcaacaagagaagcucaaaagagaacagcugcagguaucaugaagaaccccaccgucgauggaauuguagcaauagaccuagauccaguaguguacgacgccaaguucgaaaaacaacuaggacaaauaauguuacuaauauuaugcacgagucagauccucuugaugagaacaacuugggcccuuugugaaucuauaacuuuagcuacgggaccacuaaccacgcucugggagggauccccuggaaaguucuggaauacaacaauugcgguuaguauggcuaacauauuccgagguagcuauuuagcuggggcagggcucgcguuuagcuuaaugaaaucacuggguggaggaaggagaggaacuggagcccaaggugaaacacucggcgaaaaauggaaacgucaacuaaaccaauugaguaagagcgaguuuaauaccuauaagcgaucagggauaauggaaguggauaggucggaagcaaaggaaggacugaaacgaggcgaaacgacaaaacacgcagucagucgggguaccgccaaacuaaggugguucguugaaagaaaccuaguuaaacccgaaggaaaggucauagauuuaggaugcggacgaggcggauggucguauuacugugcaggauuaaagaaggucacagaagugaaaggauauacuaaaggagguccaggucaugaggaaccuaucccuauggccacuuauggauggaaucucgucaaacuucacagugguaaagacguauuuuucauacccccugaaaaaugcgauacgcuccuuugugacauaggugaaucgagcccaaacccuacaauagaggagggaagaacucuaagaguuuuaaagauggucgaaccuugguuaagagggaaccaauuuuguauaaaaauacucaacccguacaugccgucaguaguagagacacuugaacagaugcaaaggaagcauggaggaaugcugguaagaaauccauuaucuagaaauagcacacaugaaauguauuggguaagcugcggaacgggaaauaucgucucagcuguuaauaugaccagucguauguugcuuaaccguuucacaauggcacacagaaaaccaacguaugaaagggauguugacuuaggagcaggaacucgacacguagcuguagaacccgaaguagcuaacuuagauauaauaggacagagaauugaaaauauaaaacaugaacacaagaguacauggcauuaugacgaagauaacccauauaaaaccugggccuaucauggcaguuaugaagugaagccgagcgggucggcaaguaguaugguaaauggcgugguaaaauuauuaacuaaaccaugggauguuauaccaaugguaacucagaucgcuaugacagauacuacucccuuuggacaacaacguguauuuaaggaaaaaguggauacuaggacccccaaggcaaaacgcggcacugcgcaaaucauggagguaacugcuaaaugguuguggggauuucuaaguaggaauaagaaacccaggauuuguacaagagaggaauuuacuagaaaaguuaggaguaacgcagccauaggagcaguuuuuguagacgaaaaucaguggaauagugcgaaagaagcgguagaagaugaacguuucugggaucuaguucauagggaacgagaguuacacaaacaagguaaaugugcuacuuguguuuacaauaugauggguaaacgagagaagaaacuaggcgaguucggaaaggccaaaggcucucgagcaauaugguauauguggcuaggcgccagauuuuuagaauuugaagcacuggguuuuaugaacgaagaccacugguucucccgggaaaauagcuuaucgggaguugaaggagaaggccuccauaaacuuggcuacauccuacgagauauuaguaagaucccaggaggaaacauguacgccgacgauaccgcuggaugggauacacguauaacagaagaugaccugcagaaugaggccaaaaucacugacauaauggaacccgaacaugcauuauuggcaaagucaauauucaagcugacauaucaaaauaaaguagugagaguacaacgaccugcaaagaacgggacaguaauggacgucauaucgcguagagaccaaagggggucuggucaaguugggaccuauggguuaaauacauuuacgaauauggaagcucaguuaauuagacaaauggaaagcgaaggaauauuuucgccgucagaauuggagacacccaacuuagcggguagaguacuagauugguuagagaaacauggggucgaaagacucaagcgcauggccauuaguggagacgacugcguaguuaagcccauagacgauagauucgccacagcgcuaaccgcauuaaaugacaugggaaaaguaagaaaagauaucccccaaugggaacccucuaagggguggaaugauuggcaacagguccccuuuugcucacaccauuuccaucaacuaauaaugaaggauggcagagagauaguaguaccgugccgcaaccaagaugaauuagugggacgugcaagaguaucucaaggagcuggauggucguugcgugaaacagcuugucuggguaaaagcuacgcacaaauguggcaguuaauguauuuccauagacgagaccugaggcuugccgcuaacgcuauaugcucugcuguuccaguggauuggguaccaaccaguagaacuacauggaguauccaugcacaucaucaauggaugaccacagaggacaugcugagcguguggaauaggguguggauagaagagaacccguggauggaagauaaaacccauauaucaaguuggggagauguaccuuaccuagggaagagggaagaccaauggugugguucacuaaucggucuaacagccagagcaacuugggcaacaaauauacaaguagcuaucaaucaaguaagaagguuaauaggcaaugagaauuauuuagauuauaugacaucgaugaaaagauuuaaaaacgaaagcgauccugaaggugcuuuaugguaa

SEQ ID NO: 21839 - RNA, 9879 nt, Artificial Sequence
  derived and/or modified CDS sequence (opt6) from DENV-1__GU131763__SS-prME
ucaguaaccaugcuauuaauguugaugccgacugccuuagcguuccaucuaacgaccagagguggugaaccucacaugauagucacaaaacaagaacgugguaaaucacuguuauuuaaaaccuccgcuggugugaauauguguacguuaauugcaauggauuugggagaacuaugcgaagauaccaugacauacaaauguccaagaauaacugaggcggaaccagacgauguugauuguugguguaacgcaacggauacguggguaacauauggaacauguucgcaaacuggagaacaucgaagagauaagagauccguagcccuggccccacacgucggguugggacuugaaacgcgcacagaaacauggaugucuucagagggugcauggaaacaaauacaaagaguggaaaccugggcuuuaagacacccuggauuuacggugaucgcacuauuuuuggcacacgcaauagggacaucaaucacgcaaaaaggaaucaucuuuaucuuacugauguugguuacgcccaguauggcuaugcguuguguuggcauuggaaguagagauuucguagaaggacuaaguggagcgacauggguugauguaguacuggagcauggaucguguguuacuacaauggccaaggacaaaccaacuuuagauaucgaacugcuaaaaacggaagucaccaauccagccguacuaagaaaacuuuguauagaagcaaaaauuaguaacacaacaacggauucuagaugucccacgcaaggcgaagcaacguugauggaagaacaagacgccaauuuuguaugucguagaacuuuuguagaucguggauggggaaacggguguggccuauuuggcaaagguucauugauuacaugugccaaguuuaaaugugucacaaaacuagaaggaaaaauuguacaauacgaaaacuugaaauauagugucauagugacagugcauacaggugaucaacaucaagugggcaaugagagcacagaacaugggacaacggcuacaauaacgccccaagcgccaaccucagaaauucaauuaaccgauuauggugcauugacauuagauugcucgccuagaacaggguuagauuucaacgaaaugguuuuguugacuaugaaagaaaaaucauggcucguccacaaacaaugguuuuuggaccuuccucuaccauggaccuccggagcuagcacaagucaagagacauggaaucgccaagauuugcuuguaacuuuuaagacagcgcacgccaaaaagcaagaggucguuguucuagggucccaagaaggcgcuaugcacaccgcuuuaacgggagcuacugaaauucagacuagcggaacuacuaccauauucgccgggcaucucaagugucgacuaaagauggauaaacuuacacuaaaaggaaugucauacguaauguguacuggaucauuuaaauuagaaaaagagguggcugagacgcagcauggaacuguucucguucagauaaaauacgaggguacagaugcacccugcaaaauacccuuuucaacacaagacgaaaaaggagucacucaaaauggccggcucauuacagccaauccaauuguaacagauaaagaaaaacccgucaauauagaagccgagccuccauucggggaaaguuacauagucauaggcgcaggagaaaaagcguuaaaacuuucaugguuuaagaaaggcagcaguauaggcaaaauguucgaagcuacagcacgaggugcaaggcggauggcgauacuuggagauacggcuugggauuuuggcagcauaggaggaguauucacuucugucggaaaacuuguacaucaaaucuuuggcacggccuacgguguacuguuuucaggaguuucauggacgaugaaaauaggaaucggaguucuauugaccugguuaggucuuaauucuaggaguaccucacuaaguaugacauguauugcugugggccugguaacauuauauuuaggagucaugguucaagccgauucugguugugucauaaacuggaaagguagagaacucaaaugcgggucaggcauauucguuacaaaugaaguccacacuuggacggaacaauacaaguuccaagcggacagcccaaagaggcuuagcgcagcgauaggcaaggcuugggaagaagggguguguggcaucagaucagcuacaagacuagaaaauauaauguggaaacaaaucaguaacgaauugaaucauaucuugcuggaaaaugauaugaaauucaccguagucguaggugauguugucggcauauuggcgcaggggaagaaaaugauucgcccucaaccaauggaacauaaauauucauggaagucauggggaaaagcgaaaauuauuggagcagacguucagaacaccacauuuauaauagacgguccgaacacuccggagugcccagacgaccaacgagcuuggaauauaugggaaguggaagacuaugguuucgggauuuuuaccacaaauauuugguuaaagcuacgggauagcuacacucaaguuugcgaucaucgacuaaugagugccgcgauuaaagauucaaaagcuguacacgccgauauggguuacuggaucgaaucugagaaaaaugaaacuuggaaacucgccagagccuccuucauagaagucaaaacuugcaucuggcccaagagccauacuuuauggaguaaugguguucuugaaucagaaaugauaauaccaaagauuuauggaggacccauaucccaacacaauuauaggccaggcuacuuuacacagacagccggccccuggcauuuaggaaaacuggaauuagauuucgaucuuugcgaaggcacuacaguaguuguugacgagcacuguggaaauaggggacccucuuuaagaacaacgacugugaccgguaagauuauucacgaaugguguugccgcucuugcacauuaccucccuuaagguucaagggagaagacgguuguugguacggaauggagauccguccuguaaaagaaaaagaggagaauuuaguuaaaaguaugguaagcgcaggacucggugaaguggauucuuuuagucuuggauuguuaugcauuaguauuaugauagaagaaguuaugcgcagucgcuggucacgcaaaaugcuuauggcagguacacucgccguauuuuuacuuuuaauaaugggccaauuaacuuggaaugauuuaauaagauuauguauaaugguuggggcaaaugccagugacagaaugggaauggguacuacauaccucgcguuaauggcaacuuuuaaaaugagaccuauguuugcaguaggacuacuauucagacgacuaacuucgagagaagucuuacuucugacaaucggauuaucucuaguggcuucagucgaacuacccaacucucuugaggaguuaggggauggcuuagcuauggggauaaugauccuaaaacuucucacggauuuucagagucaucaacuaugggcuacacugcuuucuuuaacauuuauuaaaacuacauugagucuccacuacgcguggaagaccauggcaaugguguuaaguaucguaaguuuauucccucuaugccucucuacaacaagucagaaaaccacaugguuacccguacuacuugggucguugggguguaaacccuugacaauguuucuaaucgcagagaauaaaauuuggggucguaaaucguggccgcuaaacgagggcaucauggcaguagguguaguaaguauacuccuuucuucacuacuaaagaacgauguaccauuagcagguccacuuauagcagggggaauguugauugcaugcuauguaauaaguggaagcagugcugauuuaagucuugaaaaagcagcggagguuucaugggaagaagaggcugaacacuccggagcaagccacaauauauugguagaaguacaggaugacggcacaaugaaaaucaaagacgaagaaagagaugauaccuuaacaauuuuacuuaaggcaacacuucuagcaauaagcggcguguauccuuuaucaauuccggcgacuuuauuuguuugguauuuuuggcagaagaaaaagcaacgaucaggaguacucugggacacgccgucaccaccagaaguggaacgagcuguuuuagaugauggaauuuaucggauuaugcaacgugguuuguuggguagaucacaaguaggagugggugucuuucaagaaaauguauuccauacaauguggcacguaacucggggagcaguccuuauguaucaaggaaaaaggcuugagccuagcugggcaucugugaagaaagauuuaauuagcuauggggguggauggcggcugcaaggaucuuggaacacaggggaggaagugcagguaauagcaguugagccaggcaaaaaccccaaaaauguccaaacugcaccuggcacuuuuaagacgcccgagggagaaguuggugcgauugcauuagacuuuaaaccaggcacaucaggaagcccaauuguaaacagagagggcaaaauuguugguuuauauggaaauggagucguaacaacuucaggaacauauguaagugcaauagcacaagcaaaagcgucacaggaaggcccgcuacccgaaauugaagaugaaguuuuuaggaagaggaauuugaccaucauggauuuacacccuggauccggaaagacacgacguuaccuacccgcaauuguaagagaagcaauaaaacgcaagcugcgaacguuaauacuagcgccaacaagagugguugcgucugaaauggcugaagcgcuaaaaggaaugccuauacgauaucaaacaaccgcugugaagagugaacauacuggaaaagagauagucgaucuaaugugccacgcuacauucacuaugagacucuuaucaccuguaagaguaccuaauuauaauaugauaauaauggaugaagcgcacuuuacggauccgucgagcauugccgccaggggauauauaagcacgcguguuggcaugggugaagcugccgcuauauucaugacagcuacucccccggggucggucgaggcuuucccccaaagcaaugcaguuauacaagaugaagaacgagauauuccugaacguucguggaacuccgguuacgaauggauaaccgacuucccgggcaaaaccguaugguucguacccaguaucaaauccgguaacgauauugcuaauugucuucggaaaaacggaaaaaggguaauccaacuaucacgaaaaacauucgauacggaauaucaaaagacuaaaaauaacgacugggacuauguagugacuaccgauaucuccgaaaugggagccaacuuucgagcugaucguguuauugauccgaggagaugcuugaaaccuguaauauuaaaagauggucccgagcgcgucauucuagcuggaccaaugccuguaacaguugccagugcagcacagcgccggggacgcauaggacggaaucacaauaaagaaggcgaccaguacauauauaugggacagccacuaaauaaugacgaagaccacgcucauuggacugaggcaaagauguuauuagacaauauaaauacucccgaaggcauaauaccugcauuauuugaacccgaaagggaaaaaucggcagcaauugauggugaauauagguuaagaggcgaggcaagaaaaacauuuguugaacuaaugagaagaggagaccuuccagucuggcugucauauaaaguagcuagugaagguuuucaguacagcgaucgccggugguguuucgacggagagcgaaacaaucaagucuuagaagaaaauauggauguagaaauauggacaaaagagggcgaaagaaagaaauuaagaccucgcugguuagaugcaagaacguauucggacccucucgccuugcgugaauuuaaagaguucgcagcaggucguagaaguguuucaggggaccuuaucuuggagaucggaaaauuaccacaacaucuaacacaacgagcccaaaaugcuuuggauaacuuaguaaugcugcauaauagugaacaaggagguagagcguaccgacaugcuauggaagaguuaccggauacaauagaaacacuuaugcuauuagcuuuaauagcuguacuaaccggagguguuacauuguucuuuuuaagcggucgaggacuaggaaaaacgaguauaggacugcuguguguuauggcaucaagcgugcuacuauggauggcaucugucgaaccacauuggauagcagcuagcauuauacuggaauuuuucuuaaugguucuguuaauaccggaaccagacagacagcgaacaccacaggacaaucaacucgcauacguagugauaggacuuuuauuuaugauauugacagucgcagcgaaugaaaugggacugcuagagacaacuaagaaagauuuagguauaggucauguugcgguagaaaaucaccaccaugcuacaaugcucgauguugaucuucauccagcgucagcuuggaccuuauacgcgguagcaacuacaaucauuacgccuaugaugcgucauacaauagaaaacaccacugcgaacaucagcuuaacggcuauugcuaaucaagcagcgauacuuauggguuuagacaaaggcuggcccaucagcaaaauggacauuggaguaccauuacuugcacuaggaugcuauucacaagugaaucccuuaacucugaccgcagcuguauuaaugcuaguagcacauuaugcaauuauugguccuggguuacaagccaaagcaacucgugaggcucaaaaacgaaccgcggcggggaucaugaaaaauccgacgguggacggaauuguagcuauagauuuagauccaguaguauaugacgcuaaauuugagaaacaguuaggucaaauuauguuacuuauacuuuguacaucacaaauauugcuaaugaggacgacaugggcacuaugugagaguauaacacuagccacaggaccgcugacaacucugugggaaggaucacccgguaaguuuuggaauacaacaaucgcaguaagcauggcuaauauauuucgugggucguaccuggcaggagcaggcuuagccuuuucacuaaugaagucccuuggaggaggacgaaggggaaccggagcgcaaggugaaacauugggagaaaaauggaaacgacaacuaaaucaauuguccaagagugaguuuaacauauacaagcgcaguggaauuauggaaguggauaggagugaggccaaggaaggacuuaaacgcggugagacuacacgucacgcaguaucucgaggaacagcaaaacuacgaugguuuguagaaaggaauuuaguuaaaccagaagguaaagugaucgaucuagguugcggaagggguggguggucuuauuauugcgcagggcucaagaaagucacugaagucaaaggauauaccaaaggaggaccaggacacgaggaaccaauaccaauggcgacuuacggguggaauuuaguuaaauuacacagcggaaaggacguuuucuucacaccacccgaacgaugcgauacauuacuuugugauauaggagaaagcucacccaauccaaccauagaggagggacgaacauugagaguacuaaaaaugguagaaccauggcuacgaggaaaucaguuuugcauaaaaauuuuaaacccguauaugccuuccguuguagaaaccuuagaacaaaugcaaagaaaacaugggggaaugcuaguuagaaacccguuaagcaggaacagcacacacgaaauguacugggucucguguggaacaggaaacauaguaagugccguaaacaugacuucuagaaugcuacugaauagauuuacuauggcucacagaaaaccuacguacgaaagagacguggaucugggagcggguacucgccacgucgcaguugaaccagaaguagcgaacuuagacauaauagggcagagaauugaaaauauaaaacaugaacauaaaucuacauggcauuacgaugaagacaaccccuauaaaacaugggcauaucaugggucauacgaaguuaagccuucaggaagugcaagcucgaugguaaauggugucguuaagcuacucaccaaaccaugggacgugauaccgaugguaacccaaauugcaaugacggacacaacgccuuucggccaacaacgaguguucaaagaaaagguagauacgagaacuccgaaggcgaaaagaggcacugcacaaauaauggaagugacagcgagguggcuguggggauucuugagcagaaauaagaaaccaaggauauguacaagagaagaguucacucgaaaggugagaagcaaugccgcaauaggcgcgguuuucguagaugaaaaccaauggaacucggcuaaagaagcgguugaagacgagcgauucugggauuuagugcaaaaagagcgagaauuacacaagcaagggaagugcgcaacuuguguguauaacaugaugggaaaaagagagaagaaguuaggagaauuugguaaagcuaaagguagcagggcaaucugguauaugugguuaggagcuagauuccuagaguucgaagcacuaggcuuuaugaacgaggaucacugguuuucaagagaaaauaguuugaguggcgucgaaggcgaaggauuacacaagcuaggauacauucuaagagauauaucgaagauuccggguggcaauauguaugcggacgauaccgcaggaugggauaccaggauaacagaagacgacuugcaaaacgaagcaaaaaucacagauaucauggaaccugaacacgcacuuuuagcaacgucaauauuuaaauuaacauaccaaaacaaaguagugcguguacaacgaccugccaaaaaugggacggucauggaugucauaucgcgacgugaucaacgcgguaguggacagguuggcacauacggauuaaauacauucacaaauauggaagcacagcuaauacggcaaauggaauccgagggaauauuucuaccgagugagcuggagacuccuaaccuggccgaaagaguguuagauuggcuagaaaaacaugggguggaaaggcuuaagagaauggcaauaucaggagacgauugcguaguaaaacccaucgacgacagauucgcgacagcacuaacagcccuaaaugauauggguaaggugagaaaggacauaccucaaugggagccaucgaagggcuggaacgacuggcagcagguuccauuuuguucccaccacuuccaccagcuaaucaugaaagauggacgggaaauaguaguaccaugcagaaaucaagacgaacuuguugguagggcaaggguaucccaaggcgcagguuggagccugcgcgaaacggcaugucuugguaaaucuuaugcucaaauguggcaauugauguauuuucauaggcgugaucugagauuggccgcaaacgcaauaugcucagcgguaccggucgauugggugccaacgucacguacuacuugguccauacacgcacaucaucaauggaugacuacggaagauaugcuaucuguuuggaauaagguguggauagaagaaaacccguggauggaagacaaaacccaugucucuuccuggggagacguaccguaccucggcaagcgugaagaucaaugguguggcagccuuaucggauugaccgcuagagcgacaugggcgucuaauauccagguugccauuaaccaaguccgaagguugauagguaaugagaacuaccuagacuacaugacaaguaugaaacgcuuuaaaaacgaaggugacccagaaggugcuuugugguag

SEQ ID NO: 21840 - RNA, 9879 nt, Artificial Sequence
  derived and/or modified CDS sequence (opt6) from DENV-1__GU131766__SS-prME
ucagugacaaugcuuuuaaugcuuaugccuacggcucuggcuuuccacuuaacuacaagagguggagaaccacacaugauuguuacgaaacaagaaagagggaaaucuuuacuauucaaaacgagugcgggaguaaauaugugcacauugaucgcaauggacuugggagaacucugugaagacacaaugacauauaaauguccaagaauaacugaagcagaaccagaugauguugauugcugguguaaugcgacagauacuugggugacuuacgguacgugcucacaaacgggcgaacauaggcgcgauaaaagaucaguugcacuagcaccucauguaggauuaggguuagaaacgaggaccgaaacuuggaugagcagcgaaggggcauggaaacaaauccaacguguugaaacaugggcccuacgucauccaggguucacuguaauugcgcucuuuuuagcucacgcuauugguacuuccauaacucaaaagggaauaaucuuuauauuguuaauguuaguaacuccaucuauggcuaugagauguguuggaaucgggaguagagauuuuguugaaggccuuaguggcgcaacauggguggacguuguuuuagaacacggaucguguguuacuaccauggcaaaagauaaaccaacucuggacauagaacuccuaaagaccgaagucacaaauccagcggucuuacgaaaacugugcauagaggcuaaaaucagcaauacaacaacagauuccagaugcccaacucaaggcgaggcgacacuuauggaagaacaagacgcaaacuuuguuugcaggcgcacguucguagacagaggauggggcaauggcugcggacuguucggaaaaggaucccucauaacaugcgccaaauuuaagugcguaacaaaauuggaagguaaaauuguacaauaugaaaaccugaaauauucuguuauagucacugugcacacgggcgaucaacaucaagugggaaaugaaaguauugaacacgguacaacugcuacuauaacaccucaagcuccaaccuccgaaauucaguugacugauuauggagcauuaacguuagauugcaguccaaggacagggcuagacuuuaacgaaauggugcuacuaacgaugaaggagaaaaguuggcuggugcauaaacaaugguucuuggaucucccacucccguggacaucaggagcuucaacaucgcaagaaacuuggaaucggcaagaucuauuaguaacauuuaaaacagcccacgccaagaaacaggagguaguuguccucggcucccaagaaggcgcaaugcacacggcauugaccggagcaacagaaauacaaacauccggaacaacaacuauuuuugcaggccauuuaaaauguagacuaaagauggauaaacuaacccuuaaaggaaugaguuaugugauguguacaggaaguuucaaacuggaaaaagaagucgcagaaacccaacacgggacaguccucguucagauuaaauaugaaggaacggaugcgccauguaaaauuccauuuucaacucaagaugaaaaagguguuacacaaaaugguagacuaaucacggcaaauccgaucguuauagacaaagaaaagccuguaaauaucgaagcugagccacccuuuggagaaucauacaucguaaucggagcuggagaaaaggcauuaaaacuaaguugguucaagaaagguagcagcauugguaagauguucgaagcaacagcgagaggcgcaaggagaauggcuauacugggcgacacagcaugggacuucgguuccauaggaggcguuuuuacaucuauagggaagcuaguacaucagaucuuugggacggcauacggggugcuuuucucaggaguaagcuggaccaugaaaauaggcauugguguguuauuaacaugguuaggacuaaacucaagaagcacuagcuuaucuaugacaugcauugcaguuggcuugguaacucuauaucuugguguaaugguacaagcugauucagggugcguuauuaauuggaaaggucgugaauuaaaaugcgggaguggaauuuuuguuacaaacgagguucauacauggacagagcaguacaaauuucaagcggauucacccaaaagacuaucagcagcaauaggaaaagcgugggaggaagggguguguggcauuagaucagcaacacgacuagagaacauaauguggaaacaaauaaguaacgagcuaaaucacauucuuuuagaaaaugauaugaaauucacaguaguuguaggagaugugguaggcauccuagcucaggggaagaaaaugauccgcccacagccaauggaacauaaauauucuuggaaaucguggggaaaagcaaaaauaaucggagcagauguacaaaacacaacauuuauuauugauggcccgaauacaccugaauguccagacgaucagagagcguggaacauaugggaagucgaagauuauggcuuugguauauuuacuacaaacauauggcucaaaaugcgggauaguuauacacaaguaugugaucaccguuuaaugucggcggccauaaaggauucgaaagcuguacacgccgauaugggauauuggaucgagucagaaaagaacgagacuuggaaacuugcacgagcuucauuuauagaaguaaaaacguguauauggcccaagucgcacacucucuggucuaauggaguuuuagaaucggaaaugauaauaccgaaaauauaugggggcccaauaucacaacacaacuaccgaccgggauauuucacacagacugcugggccauggcaccuaggcaaguuagagcucgauuucgauuugugcgaaggcaccacaguggucguagaugaacauugugggaaccguggacccucucuacgaacaacgacgguaacugggaaaauaauucacgaauggugcugccgaucuuguacauuaccuccucuuagauucaaaggugaggauggguguugguauggaauggaaauaagaccgguaaaagagaaagaagaaaaccuaguaaaaaguauggugagugcaggaucaggagagguagauagcuuuuccuuggguuuguuaugcaucucuauaaugauagaagaagugaugaggucucguuggucuagaaaaaugcucaugacaggaacccucgcaguauuccucuuauuaauuauggggcaauuaacuuggaacgauuuaauaaggcugugcauuauggucggcgcuaacgcuucggacagaaugggaauggggacgacauaucuagcguuaauggcuacauuuaaaaugagaccuauguuugccguuggacuccuauucaggagguugacgagucgagaaguacuacuacuaacuauaggacuaaguuuagucgccaguguagagcuaccuaacucucuugaagaauugggagacggauuagcgaugggaauuaugauauuaaaacuucugacagacuuccaaucgcaccagcugugcgccacauuauuauccuuaacauuuauaaaaacaacauugagcuuacauuaugccuggaaaacaauggcuaugguucuuucaauaguuucucucauaccacuuugccuaaguacuacaucacagaaaacuacguggcugccaguacucuuagguucacucggauguaaaccccuaacaauguuuuuaauugccgaaaauaagauuuggggcagaaaaucauggcccuuaaaugaagggauaauggccguggguguaguaagcauccuacuaucuagcuuacugaaaaacgauguuccacuugcgggcccgcuaauugcuggagggaugcuuauagcauguuauguaauaagcgggaguagugccgaucugucucuagaaaaagcggcugaaguuagcugggaagaggaagcagagcacagcggggcgucccauaacauauuaguagaaguacaagaugauggaacaaugaaaauuaaggacgaagaaagagacgauacacuaacaauucuccucaaggccacuuuguuagcagucucgggaguuuacccccuaagcauuccugcaacccuguucgugugguauuuuuggcagaaaaagaaacaaagauccggcguuuuaugggacacaccaucgccaccugaaguugaacgggcagucuuagaugauggaauauauagaauaaugcaacgaggauuauuaggucguagccaaguagggguagggguauuccaggagaaugucuuccacacaauguggcaugugacgaggggugcugucuugauguaucaaggaaaaagauuggaaccaaguugggcgucggugaagaaagaccucauuucauauggcgguggguggcgccuccaaggcucuuggaacacaggagaagaaguucaaguaauugcuguagaaccuggcaaaaaucccaaaaauguccaaacagcgccagggacuuuuaaaaccccagagggugaaguaggugcaauagcguuggacuucaaaccagguacuuccggauccccuaucguaaacagagagggaaaaaucgucggauuauauggaaauggaguagugaccacaucggguacuuaugucucugcaauugcucaagcaaaagccucacaagaggguccguuaccggagauagaagacgagguuuuucgcaagagaaauuugacgauaauggaucuacauccugguucaggaaagacccgucguuacuugccagccauaguccgggaggcaauuaaaagaaagcuaaggacauugauauuggcacccacccgaguggucgcguccgagauggcagaagcacuaaaagggaugccaauccgcuaucaaacaacagccguaaaaucagagcauacugguaaagaaauaguggaucuaaugugucacgcuacauucacaaugcgucuacuuagcccaguaagagugcccaauuauaauaugauaauaauggacgaagcccauuuuacugacccaaguucaauugcugcuagaggguacauuaguaccagagucggaaugggagaagcagcagcaauauuuaugacagccacgccacccggauccguugaagcauuuccucaaaguaaugccguuauacaggaugaggaacgugauauacccgaaagauccuggaauaguggauaugaguggauuaccgauuuuccaggcaaaacagugugguucguucccuccauaaaaucagguaaugacaucgccaauugcuuaagaaagaacggaaaacgagugauucaguugucccgaaagaccuucgauaccgaauaucagaaaaccaaaaacaaugacugggacuacguaguaacgaccgacauuagugaaaugggggcaaacuuuagggcugaucguguuaucgacccaagaagaugucuaaaaccgguaauauuaaaggacggaccagaaagaguaauccucgccggacccaugccagugacgguagcgagugcagcucagagaagaggcagaauagguaggaaucauaauaaagaaggcgaucaauauaucuauaugggacaaccccucaauaacgaugaagaccaugcucauuggacagaagcaaaaaugcuucucgauaauauuaauacuccugaagggauaauuccagcguuauuugaacccgagcgagaaaaaucagcagcaauugauggagaauauagauuacggggagaagcuagaaaaaccuuugucgaacuuaugcgaaggggcgauuugccaguuugguuguccuauaaaguagcaagcgaagguuuucaauacagugacaggcgaugguguuuugauggugaaagaaacaaucaaguucuugaggaaaauauggauguugaaauauggacaaaagagggugaacguaaaaaguuaaggccaagaugguuggacgcacguacauacagcgacccacuagcucuaagggaauuuaaagaauuugcagcagguagacguaguguaucaggagaucuaauacuagaaauagguaaauugccacaacaucuuacucaacgggcucaaaacgcacucgauaaucugguaaugcuacacaauagugaacaaggaggacgugcauacagacaugcaauggaagaacucccugauaccauagagacuuuaaugcuucuagccuuaaucgccguucuaaccgggggaguaacgcucuuuuuccuaucggggcgcggucuugggaaaaccucuauuggauuacuaugcguaauggcaagcagcguucuucuauggauggcgucuguagaaccucauuggauagcagcaucaaucaucuuggaauuuuuccugaugguccuauuaauuccugaaccggauagacaacguacgccccaagacaaucaacuugcguacguaguaauaggccucuuauucaugauuuugacaguugcagcaaacgaaauggguuuacuugaaacuaccaagaaagacuuaggaauuggacacguugcaguagaaaaucaucaccacgccaccaugcuagauguagauuugcacccggcaucagcguggacccuauacgccguagccacaacgauaauaacuccaaugaugagacacacaauugaaaacaccacagccaacauuuccuugacagcaaucgcaaaucaagcagcuauauuaaugggccucgacaaggguuggccaauuucaaaaauggacaucggggucccuuugcuagcuuugggcuguuauagucaaguuaacccuuuaacguugacagcagcaguauuaaugcuuguugcgcauuaugcuaucauuggcccggguuuacaagccaaagccacacgagaagcucagaaaaggacagcugcaggaaucaugaaaaacccaacuguagauggcauuguagcuauagauuuggauccaguugucuacgacgcuaaguuugagaaacaacuugggcaaauuauguuacuaauccuaugcaccucucaaauauuacuaaugcguacaacaugggcuuuaugcgaaaguauaacgcucgcuacagguccauugaccacauuaugggaagguucuccugggaaauuuuggaauacaacaaucgcaguuagcauggcuaauauuuuucguggaaguuaucuagccggagcuggacucgccuucaguuuaaugaaaagucucggaggaggcaggagagguacaggagcucaaggugaaacuuugggugaaaaguggaaacgucaacuaaaccaauugucaaaauccgaguucaauauauacaaacgaagcggcauaauggaaguagacagaagugaagcaaaggagggauuaaagcgcggcgagaccacacgacaugccgugucacgcgguacugcuaaguugcguugguucguugaaagaaaucuagucaaaccugaaggaaagguuauugaucuagggugugggcgggguggcuggucuuacuauugugcaggauuaaagaaggugacggaaguaaaaggauauacaaaggguggacccggucaugaagaaccaauaccaauggcaacauacgguuggaaccucgugaaacuucauucaggaaaagauguauuuuucacaccaccagaaaaaugugacacacuuuuaugugacaucggagaaagcaguccaaaucccacaauagaagaaggacgaacacucaggguuuuaaaaaugguugaaccuuggcuaagaggcaaccaauuuugcauaaaaauucucaacccuuauaugccauccguuguugaaaccuuagaacaaaugcagagaaaacacggcggaaugcugguacguaacccauuaagccgcaauaguacucacgaaauguauuggguaagcuguggcacggggaauauaguauccgccgugaauaugaccaguaggaugcuccucaauagauucacuauggcacauaggaaaccaacuuacgaaaaggauguugauuuaggugcuggaacucgucauguagcaguugaaccagaaguagcaaacuuagacauaauugggcagcgaaucgaaaauauaaaacaugaacauaaaaguacauggcacuaugaugaggacaaccccuauaaaacaugggccuaucaugggucuuacgaagugaaaccgucuggaagugcaucaucuauggucaacggaguugugaaauuacuaacuaagccuugggaugugaucccaauggucacgcaaaucgccaugacugacacuacaccauuugggcaacagaggguauucaaagaaaaaguugacacacguacaccgaaagcuaaacgcggaacuguacaaauaauggaaguaacagcacgaugguuauggggguucuugucacgaaauaagaaacccagaauaugcacucgcgaagaauuuacucgaaaagugagaagcaacgcagcaauaggggcuguuuuugucgacgaaaaucaauggaacagugccaaagaagcaguagaagaugagcguuuuugggaccuugucaagaaagaaagagaguuacauaagcaaggcaaaugcgcuaccuguguuuacaauaugauggguaaacgagagaaaaaguuaggcgaguucggaaaggcaaaaggaucuagagccauuugguauauguggcuaggagcaagauucuuagaauuugaagcucugggcuuuaugaaugaagaucauugguuuagcagagaaaacucguuauccggaguggaaggcgaaggucuucauaagcuaggauacauuuugcgugauauaaguaaaauuccgggaggaaauauguaugccgacgacacugcaggaugggacacuagaauaacugaagaugaccuacaaaaugaagcaaagauaacugauauuauggaaccagagcacgcgcuguuggcuacuuccauuuucaaauuaacuuaccaaaacaaagugguaaggguccaaagaccugcaaagaaugguacaguuauggacguaaucagucgaagggaccaaagaggcucuggacaaguaggaacuuacgguuugaacacauucacgaacauggaggcucaacugauuagacaaauggaaagugaagguaucuuucugccgucggaacuagagacuccuaaccuagcagaacggguucuagauuggcucgaaaaauacgguguagaacgacuaaagcguauggcaauuaguggugaugauuguguuguuaaaccaauugacgaccguuuugcaacugcucuuacggccuugaaugauauggguaagguccguaaagacauaccucaaugggaaccaucuaaaggauggaacgauuggcaacaaguacccuuuuguucgcaucacuuccaucaacuaaucaugaaagauggucgcgaaauaguaguaccuugcagaaaucaagacgaacucguugggagggcgcgcguuucucagggugcagguuggagucuucgagaaacagcuugcuuagggaagucauacgcucaaauguggcagcuuauguacuuccacagacgggauuuacgauuagccgccaaugccauaugcucggccguaccagucgauugggucccuacaucgcgaacuacaugguccauucaugcgcaccaucaauggaugacaacagaggacauguuaagcguguggaauagagucuggaucgaagagaacccuuggauggaagauaaaacccauguaucgucauggggagacguaccauaucuuggaaaacgagaagaucaauggugcgguucuuuaauuggacuaacugcgagggccacaugggccagcaauauucaaguagcgauaaaccaaguuaggcgucuaauagguaaugaaaacuauuuagacuauaugacaucuaugaaacgauucaagaacgaaggagacccagagggggcgcuuugguag

SEQ ID NO: 21841 - RNA, 9879 nt, Artificial Sequence
  derived and/or modified CDS sequence (opt6) from DENV-1__GU131767__SS-prME
ucaguaacuaugcuuuuaaugcuuaugccaacagcguuagcauuucauuugacuacuagagguggagaaccacacaugauuguaaguaaacaagaaagggguaaaucacuccuguucaaaacaaguguuggaguaaauaugugcacuuuaaucgcuauggauuuaggagaauuuugugaagauacuaugacguauaaauguccacgaauaacugaagcagagccggaugacguugacugcugguguaaugcuacugacaccuggguaacguacggaacuugcagccaaacuggagaacauaggcgggacaaaagaucggucgcauuagcaccacauguaggacuagguuuagagacgagaacugaaacuuggaugagcucagaaggagcuuggaaacaaauacaaagaguugaaacgugggcauuaaggcacccuggcuuuacuguaauagcccucuuucuagcacaugcuauaggaacaucaauuacacaaaaagggauuaucuuuauacuucuaaugcuaguaaccccuucuauggcgaugagauguguaggcaucggauccagggauuuuguagaaggauugucaggagcgacuuggguggauguaguacuugaacauggaaguugcguaacaacuauggcaaaagacaaaccuacacuagauaucgaacuucuaaaaacugaaguuacaaauccagcaguguuaaggaaacucuguauagaagcuaaaauauccaacacgacuaccgauaguagauguccuacacaaggagaagcuacucuuguagaagaacaggaugcuaauuucguaugcagaagaacauuuguggaccgugguugggguaauggcugcggacuuuucgguaaagguagccucauaacuugugcaaaauucaaaugcguaacuaaacuagaagguaaaauaguacaauacgaaaaccugaaauauucagucaucguaacaguucacacaggagaucaacaccaaguaggaaaugaaucaacagaacauggaacaaccgcaaccauaacaccacaggcucccucaacugaaauucaauuaacagacuacggggcacuaacccuugacugcucuccuagaaccggccuagacuucaacgaaaugguacuuuuaacuaugaaagaaaagucuugguuaguacauaagcagugguuuuuagauuugccacugccauggacaaguggugcuuccacuucccaagagacauggaauagacaagaccuauugguaacauucaagacggcccaugccaagaaacaggagguagucguacugggcagucaggagggugccaugcacaccgcuuuaacaggagcaacggaaauucaaacaagugggaccacuacaauuuucgcagggcaccuuaaaugucgauuaaaaauggacaaacuuacccuuaagggcaugucuuauguaauguguaccgggucauuuaagcuagaaaaagaaguagcggagacacagcacggaaccgugcuaguacaaaucaaguaugagggcacugaugcgccauguaagaucccauucucaacacaagaugaaaaaggagucacacaaaauggaagacuaauuacagcgaacccgauaguaacagauaaagaaaaacccguaaauaucgaagcugagccaccauucggagagaguuacauaguuaucggagcgggagagaaagcguuaaagcugaguugguucaagaaaggaagcuccauagguaaaauguuugaggcaacugcuagaggugcacggcgcauggccauacuuggugacaccgcaugggacuucggaaguaucggaggaguuuucacaaguguuggcaaacuuguccaucaaauauucggcaccgcguauggugugcuauuuucagguguaaguuggacgaugaagauuggcauuggaguccuauuaacaugguugggauuaaauaguaggagcacgagcuuaaguaugaccugcauugcaguuggucuuguaaccuuauaucucggugugaugguaagggcagauuccggcuguguaauaaacuggaaagggcgagagcuaaagugcggcucaggcauuuuugugacaaaugaaguacacacuuggacggaacaguacaaauuucaggcagauagucccaaaagacuuagugccgccauuggaaaagccugggaagaaggcguaugugguauccgaucugcaacaagacuagaaaacauaauguggaagcaaauauccaaugaguuaaaucauauucuucuugaaaaugauaugaaacuuacggucgucguaggcgacguggcaggcauuuuagcucagggaaagaagaugaucagaccacaaccaauggaauacaaauauaguuggaaaagcuggggaaaagcuaaaauaauuggggcugaugugcaaaacacaacauucaucauagaugguccaaauacaccggaauguccugacgaucaaagagccuggaauauaugggaaguugaagacuauggcuucggcaucuuuacuacaaauaucuggcucaaauuaagagauucauauacgcagguaugugaccacagacuaaugucagcagcgauuaaagacucuaaagcaguccacgcagacauggguuacuggauagaaucagagaaaaaugaaaccuggaaacuugcgcgggccaguuuuauagaagucaaaacauguauauggccuaagucgcauacccuauggucaaacggggugcucgaaagugaaaugaucaucccuaagauauauggagggccaaucagucaacauaauuaccggccaggauacuuuacccaaacagcuggaccuuggcacuugggcaaacucgaguuggauuuugaccuaugugaaggaacaacgguaguaguggacgagcauuguggaaauagggggcccaguuuaagaacuaccacuguaacaggaaagaucauucacgaauggugcugccgcucguguacauugccuccacuaagauuuaaaggagaggauggcuguugguacggcauggagauaaggccggugaaagaaaaagaagaaaauuuaguuaaauccauggugagcgccggaucaggugaaguagauucuuucucccuaggauuauuaugcauaucaauaaugaucgaagaaguaaugagaucaagguggucacgcaaaaugcuuaugaccggaacucuggcugucuuuuuccuauugauaaugggccagcuaacuuggaaugaucuuaucagacuuuguauaauggucggcgcuaacgcuagugacagaaugggcauggguacgaccuauuuagcucugauggcaacuuuuaaaaugcguccgauguucgcuguugggcuucuguuucgaaggcuaacaaguagagaaguacuacuacucaccauugggcuuucucuaguagcaucuguagaauuaccaaauagccuugaagaauugggugacggucuagccaugggaauuaugauccugaaacuacugacugacuuccaaagucaucaguuaugggcaacguuauuaagccuaacguucauacgaacgaccuuuucgcuacacuacgccuggaagaccauggcuaugguuuuaucaaucgucagucuuuuuccacuaugucuguccacaacuucucagaaaacaacaugguuaccuguguuacuuggcagcuuggguugcaaaccauugacaauguuucuaauagcagagaacaagauaugggggaggaaauccuggccgcuaaaugaagguauaauggcgguaggcauagucucaauacuccuaucaagucuccuuaaaaaugacguuccacuagcaggaccgcuaauugcaggggguaugcucauagcuuguuacguuauaucuggcagcucggcugaucuaucauuggaaaaagccgcagugguaucaugggaagaagaggcagaacacucaggagcaucacacaacauacuuguggaaguucaagacgaugguacgaugaaaauaaaagacgaggaaagagaugauacauuaacaauauuauugaaagcaacuuuauuagcuguuucagggguauauccauugucuauaccugcuacauuauuuguuugguacuuuuggcagaagaagaaacagagaagcgguguauugugggauacaccuucaccaccagaaguugaaagagcgguuuuggacgacgguauauaucgaauaaugcaacggggacuacuugguagaucacaaguugggguuggugucuuucaagaaaauguauuucauacgauguggcacguaacacgaggggcaguucuaauguaccaaggcaaacgauuggaaccgaguugggcaucugucaagaaagaccucaucuccuacgggggaggcuggaggcuccaagggaguuggaauacuggagaggagguacaggucauagcgguugaaccagguaaaaacccuaaaaauguacaaacugcucccggaacauuuaaaacuucagagggugaagucggugcaauagcucucgauuuuaaaccggggacuagcggcaguccaaucguaaauagagaagguaaaauaguaggauuauauggaaauggaguaguaacaacgagcggaacauauguaagugcaauagcgcaagcgaaggcuagucaggaaggaccgcucccagaaauugaagaugaaguuuucagaaaaagaaacuuaacuauaauggaccuacauccugguucggguaaaacuaggagauauuugccugcgauagucagagaggcgauuaaaaggaaacuuagaacgcucauacuagcaccaacacgcguaguagcgagugaaauggcugaggcacugaagggcaugcccauacguuaucagacgacggcaguuaaauccgaacauaccgguaaagagauaguggaucuaaugugucaugcgacauuuacgaugagacuccuuagucccguacgaguuccuaauuacaauaugauuauuauggacgaagcucacuuuacagauccuagcucaauagccgcaagaggguauauuuccacaagagugggcaugggugaagcagcugcuaucuuuaugacugcgacgccuccugguaguguagaagccuuuccacaaagcaaugcggucauacaagacgaagaaagagacauaccagaacgaaguuggaauaguggcuacgaauggauuacagacuucccgggcaaaacgguuugguucguucccagcauaaagaguggaaacgauauagcuaacugcuuaagaaagaauggcaaaagaguaauccaacucagccgcaagacauuugauacagaauaccagaaaaccaaaaauaaugacugggacuauguagucacgaccgauauuucugagaugggugcuaacuucagggcugaucgugucauagauccacguagaugcuuaaagccuguuauucuaaaagacggcccggaaagaguaauucuggcaggaccaaugccuguaaccguugcaucugcagcucaacggagaggcaggauuggucggaaucacaacaaagagggagaccaauauauauauaugggccaaccucuuaauaaugacgaagaccaugcacauuggacagaagccaaaaugcuacuagacaauauuaauacacccgaaggaauaauaccagcucuuuucgaaccagaaagggagaaaucggcugcaauugauggcgaguacagacuuagaggagaagcaagaaaaacuuucguugaauugaugagacgaggagaccucccugugugguuaagcuacaaaguagcaucggaagguuuucaauacuccgauaggagaugguguuuugauggagaacgaaacaaucaaguuuuagaagagaacauggacguagagauauggaccaaagaaggcgaaaggaagaaauugagacccagauggcuggaugcucguacguauucagacccuuuagcccuccgagaauuuaaagaguucgcagcuggucgucguaguguaucgggagaccuuauauuagaaauaggaaaacuaccacaacaccuaacacaacgugcgcaaaaugcccuugauaaucuaguaaugcuacacaauagugaacaaggaggccgagcuuaccgacacgccauggaagaauugccagauacuauagagacguuaaugcuacuggcucucauagcggucuuaacagggggugucacacucuucuuucucucugggagaggacuaggcaagacuucgauaggacuacuauguguuauggcgucuucgguucugcuuuggauggcaucuguagaaccccacuggaucgcagccaguauaauauuagaguuuuuccuaauggugcuacuaauaccugaaccggauagacaacgaaccccgcaagacaaucaacuagccuacguaguaaucggacuauuguucaugauccuaacagucgccgcuaacgagauggggcuuuuagaaacaacaaagaaagaucucggcaucggccauguggccguagagaaucaucaccaugcagcaaugcuugacguggaucuucaucccgcgagugcuuggacauuauacgcagucgcuacaacuauaaucacccccaugaugagacauacuauagaaaauacgacagcgaauauaucgcuuacagcaauagcuaaccaggcugcaauacuaaugggguuggauaaaggauggccaauuucuaagauggauaucggaguaccacuacuagcacuaggguguuauucccaagugaauccucuuacauugacagcugcaguauuaaugcugguugcccacuaugccauuauaggaccuggacugcaagcgaaggcaacaagggaagcccagaaacgcacagcagcaggaauaaugaagaauccuacaguggaugguauaguugcaaucgaccuagauccaguaguguaugacgcaaaauuugagaaacaauuaggacaaaucaugcuacuaauacuaugcacaagucaaauacucuugaugcguacgacuugggcauuaugcgaauccauuacgcuagccacagggccgcuaacaacauugugggaagguucaccaggcaaauuuuggaauacuacaauugcgguaaguauggcuaauauuuucaggggaucuuaucuggcuggagcaggacuggcuuuuaguuuaaugaaaaguuuagguggcggcagaagggguaccggugcucagggggaaacucugggcgaaaaauggaagaggcaacugaaccaauugucaaagagcgaguuuaacaccuauaaaagaaguggaaucauggaaguugacagaucagaagcaaaggaaggauuaaaaagaggggaaaccacuaaacaugccguuagucgcggcacagcuaaguuacggugguuuguugaaaggaacuuggugaaaccagaggguaaaguuauagauuuaggauguggaagggguggguggucuuacuauugugcaggccugaagaaaguaacugaaguaaaagguuauacgaagggagggcccggacaugaagaacccauucccauggcaacauauggauggaacuugguuaagcuacauucaggaaaggauguauucuucaucccaccagaaaagugugacacauuauuaugcgauauuggagaaucaagucccaauccgacaaucgaagagggucgcacuuuacggguacucaaaaugguagaaccaugguuaagagguaaucaauucuguauaaaaauccuuaacccauauaugccaagcgugguggaaacgcucgagcagaugcaacguaaacacggagguauguugguucguaauccauuaucacgaaacaguacacaugaaauguacugggugucuugcggaacugggaauauagucuccgccgugaauaugacaucuaggaugcuuuuaaaccgauuuacaauggcucaccggaagccuacauacgaacgugauguagauuuaggugcagguacacgacauguagcaguugaaccagaaguagccaaucuagauauuauuggucaaaggauagaaaauauaaaacaugaacauaaaagcacuuggcauuaugacgaagauaacccauauaaaacuugggcauaccacggaaguuaugagguaaaacccucugggagcgcuucuucaaugguuaauggaguagucaaacuuuugacuaagccaugggacguaauuccuaugguuacacaaauagcaaugacagauacaacaccguuuggacaacaacguguguucaaagagaaaguagauacuaggacacccaaggcuaagcgaggcaccgcgcaaauaauggaagucacagcaaaaugguuguggggguuccuuucgaggaacaagaaaccuagaauuuguacacgugaagaguuuacaagaaaggucagaagcaacgccgcaauaggggcgguuuuuguagaugaaaaccaauggaacucagcaaaagaagcaguugaagacgaacgguucugggaccuaguacauagggaaagagaacugcauaaacagggaaaaugugcgacaugcguuuacaauaugauggggaagcgagagaagaaauuaggugaauuugggaaggcaaaaggcucaagagcaaucugguacaugugguuaggggcgcgcuuccuagaguucgaggcauuggguuucaugaacgaggaccauugguucucgcgugaaaauucauugagcgggguagaaggggaagguuuacacaaacucggcuacauacuuagagauaucuccaagaucccaggugggaacauguaugcagacgauacagcugguugggauacacgaauaaccgaagaugauuuacaaaacgaggcgaaaaucacagacauuauggaaccugaacaugcuuugcuggcaaaauccauuuucaaacuaaccuaucaaaacaaagugguaaggguucaacgcccggccaaaaaugggacaguaauggauguuaucucuagacgagaccaacgaggcucgggucaagugggcacauauggcuuaaacacauuuaccaacauggaagcacaacuaauucgacagauggaauccgaaggaaucuucaguccgagcgagcuagaaacgccuaaucuagcaggucgagucuuagacuggcuggaaaaacauggaguggaaagacuaaaacgaauggcaaucucuggggacgauuguguuguaaagccaauagaugacagguuugcaacagcuuugacugcacuaaacgacaugggaaaaguaagaaaagauauaccccaaugggaaccaucuaaaggguggaaugauuggcagcaagucccauucuguucgcaucacuuucaucaacuaaucaugaaagaugggcgugaaauuguaguuccuugcagaaaucaagacgaacugguuggacgcgcacgcgucagucaaggugcgggauggagucuccgugaaacugccugucucgguaagucguaugcacaaauguggcaacuuauguauuuucaccgaagagauuuacguuuggccgcgaaugcaauaugcagugcaguaccuguugacuggguaccaacaagccguacaacauggagcauacacgcacaucaccaauggaugacaacggaggacauguuauccguuuggaaccgcguauggauagaggaaaacccuuggauggaagauaaaacucauauuuccaguuggggugacgucccguauuuaggaaaacgugaagaucaguggugcggaucucuaauuggcuuaacagcacgggcaacaugggcaacgaacauccaggucgcaaucaaucaaguacggcgucuccuugguaacgaaaauuaucucgauuacaugaccucuaugaaacguuuuaaaaacgaaucggauccagagggagcacuaugguag

SEQ ID NO: 21842 - RNA, 9879 nt, Artificial Sequence
  derived and/or modified CDS sequence (opt6) from DENV-1__HM181967__SS-prME
agcguuacaaugcucuuaaugcucaugccuacugcucuugcuuuucaucugaccaccagagguggagaaccccacaugauaguaucgaaacaagaacgaggaaaaucauuacuuuuuaaaaccagugcugguguaaauaugugcacauugauagcuauggaucuaggugaacucugugaagauacuaugacuuacaaaugcccgagaauaacagaaacagaaccggaugauguagacugcugguguaacgccacugauaccuggguaacuuauggaaccugcucgcaaacaggagaacauagaagagacaaacggagcguggcccuugcuccacacgucggucucggccuagaaacuagaacagaaaccuggaugucaucagaaggagccuggaaacaaauacaaaggguugaaaccugggcccuuaggcaucccggcuucacggugauagcauuauuuuuagcucacgcaauaggcacuucuauaacucaaaaaggcauaaucuuuauucuacuaaugcuagucacaccaucaauggcaaugcguuguguagguauaggaagccgugacuucgucgaaggcuugucgggagccacauggguggacguaguauuagaacauggcuccugugucacaacuauggcuaaagacaaaccaacauuagacaucgaauuacuaaaaacugaaguaacuaauccugcaguacuuagaaaacuaugcauagaagccaaaauaucaaauacaaccacugauagucgcugcccuacacagggugaagcaacacucguagaagaacaagaugcaaacuuugucugcagaagaacuuuuguagacagaggaugggguaacggauguggucuuuuuggcaaaggaaguuuaauaacgugcgcaaaauuuaaauguguaacaaaauuagaagguaaaauaguucaauaugaaaaccucaaauauuccgucauaguuacaguacauacaggugaucaacaccagguaggcaacgaaagcacggaacauggcacaaccgcuacuaucacaccacaagccccaacgacugaaauucaauuaacagauuacggcgcucugacauuagacuguucuccucguacgggacuggauuuuaacgaaaugguacugcuaacaaugaaagaaaaauccuggcuaguucauaaacaaugguuucuagaucuacccuugccauggacaagcggugcuucaacuagccaggaaacuuggaaucgacaagacuuauuaguaacauucaaaacagcacaugcaaagaagcaggaaguaguaguacuugguagucaagaaggugcuaugcacacagcacuaacaggagcuaccgaaauacaaaccagcgguacuacuacgauauuugcaggacaccuaaagugccgguuaaaaauggauaaacuaacacuuaaaggcaugucuuaugucaugugcacaggcuccuucaaguuggaaaaggaaguagcugagacccagcacggcacaguccuaguucaaauuaaguaugaaggcacagacgccccuugcaaaauaccauuuaguacucaagaugagaaggguguaacacagaacggaagauuaauuacggcuaauccaauuguaaccgacaaagaaaagccgguuaacaucgaggcagaaccgccauucggagaaucuuauauaguaauaggugcgggagaaaaagccuuaaaauuauccugguuuaagaaaggaucauccauagguaagauguuugaagcaacagcucgcggugcgaggagaauggcaauacuuggagauacagcuugggauuuugguucuauuggugggguguuuacgagcguagggaagcucgugcaucaaauauucggaacagcauauggaguuuuauucucgggcgugaguuggacuaugaaaaucggaauagggguccuuuuaaccuggcuaggacuuaacagccgaucaacuagccuauccaugacaugcauagcaguggggcuagucacacuuuaucuaggaguuauggugcaagcagauaguggauguguuauaaacuggaagggccgugaacucaaauguggcagcgguauauucguuacaaaugaaguccauacuuggacagaacaauauaaauuccaagcagacaguccuaaacgacuuucggcggcgauuggaaaagcaugggaagaaggaguaugcgggauuagaagugcuacgagauuagaaaacauaauguggaaacaaaucucaaaugaauugaaucacauacuauuggagaacgacaugaaauuuacaguaguuguaggugacguugcgggcauauuggcacaggguaagaaaaugauccgcccacagccuauggaauacaaauacaguuggaaaucuuggggaaaggcuaagauuaucggugcugauguccaaaauaccacuuuuaucauagacgguccuaauacgccagaguguccagacgaucaacgagcauggaauauaugggaaguagaagauuacggauucgguauuuucacgacaaauauaugguugaaauugagagauucguauacucaagucugugaucaucgccuuaugucggcagcgaucaaagauucaaaagccguacacgcugauaugggauauuggaucgaaucggagaaaaacgaaaccuggaaauuagcaagagcuucguuuauagagguaaagacaugcauuuggccuaagucacacacgcucuggagcaacggcguacuggaaagugaaaugauaauacccaaaauauacggaggacccauuagccaacauaauuaucgcccugguuauuuuacacaagcagcagggccauggcacuugggcaaauuagaguuagauuuugaucuaugugagggaacgaccguagugguugacgaacacugcggcaaccgaggaccuucuuuacgaacgacuacaguuaccggaaagaucauacacgagugguguugcaggaguugcacauuaccuccucuacgguuucgaggagaagauggauguugguaugggauggaaauuagaccagucaaagaaaaggaagaaaaucucgugaaaaguaugguaucugcggguaguggagaaguugauagcuuuucacuaggauugcuuuguauuaguauaaugauagaggaagugaugagaucgagauggucaaggaggaugcuaaugacgggcacacuagcaguauucuuccucuuaauaaugggccaauugacguggaacgaccuaaucagacuguguaucauggugggagccaacgcuagugaucguaugggcaugggcacgaccuaucuugcccuaauggcgacuuuuaagaugagaccgauguuugcaguuggccugcuuuuccgacggcugacgucacgagaaguauuauugcuaacaauagguuugucguugguagccaguguagaauuacccaauucacuagaagaacugggcgacggacuagcaauggguauaaugaucuugaaacuacuuacugauuuucaaucgcaccaacuaugggcuacacuucucucauuaacuuuuauuaaaacuacauuuagcuugcauuacgcauggaagaccauggccaugguuuuaucaauugucucuuuguuuccauuguguuugucaacaacuagccagaaaacgaccuggcugccaguauuauuaggaaguuuaggauguaaaccacugacaauguuuuuaauagcagagaacaagauuuggggacgacgaucauggcccuuaaaugaaggaauuauggcgguaggaauagugaguauauuacuaagcucauugcuaaagaaugauguaccuuuagcugggccucuaaucgccggugguauguuaauugcauguuaugucauuucaggaucgagugcagaccuaucacuagaaaaagcggcggagguaucuugggaagaagaagccgaacauuccggagccagucauaauauacugguggagguccaggacgacggcacaaugaagauaaaggacgaagagagagacgacacacuaacgauauuacucaaagcuacacucuuagcagucucaggaguauacccccucucaauaccagcaacgcuuuucguaugguacuuuuggcagaagaagaaacagagaucugggguguugugggacaccccaucaccaccggagguugaacgugccguauuagacgacggaauuuauagaaucaugcaacgagggcugcucggaagaagccaagucgguguagguguauuucaagaaaacguauuccauacaauguggcacgugacacgcggagcgguguuaauguaccaggguaagcgccuagagccgucuugggcgucagucaagaaagauuuaauaucauacgguggagguuggagacuacaggggagcuggaacacgggugaagagguucaaguuauugcagucgaaccaggaaagaauccaaagaauguucaaaccgcuccggggacauuuaaaacaccagaaggugagguaggagcaauagcauuagacuucaaaccagguacgagcggaucaccaaucguuaauagagaagggaagaucguggguuuauacggcaauggaguuguaacgacuucuggaaccuauguaagcgcaaucgcccaggcaaaagcaagucaggaaggaccacugccggagaucgaagacgaaguauuucgaaaaaggaaucuuacgauaauggaucuacacccuggaucuggaaaaacaagaagguaccuaccggcaauuguacgggaggcuauaaaaaggaaauuaagaacauuaauauuggcgccaaccaggguuguugcaagcgaaauggcagaagcucuaaaggguaugccuauacgauaccaaaccacagcaguaaaaagugagcauacggguaaagaaaucguagaucuaaugugccaugcaacuuuuaccaugagacuguugucucccgucagaguaccaaauuauaauaugauaaucauggacgaggcucauuuuacagacccuucuucuauugccgcaaggggguauaucucaacccgcgucgguaugggagaggccgcggcuauuuuuaugacagcgacuccgccaggaagcguugaagcauucccacaaucaaacgccgugauacaggacgaggaaagagauauccccgaaagaucguggaacucaggauaugaauggauuaccgauuuuccagguaaaacuguaugguuuguaccuucaauaaaauccgggaacgacauagcuaacugcuugcgcaaaaaugggaaaagagucauccaacuaaguaggaaaacauucgauacagaauaucagaaaacgaaaaauaacgauugggauuauguuguaacgacggauauaucagaaaugggugcuaacuucagggcagauagaguaauagacccuaggaggugccucaaaccuguuaucuuaaaagauggcccggagagagucauauuagcuggcccgaugccugucaccguggcuucagcagcucaaagaaggggacgcauuggaagaaaucauaauaaagaaggugaccaauauauauauauggggcagccguuaaauaaugacgaagaucaugcccauuggacugaggcaaaaaugcuacucgacaacauuaauacaccugaaggcauuaucccagccuuguuugaaccagaacgagagaaaagugccgcaauagacggagaguacagauuacguggagaagcacgaaaaacauuuguagaauuaaugagacgaggcgauuuaccagucuggcugagcuauaagguggcuucggagggcuuccaauauucugauagaagaugguguuucgacggcgaacguaacaaccagguucuggaagaaaauauggacguggaaauuuggacuaaagagggagaaaggaagaaacuaagacccaggugguuagaugcgagaacauacucagauccguuagcauuacgagaauuuaaggaauuugcagcaggcaggcgaucgguuagcggugauuuaaucuuggaaauuggaaagcuaccccaacaccugacccaaagagcgcagaaugcccuugauaaccuuguaaugcuucauaacuccgaacaaggcgggcgagcauauagacacgcaauggaagaacuacccgauacgauagaaacacucauguuauuggcacuaauugcuguccugacuggaggagugacacuauucuuuuuaucagguagagggcugggaaaaacauccauaggacuacuauguguuauggccucgucuguacuauuauggauggcaucgguagaaccacauuggaucgccgcaucuauaauuuuagaguucuuuuuaaugguuuuacuuauaccagaaccugauaggcagcgaacaccucaagauaaccaacucgcguauguagucaucggcuuauuauuuaugauacuaacuguagcggcuaaugaaauggggcuuuuagaaacuacaaagaaagaucugggaauuggucauauggcagucgaaaaucaucaucacgcagcgaugcuagacguugauuugcacccagcaagcgcuuggacacuauacgcugucgcuacuacuauaauaacaccaaugaugagacauacaaucgaaaauacgacagcaaauauuaguuuaaccgcuauugcgaaucaggcugcaauauuaaugggacuagauaaaggauggccaauaucaaaaauggacauuggugugccauuacucgcauugggauguuauucccaaguuaauccuuuaacucuaacggcagcuguauugaugcuuguugcucacuacgcuauaaucgguccuggucuccaagcaaaagcaacucgcgaagcccaaaaacgcacagcagcaggaauaaugaaaaaucccaccgucgacggaauuguggcaauagaucuugauccuguuguuuacgacgcuaaguuugagaaacaguuaggacagauaaugcuacucauacuauguaccagucagauuuuacuaaugaggacuacaugggcauugugugaaaguauuacccucgccacaggcccauuaacuaccuuaugggaggguaguccagggaaguuuuggaacaccaccauagcgguaucaauggcaaauauuuuuagagguaguuauuuagcuggugcaggauuggcauuuucucucaugaaaucacuaggaggaggacggagaggaacuggagcccagggagaaaccuuaggugaaaaauggaaacgacaacuuaaccagcugucaaaauccgaauuuaauacuuacaaacgaagcggcauaauggaagucgaucguagugaagcaaaggagggauuaaaaaggggcgagacuacuaaacaugccguuagucgagggaccgcaaaauuaaggugguuuguagaaagaaauuuaguaaaacccgaaggcaaagugauugauuuagguugcggacgugguggauggucuuauuacugugcggggcucaagaaaguuacugagguaaaaggguacacgaaggguggaccuggccacgaggaacccauaccaauggcuacauacgguuggaaccuuguaaaacuccacaguggaaaagacguguucuuuauuccgccggagaagugcgauacguugcuaugugauauaggggagucuaguccgaacccuaccauagaagaagguagaacguuacgaguucucaaaaugguagaaccaugguugcgaggaaaucaauuuuguaucaagauacucaacccauauaugccaucuguaguugaaaccuuggaacagaugcaaagaaaacacgggggaaugcugguaagaaacccauuaaguagaaauagcacacaugaaauguacuggguaucauguggaacgggaaacauaguaucagcuguaaauaugacaagcagaaugcuucuuaaucguuuuaccauggcgcaucggaagccaacauaugaaagggacguugacuuaggugccggaacacgucacguagcaguggaaccggaaguugcuaaucuggauauaaucggccagcgaauagaaaauauaaaacacgaacauaaaucaacuuggcauuaugacgaagauaauccguauaaaacuugggcauaccacggaucguacgaaguuaaaccaaguggaagcgcuuccagcauggugaacggaguugucaaauuguuaacaaagccgugggaugucauacccaugguaacacaaauugcgaugacggacacaacaccuuuuggacagcagaggguauuuaaggagaaagucgauacacggacaccuaaggccaaacguggcacggcacagauaauggaagucacggcgaaaugguuauggggauuuuugucacgaaauaagaaacccagaauauguacuagggaagaguucacuagaaaggucaggucaaaugcggcuauaggugcaguuuucguagaugagaaucaauggaauagcgcaaaagaagcuguggaggacgaacgauucugggacuuagugcaucgggaacgugaacuccauaaacaaggaaaaugcgcaacauguguguacaacaugaugggaaaaagagaaaagaaauuaggagaauuugguaaagcaaaaggaagccgagcaaucugguacaugugguuaggcgccagguuucuggaauuugaagccuuagguuucaugaaugaagaccauugguucucccgcgaaaauaguuuaagcggaguugaaggagaaggguugcauaaacuaggauacauucuacgugauaucaguaaaauucccgguggcaacauguaugccgaugauacggcuggaugggauacaagaauaacagaagaugacuuacaaaaugaggcgcguauaaccgauaucauggaaccggaacaugcacuacuagcaaagagcauuuucaaacuaacguaccaaaauaaaguugugcguguccaacgucccgccaagaacggcaccgucauggauguaauaucgaggcgcgaucaaaggggaucuggccaagucggaacguaugggcucaauacauucacaaauauggaagcgcagcucauuagacaaauggagagcgaaggcaucuucucaccuucagaauuagaaacacccaacuuggcagagcguguauuggacuggcuagagaaauacgguguagaaagguuaaagagaauggcaauaucaggagaugauugcgugguaaaaccaauagaugacagguucgcaacagcucugaccgcgcuaaaugacaugggcaagguaaggaaagauauaccucagugggagcccagcaaagguuggaaugauuggcagcaaguaccguuuuguucccaucacuuucaucaauugauaaugaaggacggacgugaaauagugguccccuguaggaaucaagaugaacucgucggacgugcgaggguaucucaaggugcaggauggucauugcgagaaacugcaugccuaggaaaaucauaugcacaaauguggcaacuaauguauuuucauaggcgugaccuacgauuagcugcaaacgcuauuugcucagcaguuccaguugauuggauaccuaccagccgcacuacgugguccauccacgcgcaucaucaauggaugacuacagaagauaugcuauccguguggaaucgagucuggauagaggaaaauccauggauggaagauaaaacucauauaucguccuggggugacguaccauauuuaggcaaaagagaagaccaguggugugguaguuuaauagggcucacagcaagagcaaccugggcaacgaauauucaaguagcaauaaaccaaguaagaagacugauugggaacgagaauuauuuagacuauaugacaucuaugaaaagguuuaagaaugaaagugauccagagggagccuuaugguaa

SEQ ID NO: 21843 - RNA, 9879 nt, Artificial Sequence
  derived and/or modified CDS sequence (opt6) from DENV-1__GU131768__SS-prME
aguguaacgaugcuacucauguuaaugcccacggcucuggcguuccaucuuacaacucgggguggagaaccucacaugauaguuacaaaacaagaaaggggaaaaagccuucuauucaaaaccucagccggaguuaauauguguacuuugauagcaauggaucugggagaauugugugaagacacaaugacuuacaaaugcccgcgaauuacagaagcugaaccggaugauguggacugcuggugcaaugcgaccgacacaugggugacguaugguacuuguucccaaacgggugaacaccgaagggauaaacgaucgguagcauuagcuccacauguuggucugggacucgaaacgagaacggaaacauggaugagcagcgaaggugcauggaaacaaauacaaaggguagaaacgugggcguugcgacaucccggauuuacaguaauagcacuauuucuagcucacgcgauugguaccaguauuacacaaaaaggaauuauuuuuauuuuacuuauguuaguaacaccuaguauggcgaugaggugcguagggaucgggagcagagacuucguagaaggauuaaguggagcgacauggguagacguaguacuugaacacgggagcugcguuacgacgauggcaaaagauaaaccuacucuugauauugaacuacuaaaaacagaaguaacuaaucccgcaguauuaagaaaauuaugcauugaagcaaaaaucucgaacacgacaacagacuccaggugcccuacacaaggggaagcaacauugauggaagaacaggaugcuaauuuugugugucgaagaaccuuugucgaucgcggauggggcaauggauguggacuguucgguaaaggaagccuaaucacgugcgcgaaauuuaaaugcguaacgaaacuugaaggaaaaauuguacaguaugaaaacuuaaaauauucagugaucguaacaguacauaccggagaucagcaccaaguggguaacgaaaguacagaacaugguacuacagcuacgauuacaccucaagccccaacaucugaaauccaacucacggauuauggggcuuuaacccuagauuguucaccuaggacggggcuagacuuuaacgaaaugguucuauuaacaaugaaggaaaagucauggcuaguacauaaacaaugguuccuagaucuuccucuccccuggacauccggugcuucuacaucacaagagacuuggaauagacaagaccuucugguaacauuuaaaacggcacaugccaagaaacaagaaguggugguucuagggucccaagaaggagcuaugcacacggccuuaaccggagcuacugaaauacaaaccucagguacaacaacuauauuugcaggacacuuaaagugucguuuaaagauggacaaguuaacucuaaagggaaugucauacguuauguguacaggcaguuuuaaauuagaaaaggaaguggcagaaacucaacacggaacugucuuaguacaaauuaaauaugaggguacagacgcucccugcaagaucccguuuaguacucaggacgaaaaaggcguaacacagaaugggagauuaauaacggcaaauccgauagucacagacaaagaaaaacccguuaauauagaggcagaaccgccauuuggugaaucuuacauagucauaggagcuggagaaaaagcauugaaguuaucaugguucaaaaagggcuccucaaucgguaaaauguucgaagccaccgcaagaggggcgagaagaauggcaauucuuggagacacggcaugggauuucgggagcguagggggcguuuuuacaucaguuggcaagcugguacaccagauauuugguacagcuuauggaguucuguuuucagggguuuccuggacuaugaagaucgguauaggcguucuucuuaccuggcuggguuuaaauagucgcaguacaagucuaaguaugacguguaucgccguaggacugguuacccucuauuugggaguaauggugcaggcugacaguggcugcgugauaaauuggaaaggaagggaauugaaaugugguucagguauauucguuacuaacgaaguacauaccuggacugaacaguauaaauuccaagcagauucacccaaaagauuaagugcagcuauugggaaagcgugggaagaaggaguaugcggcauacgcagugcuacaaggcuugaaaauauaauguggaagcagauaaguaaugaguuaaaccauauacuacuagagaacgacaugaaauuuaccgucgucgucggugacgucguagggauucuagcgcagggcaagaaaaugaucaggccgcaaccgauggaacacaaauacucguggaaaucuuggggaaaagcuaagauaauuggagccgauguccaaaacacuacauuuauuauugacggucccaauaccccugagugccccgaugaccaacgugcauggaacauuugggaaguugaggauuaugguuucggaauuuuuacaacaaacauaugguuaaaauugagagauaguuacacacaaguuugcgaucauagauugauguccgcugcuauaaaagauucuaaggcuguacaugcugacauggguuacuggauagagagcgagaagaaugaaacauggaaacuggcgagggcuucguuuauagaaguuaagacauguaauuggcccaaaucucauacacuguggucuaaugggguacuagaaucugagaugauuauaccaaaaauauauggcgggcccauuagucagcacaacuauagacccggauauuucacacaaacagcagguccauggcaucuaggaaaacuagaauuagauuuugaccuaugcgaggggacgaccguuguaguagaugaacauugugggaacagagguccaucacuucggacgacaacaguaacagguaaaauaauacaugaaugguguugcagaucaugcacguugccuccuuuaagauuuaaaggcgaggaugguugcugguauggaauggaaauaagacccguuaaggaaaaagaagaaaaccucguuaaauccaugguaucagcaggguccggcgaaguagacagcuuuucacuugguuugcuguguaucaguauaaugauagaagagguaaugagaucacgauggagccgaaagauguugaugacaggaacacucgcaguauuucuccuacucauaaugggacaauuaacuuggaaugaccuaauuagauuguguauaaugguuggagcgaaugcauccgaucgcaugggaaugggaacuacuuauuuagcauuaauggccacauucaagaugcguccaauguuugcaguaggucuacuauuccgaagauugaccuccagagaaguuuugcuauuaacuaucggccuaucauuaguagcaagugucgaauuaccaaauucccuagaagaguuaggcgaugguuuggcuaugggaauuaugauccuaaagcugcuuacagacuuccaaucucaccaauugugggcaacauuacuaucacuuacauucauaaaaacuacauugucguuacacuaugcuuggaagacaauggcgaugguccucucuaucguaucguuguuuccucucugccuaaguacaacgagucagaaaacuacuuggcuaccuguacuucuggggagcuuaggauguaaaccacucacaauguuccugauaacagaaaacaaaauuuggggcagaaaaucauggcccuuaaaugaggguauuauggcggugggagucguuuccauucuccucucgaguuuacucaaaaaugaugucccccuagcaggaccccuaauagccggaggaauguuaauagccugcuaugucauaaguggcucuagcgcagauuuaucacuggaaaaagcggcagaggugagcugggaagaagaagcggaacacuccggggcaagucacaacauuuugguugagguacaagaugacggaacaaugaaaaucaaagaugaagaaagagacgacaccuuaacuauacugcuuaaagccacccuucucgcggugucaggcgucuaucccuugagcauuccagccacacuauuugugugguauuucuggcaaaagaagaaacaacguuccggaguauuaugggacacaccuucuccgccagaagucgaacgagcuguccuugacgacgggaucuaucguauuaugcaaagaggccuucuggguagaucacaaguagguguaggaguguuucaggaaaauguauuucauacaauguggcaugugacacgaggcgcaguuuuaauguaccaaggaaaaagauuagaaccuaguugggcgagcgucaagaaagauuugauauccuaugguggaggguggaggcugcaggguuccuggaauacgggagaggaaguacaaguaaucgcgguugaacccggcaaaaaucccaaaaacguacagacugcccccgggacauuuaaaacccccgagggugaaguaggugcgauugcgcuugauuuuaagccaggaacaagugguucgccaauuguaaacagagaggguaaaauaguagguuuauacgguaaugguguaguaacaacaaguggaacauacgugagcgcuauagcucaagcuaaagcaucacaagagggcccauuaccagaaauagaggaugaaguauuuagaaaaagaaaucuaacgauaauggacuugcaucccggcucaggaaaaaccagacgcuaccuuccagcaaucgucagagaagcaauuaaaagaaaacucagaacuuugauauuagccccaacgcgcguaguggcaagcgaaauggcugaggcuuugaaaggcaugccuauccguuaccaaaccaccgcaguaaaaagugaacacaccggaaaagaaaucguugaucuaaugugccaugccacuuuuacgaugcgucuacucaguccgguacgagugccuaauuauaacaugauuauuauggacgaggcacauuuuacagacccaucuucuauagccgcuagaggauauauaaguacacgcguuggcaugggagaagcugcagcuauauucaugacugccacaccaccgggauccguggaggcuuuuccccaaucaaaugccgugauacaagaugaagagagagacauaccagagagaucguggaacucaggauaugaauggauuacggauuuuccuggcaaaacugucugguuuguaccgagcaucaaaagcggaaacgacauugccaacugccuucguaaaaauggaaagagagucauccaauuaagucgaaaaacguucgauaccgaauaucagaaaacuaaaaacaaugauugggacuauguaguaacaaccgauaucucagaaaugggggccaacuuucgcgccgauagagugaucgacccacgaagaugucuaaaaccuguuauccugaaggauggacccgaaagaguuauccuugccgggccaaugccagucacuguagcgagcgcagcacagagaagagggcgaauaggccgcaaccauaacaaagaaggagaccaauauauauauaugggccaaccauuaaauaacgaugaagaccaugcacacuggaccgaagcaaaaaugcuucuugauaauaucaauaccccugagggcaucauaccugccuuguuugaaccagaaagagaaaaauccgcagcaauugacggcgaguauagguugagaggggaagcgagaaagacuuuuguagaauuaaugagaagaggcgauuugccaguuuggcucagcuauaaaguagcaagugaaggauuccaauauagugacagaagauggugcuuugauggagagcggaauaaccaaguauuggaagaaaauauggacguagaaauauggacaaaagaaggagagaggaagaaacugcgaccccguuggcuugaugccagaacauacuccgacccucuggcucuuagagaguucaaggaguucgcagcuggaaggagaucagugucuggagaccuuauccuggaaauagguaaauuaccucagcaccugacccagagggcgcaaaacgcguuagacaaccuggucauguuacauaacucugaacaagguggacgagcuuacagacaugcaauggaagaacucccugacaccauugaaacguuaauguuauuggcucuuauugcagugcuaacaggaggaguaacauuauucuuucuuucaggucggggauugggaaagacaaguaucgggcuacuguguguaauggcuucaagcguauugcuuuggauggcuaguguagagccucacuggauugcugcaucaauuauucuggaguucuuucuuauggucuugcugauaccagaaccggaucgccaacgcacaccccaagauaaucaauuagcauacguagugauaggacuguuguuuaugauauugacgguugcugcaaaugaaaugggacuguuagaaaccacaaagaaagacuuagguauuggccauguugccguagagaaccaucaucacgcaacuaugcuugauguagaucuccauccggccucugcuuggacuuuauaugcgguugcgacaacaauaauaacaccaaugaugagacacaccauugaaaauaccacagcgaauauaaguuuaacagcaauagcaaaucaagcugcaauucuuaugggacuggauaaaggauggccuauuuccaaaauggauauuggaguacccuuacuugcccuugguugcuacucacaaguuaauccccuaacacuuacagcggcgguucugaugcuuguugcucauuacgcaauuaucggucccggucuucaggcuaaagcuacacgugaagcucaaaaacgaacagcugcuggaauuaugaaaaaucccacaguagaugguauuguagcgauagauuuggaucccguaguuuaugacgcaaaauucgagaagcaguuagggcaaauuauguuauuaauucuauguacuagccaaauauuacuaaugagaacuaccugggccuugugugaaucuauaacacuugcuacagggccccuaaccacccugugggaaggaucuccgggaaaauucuggaauacaacaauugcaguaucaauggccaacauauuucgggguucauaccuagcaggagcaggauuagcuuucaguuugaugaaaucguugggcggugguagaagagggacaggggcucaaggugaaacguuaggagagaaauggaagcggcaauuaaaccaauuaaguaagagcgaauuuaacauuuauaaaagaucaggcauaauggaaguugaucggagcgaagcuaaggaagggcuuaaaagaggagagacgacacgacacgccgugucuaggggaacagcaaaauugagaugguuuguagaaagaaaucuaguaaaaccagaagguaaagucaucgaucuaggaugcggucguggagguuggaguuauuauugcgcgggucuuaagaaaguaacagaagucaaaggauauacgaaaggaggaccuggccaugaagaaccaauuccuauggcaacauacggcuggaauuuaguuaaguuacacaguggaaaagacguguuuuucacaccaccugaaaaaugugauacacuauuaugcgacauaggagaaucgagcccaaaucccaccaucgaagaagggcgaacguugcgaguauuaaaaaugguugaaccuuggcuacguggaaaucaguuuuguauaaaaauacuuaauccauauaugccaucugugguagagaccuuagaacaaaugcaacgcaaacacggggguaugcuagugaggaauccauuaaguagaaauucgacucaugagauguacuggguuucauguggaacaggaaauaucguaucugccgucaauaugacaaguagaaugcuccugaaucguuucacuauggcacaccgcaaaccuacguacgaaagggauguggauuuaggagcuggcacucgacauguggccguagaaccagaggucgcaaaccuagacauaaucggacaaagaauugaaaauauuaaacacgaacauaaaaguacuuggcauuacgacgaagauaauccuuauaaaacuugggcuuaucauggaucuuaugaaguaaaaccaaguggaucugccucgucaaugguaaauggaguugugaaacuauuaaccaaaccaugggacgugauuccaaugguaacccagaucgcuaugacagauacaacacccuucgggcaacaacguguuuucaaagagaaaguggauacacguacaccuaaagcaaaaagaggcacagcucaaaucauggaaguaacagcaagguggcuuuggggauuuuugagcagaaacaaaaagccgaggauaugcacccgggaagaauuuacucgcaaaguaagaaguaacgcggcgauuggggcagucuuugucgacgagaaucaauggaacucagcaaaagaggcaguugaagacgaaagauuuugggauuuggucaagaaagaacgugaauugcauaaacagggcaaaugugcaacaugcguuuauaacaugauggguaaaagggagaagaaauuaggcgaauuugguaaagcaaaaggaagccgugccaucugguacauguggcuaggugcacgcuuccucgaguucgaggcgcuugguuucaugaaugaagaccauugguucagucgagagaacucuuuaucagguguagaaggggagggacuucauaaacuuggcuacauacucagagacauuaguaaaauaccaggugguaauauguaugcagaugauacugcagggugggauacgagaauaacggcggaugauuuacaaaaugaagcaaaaaucacggauauuauggaaccugaacacgcacuauuagcuacaucaauauucaagcuaacauaccaaaacaaaguagugagggugcagcgaccagccaaaaauggaacaguaauggacguaauaucccguagagaucaaagaggauccggucaggucggaaccuauggauuaaacacguucacuaacauggaagcucaacuaauuagacaaauggaaucagaaggcauauuucuuccaucagaacuugaaacaccuaaucuagcugaaagaguacuugacuggcuggaaaaguacggugucgaaagacuaaaacgaauggcaauaagcggcgaugauugugugguaaagccgauagaugaucgauuugcuacagcguugacagcauuaaaugauaugggcaaaguccgaaaagauauaccacaaugggagcccucaaaagguuggaaugauuggcagcaagucccauucugcagccaucacuuucaucagcucauaaugaaagacggacgagaaauaguagugccgugccgaaaucaggaugaauuaguagggcgggcaagaguaagccagggagcagggugguccuugagagagacggcaugccucggaaaauccuacgcgcaaauguggcagcucauguauuuucauagacgagaucuacgacucgccgcaaacgccauuugcucagccguaccaguugauugggugccgaccuccaggacaacguggucaauucaugcgcaucaucaguggaugacaacagaagauauguugucuguauggaaccgaguuuggauagaagaaaacccauggauggaggauaaaacacaugucucaagcuggggagauguuccauacuuaggcaaaagggaagaucaauggugcgggaguuuaaucgggcuaacagcacgcgcgacaugggcgucaaacauacaagucgcaaucaaccaaguacguagacuaauuggaaacgaaaauuaccuagacuauaugacgagcaugaaacgcuuuaagaaugagggcgacccagaaggagcuuuaugguaa

SEQ ID NO: 21844 - RNA, 9879 nt, Artificial Sequence
  derived and/or modified CDS sequence (opt6) from DENV-1__GU131770__SS-prME
uccguaacaauguuauugauguuaaugccuacggcuuuggccuuucacuuaacaacacgcggaggagaaccacauaugauaguuucgaaacaagaaagagguaaaagucuuuuauucaaaacgagugccggagucaauaugugcacuuuaauagccauggauuuaggagaacugugcgaagauacaaugacauauaaauguccaagaauaacagaaacagaaccugaugauguugacuguuggugcaaugcuacugacacauggguaacauauggaacaugcucgcaaacgggggaacauagacgcgacaaaagaucaguagcacuagcaccccaugucgguuugggucuugaaacgagaacagagacuuggaugucuucggaaggggccuggaaacaaauacaaagagucgaaacgugggcccuaagacauccaggauuuacugugauugcacucuuuuuagcccaugcaaucggaaccucuauuacgcagaaagggaucauauucauauuauuaauguuaguuacgccaaguauggcaaugcgaugcguaggcauaggcaguagggauuuuguagaagguuuguccggugcaacuuggguagacgucguccucgaacacggcucuugcguaacaacaauggcaaaagacaaaccaacguuggacauugaauugcucaaaacugaaguuacaaacccagcgguucugcggaaacuaugcauagaagcgaaaaucucaaauacaacaacagauagucguuguccuacccaaggagaggcaacguuagucgaggaacaagaugcuaauuucguaugcaggcggacuuuuguggaucguggguggggaaauggcugcggcuuauuugggaaaggaagucuuaucacaugcgccaaauucaaaugcgucacaaaacuugaagguaaaauugugcaauacgagaaccuaaaguauuccguaauaguaaccguucacaccggagaucaacaucaaguaggaaacgaaagcacagagcauggaacaacugccacaauaacuccgcaagcgccgacaacagaaauccaauugacugacuauggugcauuaacauuagacuguagucccagaacaggacuagauuucaacgagaugguacuacugacaaugaaagagaagucaugguuaguucauaagcaaugguuucuagaccuuccccugcccuggacuucuggugcaaguacgucacaagaaacguggaacagacaagaccuacuugucacauucaagacagcacaugcuaaaaagcaagaagucgugguauuagguagucaggaaggcgccaugcacacggcacuaacaggggcgaccgaaauacagacuucuggaacaacaacaauuuuugcaggacaccucaaauguagauuaaaaauggauaagcugacucucagaggaaugaguuaugucaugugcaccggaaguuuuaaacuugaaaaagaaguagcagaaacacagcaugguacaguuuuaguacaaauuaaauaugaagguacugacgcacccuguaagauucccuuuucgacacaagaugagaaggggguaacucaaaaugggcguuugaucaccgccaauccaauagucacagauaaagagaaaccuguaaauauagaagcagagccaccauuuggcgaaaguuauauaguaauuggugcaggagaaaaagccuugaaauuaucaugguuuaaaaaggguuccucgaucgguaagauguuugaggcaaccgcacggggagcaagacguauggcaauauuaggagauacggcuugggauuuuggaucgauagggggcguguuuacaaguguaggcaaauuaguccaucagauauuuggaacugcuuacggaguacuguuuagcggagucucauggacaaugaaaauugguauuggagucuuauuaacauggcuaggauuaaacucucggucaacaagccugaguaugacuuguauagcuguaggcuuagucacuuuauaccuaggcguaauggugcaagcagauucugguuguguaauuaacuggaaaggaagagaacucaaauguggaucugguauuuuugucacuaaugaagugcauaccuggacagaacaauauaaauuucaagcagauucgccgaagcguuuaucggccgcaauuggaaaggcuugggaagaaggagucugcgggauccgaagugccacacgacuugagaauauaauguggaagcaaauaucaaacgaacuaaaucauauccuacuagaaaacgacaugaaguuuaccguaguuguuggagacguggcugggaucuuagcucaaggcaagaaaaugauaagaccgcagccaauggaauacaaauacucguggaaaucuugggggaaagcuaaaaucauaggcgcagaugugcaaaauacaacuuuuaucauagauggcccuaauaccccugaaugcccggacgaccaaagggcuuggaauauaugggaaguugaagauuacggauuuggaauuuucacuacgaacauuuggcuaaaauuaagagauuccuacacacaagucugcgaucauagguugaugucugccgcaauaaaagacagcaaagcugugcacgcagauaugggauacuggauugagagugaaaagaaugaaacuuggaaacuggccagggccaguuucauagaaguaaaaaccugcauuuggccaaagucucacacucucuggagcaacggagucuuagaauccgaaaugauuauaccaaaaaucuacgggggucccauuucccaacauaauuauaggccaggauauuuuacacagacagcuggcccauggcaccuugguaaacuagaacucgauuucgauuuaugcgaaggaacgacuguaguuguugaugagcauugcgguaauagaggaccaucacucagaacuacaacuguaacggggaaaaucauucaugaauggugcugccgaucauguacuuuaccaccguuacgguuucggggagaagaugguugcugguacggcauggaaauaagacccguaaaggaaaaagaagaaaaccuaguuaaaucuauggugagcgcuggauccggcgaaguggacucauucagucuggggcuauuauguauauccaucaugaucgaggaaguaaugcgaaguagauggagcagaaaaaugcuuaugacaggaacuuuagcaguguucuuucuacugauaaugggacagcugacguggaaugaucugaucaggcuauguauuaugguaggcgcgaacgcuucagauagaauggggaugggcacaacauaucucgccuuaauggcaacauucaagauucgaccaauguuugcagucggucucuuauuuagaagauugacaucgcgggaaguacuguuacuaaccauuggauuaucuuuaguagcaucggucgaauugcccaacagccuugaggaauugggagaugggcuagcaauggggauuaugauccuaaaacuauugacugacuuucagucgcaccaacugugggcaacauuauuaucauuaacauuuauuaagaccacuuucagcuuacauugcgcuuggaaaacgauggcaaugguauuaaguaucgugagucuauuuccacuauguuuaucgaccacaucacagaaaaccacguggcucccaguauuguuaggcagccuaggguguaaaccauugaccauguuucucauagccgaaaacaaaauauggggacgaaggucauggcccuuaaaugaagguauuauggcggugggaauuguuagcauacuuuuaucaaguuuacugaaaaaugacgugcccuuagcuggcccguugauagcgggugggaugcuaauagcuuguuaugugauuuccggguccagcgcagaucucucacuagagaaagcagcggagguaagcugggaggaagaagcugagcacagcggugccagucacaauauuuuaguagaaguacaagaugacgggaccaugaagauuaaagaugaagaacgagacgauacucuaacaauacugcucaaagcuacuuuacuggcugugucuggaguuuauccacuaucgauacccgccacgcucuuuguuugguacuuuuggcagaagaagaaacagagaucaggcguucuuugggauacaccaagcccaccugagguugagcgugcaguccuggaugacgguauuuauagaauuaugcaaagaggacucuuaggucgaucacaaguaggcguugguguguuucaagaaaauguauuucauacuauguggcacguaacaagaggagcaguuuuaauguaucaagggaaaagauuagagccaaguugggcaucaguuaagaaagaucuaauuaguuacgguggaggauggcgcuuacaggggagcuggaauacaggagaagaaguccaaguaaucgccgucgaaccggguaaaaauccaaagaacguccaaacagcucccggaacauuuaaaaccccggaaggagaaguaggcgcaaucgcccuugacuuuaaacccggaaccagugguagcccgaucguaaaucgagaggguaaaauaguaggcuuauacgguaacggaguuguuacuacaucaggaacauacguaagcgcaaucgcgcaagcuaaggcaagccaagagggaccacuaccugagauugaagacgaaguauuucgaaaacggaaucuuacaauaauggauuuacacccugggagugguaaaacuaggagauaccuuccagcuaucgucagagaagcgauaaaacgcaaauugagaacauuaauuuuagcacccacaagaguaguugccucugaaauggcugaggcgcuaaaaggcaugccaauacgauaucaaacaacagcaguuaagucggaacauaccggaaaagaaauugucgauuuaaugugucacgcaaccuuuacgaugagguuauuaagcccagugcggguuccuaauuauaauaugauuauaauggaugaagcucacuuuacggauccaagcucaauagcugcaagaggauauauuucgacgagaguaggcaugggugaggccgcggccauauuuaugacagcaacaccaccagguaguguugaggcauuuccacaaagcaaugcuguaauccaagaugaggagagggauauaccugaaaggucauggaacucuggguacgaguggaucacagauuucccgggaaaaacaguuugguucguaccuucuauaaagagcggaaaugacauagcaaauugcuuaaggaaaaacgggaagcgaguuauacaauuaucaaggaagaccuucgauaccgaguaucagaaaaccaagaauaacgacugggacuauguagugacaacugacaucuccgaaaugggugcuaacuuucgcgcagaccgaguaaucgauccuagacguugucuaaagcccguaauccugaaagacggaccagaacgaguuauccucgcaggcccaaugccuguaacaguggcaucugcagcccaacgacgagggagaauuggaaggaaccauaacaaggaaggagaucaauacauuuauaugggucagccacugaauaaugaugaggaucaugcacauuggacagaagcgaagauguuauuagacaauaucaacacgccggaaggcaucauaccagcucuauuugaaccugaaagagaaaaaucugcggcuauugauggagaauauagacuaagaggagaagcacgaaaaacguucgucgagcuaaugcguagaggggaccuaccgguaugguugucguauaagguagcgucagaaggcuuucaguacucagacagacguugguguuucgauggagaaagaaauaaucaaguacuagaagagaacauggacguagaaauuuggacaaaagagggugaaaggaagaaacuacggccuagaugguuagaugcucguacuuauucagaccccuuggcgcuaagggaauuuaaagaauuugcugccgguagaaggagugucaguggagacuuaauuuuagaaauagguaaacuuccgcaacauuuaacucaaagagcccaaaaugcucuagauaauuugguuauguuacacaacucagagcaagguggccgagccuauagacaugcaauggaagaacuuccagauaccauagaaacauugauguuguuggcauugauagcaguacucaccggggguguaacccuauucuuuuugucuggacgaggucuagguaagacgucaauaggacuacucuguguaauggcaucaaguguccuauuauggauggcgucaguggagccucacuggauugcugcaucuauaauauuagaauuuuuccuuauggucuuauuaauaccagaaccggacaagcaacguacaccucaagauaaccaacucgcuuauguaguaauagguuuauuauucaugauuuuaacaguagcagcuaacgaaaugggucuacuagaaacaaccaagaaagaucucggaauuggacauguagcaguagagaaucaucaucacgcugccauguuagauguagaccuacacccggccagugcauggacacuauaugccguagcuaccacaauaaucacaccaaugaugagacauacgauugaaaauacgacagcaaauauuaguuugacagcaauugcuaaucaagcggcaaucuugaugggauuagauaaaggauggccgauaucgaaaauggacauagguguaccacuucuagcuuuagguuguuacucucaaguuaacccguuaacacucaccgcugcagugcuaaugcugguugcacauuaugcgauaauaggaccggguuuacaagcaaaagcgacgcgcgaggcgcagaaaagaacagcagcaggaaucaugaaaaaucccacaguagacggaauuguagccauagauuuagacccgguaguguaugaugcaaaauuugaaaaacaacuggggcaaaucaugcuucuaauacuuuguacaucacaaauacuauuaaugcguacaacuugggcauuaugugaaaguauaacucuagcuacaggaccacuaacaaccuuaugggaaggaagcccaggaaaguuuuggaauacaacaauugcaguaucaauggccaauauauuuagagguaguuaucuggcgggugcaggguuagcauuuucacuaaugaaaaguuuaggagggggcagaagaggaacuggagcacagggagaaacuuuaggagagaaauggaagaggcaguugaaucaacucagcaagagcgaauuuaacacauauaagcggagcggaauaauggagguggauagaagugaagcaaaggaagguuuaaaaagaggcgaaacaaccaaacacgcaguuucaaggggaacugcuaaauuaagaugguuuguggaaaggaaucugguaaagccggaaggcaaagugauugacuuggguugugguagaggagguuggucguauuauugugcaggacuaaagaaaguaacugaagugaaaggauacaccaagggagguccgggucacgaagaaccgauuccgauggcuacauacggauggaaucuuguuaaauuacauaguggaaaagauguauuuuucauaccuccggagaaaugugacacguuacugugugauauuggagaaucgucuccgaauccuacuauugaagaaggucgaacuuuacgaguacuaaaaaugguagagccuugguuaagaggaaaucaauuuuguauaaaaauauugaauccauauaugccuaguguaguagagacacuagaacaaaugcagagaaagcacggcggaaugcucguucggaauccguuaagucgaaauucuacucaugaaauguauugggucucuugugguacggggaauauaguuagcgccgugaauaugacgaguagaauguuacuaaacagauucacaauggcacauaggaagccaacauaugaaagggauguagaccugggugcaggaacccgacauguugcuguagagccugaagucgccaacuuggacaucauaggucaacgaauagaaaauauaaaacaugagcauaaaucaacguggcacuacgaugaggacaacccuuacaaaaccugggcuuaccauggaaguuaugaaguuaaaccgucuggaucugcuucaucaaugguaaacggcguuguaaaauugcugacuaaaccaugggauguuauaccuaugguuacacaaaucgcuaugacagauacaacuccuuucggucagcaaagaguauucaaagagaagguagacacacgaacucccaaagcgaaaagggggaccgcgcaaauaauggagguuaccgcaaaaugguuguggggcuucuuaucgagaaauaaaaagccaagaaucugcaccagagaggaauuuacacgaaaggugcguucaaacgcagcaauuggcgcaguauuuguggacgaaaaucaauggaacuccgcuaaagaggccguggaagaugagagauuuugggacuuaguucaccgggaaagagaacuacacaagcaggguaagugcgcuacuugugucuauaacaugaugggaaaacgugagaagaaacuaggcgaauuuggaaaagcaaaaggcucaagggcaauaugguacaugugguugggcgcaagauuccuagaguucgaagccuuggguuucaugaacgaagaucacugguucucacgagaaaacagucucucaggaguagaaggagaaggacuacauaagcuaggauacauccuccgagauauuucaaaaauacccgguggcaauauguacgcagaugauacugcagggugggauacaagaaucaccgaagaugaucuucaaaaugaagcacguauaaccgauaucauggagccagaacacgcauuauuggccaaaucaauauuuaaacuaacuuaucagaauaaaguaguccgaguccagcgcccggcuaaaaaugguacagugauggauguuauaucccgaagggaccagcggggaaguggucaaguuggaacuuacggccugaacaccuucacaaauauggaagcccaacuuauaagacaaauggagagugagggaauuuuuagcccguccgaacuagaaacacccaaucuagcugaacggguuuuagauuggcuggagaaguauggaguagaacguuuaaaacgaauggcuauaucaggugaugauuguguagucaaacccauugacgacagguuugcaacagcgcuaaccgcacuuaacgauaugggaaaaguaagaaaagacauaccucaaugggaaccaucgaagggcuggaaugauuggcagcaaguuccguuuuguucacaccacuuccaucaauuaauaaugaaggaugguagagaaaucguaguacccuguagaaaucaggaugaguugguaggacgugcuagagugucacaaggcgcuggcuggucguuaagggaaacugcaugccuaggaaagaguuacgcgcaaauguggcaauuaauguauuuucauaggcgagaucugcgacuagcagcuaaugcaauaugcucugccgugccaguagauuggauaccuacaucccguaccacguggucaauccaugcucaucaucaauggaugacaacagaagauauguuaucgguguggaauagaguuuggauugaagagaauccauggauggaagauaaaacgcauaucucaucuuggggagauguaccuuacuugggaaaaagagaggaucaauggugugggagucucauaggacuuacugcaagagcuacuugggcaacaaacauacaagucgcaauaaaccaaguuagacgauuaauaggaaaugaaaacuauuuagauuauaugacaucaaugaaacgguuuaaaaacgaaucggacccugaaggagcacucugguag

SEQ ID NO: 21845 - RNA, 9879 nt, Artificial Sequence
  derived and/or modified CDS sequence (opt6) from DENV-1__GU131773__SS-prME
ucaguaacaaugcuacuuauguuaaugccgacagcacuagcauuccaccuaacuacaagaggaggagagccgcacaugauuguuucaaaacaagaacgagggaaaagccuacuauuuaaaacaucagccgguguaaauaugugcacacuaauugcaauggauuugggcgaacuaugugaagauacaaugacauacaaguguccucgaauaacagaggcagagccugaugauguagacuguugguguaacgcaacagauacauggguaacuuaugguacauguucccaaacuggcgaacaucgucgugagaaaagaucgguugcuuuagccccacacgugggguuggguuuagaaacacggacggaaacauggaugucgucagagggugcauggaagcagauucaacggguugaaacuugggcauuaagacacccagguuuuacagucauagcucuuuuccuugcccaugcuaucgguacgucuaucacucaaaaagggaucauauucauacuguuaauguuaguuacgccaucuauggcgaugcggugcguugggauagguucacgagacuucguagaggguuuguccggugcaacaugggucgauguuguauuagagcauggcucuugugucacgaccauggcaaaagauaaaccaacuuuagauauugaacuacuaaaaacggagguaacaaacccagcaguuuuaagaaaacuuuguauagaagcgaaaauaucgaacacaacuacggauucacgguguccuacucaaggagaagcuacccuaguugaagaacaagaugcuaauuucguaugucgaagaaccuuuguagaccgcgggugggggaauggauguggucuauucggaaaaggaucacuacuaacuugugcuaaguuuaaaugcaugacuaaacuggaaggaaagauugugcaguaugaaaaucuuaaauacuccguaauaguaacuguacacacaggggaucaacaccaaguuggcaacgaaagcaccgaacaugguacaacggccacaaucacuccacaagcgcccacgacugaaauccaacuaacugauuacggagcgcucacuuuagauuguucacccagaacaggauuagauuucaacgaaaugguccuguuaacuaugaaggaaaaaucauggcugguacacaagcaaugguuucuagauuuaccucuuccguggaccucaggagcaaguacgucacaagaaacauggaaucgacaagaccuuuuaguaacauucaaaacugcacacgcgaaaaagcaagaaguagugguuuuaggaagccaagagggcgcaaugcacacagccuuaaccggagcaaccgaaauucaaacaagcggcacuacuacaaucuucgcugggcauuuaaaaugucguuuaaaaauggacaaguugacacucaaagguaugucauaugucaugugcacuggaucauucaaacuugaaaaggagguugcagagacacagcacggaacagugcuaguacaaaucaaauaugaaggaaccgaugcacccugcaaaauuccauucucuacccaagaugaaaaagguguuacacagaaugggcgccucauaaccgcgaauccgauaguaaccgacaaagaaaaaccaguuaacaucgaggcagaacccccguuuggagaaaguuauauuguuaucggagcuggagaaaaagcacugaagcuauccugguucaagaaggguuccaguauaggaaaaauguucgaggcaacagcaagaggagcgcgacgcauggcgauacucggugauaccgcaugggauuuuggaaguauaggggguguguucacuagcguggguaaguugguccaucaaauuuuugggaccgcguacggggucuuguucagugggguaucguggacaaugaaaauaggaauuggcguccuacuaacauggcuuggucuuaauucccggagcaccucacucucgaugacuuguauagcaguagguuuggugaccuuauaccugggagugaugguacaagcugacucagguugcguaaucaauuggaaaggaagggaacuaaaauguggcucgggaauuuucguuacaaaugaaguccacacauggacagaacaauacaaauuucaagcugacucccccaaaaggcucuccgcggcgauaggcaaagcaugggaagaaggugucugcgggauaaggagugcaacccgucuggaaaacauaauguggaaacagaucucuaaugaguuaaaccauauauugcuugaaaacgauaugaaauuuacuguggugguaggugaugucgcagguauucuaguccaggggaagaaaaugauacgaccgcaaccaauggaauauaaauauuccuggaaaaguuggggaaaagcuaaaauaauaggugcagacguacaaaacucaaccuuuauaauagauggcccuaacacaccggaaugcccagaugaucaaagagcuuggaacauaugggaaguugaagauuacggauucgggauauuuacuaccaacauauggcuaaagcuaagagauagcuacacgcagguuugugaccauagauuaaugucagcggcuauaaaagauuccaaagcaguucacgcagauaugggauacuggauugaaucagagaagaacgagacguggaaauuagcuagagcaucuuuuauugaagucaaaacauguauuuggccuaaaucccacacacuauggaguaaugguguucuagaaagcgaaaugaucauaccuaaaauacauggcggaccuauuagucaacacaacuauaggccuggguacuuuacucaaaccgcaggaccauggcacuuggguaaauuggaacuagacuuugauuuaugcgaagggaccacagucgucguagaugaacacugcggaaauagggguccgagccuacgaacuacaaccguuaccggaaaaauuauacaugaauggugcugccggucaugcacauuaccaccacuucgauuucgaggugaggauggaugcugguacgggauggaaauuagacccguaaaagaaaaagaagagaaucucguaaaaucuaugguaagugcaggauccggagaaguugauagcuuucuguuaggauuauuauguauaucuauaaugauugaagaaguaaugcguucucgcuggucuagaaaaaugcucaugacagguacacucgcuguauucuuuuugcuuauaauggggcaacugaccuggaaugaucuaauuagauuaugcauaauggucggagccaaugcgucagaccgaauggggaugggaacaaccuaucuggcuuuaauggcaacuuuuaaaaugcggccuauguucgcgguuggguuauuguucagacgcuuaacaagucgugaaguauuauuguuaacaauaggacucucccuuguagcuaguguagaauuaccuaauagucuugaagaguuaggagacggacuugcaauggguauuaugauauuaaaacuauuaacugacuuucagucauaccaacuuugggcgacacuauuauccuuaacguuuauaaaaaccacauuuagcuuacauuacgcauggaaaacgauggcuaugguucugaguaucguaucccuauuuccauuaugccucaguacaacuucucagaagacaacaugguuaccaguguugcuuggcucacugggcugcaaaccacucacuauguuccugauagccgagaauaaaauuuggggccgaaaaucuuggccucuaaaugagggaaucauggcggugggaauagugaguaucuuauuaucaaguuuacucaaaaacgacguaccacuugccggaccguuaauugcugggggaaugcuaauugccugcuauguaauuucugguagcagugcugaccuaucacucgaaaaagcggcggaaguaucaugggaggaagaggcagaacacaguggagcaagucacaauaucuuaguggaaguacaagaugacgguaccaugaaaauaaaagaugaagaaagggacgauacucuaacuauuuuauugaaagcuacgcuguuggcgguuagcggggucuacccauugucuaucccugcgacucuguucguauggcauuucuggcagaagaagaaacaaagaagugguguguuaugggauacaccuucaccuccagagguagaacgagcuguucuagaugauggcauauauagaauaaugcaaaggggucuacucggacgcucccaaguagggguugguguuuuccaagaaaaugucuuucacacaauguggcaugucacacggggagcaguucugauguaucaaggaaaacgauuagagccuagcugggcuagcgugaagaaagaccuuauaucuuacggagggggauggagauuucaaggcucguggaacaccggcgaagaaguucaagucauugcgguagaacccggcaaaaaccccaaaaacguccaaaccgcaccaggcaccuuuaaaacacccgaaggugaaguaggugccaucgcuuuggacuuuaaaccagggaccucugguagcccuauaguaaauagagaggguaaaauaguaggccuuuaugggaacggagugguaacgacaagcggcacauaugucuccgccauugcgcaagcaaaggcuucucaggagggccccuuaccagaaaucgaagacgaaguauuucguaaaaggaauuuaacaauaauggaucuccacccagguaguggaaaaacaaggagauaucuuccugccaucguaagagaggcaauuaagcgaaaacuuaggacacucauucucgcuccuacacguguaguagcuucagagauggcagaagcacuuaaaggcaugccaauucgguaccaaacaaccgcuguuaaaucagaacauacaggcaaagagauagucgaucugaugugucaugcgaccuucacuaugagacuacucagccccguaagaguuccuaauuauaacaugauaaucauggaugaagcacauuucaccgacccauccucaauugcugcaagaggcuauaucucuacacgaguagguaugggugaagcagcagcaauauuuaugacugcaacaccaccagggaguauggaagcauucccacagaguaacgcagugauucaagaugaggaacgugacauaccugagcguaguuggaauagcggcuacgaauggaucaccgauuuccccggaaaaacaguaugguuuguuccaagcaucaaggcagguaacgauauugcaaauugcuugagaaagaacggaaagagaguaauacaguugucaagaaaaacguucgacacagaauaucagaaaaccaaaaauaaugacugggauuacgugguuacaacagauauaucugaaaugggggcuaacuuuagggcugacagagucauagaucccagaaggugccuaaaacccguaaucuugaaagacggaccagaaagaguaauauuggccggaccuaugccaguaacuguagccucugcugcacaaagacgaggacgcauaggaagaaaccauaacaaggaaggggaccaauacauuuacaugggacagccacuaaacaacgacgaggaucacgcccacuggacggaagcaaaaaugcuacuagacaauauaaauacgcccgaagguauuaucccugcgcucuuugaacccgaaagagagaaaagcgcggccauagauggagaauaucggcuucggggcgaagcaagaaagacguucguagaauuaaugagacgcggagaucugccggucuggcuauccuacaaaguugcaagcgagggauuccaauauagugaucguaggugguguuuugauggagagcguaacaaucaaguauuggaggaaaauauggaugucgaaaucuggacuaaagagggagaaaggaagaaauuacggccgagauggcuggacgcacgcacuuacucggacccauuagcccuccgugaguuuaaagaauuugccgcaggacgccgcucagugucaggggacuuaauuuuggagaucggcaaguuaccacaacaucuaacucagagagcacaaaacgcccuagauaaucuaguaauguuacauaauucagaacaaggagggagagcuuauaggcacgcaauggaagaacuaccagacacaauagagacucuuauguuauuagcuuugaucgcaguauuaacaggaggaguaacacuuuucuucuugagcgguaaaggguuaggaaagacaucgaucggacugcuaugcguuauggcuucgucaguauuguuauggauggcuagcguagagccacacuggaucgccgcaucaaucauuuuagaguucuuucugaugguguuacuaauaccugaaccggaccgacaaagaaccccgcaagacaaccaacuggccuauguggugaucggcuuguuauuuaugauacucacaguagcagcaaaugaaaugggacucuuagaaacuaccaagaaagauuugggaauaggacauguggcagucgaaaaccaccaccaugcagccaugcuugauguagacuuacacccugcuucagcguggacauuauaugcgguagccacuacgauuauuacaccaaugaugaggcacacuauagaaaauacaacagcaaauauuucauuaacagcaaucgcaaaucaagcagcaauuuuaauggguuuggacaaagguuggccuaucaguaagauggauauugggguaccauuauuagcacuaggauguuacagucagguaaacccucucacauugacggccgcgguuuuaaugcuuguggcacacuaugcgauaauaggcccaggauuacaagcuaaagcuacgagagaagcgcagaagaggacugcggccggcauaaugaaaaacccaacaaucgacgguauaguggcuaucgaucucgauccuguugucuacgaugcaaaauuugagaagcaguuaggucaaaucauguuguuaauacuauguacaucucaaauacuauuaaugagaacgacgugggcauugugcgaaucaauaacuuuagcaacuggaccccuuacaacccucugggaaggaucaccaggaaaauuuuggaauacuaccauagcaguuucuauggccaauauauuccggggcucuuaucuagcaggcgcaggguuagcguucagccuaaugaagucgcuggguggaggcagaagagggaccggagcccaaggagagacacuaggggaaaaauggaagcggcaacuaaaccaacuauccaagucagaauuuaacacauacaaaaggaguggaauuauggaaguugauagaucagaagcuaaagagggacugaagcgaggagagacaacuaagcacgcgguuucuaggggaacugcuaaauugaggugguuugucgagcguaauuuggugaaaccugaaggcaaagugauagacuuaggauguggaagaggcggauggucuuacuauugugcugggcucaagaaagugacugaaguaaaggguuauacuaaaggagggcccggacacgaagaaccaaucccaauggcuaccuaugguuggaaucugguaaaacuacauuccgggaaagacgucuucuucauaccaccagaaaaaugugauacguuauugugcgauauuggagaaagcagccccaacccgacgauagaagaaggucgaacacucagaguauuaaagaugguugaaccaugguuaaggggaaaucaauuuuguaucaagauccuuaauccauauaugccgaguguaguagaaacacuagaacaaaugcaacgcaagcauggagggauguuagucagaaacccacuaucuagaaacagcacacaugaaauguauuggguauccugcgggaccggaaacauagucucagcaguaaauaugaccagucguaugcuauuaaaucgauucacgauggcucacaggaaaccaacguaugagcgagacguugauuuaggagcggggacgaggcacguagcaguggaaccggagguagcaaauuuagauaucauaggacagcguauagaaaauaucaaacacgagcauaagucuacauggcacuaugaugaggacaacccuuacaaaacaugggcguaucauggcucauacgaaguaaaaccaagcgggucggcgagcaguaugguaaacgguguaguaaaacuucugacgaaaccaugggauguaauaccuaugguaacgcaaauagccaugacagacaccacaccauucggacaacaacggguuuucaaggaaaaaguugauacgaggacaccaaaagcgaagcguggaacagcgcaaauuauggaagucacagcucguugguuauggggguuucuaucucguaacaagaaaccaaggauauguacuagagaagaauuuacacgcaaaguuagauccaacgcagcuauaggagcgguauuuguugaugaaaaucaguggaacuccgcgaaagaagcagucgaagaugauagauuuugggaucuagugcacagagaacgagaacuacacaaacaagggaaaugcgcaacaugcguauauaauaugaugggaaaaagggagaagaaauugggagaguuugguaaggcaaaagguagccgggcaaucugguacauguggcuaggugcacgcuuccuugaauuugaggcuuugggauuuaugaaugaagaccacugguucagcagagaaaauucucucuccggaguugaaggagaaggguuacacaaguugggauacauauuacgagauauaucaaaaaucccugguggaaacauguaugcagaugauaccgcagguugggacacaaggaucacugaagaugaccugcagaaugaagcaaaaauaacugacauuauggaaccagaacacgcacuauuagcaaaaagcauuuucaaacuuaccuaucaaaauaaaguaguaagagugcagcguccagcgaagaacgguacgguaauggauguuauaucuagacgagaucaaagaggcaguggucaagugggaacuuaugguuuaaauacauucacaaauauggaagcccaacuuauacgacagauggagucugaaggaauuuuucuaccgaacgaguuagaaacaccaaaccuggcaggaagaguucuggauuggcuugaaaaauauggaguagaaagacuuaaaagaauggcuauuaguggggacgacuguguagucaaaccaauugaugaccguuucgcaacagcccuaaccgcacucaacgacauggguaaaguuagaaaggauauaccacaaugggaacccaguaaaggauggaaugacuggcagcaagucccguucugcagucaucauuuccaccaacuaauuaugaaagacggacgagaaauaguaguuccauguagaaaccaggacgaacuuguggggagagcucgaguuagccagggggcuggauggucacuccgugaaacagcuugcuugggaaaaaguuaugcccaaauguggcaguugauguacuuucauagaagggaccuaagacuagcagcaaacgcuauaugcucagcaguuccuguagauuggguuccaaccagucggaccaccuggucaauacaugcacaucaccaauggaugacuacggaggacauguuaucaguauggaauagaguuuggauugaagaaaacccuuggauggaagacaaaacccgcauuucuucgugggaagacguaccauaccuaggaaagagagaagaucaauggugugggagucuuauuggacuuacugcuagagcgacaugggcaacuaauauacaaguugcaauaaaccaaguacguagacuaaucgggaaugaaaauuauucagauuauaugacaucuaugaaaagauuuaaaaacgaaucugaaccagaaggagcacugugguga

SEQ ID NO: 21846 - RNA, 9879 nt, Artificial Sequence
  derived and/or modified CDS sequence (opt6) from DENV-1__GU131775__SS-prME
agcgugaccaugcuucuuaugcugaugccgacugcauuagcauuucaccucacuacacgcgguggggagccacacaugauuguuacaaagcaagagagagggaaaucccuucucuucaaaacaagugcggguguaaauaugugcacacuaauagcaauggaccuuggagaguuaugugaagacaccaugacauauaaaugccccagaauaaccgaggcagaaccggacgauguugauugcugguguaacgcuaccgacacaugggugaccuaugguacauguagucaaacuggcgaacaucggagagacaagcgcagcguagcuuuggcaccacacguggguuuaggucuggagacacgaacagaaacuuggaugucaagugaaggcgcuuggaaacaaauacaacgagucgaaaccugggcgcuucgacacccaggauuuacggugauagcacuguuucuagcucaugcaauuggaacaaguauaacucaaaagggcauaaucuuuauauuauugauguuagucaccccaucuauggcuaugagaugcgucggcauuggcucccgagauuuuguugagggcuuaucgggugcuacuuggguggacguaguucuugaacauggaucauguguaacuacaauggcaaaagauaaaccaacccuagacauugaacuuuuaaaaacggaaguuacaaacccagcuguucuacguaagcuaugcaucgaagccaaaaucaguaacacuacgacagauucaagaugccccacccaaggcgaagcaacacucauggaagaacaagacgccaauuuuguguguagaagaacauuugucgaucgagguuggggaaauggauguggacuauuuggcaaaggcagucucauuacaugugcuaaauucaaauguguaacuaaacuugaagguaagaucguacaauaugaaaaccuaaaauauuccguuguuguaacaguccauacaggugaccaacaccaagucggcaacgagucaacagagcacggcacuacggcaacaauaacuccccaagcgcccaccucugaaauacaacuuacggacuacggugcacugacauuagacugcucgccuaggacaggccuagacuuuaacgaaaugguuuuauuaacgaugaaagaaaagucguggcuugugcacaaacaaugguuccuagaucuaccgcucccuuggaccaguggggcaucaacaagucaagagacauggaaccgacaagauuuacucguuacuuuuaagacagcacacgccaagaaacaagaaguaguuguucucggaucacaggaaggagcaaugcacacugcacugacaggugcuaccgaaauacagaccaguggaacaacaacaaucuuugcaggucaccucaaguguagacuuaaaauggauaaacuuacuuuaaaggggaugagcuacguuauguguaccggaaguuuuaaauuagaaaaagaaguugccgagacccaacacgguacaguuuugguucaaauaaaauaugagggaacagacgcaccuugcaaaauuccuuucucgacccaagacgaaaaggggguaacacagaacggcagacucauaaccgcaaaccccauaguaacagacaaagaaaaaccagucaacauugaggcagagcccccguuuggcgaaucuuauauagugauuggggcugggggcaaagcucuaaaguuaucaugguucaagaaaggaaguaguauaggcaaaauguucgaggcaacggcacgaggcgcuagaagaauggcaauucugggggauacagccugggacuuuggaaguguuggcgguguuuuuaccucuguaggaaaguuaguacaucagauauuugggacagccuacggcguauuauucaguggaguuagcuggacuaugaaaaucggaauugggguuuuauugacguggcugggacuaaauucaagauccacgagucuaagcaugacauguauagcaguuggccuaguaacacuuuacuuggguguuaugguccaagcggauagcgggugcguaauaaauuggaaagguagagaauugaaauguggaucggguauauuuguuacgaacgaaguucacaccuggacagaacaauauaaguuccaagcagacucacccaagagacugucugcagcaauagguaaagcaugggaagaggguguauguggaauuagaucugccaccaggcuagagaauauuauguggaaacagauaagcaacgaguugaaucauauauuauuggaaaaugacaugaaauuuacaguaguugucggagauguaguaggcauacucgcacaaggcaagaaaaugauaaggccucaaccaauggaacauaaguacagcuggaagucaugggguaaagcaaaaaucauuggggcagacgugcagaacacaacuuuuauaauagacggaccuaacacaccugaaugucccgaugaucaacgugcuuggaacaucugggaaguggaggacuacggauuugguauauucacaacaaauaucuggcuuaaauugcgggacucuuacacacaagucugugaucacagguuaaugagcgcggcaaucaaagacagcaaagcagugcaugcugauaugggauauuggauagaaagcgagaaaaaugagaccuggaaauuagcuagagccagcuuuaucgaagucaaaacuugcaucuggccuaaaagccacacacuuuggaguaauggcguuuuagaaucggaaaugauuauuccaaaaauauacggcggcccaaucucucaacauaacuaccgaccggguuacuuuacccaaacagcagguccauggcaucuaggcaagcucgagcuagacuuugauuugugcgaagggacuacuguuguuguugacgaacacugcggaaaccgcggaccgucguuacguacuacaacuguaacgggaaaaauaauacaugaauggugcuguagaaguuguacacuacccccucuaagauucaaaggggaagaugguugcugguaugguauggaaauacgaccaguaaaggagaaagaagaaaacuuggugaaaucuaugguuucugcaggaucaggcgaaguggacucuuuuagucucggucuuuuaugcauaaguaucaugauagaagaaguaaugcggagcagauggucaagaaagauguuaaugacggggaccuuagcaguuuuccuccuauuaauaaugggucaacugacuuggaacgaucuaauacgauugugcauuaugguaggagcgaacgcgagcgacagaauggguaugggaacaacauaucuagcauugauggccacuuuuaaaaugagaccaauguuugcgguagggcuccuuuucaggcgucuaacgaguagagaaguacuauuacuuacaauaggacuuucuuuagucgcuagcguagaauugccaaacagucuagaagaacucggugacggccuagcuauggguauuaugaucuugaaguuacuaacagauuuucagagucaucaacuaugggcgacuuuauuaagccuaacuuuuaucaaaacaacauuaucauuacacuacgcuuggaaaacaauggcaaugguacuuaguauagugagucuguuuccguuaugucucaguacaaccucccagaaaacgacaugguuaccgguacuccugggcucucugggaugcaagccuuuaaccauguucuugaucacagagaauaaaauauggggccguaaaaguuggccacuaaaugaggggaucauggcuguagggguuguaucaauacuguuaaguucucuucucaaaaaugacgucccauuagcaggaccuuuaauagcggguggaaugcugauugcuuguuauguaauaaguggaucguccgcagaucuaucauuagaaaaggcugcugaagucaguugggaagaggaggcugaacacagcggugccucccauaauauccuugucgaaguccaggaugacggaaccaugaagaucaaagaugaggaaagagaugacacacucacaauacuacucaaagcuacuuuauuagcugugucuggcgucuacccucuauccauacccgcaacauuauucguaugguacuucuggcagaagaagaaacagcgaagcggcguucuaugggauacgccaucucccccugagguggagagggcuguucuugaugacgggaucuauagaauaaugcagagaggacuauuagggcgaucucaaguagggguuggagucuuucaagaaaacguauuccauacaauguggcauguaacucgaggagcuguacuaauguaucaagggaaaagauuagaaccaucaugggccagugugaaaaaggaucuaauaucauaugguggugguuggcgacuucaagggucauggaacacaggugaagaaguccaagugauagcagucgaaccuggaaagaacccuaaaaacguacagacagcuccuggaaccuucaaaacaccagagggugagguuggggcaauugcguuggacuuuaagccuggaacgucugguucuccgauaguaaacagagaaggcaaaauagucgggcuauacggaaauggcguagugacaacaucaggaacuuauguaucugcgaucgcacaagcaaaagcaagccaagaaggaccauugccugaaauagaagaugaaguguucagaaaacgaaaucuaacuauuauggaccuccauccagggaguggaaagacacgacgauauuuaccggcuauugucagagaggcuauaaaaagaaaacuuagaaccuuaauccucgcucccacccgagugguagcauccgaaauggcugaagcgcuaaaagggaugccaauuagauaucaaacaacagcaguaaaaucagaacauacugguaaagaaauagucgaucuuaugugucaugcuacguucacaaugagauugcuaagcccaguaagagucccuaauuauaauaugauaauaauggaugaagcucauuuuacagauccuucaucuauagcagcuagaggcuacaucucgacuagaguuggcaugggagaggcagccgcuauauuuaugacggcgacgccaccggguaguguagaagcauuuccgcaaucaaacgcaguaauacaggacgaggaacgugauauaccugaaagaucguggaacucagguuaugaauggauuaccgacuuuccagguaagacuguaugguucguaccaucaaucaaaucgggaaaugauauagcuaauugccuaaggaaaaacggcaaacgaguuauucaacuaaguaggaaaacguucgacacggaauaccagaaaaccaaaaauaaugauugggauuacguaguuacgacagacaucuccgagaugggcgcuaauuuucgugcagacagagucaucgaucccagacguugccuaaagccaguuauacucaaagacggaccggaaagaguuauauuagcaggaccuaugccuguuacgguagcaucagcugcacaaagacgaggccgcauuggaagaaaucacaauaaagagggugaucaauacauuuauaugggacaaccccuaaacaacgaugaagaccaugcacacuggacagaagcuaagaugcuucuggauaauauuaauacaccagaaggcauaauuccggcauuauucgaaccggaacgagaaaagucugcggcaauugacggagaauauaggcuuagaggugaagcacguaaaacuuucguugaacuaaugagaaggggugaucugccaguuuggcucucauacaagguugcaucagaaggcuuccaauauucggauaggcgauggugcuuugauggugaaaggaauaaucagguacuugaagaaaauauggauguagaaauuuggacuaaggagggagaaaggaagaaacuaagaccuagauggcucgacgcuagaaccuacuccgauccacuagcccuacgagaauuuaaagaauuugcugcgggacguagaucaguaucaggagaucugauacuggaaauuggaaaacucccccaacauuuaacgcaacgugcucaaaaugcccuagacaaccuuguaauguuacauaauucggaacagggcggucgagcuuacagacacgcaauggaagaauugccggauacuauagagacauuaauguuacuagcuuuaauagcaguucuuacuggaggggucaccuuauuuuuccugaguggacguggcuuagguaaaaccaguauaggcuuacuauguguuauggcaucuagcgucuuauuguggauggcgagugucgaaccacauuggauagcagccucaaucauccuagaguucuuucuuaugguccuucuaauucccgaaccagacagacaaagaacuccccaagauaaucaauuagcauacguaguaauuggacuucuauuuaugauccuaaccguagcagccaacgaaaugggguuauuagaaacgacuaagaaagaucucgguauuggucauguagccguagagaaucaccaccaugcaacuauguuggauguugaccuacacccugcaagcgccuggacccuuuacgcaguagcaacaacgauaauuacaccgaugaugcgacauacaauugaaaauaccacagcgaacauaaguuugacagcuauagcgaaucaggcugcaauauuaaugggacuugauaaagguuggccaaucucaaaaauggauauaggaguaccauuguuagcauuagguugcuacucgcaaguaaauccacucacauuaacugcagcgguauugauguuaguagcacauuacgcgauuauagggccugggcugcaagcaaaagcaacgagggaagcacagaagcggaccgcagccggaaucaugaagaauccaacaguggaugggauaguagcgauagaccuagacccagucguuuacgaugcaaaauuugaaaaacaacugggacaaauuaugcuucuuauacuuugcaccucgcaaauuuuguuaaugcgaacaacgugggcguugugugaaucaauuacacuagccacuggaccuuugacaacacuaugggagggcucaccgggaaaauucuggaauacgacaauagcugugucuauggcaaacauauuuagaggaagcuaucuagccggugcuggacucgcuuuuagucugaugaagagucuaggcggcggaagacgaggcaccggcgcucaaggggaaacucugggugagaaauggaagagacaacuaaaccagcuaucgaaaucagaauuuaauauuuauaaaagaucagguauaauggagguagauagaucagaagccaaagagggauuaaaaagaggugaaacuacaagacacgcagugagcaggggaacggcaaaacuucgaugguuuguugaaagaaauuuaguuaaaccugagggaaaaguuauagauuugggaugcggaagaggaggauggucguauuauugugcggguuugaagaaaguaaccgaaguaaaaggauauacaaaagggggaccaggucaugaggaacccauuccaauggcaacuuacggauggaaccugguuaaauuacauucuggcaaggauguauucuuuacaccacccgaaaaaugugacacucuauuaugugacauaggugaaaguucuccaaacccaacaaucgaggaggguagaacguuaaggguauugaaaauggucgaaccguggcuacgcggaaaucaauuuuguauuaagauacuuaacccuuacaugccaagugugguggagacauuagaacaaaugcagcguaagcaugguggcauguuagugaggaacccccucagcaggaacuccacccaugaaauguauugggucaguuguggaacgggaaauauaguaucugcaguaaauaugacgagcagaaugcuuuugaaucguuuuacaauggcucauaggaaaccaacauacgaaagagacguagauuugggagcuggaacuagacaugucgccguggaaccugaaguugcuaaccuggacauuauaggucagcguauugaaaacauuaaacaugaacacaaaagcacuuggcauuaugaugaggacaauccauacaagacuugggcuuaccacggaucauaugagguaaagccaaguggaucggcaaguucaaugguaaauggagucguuaaauuacugacaaagccaugggauguaauacccaugguuacacagauugcaaugacagacacaacacccuucggacaacagaggguauucaaagaaaaaguagacacuagaacuccaaaagcaaaaaggggcacugcucaaauuauggagguuacggcucguuggcuauggggauuccuuagucguaauaaaaagccuagaauaugcacacgugaagaguucacacguaaaguucguaguaaugcagcaaucggagccguauucguugacgagaaccaguggaacuccgcuaaagaggcuguggaagaugagcgcuucugggaccugguacaaaaggaaagagagcuacauaaacaagggaaaugcgccaccugugucuauaauaugauggguaagcgugaaaagaagcucggggaauuugguaaggcgaaagggaguagagcuauuugguauaugugguuaggggccagauuucuugaauuugaagcucuggguuucaugaaugaagaucacugguucagcagagaaaauucauuauccggugucgagggagaaggguugcacaaacuuggcuacauacuuagggacauauccaaaauaccaggcgguaacauguaugcagaugauacugcaggcugggauacacguauuacugaggacgacuuacagaaugaagccaaaauuaccgauauuauggaacccgaacaugcacuacuugcuacaaguauuuucaaauuaacguaccaaaauaaaguaguuagaguccagagaccugcgaagaaugguacgguaauggaugugauaucaaggcgcgaucaaaggggaagcggucaaguagggacuuauggguugaauacauuuacaaauauggaagcccaauugauccgccaaauggaaagcgaggguauauuucuuccaucagaguuagaaacuccgaaucuagccgaacgagugcuggacuggcuugagaaauaugguguagagaggcuuaaaagaauggcaauaucaggagaugauuguguugucaaaccaauagaugauagguuugcgaccgcauuaaccgcucuaaaugauaugggaaaaguaagaaaagauauaccccagugggaaccaaguaagggauggaaugacuggcaacagguacccuuuuguagucaucacuuucaccaguuaaucaugaaagacggacgagagauaguugugccuuguaggaaccaagacgaguuaguuggucgagcucgcguaagccaaggggcgggauggagucucagagaaacugcaugcuuaggaaaaaguuaugcucaaauguggcaauuaauguacuuucauagacgugaccuuaggcuagccgcaaacgccauauguucugccguaccuguggacuggguaccuacaucacguacuacauggucuauacaugcucaucaccaauggaugacgacagaagauaugcuuucgguuuggaaccgagucuggaucgaagaaaauccauggauggaagauaaaacgcaugugagcaguuggggagaugucccuuauuugggcaaacgagaagaccaauggugcggaucucuaaucggccuuacagcaagagcuaccugggcuagcaacauccaggucgcgauaaaccaaguuaggcggcugauaggaaacgaaaacuauuuagauuacaugacaucaaugaaaagguucaaaaacgaaggugaccccgaaggugcucuuugguag

SEQ ID NO: 21847 - RNA, 9879 nt, Artificial Sequence
  derived and/or modified CDS sequence (opt6) from DENV-1__GU131777__SS-prME
aguguaacgaugcuauugauguuaaugccaacugcacuagcauuccacuuaacuacucgaggaggggaaccacacaugauugucucuaaacaagaaagggggaaaucuuugcuauucaaaacuagcgccggaguuaacaugugcacucuaauugcaauggaccucggagaacuuugcgaagacacaaugacuuauaaauguccuaggauaacagaaacggaacccgaugacgucgauuguugguguaacgcaacggacaccugggugacuuacggaaccugcucgcaaaccggcgaacaucgacgggauaaacgaucaguagcacuugcaccccauguuggucugggacuggaaacuagaacugaaaccuggaugaguucugaaggggcauggaaacaaauacaaagaguagaaaccugggccuuaaggcaucccgguuuuacgguaauugcucuauuccuagcgcaugcaauaggaacgucaaucacacaaaaaggaauaauauuuaucuuauuaauguuaguuacgccaucgauggcgaugcgauguguaggaauuggaagucgagacuuugucgaaggucucaguggggccacgugggucgauguuguuuuagaacacgggaguugcguaaccacgauggcuaaagauaaacccacacuugauauagaacuucuaaaaacagagguuacaaaucccgcgauucuaaggaaacuguguauugaggccaaaauaagcaauacaacgaccgauagccgcuguccuacucagggugaggcuacucucguagaagaacaggaugcgaauuuugucugccgacgaacauuugucgacagagguugggguaacggauguggauuauucggaaaaggcaguuugauaaccugugcgaaauucaaaugugucacgaaacucgaaggcaaaauuguacaauaugaaaaucugaaauacuccguaaucgugacuguacauacaggagaccaacaucaaguaggaaaugaaaguacggagcauggaacaacugcaacaauaacaccgcaggcaccaacuacagagauccaacuuacagacuauggugcuuuaacgcuggauugcucgccaaggacuggguuagacuucaaugagaugguuuuacugacuaugaaagaaaagucaugguugguacacaaacagugguuuuuagaucucccacuuccuuggacgaguggagcaaguacuucucaagaaaccuggaauaggcaagaucuccugguaacguuuaaaaccgcccaugcuaagaaacaagaagucguuguauuaggcagccaggaaggugccaugcauacagcauuaacaggugccacagaaauucaaacaucagggacaacaacuauauucgccggacaucuaaaaugucgucucaaaauggauaaauuaacgcuuaaaggaauguccuacguuaugugcaccggaucauuuaaacucgaaaaggaaguggcagaaacacaacacgggacaguauugguucaaauaaaauaugagggaacugaugccccauguaaaauuccauuuucuacacaagaugaaaaaggcguaacacagaaugggcgucuaauuacagcgaacccuauugugacggacaaggaaaaaccaguaaacauugaggcggagccaccauucggagaaucguauauuguuaucggggccggugaaaaagcucuuaaacuaucuugguuuaaaaagggcucaaguaucggcaagauguucgaagccacagcgcguggagcacgaagaauggcgaucuuaggugacaccgcuugggauuucggaaguauagguggugucuucacuucgguuggcaaguuaguucaccagauauucggaacugccuacggaguuuuauucagugguguaaguuggacuaugaaaaucggaaucggagucuuauuaacauggcuaggccuaaauucaaggagcacuucccugagcaugacauguauagcgguuggacuuguaacguuguaucuagggguaauggugcaggccgacagcggaugcguuauaaacuggaaaggaagagaacugaaaugcggaagcggcaucuuuguuacaaacgaaguucacacuuggacagagcaguacaaauuucaagcggauucgccuaagcgauuguccgccgcuauugggaaagcaugggaagagggaguaugcggaauacggagcgccacaagguuggaaaacauuauguggaagcaaauaagcaacgaacuaaaucauauauuauuagaaaacgauaugaaauucacggugguaguaggagauguugcaggcauccuggcacaaggaaagaaaaugauuagaccucagccaauggaguacaaguacucauggaaaagcugggguaaagcaaagaucauuggcgcagacguucagaacacgacauucauaauugauggaccaaauacaccagaaugccccgacgaucagagagcuuggaauauaugggaaguggaagauuacgguuuugguauuuuuaccacaaauauuuggcuuaaauuacgugauucauauacacagguaugcgaccacagguuaaugucggcagcgauuaaagacucaaaagcugugcacgccgacaugggauauuggauagaaucugaaaagaaugaaacauggaaguuagcacgggcuucuuucauugaggucaaaacuuguauauggccgaagucacauacucuauggucaaacggagugcucgaaucugagaugaucauuccuaaaauauacggcgguccgauuucacaacacaauuauagaccuggauacuuuacucagacagccggcccguggcauuuaggcaaacuagaauuagauuuugauuugugcgagggcacgacuguggugguugaugaacauugcgggaaucgaggaccaucuuuacggacaacaacaguuaccgguaagauaauucacgaauggugcuguagauccuguacucuuccaccguuaagauuucgaggcgaggaugguuguugguaugguauggaaauucgaccuguuaaagaaaaagaagaaaaucuugucaaaaguaugguaucagccgguucaggagaagucgacagcuuuaguuuaggucuauuauguaucuccauuaugauagaagagguaaugagaucacgcuggucgcggaaaauguugaugacagguacucuggcuguauuuuuacuacuaauaauggggcaacuaacauggaaugaucuaauccgucucuguauaaugguaggggcaaacgcgagugauagaaugggaaugggcacaacauaucucgccuugauggcuacguuuaaaaugaggccaauguuugcaguaggcuuauuauuuaggcgcuuaacaagucgagaaguccuacuuuuaacaauugguuuaaguuugguagcuaguguagaauuaccgaauaguuuagaagaguuaggggauggacucgcaauggguauaaugauacuaaaacucuuaacagauuuccagagucaccaauuaugggccacucuucuuucucugacauucauuaagacaacguuuucucuacauuaugccuggaaaacgauggcaaugguccuaucgaucguaucccuuuuuccccucugucugucuacaacgucucagaaaacuacaugguugccuguacuauugggaucguugggcugcaaaccacugacaauguuuuuaauagcggagaauaaaauauggggaagacguagcuggccucuaaacgaaggaauuauggcaguaggcauuguaagcauucuacucucaagccuauuaaagaaugauguaccccuagcaggcccuuuaaucgcaggagguauguuaauagcgugcuacguuauaaguggaucaagcgcagauuugagcuuagaaaaagcagcugaagugucgugggaagaggaagcugaacacucaggagcaucucacaacauccuaguagagguucaagaugauggaacaaugaaaauaaaagaugaggaaagggaugauacccuaaccauccuacuuaaagcuacauuacuagcuauaagugguguauacccacuaaguaucccugcaacgcuauucgugugguacuucuggcaaaagaagaaacaacggaguggcguuuuaugggacacuccaucaccacccgagguggaacgcgcaguccuagaugacggcauauaucggauaaugcaacgaggacuguuaggacgcucacaaguagguguaggggucuuccaagaaaacgucuuccauacaauguggcacgucacaaggggcgcaguacuuauguaccaagguaagcgacucgaacccagcugggcgucugucaagaaagaccuaauuagcuaugguggaggcuggcgacuacaaggaucauggaauacuggggaagagguccaagugaucgccguagaaccaggcaaaaaccccaaaaauguccaaacaacaccaggaaccuuuaaaaccccugaaggugagguaggagcuauugcacuagauuucaaaccagggacaucuggauccccgauaguaaacagagaaggaaaaaucguaggauuguauggaaacggggucguaacaaccuccgguacguacgugagugccaucgcacaagccaaggcaucucaagagggcccguuaccugaaauagaggacgaaguuuuuagaaaaagaaauuuaaccauuauggaccuucauccugggagcgguaagacaagaagauauuugccagcuauuguaagagaagccauuaaacgaaaacuccgaacacuaauccucgcuccaacaagaguaguugcaagugaaauggcagaagccuuaaaggggaugcccauccguuaucaaacaacagcaguuaagagcgaacauacaggaaaagaaauuguugaccuaaugugccaugcaaccuucaccaugagacuacugagcccuguccguguaccuaauuauaacaugauuaucauggaugaagcucauuucacugauccaaguucuauagcagcacgaggcuauauuucaacuaggguagggaugggagaagcugcagcaauauucaugacagccacuccaccuggaucaguugaggcguuuccacaaucaaaugcagucauucaagacgaggaacgagauauaccggaaagaucauggaacagcggauacgaguggaucacagauuuuccgggcaaaacaguuugguucguaccaagcauuaaaagcggcaaugauauugcgaauugccucagaaagaacggaaaaaggguuauacaauuaagucggaaaacauucgacacggaauaucagaaaaccaaaaauaacgacugggauuacguaguuacgacagauauuucugaaaugggggcuaacuuccgagcagacaggguuauagacccaagacgaugcuuaaaaccaguaauacuaaaagaugggcccgaaagagucauucuugcagguccgaugccugucacgguggcauccgcugcgcaacgaagaggacgaaucggucgcaaucacaauaaggaaggugaucaauauauauacaugggccaaccguuaaacaacgaugaagaucaugcgcacuggacggaagcaaaaaugcucuuagauaacaucaauacaccagagggaauuaucccugcauuauuugaaccagaaagggagaaaagcgcugcuauagauggugaauauagauuacgcggugaggcuagaaagacguuuguagaauuaaugagaagaggggaucucccaguauggcuuagcuauaaggucgccuccgaaggauuccaguauucggacaggcgaugguguuucgauggcgaaaggaauaaucaagugcuagaagaaaacauggacguagagauauggaccaaggaaggcgaaaggaagaaauugcgcccacgguggcuagacgcgaggacauacagugacccacuagcgcuuagagaauuuaaggaguucgccgcgggccgaagaucgguaagcggggaccuaauccuagaaauaggaaagcugccgcagcauuuaacacagcgcgcucaaaaugcguuggauaaucuggugaugcuucauaauucugagcaagggggccgcgcauaccggcacgccauggaagaacuaccagauacaaucgaaacauugauguuacuugcccugaucgcaguauuaacgggagguguuacacuauucuuuuuaagcggaagggguuuggggaagacuagcaucggguuacuguguguuauggcauccucuguguuacuauggauggcaagcguggaaccgcacuggauagccgccucaaucauucuugaguucuuucuaauggugcuacuaauaccugaaccugacagacaacgcacgccccaagauaaucaacuugccuauguuguaauugguuuacucuucaugauuuugaccgucgcagcaaaugaaaugggccuccuagaaacaacuaagaaagaccuagggaucggacauguugccgucggaaaccaucaccaugcagcaaugcuagauguagauuugcacccagccagugcauggacgcucuacgcaguagcaacaacgauaaucacucccaugaugcgacauacgaucgagaauacuaccgccaacauaucauugacggcaauagccaaccaagcagcaauauuaaugggucuagauaaaggguggccaauaucaaaaauggacauuggaguuccccuauuggcacucggaugcuauucacaagucaauccacuaacauuaacggcggcaguucuaaugcucgucgcgcauuacgcaaucaucggaccgggacuccaagcaaaagcgacuagagaagcacagaaaaggaccgccgcgggaauaaugaagaacccuacuguagaugguauaguagcaauugaucuagauccaguuguuuaugaugcuaaauucgagaagcaguuagggcaaaucauguuauuaauauuaugcacgagucaaauauuauugaugaggaccaccugggcauuaugugagucaauaacucuugcaacugguccccuaacaacucucugggaagguagccccgggaaauuuuggaauacuacuauagcaguaucaauggcuaacauuuuuagagguucauaucuggcgggagcggggcuagccuucucauuaaugaagucccuggguggcgggagaaggggaacuggggcacaaggugaaacgcuaggcgaaaaauggaaacgacaacuaaaccaauuaagcaaaagugaguucaauacguacaaacgaaguggaaucauggagguggacagaagcgaagcuaaagaaggucuaaaaaggggagaaacuacuaaacaugcgguaucaagagguacugcaaaacuacgcugguucguagaaagaaaccuaguaaaacccgaagguaaaguaaucgaucuagguuguggaagagguggauggucuuauuacugcgccggguuaaagaaagucacagaaguaaaaggcuauaccaaagguggaccuggacaugaagaaccaauuccuauggccacguacggauggaauuuagugaaacuucauagugguaaagacguguuuuucauuccuccagaaaaaugugacacacuauuaugugauaucggcgaguccucacccaacccaacaauugaagaagguagaacacuaagaguuuuaaagauggucgaaccuuggcuaaggggaaaccaauuuugcauaaagauuuuaaacccauauaugccaagcguuguggagacacucgaacagaugcaaagaaaacauggagggaugcucguuagaaauccauuaucucgaaauuccacacacgaaauguacugggugucuuguggaacagguaauauaguaagugcaguaaauaugacuagccgcauguuacucaaccgauuuacaauggcgcaucggaaacccacauacgaaagagacgucgaucucggggcaggaacucgacacguagcaguagagccagaagucgcaaauuuggauaucauaggacaaaggauugaaaacauaaagcaugaacauaaaucuacauggcauuacgaugaagacaauccauacaaaacaugggcuuaucauggaucauacgaagugaaaccaagcggaagcgcgucaucaaugguaaaugguguaguaaagcuauuaacuaagccaugggauguuaucccuauggugacccagauagcaaugacagauaccacaccauuuggucaacagagagucuucaaagaaaagguagauacuagaacucccaaagcgaagcgaggcacugcacagauaauggaaguaacagcgaaauggcugugggguuuccugucacguaauaagaaaccaagaauauguacuagagaagaguucacccgaaaaguaagaaguaacgcggcaauuggggcaguguuuguugacgagaaucaauggaacagugcuaaagaggcaguggaggaugaaagauucugggaccugguucaucgagagagagaauuacacaaacaagggaaaugcgcaacuuguguauauaauaugauggguaagcgagagaagaaauugggagaguucgguaaagcaaaagggucaagagccauaugguauaugugguuaggcgcaagauuuuuagaguuugaagcacuagguuucaugaacgaagaccauugguuuucaagagaaaauucuuuaaguggaguggaaggugaaggcuugcauaagcugggcuauauauuacgcgacauaaguaaaauaccaggugguaauauguaugccgaugacacagcaggaugggauacuagaauaacugaagaugauuuacagaacgaagcaagaaucaccgauauuauggagccagagcaugcguuauuagccaaaucgauauucaaguuaaccuaucaaaauaaagugguaagaguccagagaccggcaaagaacggaaccguuauggauguaauaaguaggagagaucaaagggggucaggccaaguugguaccuauggauugaauacuuucacgaauauggaggcgcaguuaauaagacaaauggaaucugaaggaauauuuucgccaucagaacuagaaaccccgaaucucgcugagagaguguuagauugguuggagaaguacgguguagaaaggcugaagagaauggcgauuaguggagacgauugcgucgugaaaccaaucgacgaccgauucgccacagcgcuaacagcacuuaacgauaugggaaaaguucguaaagauauaccucaaugggaaccaucaaaggguuggaaugauuggcaacaagucccauucugcucucaccauuuucaucaauuaauuaugaaagacgggagggaaauaguggugccaugucgaaaccaagaugaauugguaggccgugcucgaguaagccaaggugcaggauggucccuaagagaaaccgcgugcuuaggcaaguccuacgcccaaauguggcaacuaauguacuuccauaggagagacuuaaggcuggcagcgaaugccauauguagcgcugugccaguagauuggauaccgacaagucguaccaccuggagcauacacgcucaucaccaguggaugacuacggaagauaugcuaucggucuggaauaggguauggaucgaagaaaauccuuggauggaggauaaaacccacauaucaucauggggagauguaccauauuuagggaagagagaagaucaauggugugguagcuuaaucggccuaacagcaagagcaacuugggcaacaaacauacaaguagcuaucaaccaaguuagaagguugauugguaaugagaacuauuuagauuauaugacgucuaugaaaagauuuaagaaugaaucagauccagaaggcgcuuuaugguaa

SEQ ID NO: 21848 - RNA, 9879 nt, Artificial Sequence
  derived and/or modified CDS sequence (opt6) from DENV-1__GU131778__SS-prME
ucgguuacgaugcuccugauguuaaugccaacugcguuagcguuucacuuaacuacuagaggaggugaaccgcacaugaucgucucuaaacaggaacgaggaaagucucuauuauuuaagacuagcgcaggagucaauaugugcacucuuauagcuauggaucuaggcgaauuuugugaagauacaaugacuuacaaaugucccaggauaacagaagcagaaccagaugacguagacugcuggugcaaugcaacagauacguggguuaccuaugguacuuguucucagaccggugaacacaggcgagauaaacgaucaguugcgcucgcaccucaugugggacucggacuagagacacguaccgaaacuuggaugaguucggaaggagcauggaagcagauccagcgaguggagaccugggcacuacgacacccuggguuuaccguaauagcucuauuuuuggcacaugccauuggaacgucaauaacccaaaagggaaucauauucauuuuauuaauguuagucaccccuagcauggcgaugcguuguguagguauagggucacgugacuuuguggagggauuaucaggugcuaccugggucgacguaguguuagaacaugguagcugcgugacaacuauggcaaaagacaaaccaacauuggauauugaguugcucaaaacagaagugacaaauccagcaguacucagaaaguuguguauugaagcuaaaauaucaaacacaacuacagauucacgauguccaacucagggcgaagccacauuaguugaagaacaagaugcaaacuuuguuugcagaagaaccuuuguugaucgagguugggguaauggaugugguuuauucggaaaagguaguuuaauaaccugugcaaaauuuaaauguguaacaaaacuagaaggcaaaaccguccaauacgaaaauuuaaaauacagcgucauuguaaccguacacacgggagaccaacaucaaguaggcaacgaguccaccgaacaugguaccacugcuacaauaacaccgcaagcaccgaguacugaaauccaacuaacagauuacggggcuuuaaccuuagauuguagcccacgaacgggauuagacuuuaaugagauggugcuacugaccaugaaagagaaaaguugguugguacauaaacaaugguuccucgaccugccauuaccauggacaaguggugcaaguacuucucaagaaacauggaaccgaaaagacuuacucguaacuuuuaaaacagcacaugcuaaaaagcaagaaguaguaguucuaggaucucaggaaggagccaugcauacugcauuaacaggugcaacagaaauucaaacuagugggacuacgacaauuuucgcagggcacuuaaaaugucgucuuaaaauggauaaauuaacucucaaaggaaugucguacguuaugugcaccggcaguuuuaaauuagaaaaggaagucgcagaaacacaacauggaacgguacucgugcagauaaaauaugaagguacagaugcuccuuguaaaaucccauuuucaacacaggacgaaaagggugucacucagaacgggagauugauaacagcaaauccuauagucacggauaaagaaaagccggugaacauagaagccgaaccaccuuucggugagagcuacauagugauaggugcgggagagaaagcccucaaacuuucuugguucaaaaagggaucgaguaucggcaaaauguucgaagcuaccgcgcguggagcccguagaauggccauacuuggcgauacagccugggacuucgggucuauaggggguguauuuaccuccguagggaagcucguucaccaaauauucgggacggcuuauggggucuuauucagcggcguuucuuggacaaugaaaauaggcauaggaguauuacuaacgugguuaggcuuaaacucuagguccacguccuuaucaaugacauguauagcaguugggcuugugacauuauauuuaggcguaaugguacaagcggauagcgggugcguuaucaauuggaaaggaagagagcuuaaaugugguagcgggauauuuguuacuaaugaaguccacaccuggaccgaacaguacaaauuccaagcagauagcccaaaacgucucuccgcugcgaucggaaaagcgugggaagaaggaguaugcggcauacgaucugccacucgauuagaaaacaucauguggaaacaaauuaguaaugagcuuaaccauauccuauuagagaaugacaugaaguuuacagugguagugggggauguggcaggaauacuagcgcagggaaaaaagaugauaagaccgcaaccaauggaauauaaauauucuuggaagaguuggggaaaagcaaagauaauaggagcugaugugcaaaauacaacauucauuauagacggaccuaauacgccggaaugcccggaugaucaacgagcauggaauauaugggaaguagaggacuauggauuuggaauauuuacuacgaauauuuggcuaaagcuccgagauucauacacgcagguaugugaccaucgucugaugagugcagcuauaaaagacagcaaagcaguacaugccgauaugggguacuggauagagucagaaaaaaacgaaacauggaaauuagcgagagcguccuuuauugaagugaaaacuugcaucuggcccagaagccacaccuuguggucuaacggaguccuagaaagcgaaaugauaauaccaaaaauauauggcggcccuauuagucaacacaauuauagaccaggcuauuucacacagaccgcagggccguggcaccuaggaaaauuagaacuagauuuugaucuuugugaaggaaccacaguaguugucgaugaacauugugguaaucggggacccucgcuacggacgaccacuguaacagguaaaauuauccacgaaugguguugccguucguguacacuaccucccuuaagguuuaaaggugaagacggcugcugguacgggauggagauaagaccggucaaggaaaaagaagaaaaucuugucaaaagcaugguaucugcaggaaguggggaaguggacaguuuuucgcuugggcuacuuuguauaagcauuaugauagaggaaguuaugcgauccagauggucccggaaaaugcuuaugacagguacacuugcaguguuuuuuuuacuaauaauggggcaacuaacuuggaaugaccugaucagguuaugcauaauggugggcgcaaacgccuccgaucggauggguauggguacaacuuaccuagcuuugauggcaacauuuaaaaugaggccaauguuugcgguaggcuuacuuuucaggaggcuuacaaguagggagguacuauugcuuacgaucggacuauccuuaguagcaucaguugaacuaccuaauucgcuugaagaacugggagauggacuugcaauggguauuaugaucuuaaaauuacuaacugauuuccaaucucaccaguugugggcaacuuuacuaucauuaacguucauuaaaacaacauucagccuacauuacgcauggaaaacaauggccaugguacuaaguauagucucacucuuuccauuaugcuuaagcacaacaucacaaaaaacuaccugguuaccuguccuccugggaagcuuaggauguaagccacuaacgauguuucucauagcagaaaauaaaaucuggggaagaaagucauggccauuaaaugaaggaauaauggcgguaggaauagugaguauauuacuuagcuccuuguuaaaaaacgauguaccguuagccgguccgcuuauugcuggaggaaugcuuauugcgugcuaugucauauccggaucaucggcagaccuuucccuagaaaaagcugccgaaguaucuugggaagaagaagcagaacacaguggugccucacacaauauucucguugaaguacaagacgauggaacgaugaaaauaaaagaugaagagagagaugacacacuaacaauacucuuaaaagccacuuuacuagcaguaagcggaguguacccacuauccauaccugcuacucucuucguuugguauuuuuggcaaaaaaagaagcaacguucaggaguacugugggacauaccaucacccccugaagucgaaagagcaguacuagaugacgggauuuaucgcauuaugcaaagggggcuccuagggcgaucccaaguugguguugguguuuuccaggagaacguuuuccacaccauguggcacgucacuagaggugcaguacucauguaccaggguaaaaggcuugaaccuuccugggcuucgguaaagaaagaccuaauaucauacggagguggguggcgcuuacaaggaucuuggaauacaggagaagaaguacagguaauugcuguggagccuggaaaaaacccaaagaacguacaaacggcaccugggacuuuuaaaacgucagagggagaagugggcgcuaucgcuuuggacuuuaaaccaggaacuuccgggaguccuauaguaaaucgagaggggaaaauuguugguuuauacggaaacggagucguaacaacaagugguacguauguuucagcaauagcacaagcuaaggcuagucaagagggaccacuaccagaaauagaagaugaaguauuuaggaagaggaaucuuacuaucauggaccuacauccuggcuccgggaaaacaaggagauaucuaccagcaauaguaagggaagcuaucaaaagaaaacucagaacauugaucuuggcaccaacucgagucguagccucugaaauggcugaagccuuaaaaggaaugccaauaagguaucagaccacagcuguuaaaagugagcauacaggaaaagagauaguagauuuaaugugucaugcaacuuuuacgaugagguuacucaguccuguuagagucccaaacuacaacaugauaauuauggacgaagcccacuuuacagacccaucauccauugcagcuagagguuacauaagcacaagaguggguaugggagaagcagcagcaauuuuuaugacugcaacuccucccgguucuguugaggcuuuuccucaaaguaaugccgucauucaagacgaagagagagauauaccugaacgcucauggaauagcggguaugaauggauuacagauuuuccgggaaagacugucugguuugugccaucgauaaagucagggaaugauauagccaacugccugagaaagaacggaaaaagaguuauacaacuuaguagaaaaacguucgauacggaauaccaaaagacgaagaauaacgacugggauuacguuguuacaacagauauaucugaaaugggugcaaauuuucgagcugacagagucauagacccccgaaggugucuaaagccuguaaucuugaaggauggcccggaaagaguuauucuagcuggucccaugccaguaacgguagcuucagccgcgcagagacgaggcaggauagggaggaaucauaauaaagaaggagaucaauauauauauaugggucaaccacugaacaaugacgaagaccaugcacacuggacagaagcuaagaugcuccuagacaauauuaacacacccgaagggauaauuccugcguuauucgaaccagaacgggaaaagucugccgcaauagauggagaauauagacucagaggagaagcgaggaagacguuuguggaacuaaugcgcagaggggacuuaccugucuggcuaucuuacaagguagcgucggaaggauuccaauauucggauaggagauggugcuucgauggggaaaggaauaaucaaguguuggaagaaaacauggauguagaaauuuggaccaaagaaggggaacguaaaaaacugaggccuagguggcucgaugcaagaacauacuccgauccauuagccuuaagggaauuuaaggaauuugcagccggcagaagaucaguaucaggugaucugaucuuagaaauagguaagcugccccaacauuuaacgcaaagagcacagaacgcucuggauaacuuggugauguuacauaacagcgaacaagggggucgagccuauagacacgcgauggaagaauuaccagacacaaucgaaaccuugauguuacuagcgcucauagccguguuaacgggaggcguuacguuauuuuucuugagcggaagaggccugggaaaaacaagcauaggucuauuaugcguaauggcaaguagcguauuauuguggauggcaucuguugaaccgcacuggaucgcagcgucaaucauauuggaauuuuuuuugaugguauugcuuauuccagaaccagauaggcaaagaacuccacaagauaaucagcucgcuuaugucguaauaggauuauuauucaugauucugacaguugcggcuaacgaaaugggccuacuagaaacaacaaagaaagacuugggaaucggccauguagcaguagaaaaccaccaucacgcugccaugcuagauguugaucuacauccagcaagugcauggacuuuguaugcugucgcaacaacaauuaucacaccaaugaugaggcauacaaucgaaaauaccaccgcaaacauaucacugacggcgauagcuaaucaagcagcuauucugauggguuuagacaagggauggccaauuagcaaaauggacauaggcguuccgcuguuagcccuuggauguuauagccagguaaauccguuaacacuaacggcagccguccucaugcuaguugcccacuacgcaauaauagguccagguuuacaagcgaaagcuacgcgagaggcccaaaaaagaacagccgcaggaauaaugaaaaaccccaccguugauggaauaguagccauagaccuagauccuguaguuuacgaugcuaaauuugaaaagcaguugggucaaauaauguuacugauccuguguacaucucagauccuauuaaugagaacgacaugggcguugugcgaaucgaucacauuagccaccggaccgcugacgacacuuugggaggggucuccaggaaaauuuuggaauacaacaauagcggucucaauggcgaauauauucagggguuccuaucuugcgggugcaggacuggcuuuuucgcuuaugaaaucacucggggguggucgaaggggcacgggggcccaaggugaaacauuaggagaaaaauggaagcgucaacucaaucagcuaucuaaaagcgaauucaauacauacaaaagaagugguauaauggaagucgacaggagcgaagccaaggaaggguuaaagaggggugaaacgacgaaacaugcagucuccagaggaacugccaaguuacgaugguucguagagagaaacuuaguaaaaccagaaggcaaaguuauagaucuggguuguggaaggggugguuggaguuauuauugugcaggcuugaaaaaaguaacggaagugaaaggcuacacgaaagguggcccaggucaugaggaaccaaucccuauggcaacuuacgguuggaaccuagugaaacuacauucaggcaaagacguuuuuuuuaucccacccgagaaaugugauaccuuguugugcgacauaggggaaucauccccuaacccuacuauugaagaaggacguacccuaagagucuuaaaaaugguugaaccuuggcuucgugggaaucaauucugcauaaaaauuuugaacccuuacaugccgucaguuguagaaacccuagaacaaaugcaaaggaagcaugggggcauguuggugcgaaacccucuuucgcgaaacucgacucacgaaauguacuggguuucuugcgggacaggcaauauugucucugcaguaaacaugacaucgagaaugcuccugaauagguucacgauggcacauagaaagccaacuuacgaaagagacguugaccuuggcgcaggaacaagacauguggcgguagaaccugaaguugccaacuuagauauaauaggacaacgaauagaaaacauaaagcacgaacacaaguccacauggcacuaugaugaggauaaccccuauaaaacuugggccuaucacggaagcuacgaaguaaaaccuucaggauccgccaguaguaugguaaaugggguaguaaaacugcugacaaaacccugggauguaauaccuauggugacacaaaucgcuaugacugauacaacuccauuuggacaacaaagaguauucaaagagaaaguagauacgagaacgccuaaagcaaagagaggcacugcgcaaauaauggaagucacggcgaaguggcuguggggauuccuaagcaggaacaaaaaaccaagaauauguacgagagaagaauuuacacgaaagguaagaucaaacgcagcuauaggugcaguauuuguagacgagaaucaauggaauucagcaaaggaagcgguugaagaugagagauuuugggauuuaguucauagagaaagagaauugcauaagcaaggaaagugcgcaaccuguguauauaauaugauggguaagcgagaaaaaaaauugggugaauuugggaaagcaaaaggaucacgcgccauuugguacauguggcucggagcuagauuuuuggaguuugaggcguuaggcuuuaugaaugaggaccacugguuuucacgagagaacagccuuucggguguagagggagaaggacuacauaaguuaggcuauauauuaagagacauaucaagaauaccugggggaaacauguacgcugaugauaccgcaggaugggauacuaggaucacugaggacgaucuacagaacgaagcuaaaauuacggauauaauggaaccugaacaugcuuuacuagcuaagucaauuuuuaaacugacuuaccagaacaagguaguccgaguacagcgaccugcaaaaaauggaacaguuauggacguaaucucucguagagaucagaggggaucaggucaagucggcaccuauggacuaaauacauuuacuaauauggaagcacaauuaauacgacaaauggaaucugaaggaaucuuuagcccaucagaauuagaaaccccaaaccucgccgggcgcguauuagauugguuggaaaagcauggaguugaacgucuaaagagaauggcaauaaguggugacgauuguguuguaaaacccauugacgacagauuugcaacugcacuaacggccuuaaacgacaugggaaaagugcggaaggauauuccucaaugggaaccaaguaaaggguggaacgauuggcaacaaguuccauuuugcucacaucacuuucaucaacuaauaaugaaagacggaagagagaucguaguaccgugccgaaaccaagacgaacucgucggaagggcuagaguuucacaaggggccggauggagucuccgcgaaacagcuugcuuaggaaagucuuacgcacaaauguggcaacuaauguauuuccauagaagagaucucagauuggcagccaacgcaauaugcucagcgguaccaguugacuggguuccuacaagcagaaccacauggucaauacacgcgcaccaucaauggaugacgacugaagacaugcugucgguauggaaccgaguauggauagaagagaauccauggauggaggauaaaacccauauuagcuccuggggugaugucccuuauuuagguaaaagggaagaucaaugguguggaucccuaaucggucucacugcccgugccaccugggccacuaauauacaggucgcuauuaaccaagucagacgccuaauaggaaaugagaauuaucuugacuauaugacaucuaugaaacgauucaaaaacgaaucagauccggaaggggcucuaugguaa

SEQ ID NO: 21849 - RNA, 9879 nt, Artificial Sequence
  derived and/or modified CDS sequence (opt6) from DENV-1__GU131779__SS-prME
uccgugacgauguuacuuaugcuuaugccaacggcacuagcguuccacuuaacuacuaggggaggagaaccacauaugaucguuucuaaacaagaacgaggaaagagcuuauuauuuaaaacuucugcaggaguuaacaugugcaccuuaauagcuauggauuuaggagaacuaugcgaagauacuaugacuuacaaauguccacggauuacagaaaccgagccagacgacguggauuguuggugcaacgcaacggauacguggguaacauacgguacuuguucacaaacuggagaacaccgaagagauaaacgaucaguugcuuuagcuccacauguaggucucggguuggaaacaagaacagaaaccuggaugucaucugagggugcuuggaaacaaauccaaaggguugaaacaugggcguuaagacaccccggcuuuacaguaauugcuuuauuuuuagcucacgcuauaggcacguccaucacucaaaaagguaucauuuuuauccuccuaauguuggugacaccaucgauggcaaugagauguguuggaaucgguucacgugauuuugucgagggauuaaguggggcaacauggguagauguuguauuagaacauggaucgugcguaacuaccauggcaaaagacaaaccgacgcucgauaucgaauuacucaaaacugaggucacuaauccugccauacugagaaaauuaugcaucgaagcaaaaaucucaaacaccacaaccgacucaagguguccaacucaaggcgaagccacgcuuguggaagaacaagaugcuaacuuugucugcagacguacauuuguagaucgagguugggguaauggcuguggauuauucgguaaaggaagccugauuacaugugccaaauucaaauguguaacaaaauuggaagguaaaaucguacaauaugagaauuuaaaguauagcguaauaguuaccguccauacaggagaucaacaucaaguagggaaugaaaguacagaacacggcacuacagcuacaaucacaccacaagcacccacaacagaaauacaauuaaccgauuauggggcccugacacuugacuguuccccuagaaccggacuagacuucaaugaaaugguuuuacuaacuaugaaagaaaaaucuuggcuuguucacaagcagugguuucuugaccugccacuaccauggaccucgggugcauccacuucccaggaaacauggaaucgacaagaucuauuaguuacuuuuaaaaccgcacaugccaagaaacaggaaguagugguucuaggcagucaagaaggagcuaugcacaccgcucugacuggagcgacagaaauacagacaaguggaacaaccacaauuuuugcaggacaucuaaagugcagauugaaaauggauaaauuaacacuuaaaggaaugaguuauguaaugugcacggguucuuuuaagcucgagaaagaagucgcugaaacucaacauggcacaguccuaguucaaaucaaguaugaaggcacggaugcucccugcaaaauaccauucucuacgcaagacgaaaaagguguuacgcaaaacggucgguugauuaccgcgaauccaauaguuacugauaaagaaaagccaguaaauaucgaagcugaaccaccauuuggggagucuuauaucgugaucggagcgggagagaaagcccucaaacuuuccugguucaagaaagguaguagcauugguaaaauguuugaagcuacggcgcgaggagcacguagaauggccauacuaggggacacugcuugggauuucgguagcaucggaggaguuuucacgucggugggaaaacucguucaccagauuuuuggcacagcauacggcguauuguuuucaggaguaucuuggacuaugaagauuggaauaggaguuuugcuaacuuggcuugguuugaauaguagguccacaaguuugagcaugacguguauugcaguaggucugguaaccuuauaucuaggagugaugguucaggccgauaguggaugcguuaucaauuggaaaggaagagaacuaaaauguggaagugggauauuuguuacgaacgaaguccacacauggacugaacaauauaaguuucaggccgacucaccuaaaagacuuagugcugcgauugguaaggcuugggaggaagggguuugugggauacgaucagcaacaagacuagaaaauauuauguggaagcaaauuaguaaugaacuaaaucacauccuacuggaaaacgacaugaaauuuacagucguaguuggugauguagcugguauauuggcucaagguaagaaaaugauacgcccacaacccauggaauauaaauauagcuggaaaaguuggggaaaagcaaaaauaauaggggcggauguucaaaacaccacauucauuauagauggaccaaauacaccugaauguccagacgaccaacgagcguggaauaucugggagguagaagauuauggauucggcauauucacgaccaacauauggcuaaagcuccgcgacuccuacacucaagucugcgaucauagauuaauguccgcggccauaaaagauucuaaagcuguucacgcugacauggguuauuggaucgaaucagaaaagaaugaaacuuggaaacucgcaagagcgucauuuauugaaguuaagacaugcauauggccaaaaagucauacuuuguggagcaaugguguauuagaaagcgaaaugauuauuccgaagaucuauggagguccgauaucacaacacaauuauaggccugguuauuucacgcaaacagcugggcccuggcaucuggguaaauuagaacuugacuuugauuugugugaaggcaccacuguaguaguagacgagcacuguggaaacaggggacccucauuacgaacaacaacaguuacaggcaaaaucauccaugaauggugcugcagaagcuguacauuaccuccauugcgcuuucggggcgaagacggcugcugguaugggauggagauaagaccaguaaaagagaaggaagaaaacuuaguaaaaagcauggugucagcaggaaguggugagguugauucauuuagucuuggguuauuauguauaucgauuaugauagaagaaguaaugagaaguagauggaguagaaaaauguugaugacagguacgcuggcaguauuuuugcuguuaauaaugggccagcuaacauggaaugaccuaauacggcuaugcauaaugguaggcgcgaaugccucugaucggauggggaugggcacuacguaccuagcccuuauggcaacauucaaaaugagaccaauguuugcuguuggucuucuauuuagaaggcuuacaucaagagagguacugcuuuuaaccauaggacuaucacugguugugaguguagaauugccuaauucacuagaagaguuaggugacgguuuagcuaugggaauuaugauuuuaaaacuauugacugauuuucagucgcaucaacuuugggcgacauuguuaucacucacguuuauaaagaccacauucuccuuacauuaugcauggaagacgauggcaaugguuuuaagcaucgucucacuauucccuuugugucuuuccacuacaucgcagaaaacaaccuggcucccuguacuuuuagguagccuuggaugcaaaccccuaacuauguuccugauugcugagaauaaaauuugggggcgaaggucuuggccacuuaacgaaggaauuauggcugucggaaucguaucaauucuuuugucuagucuucuaaagaaugacguaccacuagcggguccucuaauagcugguggaauguuaauagccuguuauguaauuaguggaaguuccgcggaccuaaguuuagaaaaagcugcugaggucucgugggaagaagaagcagaacacucgggagcaucgcacaauaucuuggucgaagugcaagacgacgggacaaugaaaauaaaagacgaggagagagaugauaccuuaaccauucucuuaaaagcgacucuuuuggcaguuuccgguguguauccuuuaaguauccccgcaacucuguuuguaugguauuuuuggcagaaaaagaaacaaaggucgggaguacuaugggauacuccuucuccuccagaaguugaacgggcuguauuagaugaugguauuuaccgaauaaugcaacgaggacuauuaggaagaucucaagucggugucgggguuuuccaagaaaaugucuuccacacaauguggcacguaacacgcggcgcaguauugauguaucaagggaagagauuagagccaucuugggccuccguuaagaaagaucuuaucucauacgguggcggauggagauugcagggaucguggaauacaggagaagagguacaaguuaucgccguggagccuggcaaaaaucccaagaacguucaaacaacacccggcacauucaaaacuccugaaggugaagucggagcaauagcacuggauuucaaaccaggaacgagugguaguccuauaguaaauagggaaggaaaaauagugggacuauauggcaauggaguaguaacgacuagcggcaccuacguaucagcaauugcccaagccaaagcgagucaagagggaccuuuaccagagauagaagaugaagucuuuaggaagagaaacuuaacgauuauggaucuacaucccggcagcggaaaaacacguagauauuuaccagcaauuguucgagaagcaauaaagcguaagcuacgaacgcucaucuuagcaccgacacgcgugguagcgucggaaauggcggaggcacuuaaaggcaugccuauaagauaucaaaccacagccguaaaauccgaacauacagggaaagagauaguagaccuaaugugccaugcaacguuuacaaugaggcuuuuaucgccugugagaguaccaaauuacaauaugauaauaauggaugaagcacauuuuacagauccgagcucaauagcagcuagaggguacaucagcacacgugucggaaugggugaagcggccgcaauuuucaugaccgcaacaccacccggaucuguagaggcauucccccagagcaaugcaguaauacaggacgaagaaagagacauaccagaaaggucuuggaacucugguuacgaauggaucacagacuuucccggaaaaacaguaugguuuguuccgucaauaaaaucaggaaaugauauagcuaauuguuuaaggaaaaaugggaagcgaguaauucaguuaagccgaaaaacauucgauacagaguaucagaaaacgaaaaacaacgauugggacuacguuguaacaacugauauaucugaaaugggagcgaauuucagagcagaucgaguuauugacccgcgccgauguuugaagccuguaauauuaaaagacgggccggaacguguuauuuuagccgggccuaugcccguaacagucgcaucugcugcccagcgacguggcagaauaggccgcaaccacaauaaagaaggggaccaauauauauacauggggcaaccuuuaaauaaugaugaagaucacgcucauuggacagaagcuaaaauguuguuagacaacauaaacacaccugagggaauuauaccagcauuauucgaaccagaaagagagaaaagugcggcuauagauggagaauacagauugagaggagaagcaagaaaaacauucgucgaacuaaugagacgcggagauuuaccagucuggcuuagcuacaaagucgcguccgaggguuuucaauauucggaucgacgauggugcuuugacggagaacguaauaaucaaguacuagaggagaacauggacguugaaauauggacuaaagaaggagaaaggaagaaacuaagaccacgaugguuagacgcccgcacuuauucagauccguuagcacugagagaguuuaaagaauuugcagcagggcgcagaagcguaucaggugauuuaauccuugaaaucggcaaacucccgcaacauuuaacacaacgcgcucagaaugccuuagauaaccuaguaaugcuacacaauucggagcaaggagguagggcauaucgacaugcgauggaagaauuaccagauacuauagaaacuuugauguuguuagcccuaauugcuguccuuacgggugggguaaccuuauucuuucucaguggaaggggccugggcaaaacaaguauuggacuauuauguguaauggcuagcaguguacuacuguggauggcaucagucgaaccacacuggauagcagcuucgauuauccuagaauuuuucuugauggucuuacugaucccagaaccagacaggcaaagaaccccucaggauaaccaguuagccuaugugguuaucgguuuacuguuuaugauacucacgguugcggcaaaugaaaugggauuacuugaaaccacgaagaaggaucuuggcauuggacacguugcagucggcaaucaccaucacgcugcuaugcuugacguagauuuacaucccgcuuccgcauggacauuauaugcgguugcuaccacuaucauuacuccaaugaugagacauaccauagaaaauacgacggcuaauauaagccuuacggcuauugcaaaucaagcugccauacuaaugggacuggauaaagguuggccuauuucuaaaauggacauaggaguuccucuacuugcauugggaugcuacucacaagucaauccacuuacauuaaccgccgcaguauuaaugcuaguugcgcauuacgcaaucaucgguccaggacuucaagcuaaggcaacucgggaggcacagaaaagaacugcagcugguauuaugaaaaacccaaccguagacggaauaguagccauugauuuagacccaguaguauaugaugcaaaauuugaaaagcaauugggucaaaucaugcuauuaauucugugcaccagccaaauauuauuaaugagaacuacuugggcauuaugugaaucuauaaccuuggcgacggguccccucacaacauuaugggaggguaguccaggaaaguuuuggaacaccacuauugcggugaguauggcgaauaucuuccgaggcaguuacuuagcgggagcgggacuugcuuucagucuaaugaagaguuugggugggggacguagagguacuggcgcacaaggcgaaacauuaggggaaaaguggaagcgacaacuuaaucaauuaagcaaaagugaguucaauacuuauaaaagaagcgguauaauggagguagaucgaucggaagcaaaagaaggacuaaagcgcggcgaaacuacuaaacacgccguaucucgcggaaccgcuaaauuaagaugguucguggagcguaaccuagugaagccagaaggaaaagugauagauuuggguuguggacguggaggauggucauauuauugcgcaggucuuaagaaaguaacagaaguaaaaggguauacuaaagguggacccggacacgaggagccuauacccauggcuaccuaugguuggaaucuuguuaaacuucacucaggaaaagauguguuuuucauacccccugagaagugcgauacuuuacuaugugacauaggggagagcaguccgaaucccacuauugaggaagggagaacacuucguguccuaaagaugguggaaccuugguuacgcggaaaucaauuuugcauaaaaaucuuaaacccauacaugccauccgucguugaaacccuagagcaaaugcaaaggaaacauggagggauguuaguucggaacccuuuaucgagaaacaguacacacgaaauguauuggguuagcugugguaccggaaauauuguuucugcaguaaauaugacaucuagaaugcugcuuaacagauucacaauggcccaucguaagccgacuuaugaacgugauguugauuuaggcgccggaaccagacauguggcuguagaaccagaaguggcgaaccuagauaucauaggacaacggauagagaauauaaaacacgagcauaaaucuacuuggcauuaugaugaagauaauccuuauaaaacuugggcuuaccauggcucauaugaagucaaaccaagcgguucugcaaguucaauggucaauggugucgucaaauuacuaacaaaaccaugggacgucauaccaaugguaacacagauagcgaugacagacacuacaccuuuuggucaacaaagaguauucaaagagaaaguagauacccgaacaccuaaagcgaaacgaggcacagcccaaauaauggagguaacagcaaaaugguuauggggauuuuuaucucgaaacaagaaaccccgaauauguacccgugaagaauuuacacgcaagguacggucuaacgcagcaaucggugcgguauuugucgacgaaaaucaauggaacucagccaaagaagccguugaagacgaacgauucugggaucuuguacaccgugagcgagaauuacauaaacaaggaaaaugugcaacaugcgucuauaauaugaugggcaaaagagagaagaaauuaggagaauuuggaaaagcuaaaggaucacgggccauaugguauauguggcucggagcacguuuccuagaauuugaggcuuuagguuuuaugaaugaagaucauugguucagucgagaaaauucacuuuccggaguagaaggugaaggacuucacaaacuugguuacaucuuaagagacauaucuaaaauacccggugggaauauguacgcagacgacacugcaggcugggacacgcgaauuacagaggaugauuugcagaaugaagcucguauaacagauauaauggaaccagaacacgcgcuauuagcaaaaucgauauucaaacuuacuuaccagaauaaaguaguccgcguacagcgcccggccaaaaaugguacugucauggacguuauaucccgaagagaccaaaggggaagcggacaagucgguacauaugggcuaaacaccuuuacaaacauggaggcgcaauugauacgacaaauggagucagaaggcaucuucaguccaagcgaacuagaaacuccaaaucuagcagaaagaguacucgacugguuagaaaaguauggaguagaaagacuaaaacggauggcaauaaguggcgaugauugcgucguuaagccaauugacgauagguucgcuaccgcucuaacagcgcuaaaugauauggggaaggucaggaaagacauaccccaaugggaaccgucuaaaggauggaaugauuggcagcagguuccauucugcagccaucauuuucaucaguuaaucaugaaagauggaagagaaauagucguaccaugcagaaaucaagacgagcugguugguagagcccgagucagucaaggugcuggauggucccucagagagacagcauguuuagguaagucguaugcgcaaauguggcagcugauguacuuucauaggagagaucugagauuagcugcgaaugcgauuugcagcgcaguuccuguugauuggauaccaacaucaaggacaacauggaguauccaugcccaucaccaguggaugacaacugaagauaugcuaucggucuggaaccgagucuggauagaagaaaacccauggauggaagauaaaacccauauaucguccuggggagauguuccauauuuaggaaagagggaagaucaaugguguggcaguuuaauaggucuuacagcaagggcuaccugggcuacaaacauacaaguugcaauaaaccaaguacggagauuaauuggcaaugaaaacuaucuagacuacaugacaucuaugaaacgcuucaagaaugagagcgacccagagggugcauuaugguga

SEQ ID NO: 21850 - RNA, 9879 nt, Artificial Sequence
  derived and/or modified CDS sequence (opt6) from DENV-1__GU131780__SS-prME
agcguaacuauguuauuaauguugaugccaacggcacuugcuuuccaucuuacaacaagagggggagaaccacacaugauagucucgaaacaagaaagagguaaaagucuacuauuuaaaacaucggcgggcguaaauauguguacacuuauagcuauggacuuaggggaauuuugugaagauacaaugacuuacaaauguccaagaauaacggaagcugaaccagaugaugucgauuguugguguaaugcaacagauacuugggugacauacggaacauguagucaaaccggagaacacagaagagauaaaaggagcgucgcgcuggcgccacauguaggcuuaggguuagagaccaggacagaaaccuggaugucgucggagggcgcauggaaacaaauucaacguguugaaacaugggcacuuaggcacccgggauuuacuguaauagcccuauuuuuagcacaugccauaggaacuucuauaacacaaaaagggauuaucuuuauacuucugaugcuaguaacgccuucaauggcgaugcguugcgucgguauagguucuagagacuuugucgaaggauuaucaggcgcaacauggguagaugugguauuagaacauggaagcugcgucaccacgauggcaaaagauaaaccuacccuugacaucgaacuucucaagacugaggucacaaauccagcgguauugaggaaguuaugcauagaagcuaaaauaucaaacacuacaacagacucacgauguccaacccaaggggaagccacacucguggaagaacaagacgcaaauuuuguuugcagacgaacguuuguagaucgaggauggggcaauggcugcggguuguucgggaaaggaucauuaauaacaugugcgaaauucaaaugcgugaccaaauuagaaggaaaaacgguacaauaugaaaaucuaaaauacagugugauaguaaccguucacacaggagaccaacaucaggucgguaaugaaucgacggagcaugguacaacggcgacuauuacgccacaagcgccaaguaccgaaauccaauuaacugauuauggggcucugacucuagacugcucuccuagaacaggacuagauuuuaacgagaugguccuauuaacuaugaaagagaaaagcuggcuugugcauaagcaaugguuccucgaucuuccacuaccauggacuucgggggcuucaacaucccaagaaacauggaauagaaaagaucuauuaguuacauuuaagacugcacacgcgaagaaacaagaaguaguuguguuagguagucaagaaggugccaugcauaccgcacuaaccggagccaccgagauacaaaccaguggaacgacaacaaucuuuucuggccauuuaaaaugucgacuaaaaauggacaaguuaacguuaaaagggaugucuuauguaaugugcacgggaucuuuuaaauuagagaaggaaguugcagagacacaacacggaacaguauuaguccagaucaaauaugaggguacggaugcaccaugcaaaauaccauucagcacucaagaugaaaaaggaguuacucaaaaugggaggcuaauaacugccaacccgauaguaaccgauaaggaaaaaccggucaauaucgaggccgaacccccguuuggagaaucauauauugugaucggagcuggggaaaaggcacucaaacuuucaugguuuaagaaagguucaagcaucggaaaaauguucgaagcuacugcaagaggcgcaagacgaauggcaaucuuaggagacacagccugggacuucgggagcauagguggggucuuuacgucuguagguaaauuagugcaucaaauauucgggacugccuaugguguuuuauuuucaggcguuaguuggacuaugaagauagggauugggguucuauuaacuugguuaggauugaacucaagauccacuuccuuaucaaugaccugcauagcaguggguuuggucacgcuauauuugggaguaaugguucaggcugacagcggaugcguaauuaacuggaaaggccgggaacuaaaaugugguucagggauauucguuacuaaugagguccauacuuggacugagcaauauaaauuucaagccgacagccccaaaaggcucucagccgcaauugggaaggcuugggaagaagguguaugcggaaucagaagugcuacacgcuuagagaauaucauguggaaacaaauaucaaacgaacuaaaccauauauuacuagaaaaugacaugaaauuuacggucgugguuggggacgucgcaggaauauuggcacaaggcaagaaaaugauucgaccacaaccaauggaauacaaauauucuuggaaaucauggggaaaagcaaagauaauuggcgcugauguacaaaauacuacuuuuauaauagacgggccaaacacacccgaaugcccugaugaucaaagagcuuggaacaucugggagguggaagacuacgguuuuggcauuuucacuaccaacauaugguuaaaacuacgugauucuuacacccaaguaugugaccacagacuaaugucagcagcaauaaaagauaguaaagccguacaugccgacaugggcuacuggauagaaucagagaaaaaugagacauggaaauuagcgagagcaucuuucauagagguaaaaacauguaucuggccuaaaucacacacccuauggagcaacgguguucuggaaucagaaaugauuauaccaaaaaucuacgguggcccuaucucgcagcacaauuaucgccccggcuacuucacacaaacggcaggcccauggcaucuugggaagcuagaauuggacuucgaucuuugcgaaggaaccacuguugucguggaugaacacuguggaaaccgaggaccgagccuacgaaccaccacuguaacugguaagauaauacaugaaugguguugcaggaguuguacacuaccuccucucagguucaagggcgaggacggguguugguaugggauggaaauuagaccagucaaagaaaaagaagaaaacuuaguuaaaaguaugguaucagccgggucaggagagguugauucguucagucuuggccucuuauguaucaguauaaugauagaagaaguuaugagaucgagauggucgcgaaaaaugcuaaugacgggaacacucgcaguauuuuucuugcuaauuauggggcagcuaaccuggaaugauuugauaagguuaugcauaauggugggugcuaacgccagugacagaaugggcaugggcaccacauaccucgcccuaauggcuacuuuuaaaaugagaccuauguuugcaguaggauugcucuuuaggagacugacaaguagagaaguccucuugcuuaccauuggcuuaucauuaguugcaucugucgaauuacccaauagucuagaagaacuaggugacggauuagccaugggaauuaugauuuugaagcuauuaacagauuuucaaagucaucaauuaugggccacccuguuaagucucacuuuuauuaaaacaaccuucucauugcauuacgcauggaagacgauggccaugguauuaucaaucgugucucucuuuccacuuugccugucaacaacaucacaaaagacaacuuggcucccugucuuacucggaucauuagguuguaagccucuuacaauguuucuaaucgccgaaaauaaaaucuggggaagaaaaucauggccauugaaugagggcauuauggcuguuggaauaguuucaauauuauugaguucucuucuuaaaaaugacguuccgcuugcuggaccauugauugcaggcggaauguuaaucgcauguuacgugauuucuggcucgucggccgauuugucacuagagaaagcagcagagguaucaugggaagaagaagcagaacacucuggugcaagccacaauauccuaguugagguacaagacgauggaacaaugaaaauaaaagaugaagaaagagaugacacacuuacaauacuucuaaaagcuacauuacugacugucagcgguguguauccgcuuaguaucccagcaacauuauuuguaugguacuuuuggcagaagaagaaacaaagaaguggaguacuaugggauacgcccucaccaccuaaaguugaacgagcuguacuugaugauggcauauaccgaaucaugcaacguggacuacuggggcgaucacagguagguguuggaguuuuucaagagaaugucuuucauacgauguggcacguuacaagaggagcgguauuaauguaccaggguaagagauuagaaccaucaugggcaagugucaaaaaggaccuaaucuccuauggcggagguuggagacuacaagguucuuggaacacaggagaagaaguacaaguaauagcaguagaacccggcaaaaaucccaaaaacguacaaacagcuccaggcacauuuaagacaagugaaggagaaguuggugcaauagccuuagauuuuaaaccggguaccaguggaagcccuauaguaaaucgugaagguaagauuguuggauuauacggaaacggcguaguaaccacuucuggcacuuacguaagcgcuauagcccaagcaaaagcuagccaggaaggcccguuaccagaaauagaggacgaaguauuccguaaaaggaacuuaaccauuauggauuuacaucccggcaguggcaaaaccagaagguaccuaccagcgaucguacgagaagccaucaagagaaaauuaagaacauugaucuuagcaccgacacguguaguagcgucugaaauggcggaagcucuaaaggguaugccuauaagguaucaaacaacugcuguaaagucagaacacacgggaaaagagaucguugaucuaaugugccaugcgacauucacuaugagauuacuaucaccaguaagaguaccgaauuauaauaugauuauaauggaugaagcgcauuucacggauccuaguucgauugcagcaagaggauacauaagcacacgcgucgggaugggggaggcggccgcuauauuuaugacagcaacgcccccagggucuguagaggcauucccucaaagcaacgcaguaauacaagacgaagaaagagauaucccugaaagaaguuggaacucuggauacgaauggauaacggauuucccugggaaaacuguaugguucguaccgaguauaaaaucagggaaugauauugcuaauugucuaaggaaaaaugguaaaagaguaauucaacuuucucgaaaaacauucgauacugaguaccagaaaacuaagaacaacgauugggacuauguugucacuacagauauaucggagaugggagccaauuucagagcugaucguguaauugauccucguagaugccuaaagccagucauauuaaaagauggaccugaacguguuauauuagccggaccgaugccaguuacaguugcaucagcggcacaaaggagagguagaauaggcagaaaccauaauaaagaaggggaccaguacauuuacaugggccaaccauuaaacaacgaugaagaccaugcacacuggaccgaagcuaaaauguuacuagauaauauaaacacgccagaagggauuauaccagcucuguuugagccagaaagagagaaauccgcggcaaucgauggugaauaucguuugagaggcgaagcgaggaaaacauucguagagcuaaugcgaaggggagauuuaccaguaugguuauccuauaaaguagcuagugaaggcuuucaguacucugacaggaggugguguuucgauggggaacggaauaaccagguacuugaggagaauauggacguugaaauauggacgaaggaaggggaacggaagaaauugaggccuaggugguuagaugcuagaaccuacucugauccgcuggcccuaagagaauuuaaagaauuugcagcgggccgacguagcgucuccggugaccuuauccuagagauagguaaauuaccucaacaucuuacacaacgagcccaaaaugcacuagacaacuugguaaugcugcauaacucggaacagggaggcagagcauauaggcacgcuauggaggaauugccagauacuaucgaaacaaugauguuguuagcccuuauagcaguauuaacaggcgggguaacuuuguucuuuuugagcgguaggggacuuggaaagacaaguauaggccuacuauguguuauggcaucuagugugcuccuauggauggcaagcgucgaaccgcacuggauagcagcuucuauaaucuuagaguuuuuccuuaugguucucuuaauuccagaaccugaucgacagcgaacaccacaagacaaccagcucgcauaugucgugauugguuuauuguucaugauucucacuguagcagcuaaugaaauggggcuucuagaaacaacgaagaaggaccuagguauaggacauguagcuguugaaaaccaucaucaugcugcaauguuagauguugaccuccauccagccagugcauggacccuguaugcgguggcuacuacuauaauuaccccaaugaugaggcauacaauagagaauacaaccgccaauauuagcuugaccgcuauagcgaaucaggccgccauuuuaaugggucuagacaaaggguggccaauuucaaagauggauauuggagucccacuacuugcuuuaggcuguuacagccagguaaauccuuuaacuuuaaccgcagcgguauugauguugguagcacauuacgcgauaaucgguccaggauuacaagcaaaagcgacgcgggaggcgcagaaaagaacggcugcagggauaaugaaaaacccaacugucgacggcauuguagccauagaccucgauccagugguauaugaugccaaauuugaaaaacaauugggacaaauaauguuauugauauuauguacaagccaaauacuguugaugcguacgacaugggcauuaugugaaaguaucacacuagccaccgguccuuuaacaacucuuugggaagguucgccaggaaaauucuggaacacgacaauugcaguaaguauggcaaacaucuucagaggaucguacuuagcaggcgcaggacucgccuuuucauuaaugaaaucauuagggggcggaaggcgcggcaccggagcacaaggagaaacucuuggggagaaauggaagagacagcuuaaccaauuaaguaagucagaauuuaacaccuauaaaagaaguggcauuauggaagucgauagaucagaggcaaaagaaggccuaaaaagaggugagacuaccaaacaugccgucagccgaggaacugcaaaauuacguugguuuguugagagaaaucuagucaaaccagaaggaaaagugauagaccuaggaugugguagaggagguuggucauauuacugugcagggcucaagaaaguuacagaaguuaaaggauacacaaaaggagguccuggacaugaggaacccauaccuauggcgaccuacggauggaacuuagucaaacuacacaguggaaaggauguauucuuuauuccaccagaaaaaugugauacauuguuaugcgacauaggugagucaucgccaaauccgacaauagaagaaggacgaacauuaagggugcucaaaaugguagagcccugguuaagagggaaccaguuuugcauaaaaauauuaaaccccuacaugcccuccguuguggaaaccuuagaacaaaugcaacgaaaacauggaggaaugcuaguaagaaauccauugucaagaaauucaacccaugaaauguauuggguaaguugcgggacaggaaauauagucagugcuguaaauaugacuucucgcaugcuguuaaaucgauucaccauggcgcauaggaaaccaaccuaugaaagggacguugaucugggagccgggacacgacacguggcuguagagccggaaguugccaauuuagacauaaucggacaaagaaucgagaauaucaaacaugagcauaaaagcacuuggcauuaugaugaagauaacccauauaaaacgugggcauaucauggaucauaugaggucaaaccaucaggaucagcgaguaguaugguaaacgguguaguaaaacuucucacaaagcccugggacguaauaccgauggucacacagaucgcgaugaccgacaccacgccuuuuggccaacaacgaguauucaaggagaaaguugauacgagaacaccgaaagcaaagcgaggaacagcacagauaauggaaguuacggcgaaauggcuuuggggauuuuuaucccguaauaagaaaccacgaaucuguacuagagaagaauuuacgcgaaaggugagaaguaacgcagcgauaggcgccguauuuguggacgaaaaucaauggaauagugcuaaagaggcagucgaagaugagagauucugggaccuaguacaccgagaacgagaauuacauaaacaaggaaagugugcaacuuguguauacaauaugaugggaaaaagagagaagaaacuaggagaauuuggcaaagccaaaggcucaagggcaauaugguauauguggcugggggcuagauucuuagaauuugaagcccuuggguuuaugaacgaggaccacugguuuucucgcgaaaauucauuaucaggugucgaaggagaaggauugcacaagcucggauauaucuugagagauauaucgaaaauaccaggcgggaauauguaugccgaugacacagcagggugggacacacgcauaacagaagaugacuuacaaaaugaagcaaaaauaacugacauaauggaaccagaacaugcccuucuugcgaagaguauauuuaaacucacauaucaaaauaaagugguucguguacaacguccagccaaaaacgguaccgucauggacguuaucucuagacgagaccagagaggaucaggccaaguagguaccuacgguuuaaacacauuuacuaacauggaagcacaauugauacgucagauggaauccgaggguaucuucaguccauccgaacucgaaacccccaauuuagcaaggaggguuuuggauugguuggagaagcauggaguugagcgacuuaaacguauggcuauaaguggggaugauuguguuguuaaaccaauagacgauagguucgcgacugcccuuacggcucuuaaugauauggggaaaguuaggaaagauauaccacagugggaaccgucaaaaggauggaaugauuggcaacagguuccguuuuguagccaccacuuccaucaacuaaucaugaaggaugguagagaaaucgucgucccgugccgcaaucaagacgagcuuguuggaagggcaagggucagccagggugccggguggagcuuaagggaaacggcaugccuaggaaaaaguuaugcacagauguggcaguuaauguauuuucaucgccgggauuuacgccuagcugccaacgcgauauguagugccgucccgguagacugggugccaacauccaggacgacuuggucaauccacgcacaccaccaauggaugacuacagaagacaugcuuucuguauggaauagaguauggauugaggaaaacccauggauggaagacaaaacacacauuucuuccuggggagacguaccauaucuaggcaaacgugaagaucaauggugugggaguuugauuggacucacagcacgugcgacaugggcaaccaauauccaaguggccauuaaccaagugagacgacuaaucggaaacgagaacuauuuagauuacaugaccucuaugaaaagguuuaaaaaugaaagugauccugaaggagcgcuaugguag

SEQ ID NO: 21851 - RNA, 9879 nt, Artificial Sequence
  derived and/or modified CDS sequence (opt6) from DENV-1__GU131781__SS-prME
ucagucacuaugcuuuugauguuaaugccuacagcauuggccuuucaccucacaacucgcggaggugaaccucacaugauuguaucuaaacaagaacgcggcaaaucucuccuauuuaaaacgagugccggcguuaacaugugcacucuaauagcuauggaccuuggcgaauuuugugaagauacaaugacuuauaaauguccgcgaauuacugaagcagaaccugaugaugucgacuguugguguaacgcaacugauacauggguaacuuaugggacauguagccaaaccggagaacaccggcgcgauaaaagaucaguggcucucgcaccacacgugggacuaggccuggaaacacgaacugaaacguggaugucgucagaaggagcauggaaacaaauucaaaggguggaaacaugggcauugcgccauccaggauuuacgguaauagcauuauuuuuagcucaugcaauugggacuucaaucacgcagaaaggaauaaucuuuauacucuuaaugcuugugaccccuucuauggcaaugagaugcgucgguaucggaaguagagacuuuguagaaggucuaaguggugccacaugggucgacguggucuuggagcacggcuccugcguuacaacuauggcgaaagauaaaccaacgcuugauauugaacuacuaaaaacugaaguaacaaauccggcgguucuuagaaaacuauguaucgaagcgaaaauaagcaauacaacuaccgauaguagaugucccacacaaggagaggcgacgcuuguugaagaacaagaugcaaauuuuguuuguaggaggacauucguagaucggggguggggaaauggcuguggacucuucggaaaagggucacuaauaacaugugccaaauucaaauguguaacuaaauuagagggcaaaauuguccaauacgaaaacuugaaauauagcguaauaguuacuguccauacaggagaucaacaccaagugggaaacgaaagcacagagcacggaacaacagcuacaauuacaccucaagcgcccaguacggaaauucaacucacggacuacggggcgcuaacccuagauugcucgccacggacaggacuugauuuuaaugaaaugguacuauugacuaugaaagagaaaagcuggcuuguucacaaacagugguuccuagaccuuccguugcccuggacaaguggugcguccacaagucaagagacauggaaucgucaagaccuucucguaacauuuaaaacggcccaugccaagaaacaagagguuguugucuuaggaucccaagaaggugcaaugcauacugcgcuaaccggggccacagaaauccaaacauccgguacgacuacaauauucgcuggacauuuaaaauguagauuaaagauggacaaauuaacccuuaagggaaugaguuauguaauguguacuggcucauuuaagcuagaaaaagaaguagcugagacgcaacaugggacaguacucguucaaauuaaauaugaagguacagacgcgccauguaaaauacccuuuuccacccaggaugaaaaaggugucacccaaaacgggagacuaauuacugccaauccaauaguaacagacaaggacaaacccguaaacauugaagcugaaccaccuuuuggcgaaagcuauauagugauaggcgcuggagagaaagcauugaaacucucuugguucaagaaaggcagcucaauuggaaaaauguuugaggcgacagcaagaggcgccagacgaauggcaauacucggcgacacugcuugggauuuuggaucaauugguggcguguucacgucuguugguaaacuugugcaucaaauauuuggaacagcuuauggaguacuguuuucaggagucucauggacaaugaaaauaggaauaggaguucucuuaacaugguuagguuuaaauucucgaucaacuucauuaaguaugacguguauugcaguagguuuaguaacacuauauuugggggucaugguccaagcagacucuggauguguagugaauuggaaaggacgggaguuaaaauguggauccggaauauuugucacuaacgaaguccauacauggacugaacaauacaaauuucaagcagauaguccuaaacgguuaucggcagcaauuggaaaggcaugggaagaaggaguaugcggaaucaggagcgcuacccguuuagaaaauauuauguggaagcagauaagcaacgaacuuaaucauauacuucuggaaaacgauaugaaguucacuguaguggucggugacguggcagguauauuagcucaagggaagaaaaugauacggccccaacccauggaauacaaauacaguuggaaaucauggggaaaggcuaaaaucauaggagccgauguacaaaacacuacuuucauuauagacgggccaaauaccccugaauguccagacgaccaaagggcguggaauauaugggaaguggaagauuauggauuuggaauuuuuacaaccaacauauggcuaaaacugcgagacucauacacccaaguaugugaucauaggcuaaugagcgcagcaaucaaagauucaaaagcaguacacgcggauaugggauacuggauagaaagugagaaaaaugaaacuuggaaauuagcuagggcaaguuucaucgaagugaaaacguguauuuggcccaagucacacacuuuguggaguaauggaguacuagagagcgaaaugauaauacccaaaauauaugguggaccaauuucccaacacaauuaucgcccaggcuauuuuacccagacggcagguccguggcaccucggaaaacuugaacuagacuucgauuugugcgaagggacuacuguagugguugaugaacacuguggaaaccgcgguccaucauuaaggaccacaacaguaacuggaaaaauaauucaugaaugguguugucguucaugcacuuuaccgccacuucgauucaaaggcgaagauggaugcugguacggcauggagauaaggccgguaaaagagaaggaagaaaaucuaguaaaaaguaugguaagcgcgggcuccggggagguugauaguuuuagucuaggucuccuauguauaagcauaaugauagaagagguaaugaggucaagauggaguagaaaaaugcugaugacaggaacauuagccguauucuucuuacugauaaugggucaauuaacuuggaaugaucuaauacgauuaugcaucauggugggugcaaaugcaucagauagaauggguaugggcaccacauacuuagcucugauggcaacuuuuaaaaugcgaccaauguucgcugucgggcuucuauuucgcagacuuacuucucgagaaguucuuuuauuaacgauuggacucagccugguugcaaguguggaauuaccaaauucacucgaagaauuaggagauggccuagcaauggggauaaugauacucaaauuacucacggauuuucaaagccaccaacuaugggcgacuuugcugucacuuacguucauuaagacaacguuuucacuacauuacgccuggaagacaauggcuaugguucuaucaauaguaucgcuguucccguuaugcaugaguacuacgagccaaaagacaaccugguugcccguccuguuagguucacuaggaugcaaaccccuuacaauguuuuuaauugcugagaauaaaauaugggggcggaaaucauggccacuaaacgaaggcauaauggcuguaggaauaguuaguauacuuuuaaguucccuacuaaagaacgauguaccauuagcaggaccucuaauagcaggagguaugcugauagcauguuaugucauaagcggaaguagugcggaccuuucucucgaaaaagcggcagagguaucaugggaagaagaagcugaacauucuggagcgucucacaacauauuaguugaaguacaagaugacggaacgaugaaaauaaaagaugaagagagggaugauacacugacuauccuacuuaaagcaacuuuguuagcaguuuccggugucuaucccuuaucgauccccgcaacguuauucguaugguauuucuggcagaaaaagaaacaaagaagcgguguauuaugggauacgccaagcccaccugagguugaacgagcuguacuagaugaugggauauauaggaucaugcaaaggggcuuacuaggucggucucagguaggcguuggaguauuccaagagaacgucuuucauacuauguggcauguaacgagaggggccguauuaauguaccaaggaaaaagauuggaaccgucaugggcgucgguaaagaaggauuuaauauccuauggaggugguuggcguuuacaaggcagcuggaauacaggcgaggaagugcaaguaaucgcaguggaaccaggaaagaaucccaaaaauguucaaacagcaccagguaccuuuaaaacaagugaaggagaagugggggcaauagcauuggacuuuaagccagguacuucugggucaccgauaguuaaccgcgaagguaaaauuguaggacuuuacggaaacggagugguuacaacaucaggcacuuauguaagugcgauagcacaagcuaaggccucacaggaaggaccauuaccagaaauugaagacgagguguuuagaaaaagaaacuuaacuauaauggaucugcauccggggagcgguaagaccaggagauacuuaccggcaauugugagagaagcaauaaaaaggaaauuaagaacauuaaucuuagcuccaacacgaguaguagcgagcgagauggcggaagcacuuaaagggaugccaauacgcuaucaaacaacggccguaaaaucagaacauacaggcaaggaaaucgucgacuuaaugugucaugcuacauuuaccaugcgauugcuauccccaguacgcgucccaaauuacaauaugauuauaauggacgaggcacacuuuacagacccaucuucaauagccgcaagagguuauauaucgacaaggguagguaugggagaggcagcggcgauauucaugacugcgacgccuccaggcagcguagaagccuucccacaaucaaacgcuguaauucaagaugaagaacgagauauuccagaaaggagcuggaacucagguuacgaguggauuaccgauuuuccagguaagacugugugguucguaccaucgauuaaaaguggaaaugacauugcaaacuguuuaaggaaaaauggcaaacgaguaauccaacugucaagaaagacuuucgauacagaauaccagaaaacuaaaaacaaugacugggacuaugucgugacaacugauaucucagaaaugggugcgaauuuucgcgccgaucguguaaucgacccaagaaggugcuuaaagcccgucauuuuaaaggacggaccagaaaggguaauauuggcgggaccuaugccggugacugucgcuuccgcagcacaacggcguggaaggauuggucggaaucacaauaaagaaggggaucaguacguauauauggggcaaccccucaacaacgaugaagaucacgcucacuggacugaagcaaaaaugcuucuugacaauauaaauacaccugaaggaauaauucccgcuuuauuugaaccugagagagagaaaagugccgcaaucgauggcgaauauagacuucgaggcgaagcaagaaaaacauuuguagaacuuaugcguagaggagaucuaccaguaugguuauccuauaaaguggcuucugaagguuuccaauacucagauagaagauggugcuucgauggagaaagaaacaaucaaguucuggaggaaaacauggauguugagauauggaccaaggaaggagagcgaaagaaacuuagaccgcguuggcuagacgcaagaacauacucggauccccuagcucuccgagaguuuaaagaauuugcagcugguaggcgcagugucaguggagauuugauacuggaaauugggaaacuaccccaacaccuaacucagcgagcacaaaaugcucucgauaaucucguuauguugcauaauucagaacaagguggccgagccuacaggcaugcgauggaggaacuaccggauacaauugagacgcuaauguuacuagcuuuaauagcgguccucacaggcgguguuacauuauucuuucugucaggcaggggucucgggaagacuucaaucggauuacuaugugucauggcgaguuccguacucuuguggauggcuuccgucgaaccucauuggauagcugcuagcauuauuuuagaauuuuuccuaaugguacuauuaauaccagaaccagacaggcaacgaaccccgcaagauaaccaauuggcauacguagucauaggacuccuauuuaugauacucacaguugcggcuaacgaaaugggucuauuagaaacaaccaagaaagaccucggaaucggacacguagcuguagaaaaccaucaucaugcugcaauguuagauguugaucugcacccagcuucagcuuggacauuauacgcaguagcgacgacuauuauuacuccaaugaugagacacacuauugagaauacuacagcgaacauaucccuaacagcaaucgcuaaccaggcggcaauuuuaauggguuuagacaaaggcuggccaauuagcaaaauggauauuggugugccacuacuagcguuagguugcuacucucaggugaauccacuaacuuuaaccgcugcaguccuaaugcugguugcucacuaugcuauaauugggccgggauuacaggccaaagccacaagagaagcccaaaaacgaacugcagcagggauaaugaaaaaucccaccguugauggcauaguagcaauagaccuugacccaguugucuaugacgcaaaauuugaaaaacaacuuggacagauaaugcuauugauacuauguacuucucaaauucuacuuaugagaacgacgugggcgcuaugugaaucuauuacuuuagcuacgggaccacugacgacacucugggaagggaguccaggcaaauuuuggaauacaaccauagcagugucaauggcaaauauauuccgaggcucauaccuggcuggugcagggcuagcuuuuucuuuaaugaaaagucuggguggcggccgacgcgguacaggugcacaaggcgaaacacuaggagagaaauggaagcggcaacuaaaccaauuaaguaaaucagaguuuaacacauauaaaagaucagggauaauggaaguagauagaagugaagcuaaagaaggcuugaagcggggugaaacaaccaaacaugcagucucgagaggaaccgcgaaacugcgaugguuuguagaaagaaaccugguuaaaccagagggcaagguuauugaucuugguugcggacguggaggguggaguuauuacugugcaggauugaagaaagucaccgaggucaaagguuauaccaagggaggaccugggcacgaagaaccuauaccuauggcaacguacggguggaaucuaguuaaacuacauucggggaaggaugucuucuuuauaccaccagagaaaugugauacucuuuugugcgauauaggugaaucaagcccaaauccaaccauugaagaaggaaggacacuacgaguucuuaaaaugguagagccaugguuaagagggaaucaguuuugcauuaagauacuaaauccauacaugccgucggugguagaaacacuagaacaaaugcaacgaaaacacggaggaauguuaguacgcaaccccuuaagcagaaauuccacacaugagauguauuggguaucgugcgguacaggaaauauaguaagugcaguaaauaugacaucucgcauguuacucaaccgauucaccauggcgcauaggaagccaacguaugaacgagauguagacuugggagcgggaaccaggcacguagccguagaaccggaaguagccaaucucgacauaauaggacaaaggauagagaacauuaaacaugagcauaaaucaacguggcauuaugaugaagauaaccccuauaagacaugggcguaucauggaaguuacgaaguaaaaccauccgggucugcgucuucuaugguuaacgguguuguaaaauuacugacaaaaccuugggacguaauuccaauggucacacagauugcuaugacagauacuacuccguuuggacaacagagaguguuuaaggaaaagguggauacaagaacaccaaaagcgaaacgugguacagcucaaauaauggaaguaaccgccaaaugguuauggggguuccuaucgaggaauaagaaaccacgcauaugcacacgugaagaguucacacgcaaaguacggagcaaugcagcaauuggagcagucuucguggaugagaaccaguggaacagugcgaaggaagcaguagaagaugaaagguucugggacuuaguacacagagaacgagaauuacauaaacaagguaaaugcgccacuuguguauauaacaugauggguaaaagggagaagaaauugggagaguucgguaaggcaaagggcucaagagcaauaugguauaugugguugggugcuagguucuuagaauuugaagcauuaggauuuaugaaugaggaucacugguuuucgagagaaaacagccuauccgggguggaaggcgaaggcuuacauaaacuuggauauauccuaagagauauuaguaagaucccgggaggaaauauguaugcagacgauacagcuggcugggauacaaggauaacagaagacgaccuacaaaaugaagcgaagauaacagauauaauggaaccagagcaugcacuucuugcgagaucaauauuuaaauugacguaccaaaauaaagugguucgcguacagcggccggcuaaaaaugguacagucauggacgugauaaguaggagagaucaaagggggucaggucaagugggaacuuacggacuaaauacguuuacaaauauggaagcucaacuaauacgccaaauggaaagcgagggaaucuucagcccaucagaacuugagacaccaaaucuugcgggcagaguccuagauuggcuugagaaacacggagucgagagauugaagaggauggcaauaucuggagaugauugcgugguuaaaccaauagacgauagauuugcaacagcguugacggcucucaaugauaugggaaaagugaggaaagacauaccccagugggaaccgaguaagggauggaacgauuggcaacaagucccuuuuuguagucaucacuuucaccaauuaauuaugaaagauggaagagaaauagucguacccuguagaaaccaagaugaauuagucggccgcgcacggguaucacaaggagcuggauggucucuaagggaaacagcuugccuaggaaagucauacgcgcagauguggcaauuaauguauuuccauagacgggauuuacgccuagcagcaaacgcgauauguucggccguccccguggauuggguaccuacuagccgaacgaccuggucuauucacgcucaccaucaauggaugacgacugaagauaugcucaguguuuggaauagaguauggaucgaggaaaacccauggauggaagacaagacgcacauuucaucguggggagacguuccauaucuggggaaaagagaagaucaaugguguggcagccuuauaggauuaaccgcaagggcgaccugggcgacuaauauacaaguugcuauaaaucaagugagaagauuaauugggaaugaaaauuaucuagauuauaugacuagcaugaaaagguucaagaacgagucagauccggaaggugccuuaugguaa

SEQ ID NO: 21852 - RNA, 9879 nt, Artificial Sequence
  derived and/or modified CDS sequence (opt6) from DENV-1__GU131782__SS-prME
ucgguaacaauguuacucauguugaugccuacagcucuagccuuucacuugacaacaagaggaggagaaccacacaugauagugacaaaacaagaaagagguaaaucguugcuuuuuaaaacaucagcaggaguaaacauguguacccuuauugcuauggaccuuggagaguuaugcgaagacaccaugacauacaaauguccaaggauaacugaggcugaaccugaugacguggauuguuggugcaacgcaacggacacauggguaacauacggaacguguagucaaacaggcgaacauagacgcgauaaaagaucaguugcccucgcaccucacguaggccuaggucuugaaacuagaacugaaacuuggaugucaagcgagggagcuuggaaacaaauacaaagaguugaaacaugggcacugcgccauccuggauucacuguuauagcucucuuccucgcacacgccauagggacuagcauuacacaaaaaggcauaaucuuuauacugcugauguuaguuaccccuucuauggcuaugcgauguguuggcauuggaucccgugacuuuguugaaggccucucuggggccaccugggucgacguaguacuugaacauggaagcuguguuacaacaauggccaaagacaaaccaacacucgacauugaauuguuaaaaacagaaguuacuaauccugcgguguuaagaaaauuaugcauugaagcaaaaauaucaaauaccacaacggauucgcggugcccgacccaaggcgaagcaacacugauggaagaacaagaugcaaacuucguuuguagaaggacguuuguugauagagguuggggcaacgguugcggguuauucggaaaaggcagccuaauuaccugcgcgaaauuuaaaugugugaccaaauuggaagguaaaauaguacaguaugaaaaucugaaguauagugucauuguaaccguacauacuggggaccaacaucagguaggaaacgagagcaccgaacaugggacuacggcaacaaucacaccgcaagcgccuacuagcgaaauucaauuaacugauuauggagcgcuaacccuagacuguagcccucgaacgggucuugacuuuaacgaaaugguuuuauuaacaaugaaggaaaaaucuuggcuagugcauaaacagugguuucuagaucuaccauuaccuuggacgucaggcgcaucgacaucucaggaaacuuggaacaggcaagauuuguuaguaacauucaaaacugcccaugcuaagaaacaggaaguaguuguauuaggaagccaagagggagccaugcauacagcacuaacaggagcgacagaaauccagacaucaggaacuacaaccaucuucgcagggcaccuaaaauguagauuaaaaauggauaaacucacauugaaaggaaugagcuaugugauguguacaggaucuuuuaaacuagaaaaagaaguagcugaaacucaacauggaacaguccuaguucaaauaaaauaugaaggaacggacgccccauguaagaucccauucagcacacaagacgagaaaggcgugacucagaacggacgacuaauaacagcgaaccccauaguaacugacaaagagaaaccagucaauauagaagcugaaccaccguucggagagaguuauauuguaauuggagccggcgaaaaagcauuaaagcucaguugguuuaagaaaggguccucuauaggaaagauguuugaagcaacugccaggggagcacgcagaauggcgauccuaggagacacugcaugggauuuuggaagcauuggaggaguauucacaucagucggaaaacuuguucaucaaauauuugggacugcuuacggaguucuuuucucaggaguuucauggacaaugaaaauaggaauuggggugcuauuaacauggcuaggucucaacucaaggucuacaagucuaucuaugaccuguauagcgguaggccuaguaacauuauaucuagguguaaugguccaagccgacucugggugcgucauaaacuggaaagggagagaauuaaaauguggaucagguaucuuuguuacgaacgaaguucacacauggacagagcaauauaaauuccaggccgauaguccuaaaagacuaucagcagcaauaggaaaagccugggaagagggcguuugcggcauacgcucagcaaccagacuagagaauauaauguggaagcagauuagcaacgaguuaaaucauauacuucuagaaaaugacaugaaauuuaccgucguagugggagaugugguaggaauccuugcacaggguaagaaaaugauuaggccacaaccaauggaacacaaauauaguuggaaaagcugggguaaagcaaagauaauaggcgcugauguacaaaacacaacauucauuauagaugguccuaauacuccagaguguccggaugaucaaagagcuuggaauauuugggaaguugaggacuaugguuucggaauauuuacaacgaacauauggcucaagcuccgggacucauauacucagguaugcgaccacagguuaaugucagccgccaucaaggacucgaaagccguacaugcugacaugggcuauuggauagaaucugaaaagaacgagaccuggaaacuagcuagggccaguuucaucgaaguuaaaacuuguaucuggccaaagucucauacacuguggucaaauggcguuuuagagagugaaaugauaauuccuaagauauaugggggcccgauaagucaacauaauuauagacccgguuacuuuacacaaacagcgggcccauggcacuugggcaagcuagaacuggacuuugauuuaugugagggaacuacaguuguaguugacgagcacugugguaauagaggaccaucacugaggacaacaacagugacaggaaaaauaauacaugaauggugcugcagaaguuguacauugccuccacuccgguuuaagggugaagauggauguugguauggaauggagauuagaccgguaaaggaaaaagaggaaaauuuaguaaaaagcaugguuucugcagguuuaggagagguagacaguuuuucacuaggacugcucugcauauccauaaugauagaggaagucaugcgcucgagauggaguaggaaaauguuaauggcagggacgcuagcuguuuuucucuugcuaauaaugggucaacucacauggaaugauuuaaucagacuaugcauaaugguaggagcaaaugcaucggaccgaaugggaauggggacgacauacuuggcacuaauggcuacguuuaagaugagaccuauguuugcagugggauuauuauuuagaagacugacaucacgagaaguauuacuucugacuauaggauuaucauuaguggcaaguguagaacuuccuaauucccuagaggagcuuggugauggacuggcgaugggaaucaugauacucaaauuacuaacagauuuucagccacaccaauugugggcaaccuuguuauccuuaacuuuuauuaaaacaaccuuaucauugcauuaugcauggaaaaccauggcaaugguucugucuauagucucauuauuuccuuuaugccuaucaacaaccagucaaaagacaacauggcugccgguacuacugggaucuuuaggcuguaagccgcugacaauguucuuaauagcagaaaacaaaauauggggcaggaaaaguuggccccuaaaugaggggaucauggcuguuggcguuguaaguauauuauuaucgucacuucucaaaaaugaugucccgcuugccgguccauugaucgcgggaggcaugcuaauugccuguuauguuauuagcggaaguagugcggaucuaagccuggagaaagccgccgaagugucaugggaagaagaagccgaacacucuggagcuagccacaacauccucguggaaguucaggaugacgggacuaugaaaauaaaagacgaggaacgcgacgauacgcuaacaauuuuacuuaaagcuacguuguuagcaauaaguggaguauauccuuuaucaauuccugccaccuuguuuguaugguauuuuuggcagaagaagaaacaaagaagugggguuuugugggauacaccguccccgcccgaaguggaacgagcaguucuggaugacggcauauauagaauuaugcagagaggacucuuaggucgaagccaaguaggaguaggggucuuccaagaaaauguauuccacacuauguggcauguuacuaggggagcgguccuuauguaucaaggaaaacggcuagaacccaguugggccaguguaaagaaagaucugauaaguuauggaggugguuggagacuccagggaucauggaauaccggagaagagguucaaguaauagcuguagaaccaggcaaaaaccccaaaaauguucaaacugcacccggaacauuuaaaacgccugaaggggaggugggcgcgauagcccuagacuucaaaccagguacuagcgggaguccgaucguuaaccgugaaggaaaaauaguagguuuguauggaaacgguguaguaacaacaaguggaacauaugugagcgcaauagcucaggccaaagccucacaagaagggccucugccugaaauagaagaugaaguauucagaaaacgcaaucuaacaauaauggaucuacauccagggucaggaaaaacaagaagauacuuacccgcgauagugagagaggcaauaaagaggaaauugagaacuuugauauuggcgccaaccagaguuguagccuccgaaauggcugaggcauuaaaagguaugccaauacguuaucaaaccacggccgugaaaagcgaacauacaggaaaagaaauaguggaccugaugugccaugcaacuuucacaaugagacucuuaucaccugugcguguuccaaacuauaauaugauuaucauggacgaggcccauuucacggaucccucauccaucgcagcaaggggauacauuucgacgagagucgggaugggagaggccgcggcaauauuuaugacagccacucccccugguuccguagaagcguuuccccaaucgaaugcugucauucaggaugaagagagagauauaccagaaagaaguuggaacuccggguaugaauggauaacagacuuuccaggaaaaacagugugguuugugcccucgauaaagucagggaaugauauagcaaauuguuuacggaagaacggaaaacgaguaauucaauugucacgaaaaaccuucgacacagaauaucagaaaacgaaaaauaaugacugggacuauguagugacuacugacauaucagaaaugggcgccaauuuucgggcagaccgagugauagauccgagaagguguuuaaagccaguaauacucaaggacggcccagaacgaguuauucuugcugguccaaugccagugacuguugcuuccgccgcucaaagaagaggucgaaucggucgaaaucauaacaaagagggggaccaauauauauauaugggccaaccacuaaauaaugaugaagaccaugcccauuggacugaggcgaaaauguugcucgauaauauaaauaccccugaaggaauaauacccgcacuuuucgaaccagaacgagaaaaaucagcagcuaucgauggagaauauagacucagaggagaagcaagaaaaacuuucguugaacuaaugagaagaggcgaucuaccuguuugguugucguauaaagucgcuagugaggguuuccaguauucagaucgaaggugguguuucgacggcgagaggaacaaccaaguauuggaagaaaauauggacguagaaauauggaccaaagagggugagcggaagaaacuuaggccgcgauggcuagacgcucgcacauauucggacccacuagcacuaagagaauuuaaagaguucgcugcaggaagaaggagcgugucaggcgauuuaauuuuagaaaucggaaaguugccacaacacuuaacccaaagagcacagaaugcauuggauaacuuaguaaugcuacauaacuccgaacaaggagggagagcauacaggcaugcaauggaggaacuaccagacacuauagaaacacugaugcuacuugcacugauagccguauuaacaggaggcguaacccuauucuucuugucaggaagaggauuagguaaaacaucuauaggacuacuuugugugauggcauccucugugcuacuuuggauggcuucagucgaaccacacuggauagccgccucuauaauauuggaguucuuuuuaaugguauugcuuaucccagaaccugaccgacaacgcacaccccaagacaaucaauuagcauacguuguaauaggucuuuuauuuaugauauuaacaguggcugcaaacgaaaugggucuacuugaaacgacuaagaaagaucugggcauaggacauguagcaguugaaaaucaucaccaugcuacuaugcucgauguagaccuccaucccgcgagugccuggacucucuaugcuguugccacaaccauaauuacucccaugaugcgccauacaauagagaacacuacagcaaauauuucuuugacagcaaucgcaaaucaagcagcuauuuuaauggguuuagauaaaggauggccaauaucgaaaauggacauaggcguuccauugcuagcuuuagguuguuauucacaaguuaauccucuuaccuuaaccgcagcaguauuaauguuaguagcucauuaugccaucaucgggccagggcuacaagccaaggccacaagagaggcucagaaaagaacagcagcagguaucaugaaaaacccaacagucgaugggauugucgcaauagauuuagauccuguuguauaugacgcgaaauuugaaaagcagcuaggacaaaucauguuacucauacucugcacgagucaaauauuacuaaugagaacuacgugggcauuaugcgagucuauaacgcuggcgacuggaccacuaacuaccuugugggagggauccccuggcaaguucuggaauacuacaauagccguuucgauggcaaacaucuuuagaggcaguuacuuggcgggcgcgggguuagcauucucacucaugaaaaguuuaggcggagggagacgagguacgggggcgcaaggagaaacguuaggagaaaaauggaagcggcaauuaaaccaacuaucaaaauccgaguuuaacaucuauaagagaucugggauaauggagguugauagaucggaagcaaaggaaggauugaagagaggcgaaacaacacgacaugcaguuucuagagguacagcuaagcugagaugguuuguagaacgcaaccucguuaaacccgaggguaaagucauagauuuaggaugcgggcgugggggauggucguauuauugcgcaggacuuaagaaaguaacggaagucaaaggauauacgaaaggaggaccaggacaugaagaaccaauuccgauggcaacauacggguggaaccuugugaagcuacacucgggaaaagauguguuuuucacgccaccagaaaggugcgauacguuacuaugugauauuggagaaucaaguccuaaccccacaauagaagagggucguacccugagaguuuuaaagaugguggaacccugguuacgggggaaucaauuuugcaucaaaaucuuaaauccuuauaugccgaguguagucgaaacacuagaacaaaugcaaaggaaacauggagggaugcuuguaaggaauccacuuucccguaacaguacacacgaaauguauugggugucgugcggcacuggaaauauuguaucugcaguaaacaugacuagcagaaugcugcugaaucgauuuacuauggcucauagaaaaccaacauaugagcgagauguugaccuaggagcaggaacaagacauguagcgguggaaccggagguugcuaaccuggacauaauaggacagagaauugaaaacauuaaacacgagcauaaguccaccuggcauuaugaugaagacaauccuuauaaaacaugggcuuaucacggauccuacgaagugaagccuagcgguucagcuaguagcaugguaaauggcguggugaagcuauugaccaaacccugggauguaaucccaauggugacgcaaauagcaaugacagacaccacccccuuuggccaacaacgaguauuuaaagaaaaaguggauacucgaacuccaaaagcuaaaagaggcacagcucaaauaauggaaguuaccgcacgaugguuguggggauucuuaucacgaaacaagaaaccuaggauauguacgcgagaagaguucacucggaaaguaaggaguaacgcagcuauaggagcgguauuuguagaugagaaucaguggaauagugcaaaagaagcgguggaagacgaaagguuuugggacuuggugcaaaaagaaagagaacuccauaaacaggggaagugcgcuacgugcguguauaacaugaugggaaaaagagaaaagaaacucggagaauuuggaaaggcaaaaggcucucgugccaucugguacaugugguugggagcccgauuucucgaguucgaggcuuugggguuuaugaaugaagaccauugguuuagcagagaaaauaguuuaaguggagucgagggggaaggguuacauaaacuugguuauauauugcgcgauauaagcaaaauaccaggugguaauauguaugcagaugauacugcagguugggauacgaggauaacagaagacgacuuacaaaaugaagcaaagauaacggauauaauggagccggagcaugcuuugcuugccacaaguaucuuuaaacuuacauaccaaaacaaaguggugagaguccaaaggccugcaaagaauggaacuguaauggaugugauaagcaggagagaucaacguggaagcggacaagugggaacuuauggauuaaauaccuuuacaaauauggaggcccaacuaauaagacaaauggaaagcgaagggauauucuugccgucagaacucgaaacuccgaaucuagccgaaagagucuuggacuggcuggaaaaacauggcguagagagauugaaaaggauggcgaucucgggagaugauuguguaguaaaacccauugaugacagguucgcaacagcguuaacagcacuaaacgacauggguaaaguaaggaaagauauuccgcaaugggaaccaucaaagggauggaaugauuggcagcagguaccauucuguucacaucauuuucaucaacucauaaugaaagauggccgugagauaguaguacccuguaggaaucaagaugaauuggucggaagggcucgcguaucucaaggcgcaggauggucacuccgagagaccgcuugccuaggcaaaucuuaugcacagauguggcaauugauguacuuccauagacgugacuugagauuggccgcgaaugcaaucugcucagcuguaccaguagauuggguaccaacaucucgcacuacauggaguauacacgcucaucaccaguggaugacuacagaagacaugcuuucagucuggaacagaguguggauugaggaaaauccguggauggaagauaagacucauguuucaaguuggggagacguaccauaccuugguaaaagagaggaucaaugguguggaagucugauaggucuaacugcaagagcuacaugggccaguaacauccaaguggcuauaaaccaaguaagaagguugauaggcaaugaaaacuaccuggacuauaugacguccaugaaacguuuuaagaaugaaggagauccagaaggagcuuuaugguag

SEQ ID NO: 21853 - RNA, 9879 nt, Artificial Sequence
  derived and/or modified CDS sequence (opt6) from DENV-1__GU131784__SS-prME
agcguaacuaugcuacuaaugcuaaugccaaccgcgcucgcauuucaucuaacaaccagagguggcgaaccucauaugaucguaagcaaacaagaaaggggaaaaagucuacuauuuaaaacaagugccgguguaaacaugugcacguugauugcuauggauuuaggagaguucugugaagauacgaugacguacaaauguccacgaauaacagaagcagaaccagaugacguggacugcuggugcaaugcaacagauacuuggguuacuuaugguaccugcucacaaaccggugaacauaggcgcgauaaaagaucgguugcccuugcaccucauguaggucucggcuuagaaacgaggacggaaacuuggaugaguagcgaaggugcguggaaacaaauucaaaggguagaaacuugggcgcuaaggcacccaggauuuaccguuaucgcgcuuuuucuugcccaugcaauaggcaccaguaucacucaaaaagggauuauauucauccuccuaaugcuuguaacaccuaguauggcuaugagaugcguugguaucggaucuagagauuucguugaaggauuauccggagcaaccuggguagacgugguucuagaacaugguucuugugugacgacaauggccaaagauaaacccacuuuggauauagaacuacuuaaaacagaaguaacgaacccagcaguacuccgaaaauuauguaucgaagcaaaaauaucuaauacaacgacagauucacguugccccacucaaggcgaagcgacacuuguggaagaacaagacgccaacuuuguauguagaagaacuuuuguggaccgagguuggggaaaugguugcggacuauuuggaaaagggucuuugauuacuugcgcuaaauuuaagugugucacaaaauuggaagguaaaacuguacaguacgaaaaucucaaguauucagucauaguuacuguucacacgggagaccaacaucagguggguaaugagaguaccgaacacggcaccaccgcuaccauaacaccucaagcaccaaguacagaaauucaacugacagauuacggagcacuaacucucgacugcucaccgagaacggguuuagacuuuaacgaaaugguauuacuaacuaugaaggaaaaaucauggcuuguucauaaacaaugguuucuugauuugccauuaccauggacgucaggagcaaguacuucacaagaaacuuggaaucgaaaagaccuucuaguuaccuuuaaaacagcacacgccaagaaacaggaaguaguuguuuuaggcucacaggaaggagccaugcauacagcacuuacaggagcaacagaaauacaaacgucgggcaccacuacuauuuuugccggacacuuaaagugccgauuaaagauggauaagcuaacauuaaaaggcaugucuuauguuauguguacagguaguuucaaauuggaaaaagaagucgcugaaacccaacauggaacaguccuagugcaaauuaaauacgaagggacugacgcccccugcaagauuccauuuucaacgcaagacgaaaaagguguaacacaaaacggucgccugauaacagccaauccuauagugacagacaaagaaaaaccaguaaauauugaagcagaacccccguucggcgagagcuauauaguaauaggggccggugaaaaagcucucaaauuauccugguuuaagaagggcucuagcaucgggaagauguuugaagcaacagcccgaggggcaagacgaauggcaauuuugggagauacggcaugggauuucggcaguauuggugggguuuucacgucaguggguaaacugguucaccaaauauucgguaccgcguaugguguuuuauuuagcggaguuaguuggacuaugaaaauaggaauugguguauuacuuacguggcuuggcuuaaauucgagaucuaccucauuaaguaugacgugcauagcaguaggcuuagugacauuauaucucgguguuaugguacaggcggacuccggcuguguuauaaacuggaaaggucgagaguugaaauguggauccgguauuuuuguuacuaaugagguucauaccuggacugaacaauacaaauuccaagcagacucaccgaaaagacuaucugcggcgauuggaaaggcuugggaagaaggggugugcgguauaaggucagccacccgacuagagaacauuauguggaaacagauaucuaaugaauugaaucauauacugcucgaaaaugacaugaaguuuacgguggucgugggugacguugcggguaucuuggcacagggaaagaaaaugauucggccacaaccaauggaguacaaauacuccuggaaguccugggguaaagcaaaaauuauaggugcagauguacaaaacacuacauuuauaaucgacggaccaaauacuccagaaugucccgaugaccagagagcauggaauauuugggagguagaggauuauggguuugggauauuuaccacgaacauauggcucaaauugagagauucauacacucaaguaugcgaucacagacugaugagugcagcaauuaaggacagcaaagcuguucaugccgacaugggauacuggaucgaaucagagaaaaaugaaacauggaaacuugccagggccucguucauugaagucaaaaccugcauuuggccaaagagucacacauuauggucaaaugguguacuagaaagugaaaugauaauaccgaagauauaugggggucccaucagucaacacaauuacaggccuggguacuuuacucaaacagcaggaccguggcaucugggcaaauuagaacucgauuucgacuugugcgaggggacuacgguagucguugacgaacauugcgggaauaggggacccucacuuaggacaaccacuguaaccgggaagaucauucaugaauggugcugcaggucguguacucuucccccacuacgguuuaaaggagaagauggauguugguauggaauggaaauucgcccugugaaggaaaaggaagaaaauuuaguaaagaguaugguaagcgcagguucgggugaaguagacaguuuuucacuaggcuuacuauguauaaguauaaugaucgaagagguaaugcgaucgagguggagucggaaaauguuaaugaccggcacauuagcuguauucuuccuacugauaaugggacaacuaacuuggaaugaucugauaagauuaugcauuauggugggagcuaaugcuuccgaucgaaugggaauggguacaacuuaucuagccuuaauggcgacuuuuaaaaugagaccgauguuugcuguaggauugcuguuucgcagguuaacauccagagaaguauuguuacuaacgaucggcuugagucuuguggcaucaguagaacuaccuaauagccuugaagaauugggagauggcuuagcaaugggaauaaugaucuuaaaacuucuaacagauuuucaaucgcaccaacuaugggcuacguuauuaagucucaccuucaucaaaacaacauuuagucuucaucacgcauggaagacaauggccaugguucuuucaauaguaagccucuuuccccugugucuuaguacaaccagccaaaagaccacaugguuacccguauuacugggcucuuugggaugcaaaccacuuacaauguuuuuaauagcagagaacaaaaucuggggaagaaaaucguggccucuaaaugagggcauaauggcuguugguauugucaguauacugcuuaguuccuuguuaaagaacgauguaccucuagccggaccccugaucgcuggaggcauguuaaucgcauguuaugucauuucuggcaguagcgcagaucuaaguuuggaaaaagcggcagaaguuucgugggaagaggaggcagagcauaguggcgccucucacaacauauuaguagaaguacaagacgacgguacgaugaaaauaaaggacgaggaaagagacgauacguuaacuauacuauuaaaagcgacucuauuggcgguaagcgguguauaucccuuauccauuccugcuacuuuauuuguaugguauuucuggcagaaaaagaaacaaagaucuggcgugcuuugggauacaccuaguccacccgaaguggagcgugcagugcuagacgacgguauauauaggauuaugcaacguggacucuuggggagaucacaaguaggaguagguguauuccaggaaaauguauuucacacaauguggcauguaacccggggugcgguacuuauguaccaagggaagcguuuagaaccuaguugggcauccguuaagaaagaucuuauuagcuacggcgguggauggagguuacaggguaguuggaauacaggagaagaaguacaaguuaucgcugucgaacccgguaaaaaucccaaaaauguucaaacagcuccaggaaccuuuaaaaccuccgaaggagagguuggcgcaauagcacuagacuuuaaacccgguaccucuggaucaccgaucguuaacagagaaggaaaaauaguaggucuauauggaaacggaguaguuacgacaagcggcacuuacguuucggcuauugcacaagcaaaggcaucccaagagggaccuuuaccggaaauagaggaugaaguguuccgaaagaggaaccucacaaucauggacuugcacccgggauccggaaaaacuaggcgguauuuacccgcaauugucagagaagcuauaaaaaggaaauugcgaacacugauacuugcuccgacaagaguagucgcuucugagauggcagaagcauuaaaagguaugcccauaagauaucaaacaacagccguuaaaucugaacacacggguaaagaaaucguagaucucaugugccacgccacuuuuacaaugagacuauuaucgccagucagaguuccuaauuauaacaugauaauuauggaugaagcacauuuuaccgauccgucuucaauagcggcaagggguuacauaucuacuagagucgguaugggugaagccgcagcuauuuucaugaccgcuacgccaccaggaagcgucgaggcauucccucagaguaacgcaguuauacaagacgaagaaagagauauaccagagcgcuccuggaacucagguuacgaauggauuacggacuuccccggaaaaacaguaugguucguucccucaauaaagucuggcaacgacauugcaaauugcuuacgaaagaaugggaagagaguuauacaauuaagucgaaagacuuucgauacggaauaucagaaaaccaaaaauaacgauugggacuauguaguuacaaccgauaucagcgagaugggagcaaauuuucgagcugauagaguuauugauccaagaagaugccugaagccuguaauuuuaaaagauggaccugagcguguuauauuggcugggccuaugcccguuaccguugccuccgcugcacaaagaagaggacggauaggaagaaaccauaauaaagaaggugaucaauauauauacauggggcaaccacuaaauaaugacgaagaucacgcucacuggaccgaagcaaaaaugcuacucgauaauauuaacacaccggagggaaucauuccugcacuauuugaaccugaaagggagaaaagcgcugccauagacggggaauacagauuaagaggugaagcaaggaaaacauucguugaguuaaugcgaagaggggaucugccuguuugguugucauauaaaguugccuccgaaggauuucaauauucagacagaagauggugcuucgacggugaacgaaauaaucagguauuagaggaaaauauggacgucgaaauuuggacaaaggaaggugaacgcaagaaacuuaggccaagaugguuagacgcgagaacauauucggauccucuugcauuaagagaauuuaaagaauuugcugccggccgaagaagugucucaggugacuuaauacuagaaaucgguaaacuaccgcaacaccuuacacagagagcccaaaaugcauuggauaaucuagucaugcuacauaauucugaacaaggaggacgagcguauagacaugccauggaagaauugccugauaccaucgagacacuaaugcucuuagcacucaucgcaguauuaacaggcggaguuacacuauucuuuuuaucaggacgaggacuaggaaaaacaucaauaggacugcuguguguaauggcgucgaguguuuugcuguggauggcaaguguugaaccacauuggauagcggcuucaaucauacuugaguucuuuuuaauggugcuuuuaauaccugaaccagauagacaaagaaccccucaagauaaccaauuggcguaugucguuauagguuuauuauucaugauccuuacaguagcagcaaacgaaauggggcuacucgaaaccacuaagaaagacuuggguauaggacaugcagcaguugaaaaccaucaucacgcugcaauguuagacguugauuuacauccugcaucugccuggacauuguaugcaguugcuaccacgauaauaacuccgaugaugagacacacaauagaaaacacuacagcgaauauaucgcuaacagcuauagcaaaucaggcugcgauauuaaugggcuuagauaaagguuggccgauaucgaaaauggacauuggaguaccgcuacuagcacuaggguguuauagucaaguuaauccccuaacucuuacggcggcggugcuuaugcugguagcacacuaugcaaucauuggacccggccuucaagcaaaagcuacacgggaagcccagaaaaggacugcggccggcauaaugaagaauccaacaguugauggaauaguagcaauagaucuggauccugucgucuaugacgcaaaauucgaaaagcaacuugggcaaauaaugcuucuuauccuuugcacuucacaaauuuuacugaugaggacaacuugggcauugugcgaaaguauaacgcucgcaacugggccacuuaccacacugugggaagguucgccagggaaguuuuggaauaccaccauagccguuaguauggccaacauauucagagguaguuaucuugcaggagccggcuuagcuuuuagucucaugaagucguuaggaggaggaagaagagggacuggugcacaaggugaaacacuaggcgagaaauggaaaagacaacuuaaccaauuaucuaaaagugaauuuaauacuuacaaaagaucagguauuauggaaguagacagaucggaagcuaaagaaggguugaaaagaggugaaacuacuaaacacgcggugagucgugguaccgccaaauugcgcugguucguugaaaggaauuuaguaaaaccagaaggcaaaguuauugauuuaggaugugggaggggagggugguccuacuauugugcaggacuuaagaaaguuacagaaguaaaaggcuauacaaaaggaggacccgggcacgaggagccuauuccaauggcaacuuaugguuggaaucuaguaaaauuacauucgggaaaggaugucuucuucaucccaccagaaaaaugcgauacacucuugugugacauaggcgaaucaucuccuaauccaacaauagaagaaggaaggacacucagagucuugaagaugguugagccuugguugcgagguaaccaguuuugcauaaaaauacuaaacccuuauaugccaaguguaguagaaaccuuagaacaaaugcagcguaaacauggagggaugcuuguacguaaccccuuaucaagaaacucaacacacgaaauguauugggucucgugcggaacaggaaacaucguaucagccgucaacaugacaaguaggaugcuacuuaacagguuuacaauggcacaccgaaaaccgacauacgaaagagacguagacuuaggagcuggcacuaggcacguugcgguagaaccugaaguggcaaaccuagauauaauaggccaaaggaucgagaacauaaaacaugaacauaagaguacguggcacuaugaugaagacaauccguauaagacaugggcauaucauggaucuuaugaggucaaaccaucagguucugcaaguucuaugguaaaugggguuguaaaguuguugacaaaacccugggacguuauuccuauggucacucagauugcaaugacggacacaacgccguuuggacaacaaagaguauucaaagagaagguggacacucgcacaccaaaagcaaagcgggguacagcucagauaauggaaguuaccgcaaaauggcuuugggguuuucuuucgaggaacaagaaaccacgaaucugcacgagagaagaauuuacaagaaaggugcgauccaacgcagcgauuggugccguauucguugacgagaaccaguggaacagugcaaaagaagcgguugaagacgaacgauuuugggaucuagugcaccgagaacgugaauugcauaaacaagggaaaugugcaacaugcgucuauaacaugauggguaaacgggagaagaaacuaggggaguuuggaaaggcaaaagguucuagagcaauaugguacauguggcuaggugcgcgauucuuagaauuugaggcuuuaggauucaugaaugaagaucauugguuuagcagagaaaacucuuuaaguggcguagaaggagagggacugcacaaacuaggauacauauuaagagacauaucaaaaauaccggguggcaauauguaugccgacgacacugcgggaugggacacacggauaaccgaagaugauuuacaaaacgaggcaaaaauuacugauaucauggaaccagaacaugcccuacuagcuaaaucgauauucaaauuaacuuaccagaacaaagucguucgcguucagagacccgcaaagaacgggacaguaauggauguaauuaguagaagagaucaacggggauccggucaggucggcaccuacggauuaaacacauucacgaacauggaagcccaauuaauaagacaaauggaaucagaaggcauauuuucucccuccgaauuggaaacuccgaacuuagcaaggcgcguuuuggauugguuagagaagcaugguguagagagacucaaacgaauggccauaaguggagaugacugugucgucaaaccgauugacgaccgauucgccacagcacuaacggcacugaaugacaugggcaaagucaggaaagacauaccucagugggaaccuucgaaaggauggaacgauuggcaacaggucccuuuuugcucacaucacuuucaucaauuaaucaugaaagauggcagagaaauuguagucccauguagaaaucaggacgagcuagucggaagggcuaggguuucucaaggagcuggguggucauuaagagaaaccgcuugucucgggaaaucuuaugcacaaauguggcagcuuauguauuuucauagacgcgauuugagauuagcagccaaugcaauaugcagugcaguaccuguagauuggguccccacaagccgcaccaccuggaguauccacgcacaucaccaauggaugacuacagaagauauguuaucuguguggaacagaguguggaucgaagaaaaucccuggauggaagacaaaacucauauaucaucguggggugacguaccauaccuagggaagcgagaagaccaauggugcgguucucuuauaggguugacggcgcgagcgacuugggccacuaacauccaagucgccauaaaucaaguaaggagacucauugguaaugaaaauuaucuagauuacaugacaaguaugaaaagauuuaagaaugaaagugauccagaaggagcgcuuugguaa

SEQ ID NO: 21854 - RNA, 9879 nt, Artificial Sequence
  derived and/or modified CDS sequence (opt6) from DENV-1__JF937612__SS-prME
aguguuacaauguuauuaaugcucaugccuacugcacuagcuuuucacuuaacaacacgagguggugaaccacacaugaucgucucgaaacaagaacgagguaaauccuuacucuuuaaaacaucagcagggguaaauauguguacucuaauagcuauggaucuaggugaauuaugugaagauaccaugacuuauaaauguccaagaauuaccgagacugaaccagaugauguugacugcuggugcaaugcuacugauacauggguaacauacggaacuugcagccaaacuggagaacaccgaagagacaaaaggucaguugcauuagcaccccaugugggauuaggcuuagagacgagaaccgaaacauggaugaguagcgaaggugcguggaaacaaauucaaaggguggaaacuugggcacuacgucaucccggcuucaccgugauugcacuauuccuagcccacgccauugguacaaguauuacacaaaaaggaauaauuuuuauauuauugaugcuuguaacgccuucuauggccaugcggugcguuggaauuggaagucgagacuucguggaagguuuaucaggggcgaccugggucgacgugguacuagaacaugguucaugugugaccacgauggccaaagauaaaccgaccuuagacaucgaacuauuaaaaacugaaguuacaaauccggcaguccuucgaaaauuaugcaucgaggcaaaaauuucgaacacuacuaccgacucgaggugcccgacccaaggagaggcgacauuaguagaagaacaagaugcaaauuuuguuugucguagaaccuucgucgacaggggauggggaaacgggugcggauuguuugggaaaggguccuugauuacuugcgcaaaauuuaaaugcguaacaaaauuggaaggaaaaauugugcaauaugagaaucuaaaauauucugugauuguaacuguucauacaggugaucaacaucaagugggaaacgagucaaccgaacauggaaccacagcuacuauaacaccucaagcuccgacgacggagauccagcuuacagauuauggagcccuaacguuagauuguucaccucgaacaggauuagacuucaacgagaugguacuauuaacaaugaaagagaaaagcuggcuagugcauaaacaaugguuccuggacuuaccucuaccauggaccucgggagcgucaaccucgcaagaaacguggaauaggcaagauuugcuagugacguucaaaacugcacacgccaaaaagcaagaaguagugguacuuggcagccaggagggagccaugcacacggcauuaacuggagcuacagaaauccaaacuucgggaacgacaacgaucuucgccggccacuuaaaauguagacuaaagauggauaaacuuacccuuaagggcaugagcuauguaaugugcacagggagcuuuaaguuagaaaaagaaguagcagaaacacaacaugguacgguucucguccagauaaaauacgagggaacagaugccccuuguaaaauuccuuucucaacccaggaugaaaagggugucacccaaaaugguagacucaucaccgcgaauccaauugucacagauaaagaaaaacccguuaauauugaagcugagccuccauucggagaaucuuacauuguaauuggcgcgggugaaaaggcacuaaaacuguccugguuuaagaaagguuccucaauuggaaagauguucgaagcaaccgcuagaggcgcacggagaauggcaauauuaggugacacagcaugggauuuuggcucaauuggcgguguguuuacgagugucggaaagcuaguacaucaaauauucggaacagcuuauggaguauuauuuuccgguguuucuuggacaaugaaaauagggauaggaguauuauuaacguggcuagguuugaacucuaggaguacaagucugagcaugacuuguauagcuguuggauuaguaacacuguacuuaggcguuaugguccaggcagacaguggaugcguaauuaauuggaaaggcagagaacucaagugcggcucugggauauucguuacaaaugaaguacacacuuggacagaacaauacaaguuccaagcggacagcccaaaacguuugucugcagcuauugggaaagcaugggaggaagguguaugugggauacgcuccgcuacacgguuggaaaauauaauguggaaacaaauaaguaaugaguugaaccauauacuccuagaaaaugauaugaaguuuacugucguuguaggugauguagcaggaauacuagcacagggcaagaaaaugauccgcccccaaccuauggaauauaaauacucauggaaaucaugggguaaggccaaaauaaucggugcugauguacagaaugcaacauucauuauagauggaccuaauacgccggaauguccagacgaucaacgcgcauggaauauaugggaagucgaggauuauggguuugguauauuuacaacgaacauaugguugaaacuuagagauaguuauacgcaaguaugcgaucaucgucugaugucugcggcuaucagagauucgaaagcaguucaugcagacaugggauauuggauugaaucugagaaaaacgaaacguggaaauuagcccgugccaguuucauagaaguuaaaacuuguauauggccuaagucacauacgcuuuggaguaaugguguucuugaaagugagaugaucauuccaaaaauauauggagggccaauuagccagcacaacuaccgcccgggauacuuuacacaagcagcuggaccuuggcaccuuggcaaauuagaacuugacuucgaucuuugcgaagguacuaccguugucgucgaugagcauugcggaaaucguggcccuucuuuaagaacuacgacuguuacaggaaaaauuauucacgaaugguguugcagaagcuguacucuaccaccucuacgauuucgaggugaagacggcuguugguauggaauggagauaaggccgguaaaagaaaaggaagaaaacuugguuaaaucaaugguaucggcugguucaggagagguagauucguuuagcuuggguuuauuauguauuucuauaaugauagaagaggucaugagauccagauggaguagaagaaugcugaugaccggcacacuggcagucuucuuucuccuaaucaugggacagcuaacguggaacgaucuuauuagauuaugcauuaugguaggugccaacgcgucugacagaaugggcauggguacaaccuacuuagcguugauggcaacuuuuaagaugaggccaauguuugccguggguuuacuauuccgcagacuuacgagcagggaagucuuguuauuaacaauaggucuaagccuuguugcaaguguagaacuuccuaauucacuggaagaauuaggagauggauuggcgaugggaauuaugauauuaaaacuacuaacggauuuucagucccaucaguugugggcuacucuauugaguuugacauuuauuaagacaacuuuuuccuuacacuaugcauggaaaacaauggcgaugguguuguccauaguaucauuguuuccucuaugucuauccaccaccucacagaaaacuaccuggcugcccguucuauuagggucucugggauguaaacccuuaacaauguuuuuaauugccgagaacaaaaucuggggaaggcgauccuggccuuuaaacgaaggcauaauggccgugggaauagucucaauucuauuaucuuccuuacuuaagaaugauguaccgcuugcagggccacuaauagccggaggcaugcucauagcuuguuauguaauuucaggcucaagugcugacuugagccuggaaaaggcugccgaagugucuugggaagaggaggcagaacauucgggagcgucccauaauauuuuaguugaagugcaagacgacggcacaaugaaaauaaaagaugaagaaagagacgauacccucacaaucuuauuaaaggcaacgcuacuagcugucaguggaguuuacccccucucuauccccgcaacauuauuugucugguauuuuuggcagaagaagaaacaacgaucuggggucuuaugggacacaccuaguccaccugaaguagaacgugcaguacucgaugauggcauuuauagaauaaugcagcgcggauuacuaggucgaucgcaaguuggcgugggcguauuccaagaaaauguauuccauacaauguggcauguaacgagaggcgccgucuugauguaucaggggaaacgauuagagccaucaugggcaaguguuaagaaggaucuuauaagcuauggaggagguuggaggcuccagggaucuuggaacacgggagaggaaguacaaguaauagccguugaaccagguaaaaacccuaagaauguacaaacugccccaggcacauucaaaacaccagagggggaaguuggcgcaauugcccuagacuuuaagccugggacaucuggcagccccauagucaacagagaaggaaaaauaguuggccuuuauggaaauggaguuguaacaacuagcggaacuuaugucagugcgaucgcacaagcaaaagcgucacaagaaggaccccugccggaaauagaagacgaagucuuucguaaaagaaacuuaacaaucauggacuuacacccgggaaguggaaaaacaagaagauaucuaccagcuauaguccgggaagcuaucaaacgaaaauuacggacucucauacuagcuccgacucggguuguagcaucagaaauggcagaggcacuuaaggguaugccaauccgauaucagacaacugcaguuaaaagcgaacauaccggaaaggaaauaguugauuugaugugccacgcaacguuuaccaugagacuacucagcccuguaagaguuccaaauuacaacaugauaaucauggacgaagcacauuuuacagauccaaguagcaucgcagcaagaggauacauaagcacacguguaggaaugggggaagcugcggccaucuuuaugacagcaacuccgccuggcagcguggaagcauucccgcaauccaacgcugugauacaagacgaagaacgagauauccccgagaggucauggaacucuggauacgaauggauaacggacuuucccggaaaaacuguuugguucguacccucaauaaaauccggaaacgacauagcuaauugccugaggaaaaaugguaagcgaguaauucaacuuaguagaaaaacuuuugauacagaauaucaaaagacuaaaaacaaugauugggacuacgugguaacaacugauauaucugaaaugggugcuaauuuuagggccgaucgaguaauagacccuaggcgaugucuaaaaccuguuauacuaaaagacggcccagagcgaguaauuuuagcugguccaaugccaguaacgguugcaucagcugcacaaagaagagggaggauaggucguaaucauaacaaagagggggaucaguauauauauauggggcaaccccuuaacaaugaugaagaccaugcccacuggacagaggccaaaaugcuauuagauaauauaaacacaccggaaggaauuauaccugcacuuuucgagccagaaagggaaaaguccgccgcaauagacggagaauauagguuacgcggagaggcccgcaaaacuuuuguugagcuaaugagaaggggagacuuacccguauggcuaaguuauaaaguagcgucagagggauuucaguauucugaccgaaggugguguuucgauggugagcgaaacaaucagguacuugaggaaaauauggauguggaaauauggacuaaagaaggugaaagaaagaaauuaagaccaaggugguuagacgcuagaacuuacagcgacccucuugcacuuagagaguucaaggaauuugcugcaggucgaagaaguguaaguggcgacuuaauccuagaaaucggcaaacugccccagcacuugacccaacgugcacaaaaugcauuagacaaucuuguaaugcuucacaauucagaacaaggagggcgagcuuauagacacgcuauggaggaacuuccagauacaauagaaacccuaaugcucuuagcucuaauagcaguuuuaacaggaggcgucacacuguuuuucuugucaggacgagguuugggaaaaacauccauaggauuauuaugcguaauggcauccagcguucucuuguggauggccucagucgaaccacacuggauagcagcaagcaucauauuagaauuuuucuuaaugguucuuuugauacccgagccagaccgucaacgaacuccacaagacaaccaauuagcauauguagugauaggacugcuuuuuaugauacuaacagucgcagcuaaugagaugggauuacuugaaacaacuaagaaagacuuaggcauaggacacguagcggucgaaaaucaucaucacgccgcuauguuagacguagauuuacaucccgccucggcguggacacucuacgcgguggcaacuacuauuaucacuccaaugaugagacacacuaucgaaaauacaacagcaaacauuagcuuaacagcgauugcuaaucaagcagcgauacuaaugggauuggacaagggauggcccauuagcaaaauggacauaggaguuccauuauuagcuuuagguuguuacucucaaguaaacccccugacccuuaccgcagcaguacuuaugcucguugcacacuaugcgauaauagguccaggacuucaagcaaaagccacucgggaagcacagaaaagaacagccgcagggauuaugaaaaauccuacuguagacgggauaguagcaauagacuuagaucccguaguguaugaugcgaaauuugaaaaacaauuaggacaaauaaugcuuuuaauauuauguacaucucaaauacuacuaaugcguacgacuugggccuugugugaaucuauuacuuuggcuacugggccauuaacgacgcucugggaaggaaguccugggaaauuuuggaacacaacgauugcggucucaauggcaaauauuuuucgugguucguauuuagcaggagccggacuagcauuuucguuaaugaagucucuugggggaggacguagaggaacuggagcgcaaggugaaaccuugggagaaaaauggaagcgucagcucaaucaacugucaaaaucagaguucaacacauauaaacggucagguaucauggaagucgaucgcagugaagcaaaagaagggcucaagagaggagagacgacaaaacacgccguaaguagggggacggcaaaauuacgaugguuuguugaaagaaaucuagucaaaccagaaggaaaaguuauagacuuaggguguggacgcggcggcuggucguacuauugugccggcuuaaagaaaguaaccgaagugaaaggauacacuaaaggggguccaggacaugaggaaccaauaccuauggcaaccuauggguggaacuugguaaaguugcauaguggaaaagacguauucuuuauaccgcccgaaaaaugcgauacgcuuuuaugugacaucggggaaaguaguccgaaccccaccaucgaagaaggucggacacuacgaguacucaagauggucgaaccaugguuacgagguaaucaauuuugcauaaaaauucucaauccuuacaugccgucuguuguggaaacucuugagcagaugcaacgaaaacacggaggaaugcuaguaaggaaucccuuaagucgcaauuccacacaugaaauguacuggguaucuuguggcacaggaaauauaguaucagccgucaacaugacaucgcgaaugcuucuaaacagauucacaauggcacauagaaaaccaacuuaugaaagagauguagaucuuggggcagggacgcgacauguugcaguagagccagaagucgcaaaucuagacaucauaggucaaagaauugaaaauauaaagcaugaacauaagucaacauggcacuaugaugaagacaacccguacaaaacaugggcguaccacggcucauaugaagucaaaccgagcggcagugcgucuucgaugguaaauggaguaguaaaauuauuaacaaaaccaugggaugugauaccuaugguaacacaaaucgccaugacagauacaacgccuuuuggucaacaaagaguuuucaaggaaaaaguugauacucgaacgccaaaagcaaaaagaggaaccgcgcaaauaauggaagugaccgcaaaaugguuaugggguuuccuaaguagaaauaaaaagccacggauaugcacccgugaagaauuuacgcgcaaaguucgcaguaaugccgcaaucggagcaguuuuuguagaugagaaucaauggaacucagccaaagaagccguagaagacgagagauuuugggaucuggugcacagggaaagagaauuacauaaacaagggaaaugcgcaacgugcgucuauaacaugauggguaaaagggagaagaaauuaggagaguuugggaaggccaaaggaucaagggcuaucugguacauguggcucggggcaagauuucuagaauuugaggcuuugggcuucaugaacgaagaccacugguuuucucgggaaaauagcuuaaguggagucgaaggagagggauugcauaaacuaggauauauccugagggauaucucgaaaauaccaggcggaaauauguaugcagaugacacugcuggaugggauacuaggauuacugaagacgauuuacaaaaugaggcucguauuacagauauaauggaaccggaacacgcucuuuuggcaaagucaauauucaaacuaacauaucaaaauaaaguaguacgugugcaacgaccagcgaaaaacgguacgguuauggacguuauaucucgaagagaccagagggguucaggucaagucggcacauauggauuaaauacuuuuacuaauauggaagcacaacugauaagacaaauggagucugaagguauuuucucaccaagcgagcuggaaacacccaauuuggccgaaagaguacuagauugguuagagaaguacgguguagaaagguuaaagcgaauggcgauuuccggcgaugauuguguaguaaaaccaauagaugaccgcuucgcaacagcccuaacugcgcucaacgacauggguaaaguaagaaaagauaucccucaaugggagccaucaaagggauggaaugauuggcaacagguccccuucugcucccaucauuuucaucaauuaauaaugaaagacggaagagaaauuguuguuccuuguagaaaucaggaugaguuagucggcagagcuagaguaucacagggggcgggcuggucacuaagggagacggcuugccuaggaaagucauacgcucaaauguggcaacuaauguacuuucaucggcgcgaccuccgccucgcggccaacgcaauuuguagcgcgguuccaguagauuggauaccuacaagucgcacuacauggaguauacaugcccaccaucaauggaugacgaccgaggacaugcuaucuguguggaaucgaguuuggauagaagagaaucccuggauggaagacaagacacauauuucaucauggggcgacguuccuuauuugggaaaaagagaagaucagugguguggcagccugauaggacuaacggcccgggcgacgugggcuacuaauauucaagucgcaauaaaucaaguacgucgauuaaucggcaacgagaauuauuuagacuacaugacuagcaugaagagauuuaagaaugaaagcgauccggaaggagcuuuaugguaa

SEQ ID NO: 21855 - RNA, 9879 nt, Artificial Sequence
  derived and/or modified CDS sequence (opt6) from DENV-1__GU131786__SS-prME
ucaguuacaaugcuauuaauguugaugccuacagcacucgcuuuucaucuuacuacuagggguggagaaccgcauaugauuguaaguaaacaagaacggggcaaaucucugcuauucaaaacauccgccgguguuaauauguguacacuaaucgcaauggauuugggagaauuuugugaagauacgaugacguauaaaugcccaaggauaacagaagcagaaccagaugauguugacugcuggugcaaugcaacugauacaugggucacuuaugguacguguagccaaacaggagaacacagacgugauaaacgauccguagcgcuagcaccacauguuggccuuggauuagaaacuagaacagaaacauggaugaguagugaaggugcuuggaagcagauacaacgaguagaaacaugggcucugaggcauccaggauuuacaguaaucgcauuauuucuugcgcacgcaauagguacaagcauaacgcaaaaagggaucauuuucauucuccuaaugcucgucacaccaucgauggcuaugaggugcguggggauaggaucacgggauuucguagaaggguuaagcggagcaaccuggguugaugucguacuggaacauggaucuugcguuacaacaauggcaaaagauaaaccuacgcucgauauagaauuacuuaaaacggaaguaacaaaucccgcggugcugcgaaaauuauguauagaagcaaaaauaucuaacaccacaacggacuccagaugcccuacacaaggagaagcuacccuaguggaggaacaagaugcaaacuuuguguguaggaggacauuuguugauagaggauggggcaacgguugcggccuuuuugguaaagguucauuaauaacaugugcgaaauuuaagugugucacgaaauuggagggcaaaauugugcaauaugagaaccuaaaauacucaguaauagugaccguucauacgggugaucaacaucaaguaggcaacgaguccacggagcauggaacaacugcuacgauaacaccacaagcuccaaguaccgaaauucaacugacugauuauggugcacuuacauuggauugcaguccaagaaccggccuagacuucaacgagaugguauuacuaaccaugaaagagaaaaguugguuaguucauaagcaaugguuccuggaccuaccucuaccguggacguccggggcuucaacaucgcaagaaacauggaacagacaggauuugcuaguaacuuuuaaaacggcucaugccaagaaacaggagguaguagucuugggaucacaagaaggcgcaaugcauacagcuuuaacaggagcgacagagauucagacaucaggaaccacaacaauuuucgcggggcacuuaaaaugcagacuaaaaauggacaaacuuacacuaaaagguaugaguuaugugauguguacugggaguuucaagcuagaaaaagaaguugcugaaacucaacauggaacuguauuaguacagauuaaauaugaaggcacagacgcgccauguaaaaucccguuuaguacccaagacgagaaagguguuacucaaaauggucguuugauaaccgcaaauccaauuguuacagauaaagaaaaaccgguaaacauagaagccgagccaccuuucggcgaaucguacauaguaauuggugcuggagagaaagcauuaaaacuuucgugguucaagaaaggcucaagcauaggcaaaauguucgaagccccagcaagaggcgccagaagaauggcaauccuaggggcgacagcaugggauuuuggaucuaucggcgggguauucccaaguguuggcaaacuuguacaccaaauauucgguacugcguauggagugcuuuucaguggaguaaguuggacaaugaaaauuggaauagguguucuauugacauggcuaggucuaaacucaagaagcacaucauuaucuaugacguguaucgcagugggguuaguaacguuauaucuggguguaauggucagggcggacaguggguguguuauaaauuggaaaggccgagaauuaaagugcggaucaggcauauuugugacgaacgagguucauacauggacagaacaauauaaauuucaagcagauuccccuaaaagacuuucggcugcaauaggcaaggcuugggaagaggguguauguggcaucaggucggccacucgucucgaaaauauaauguggaaacagauuaguaacgaacuaaaucauauccuauuggaaaacgacaugaaauuaacaguagugguaggggauguggcagggauauuggcccaagggaaaaagaugauacguccacaaccaauggaauacaaauacuccuggaaaagcuggggaaaggccaaaauaauaggagcagauguucagaacacaacauucauuauagauggaccaaauacaccagaauguccugaugaucagagggcuuggaauaucugggaaguagaagauuacggcuucgggauuuuuacuaccaauauauggcuuaaauugagagacaguuauacacaaguaugugaccacagauugaugucagccgcuauuaaggauaguaaagcgguccaugcagauaugggcuacuggauugaaucagagaagaaugaaacuuggaaauuggcaagagcauccuuuaucgaaguaaaaacuuguauauggccaaagucccauacccuuugguccaacggagucuuggaaagcgaaaugaucauuccgaaaauauauggaggaccgauuagucaacauaauuaucggccaggguauuucacccagacugccggaccauggcauuuagggaaauuagaacuggauuucgacuuaugcgaaggaacgacgguagugguugacgaacauugugguaaccguggaccgagccucagaacuacaacaguaacuggaaagauaauucaugaaugguguugcaggucuugcacauugccgccacuuagguuuaaaggagaagacggauguugguauggcauggaaauacgcccaguuaaagaaaaagaagaaaaucucgucaaaucuaugguuucggcaggguccggagaaguagauuccuucucuuuagguuugcuuuguauuucgaucaugauugaagagguaaugagaagucgauggucgagaaaaaugcuaaugacaggaaccuuagcaguauucuuuuuguuaauaaugggccagcuaaccuggaacgacuugauaagacuaugcauuaugguaggugcaaaugcaucugaccgcaugggaauggguaccaccuaucuggcauuaauggcgacauucaagaugcgcccuauguuugcuguaggucucuuauuccguaggcugacaagcagagagguauuauuacugaccauuggauugagccuaguagcgucgguagaauuaccgaacucccuagaagaguugggagacggauuggccaugggcauuaugauauuaaaauuauuaacugacuuccaaagccaucaacuaugggcgacacuauugucucuaacauuuauuagaacuacuuuuucauugcauuacgcuuggaaaacuauggcaauggucuuaucgauuguaaguuuauuucccuugugccuaucaacaacaucccagaaaacgacauggcucccaguucuuuugggaagucugggaugcaaaccccugacaauguuucuaauagccgagaauaagauuuggggacgaaaaucuuggccucuuaacgaaggaauaauggcaguaggaauaguaucaauacuuuuaagcucucuucucaaaaacgauguaccccucgcaggaccguuaauagcgggcgguauguugauagcuuguuacguaauaucggggaguucggcagauuugagcuuagaaaaagcagcagugguaagcugggaagaagaagcagaacauagcggugcuagccauaauauucuaguagaagugcaagacgauggaacgaugaagaucaaagacgaggagagagacgauacacuaaccauuuugcugaaagcaacacuauuagcaguaucaggagucuacccucuaaguauuccagcgacacuauuuguaugguacuuuuggcagaaaaagaaacaacgaagcggagugcuaugggacaccccgagucccccagaagucgaaagggcaguccucgacgacggcaucuaucggaucaugcaaagaggacuauuaggaagaucucaaguagguguaggaguguuucaggaaaauguguuccauacaauguggcauguaacgagaggcgcgguccuuauguaucaaggcaaaaggcuggaaccgucaugggcgaguguuaaaaaggacuuaauuuccuacggaggagguuggagauuacaaggaucauggaacacgggcgaagaaguacaaguaauugcuguugaaccugggaaaaacccuaaaaacguacagacggcuccuggaacauuuaaaacuagcgaaggagaaguaggagcuauagcccucgacuucaaaccuggaacuucggguagcccaaucgucaaucgagaggggaagauagucgguuuguacggaaacggggugguuacaacuucggguacauauguuucggcaauagcacaagccaaggcuucucaagagggaccacucccugagauagaggaugagguuuucagaaaaaggaaucuaacaauuauggacuuacauccagguucugguaaaaccaggcgguaucuuccggcuauuguacgagaggcaaucaaaagaaaacuaagaacacugauauuggcuccaacaagaguaguagcuagcgagauggcugaagcucuuaagggaaugcccaucagauaucaaacaacggcaguuaaaucggaacauacaggaaaggaaauuguagacuuaaugugucaugcuaccuucaccaugcgacuauuaagccccgucagaguacccaacuauaacaugauaaucauggaugaagcacacuuuacagauccgucaucaauagccgcucgcggcuacauaucaaccagaguagguaugggcgaggcggcggcaaucuucaugacggccacaccaccaggaucaguagaagcauuuccgcaaaguaaugcuguuauucaggaugaggaaagagacauaccagaacgaucauggaacuccggauaugaauggauuacagacuuucccggaaaaacuguuugguuugugccgucgauaaaaaguggaaaugacauagccaauugccugcguaaaaacgguaaacgcguaauacagcuaucccggaaaacuuuugauacggaguaucagaaaaccaaaaauaacgauugggacuacguaguaacaacagacauaagugaaaugggcgcaaauuuccgagcggaucgugucauugacccaagacgauguuuaaaacccguuauuuuaaaagauggacccgaacgaguaauacuugcagguccgaugccagugacaguugcgucagcggcccaacgacgaggacgaauugggagaaaucauaauaaagaaggugaucaauauauuuauaugggacaaccguuaaacaaugaugaagaucacgcgcauuggacagaggcuaaaaugcuucuagacaacauaaacaccccggaaggaauaauaccugcacuauucgaaccagagagagaaaagagcgcagcgauugauggagaauacagacuacgaggugaggcacguaaaacuuuuguagaauugaugagacgcggcgacuuaccugucuggcuuucguauaaagucgcguccgaaggauuccaauacucagaccggagaugguguuuugauggugaacgcaauaaccaaguauuagaagagaauauggacguagagauuuggaccaaagaaggcgagaggaagaaacuacgcccgagauggcuugaugcaaggacauauuccgauccucuagcacugagggaguucaaagaauuugcagcaggucgcagaaguguuaguggcgaucuuauccuagaaaucgggaaguuaccccaacacuuaacacaacgugcgcagaaugcuuuagauaaucuaguaauguugcauaacucugaacaaggaggaagggcguaccgccacgcuauggaagaacuuccagauacgauugaaacacuaaugcuauuagcccuaaucgcaguauuaacaggugggguaacucucuucuuucucaguggacgaggguuggggaaaacaucuauagggcuccucuguguuauggcgucguccguacuacuauggauggcaaguguagagccacacuggauagcagcuucgauuauacuggaguucuuuuugaugguuuuacuaauaccagaaccagauagacagagaacgccacaagauaaccagcuggcuuauguagugaucgggcuacucuucaugauucuaacuguagcagccaacgaaaugggauugcuagaaacgaccaagaaagaucuaggaauuggucauguugcaguugagaaucaucaccaugcagcaauguuagacguugacuuacauccggcaagcgcguggacccuguacgcaguagcgaccaccauaaucacgccaaugaugcgucacacuauagagaauacuacagcaaauauaucauuaacggcaauugcgaaucaggcggccauucuuaugggauuagacaaaggauggccgauauccaaaauggauauaggaguaccauugcuagccuuaggcuguuacagccaggucaauccuuugacccuuacagcagcaguucuaaugcuagucgcacacuaugcuauuauagguccugggcuucaagcaaaagcaacgagggaggcgcagaaaaggacagcugcugguaucaugaagaacccuacgguugaugguauaguagcaaucgaucuugaccccgucguguaugaugcaaaauucgaaaaacaauugggacaaauuaugcuucuuauauuguguacaucacaaaucuuacugaugcggacuacaugggcucuaugugagagcauaacccuagcuaccggaccucuaaccaccuuaugggaggggucaccaggaaaauuuuggaauacaacaauagcagugagcauggcuaauauuuuucguggcucuuaucuagcaggagcagguuuagcguuuagcuuaaugaaaucauuagguggagguagacggggaacaggagcgcagggagagacacucggggaaaaauggaaacggcaacuuaaucagcuaucuaaaucagaguucaauacuuauaaacgaucugggaucauggaaguagauagaucagaggcaaaggaaggauuaaaacgaggagaaacgacuaaacaugccguaagcagaggaacggcaaaacuuaggugguuuguggagagaaaucuaguaaaaccagaagggaaagucaucgacuuaggcuguggaagaggaggguggaguuauuauugcgcaggauuaaagaaaguuacagaagucaaaggauacacaaaaggagguccuggacacgaggaaccuauaccuauggcgacauacggauggaaccuugucaaacuucacucugguaaagauguauuuuucauuccuccagagaagugugacacucuauuaugugacauaggagaaucaaguccaaaucccaccauagaagaaggacgaacgcuaaggguacuaaaaaugguagaaccauggcucaggggaaaucaauuuugcaucaagaucuuaaacccuuauaugccuucuguugucgaaacccuagaacaaaugcaaagaaaacauggcggcauguuagugcggaauccguugaguagaaauagcacucacgaaauguacuggguuaguuguggaacagguaacauaguuucugccguuaauaugacuagcagaauguuacucaacagauucacuauggcacacagaaaaccgacauaugagagggauguugaccuuggugcggguacacgacaugucgcaguagagccggaaguugcaaaucuugauauuauuggucaaagaauugaaaauauaaaacaugaacacaaaucgacuuggcacuaugaugaagauaacccguauaaaacgugggcuuaucauggcucguaugaagucaaacccucugguucagcguccagcaugguaaaugguguagucaaauuguugacaaaaccuugggauguaaucccaaugguaacacaaauagcuaugacugacacuacaccuuuuggacagcaacgaguauucaaagaaaagguagauacacgaacuccaaaagcaaaacggggaacugcccagaucauggaagugaccgccaagugguuauggggauuuuuaucgcgcaauaagaaaccuagaauuugcacacgagaagaguucacgcguaaaguaagaucaaacgccgcaauaggggcgguuuuuguugaugagaaccaauggaacucagcuaaagaggccguagaagacgaaagauuuugggauuuaguucacagggaacgggaacuacauaaacaagguaaaugugcuacguguguuuacaacaugauggggaagcgggagaagaaacucggagaauuuggcaaagcaaaaggaaguagagcaauuugguauauguggcuaggggcuagauuccuggaauuugaagcacuaggauuuaugaaugaagaccacugguuuagucgagaaaacucucuaucaggagucgaaggagaaggcuuacacaaguuaggcuauauucuaagggacauaucaaaaauuccagggggcaacauguaugcugaugacacugcuggaugggacacaaggauuacagaagaugaccuacagaacgaagcaaagaucacagacauaauggagccagaacacgcuuuauuagccaaaucuauuuuuaaacuuacuuaccagaauaaaguaguacgugugcagagaccagcaaagaacggaacggugauggacgugauaagccgcagagaccaaagaggcagcggccaaguggggacauacggacuuaacaccuuuacgaauauggaagcacaacuaauacgacaaauggaauccgaagguauauucuccccgucugaacuggaaacacccaaccuagcuggucggguuuuagauuggcuggaaaagcacgguguggagaggcuaaaaaggauggcaauaaguggagaugacugcgucgucaaacccauagaugacagguuugcaacggcacuaaccgcauuaaaugauaugggaaaggucagaaaagauauaccucaaugggaaccuucaaagggauggaacgacuggcagcaagucccuuuuugcucucaccauuuucaucaguugauuaugaaagacgggcgggaaauaguuguacccugucgaaaucaggaugaguuaguuggaagggcaaggguuagccaaggcgcaggcuggagccuccgggaaacggcuugucugggaaaguccuacgcucaaauguggcaauuaauguacuuccacaggagagaucuucgacuagcugcaaaugcgauuuguagugcaguuccgguugacuggguuccgacuuccaggaccacuuggucgauucaugcgcaccaccaauggaugacuacagaggauaugcuaucuguauggaaucgaguuuggauagaagaaaacccauggauggaagacaaaacacauauaucuagcuggggcgauguucccuaucuggguaagcgugaagaccaauggugcggaucauuaauagggcugacagcacgagcuacaugggccacgaauauucagguagcaauaaaucaaguucgucggcuccugggaaaugaaaacuauuuagacuauaugacaucuaugaaaagauuuaaaaaugaauccgacccugagggagcguugugguga

SEQ ID NO: 21856 - RNA, 9879 nt, Artificial Sequence
  derived and/or modified CDS sequence (opt6) from DENV-1__GU131787__SS-prME
ucagugacaaugcuauuaauguuaaugccaaccgccuuggcuuuccaccugacgacaagagguggggaaccacacaugauugucaguaaacaagaaagagggaaaucacuguuauucaaaacaagugcaggaguaaacauguguacucuuauagcaauggaccugggagaacugugcgaagacacuaugacguauaaaugcccuagaauaaccgaaacagaaccggaugauguggacuguugguguaacgcaacagauacauggguaacauacgggaccuguucacaaaccggagaacaucguagagauaaaagaucugucgcuuuggcgccacauguagguuuaggcuuagagacacggacagaaacguggaugucgucagaaggagcauggaaacaaauucagcgaguggaaacaugggcuuugcggcauccuggcuucacaguaaucgcacuauuuuuagcacaugcaaucggaacuucaaucacccaaaaaggaauuauauucauucuacucauguuaguaacaccuucgauggcaaugcggugugucggcauugguucucgugacuucgucgaaggccucaguggagcaacauggguugauguuguucuggaacauggaucaugugugaccacuauggcaaaagacaaaccaacauuagacauugaacuguuaaaaacagaaguaacaaauccugcgguauuaagaaaacuguguauagaagccaaaauaaguaauacuacaacugacucuagauguccuacucaaggugaggccacgcuaguagaagaacaagaugcuaacuuuguauguagacgaacguuuguagaucgaggcugggguaacggcuguggacuguucggaaaagggucauugaucaccugugccaaauuuaaauguguaacaaaauuggaaggcaaaauaguccaauaugaaaauuuaaaauauagugucauuguuacagugcacacuggagaucaacaccaaguagguaacgaauccacugaacauggcacuacagcaacaaucacaccacaagcuccaacuacugagauucaacuuacugacuauggagcuuuaacauuagauugcaguccaagaacaggucuggauuuuaaugaaaugguuuuacuaacgaugaaagagaaaaguuggcugguacauaaacagugguuuuuagauuuaccccucccguggaccuccggagcgagcacaucucaagaaacuuggaauaggcaggauuugcuaguaacguucaaaaccgcacacgccaagaaacaggaaguaguaguacucggcagccaggaaggcgcaaugcacacagcccuuaccggggcgacagaaauacaaacgagugggacgacuacgauuuuugcaggucacuugaaaugucgcuugaaaauggacaaacuuacauuaaaaggaauguccuacguaauguguacugguucauuuaaauuggaaaaagaaguagccgaaacccagcauggcacuguuuuaguccaaauaaaguacgaggguaccgaugcaccauguaaaauacccuuuaguacgcaagaugagaaaggaguaacccagaacggcagauuaauuacggcaaauccaauugucaccgauaaagaaaaacccguaaacauagaagcugaaccaccauucggcgaaucguauaucguaauuggagcuggagaaaaggcauugaagcuaucaugguuuaagaagggaaguaguauaggaaaaauguuugaggcuacagccaggggcgcucgaagaauggccauccuaggcgauacagcaugggacuucgguagcauaggcgguguguucacuagcguuggaaagcuaguacaucaaauauucggaaccgcauauggaguauuauuuucgggcgucuccuggacaaugaagauuggaauagguguauuacuuacauggcugggacuaaacagccguagcacgucauugagcaugacaugcauagccgucggguuaguuacuuuauauuuaggagucaugguacaagcugacuccggauguguaauuaauuggaaaggccgugaauuaaaaugugggagcgguaucuuuguuacaaaugagguucauacauggacagaacaauauaaauuucaagcagacuccccuaaaagacuaagugcggcaauagguaaggcuugggaagagggaguaugugggauaagaucagcaacaagacuagaaaauauaauguggaaacaaauaucaaacgaauuaaaccacauuuuacuagaaaaugggaugaaauucacaguuguagugggugaugucgcagguauacucgcccaaggcaagaaaaugaucagaccucagccuauggaauauaaauacagcuggaagucuugggguaaagcaaaaaucauuggagcugaugugcaaaauacaacauuuaucauugacggcccaaacacgccagaaugcccggaugaucaaagggcuuggaauauaugggaaguagaagauuauggcuuugggauauuuacaacuaauauauggcuaaaacuucgugacuccuacacgcaaguaugugaucauagguuaaugagugcugcaauaaaagacaguaaagcaguacacgcugauaugggguauuggaucgagagugagaaaaacgaaacauggaaacuugcuagagcuagcuuuauagaagucaaaacguguauauggccuaagucccauacauuguggucuaacggcguacucgaaagugagaugauuauuccaaagauuuacggugggccaaucagccaacauaauuaucguccaggauauuucacacaaacagcuggaccauggcaucucggaaagcuagaacuagacuucgauuuaugcgagggaacaacgguuguaguagaugaacauuguggcaaucguggcccgucuuuacguacaacaacuguaacagguaaaauuauucacgaguggugcugccgcucuugcacucugccaccacuacgauuucguggggaagauggauguugguacggaauggaaaucagaccgguaaaagagaaagaagaaaauuugguaaagagcauggugucggcugggucaggcgaagucgacagcuuuucucuaggacuccuguguauuucaauaaugauagaagaagucaugagaucaagauggaguagaaagauguuaaugacaggaacgcucgcugucuucuuucuuuugauuauggggcaacuaacauggaaugaucuaauucgccuauguauaaugguaggcgccaacgcuagugaucguaugggaaugggcacaacguaucuugcguuaauggcuacauuuaagaugagaccuauguuugcgguaggacuacucuuuagacgauuaacaagucgagaaguguugcuacuaaccauaggucugagucuggucgcgucuguggaacuuccuaacuccuuagaggagcucggagacgggcuagccauggguauaaugauauuaaaauugcugacagacuuccaaucucaucaacuuugggcuacacuauugucucugacguuuaucaaaacaacauuuucacugcacuaugcguggaaaacuauggcuaugguccuaucuauaguaagccucuuuccauuaugcuuauccacaaccucacaaaagaccacauggcucccaguacuucuuggaagucugggguguaaaccgcuaacaauguuuuuaauagcggaaaauaagaucuggggaagaagaucuuggccauuaaaugagggcauuauggcgguaggaauagugagcauacuacuaaguucauuacuaaagaaugacgucccauuagcaggcccauuaaucgccggagggauguuaauugcuugcuauguaauaaguggguccagugcagaucucucacucgaaaaagcagcagaaguaaguugggaagaagaagcagaacauucaggcgcuucucacaauauucuuguugaaguacaggaugaugguaccaugaagaucaaggaugaagaacgagacgauacauuaacaauuuugcugaaagccacccuguuagcaguaucgggggucuauccauuaucgaucccagccacacucuucguaugguacuucuggcagaagaagaaacaacggagcggcgugcuaugggauacaccaaguccuccggaaguugaacgagccguuuuagaugacgguauauaccgcauuaugcaacgaggguuguuaggucguagucaaguggggguaggcguguuucaagaaaauguguuccacaccauguggcauguaacuagaggagcaguauugauguaccaagguaaacgucuagaacccagcugggcaagcguaaagaaggacuuaauaucuuaugguggcgguuggcguuugcaaggcagcuggaacacaggcgaggaaguacaaguuauagcuguggaaccuggcaagaaucccaaaaauguacaaacagcaccaggcacuuucaagacacccgagggugaagugggagcgaucgcacuggacuuuaagccgggaacguccggaucgccuauaguaaauagagaagggaaaauaguagguuuguacggaaauggggucguuacaacgucuggcacuuauguuucagcgauagcacaggccaaagcuagucaagaaggaccguugccugaaauagaagaugaagucuuuagaaagaggaauuuaacgaucauggaucuacauccaggaucgggaaagacccgacguuaucuaccagccauagugagagaagccauaaaaagaaaacugagaacauugauucuugcacccacucgcgucguggcaucagagauggcagaggcacuaaaaggcaugccaaucagauaucaaacaacggccguaaagagcgaacauacuggaaaagaaauaguagaccuuaugugucacgcgaccuucacaaugcgauuauuaucuccaguacgugucccaaauuauaacaugauuauaauggaugaagcgcauuucacugaucccagcucgauugcagcuagagguuacauaaguacgaggguagggaugggggaagccgcugcgaucuuuaugacugcuacaccaccagguagcguugaagcauuuccccaaucuaacgcgguaauucaagaugaagagagagacauaccugagagauccuggaacaguggguacgaauggauaaccgauuuucccgguaaaacagucugguucguuccaagcauaaaaagcggaaacgauauugcuaacugucucaggaagaacgguaaacgcgucauccaauuaagucggaagacguucgauacggaguaucagaaaacuaaaaauaacgacugggacuacguagugaccacagauaucagugaaaugggagcaaacuucagagcagauagaguuauugauccuaggcgaugcuugaaaccuguuauccuaaaagauggacccgagagagucaucuuagcagguccuaugcccguuacugucgcuagugcagcccaaaggagaggacgcauaggucgaaaucauaauaaagagggagaccaguacauuuauauggggcaaccuuuaaauaaugaugaagaccacgcacacuggacugaagccaaaaugcugcuagacaacauuaacacccccgagggaauaauuccugcccuuuucgaaccugaaagggaaaagucugcagcgauugacggagaauauagguugagaggcgaagcaagaaaaacauucguggaauuaaugagacgcggcgaucuaccaguaugguuaucauacaaagucgcaucggagggauuucaguauucagaucgcagaugguguuucgauggcgagcgaaauaaccagguacuggaggaaaacauggauguagaaauauggacaaaagaaggagaaaggaagaaacugcguccacguuggcuagaugccagaacauauagcgauccgcuagcauuacgagaauuuaaggaauuugcagcuggaaggagguccguaaguggagaucuaauauuagaaauugguaaauugccccagcaucuaacucaacgugcccaaaacgcuuuagacaaccuuguaaugcuucacaauucggaacaaggagguagagcauaucgccaugcaauggaagaauuaccggacacuaucgaaacccuuauguuacuggcuuuaauagcaguacuaaccgguggcguaacauuauucuuuuuaagugggaggggacuaggcaaaacgucgauaggacuucuaugugucauggcuaguagcguauugcuauggauggcuagcguagaaccucacuggauugcugcaucaaucauuuuagaauuuuucuuaaugguguuacuaauuccggaaccugacagacagaggacgccgcaagauaaucaacuugcguacgucguaauaggauugcuuuuuaugauacuaaccguugcugcaaaugaaaugggacuauuggaaacaaccaagaaagauuugggaauuggccacguagccguggaaaaucaccaccaugcugcgauguuagacgucgaucuacauccagcaucugccuggacauuguaugccgucgcaacuacuauaauaacaccaaugaugaggcacacaauagaaaauacuaccgccaauauuucgcuaacggcgauugcaaaucaagcagcaauacucaugggcuuggauaagggauggccuauuuccaaaauggauauagguguaccgcuauuggcgcucggcuguuacucgcaaguuaacccccugacauugacagcugcaguuuugaugcuuguagcccauuaugcaauaauagguccgggccuucaggcgaaagccacaagagaagcccagaaaagaacagcggcaggaauaaugaagaauccgacgguggauggaauagucgcaauugaucuugauccugugguauaugacgcaaaauuugagaaacaauugggacaaauaaugcuuuugauauugugcaccucucaaauucuuuuaaugagaacaacaugggcacucugugagaguauaaccuuagcgacuggcccuuuaacuacauuaugggagggaagccccggaaaauuuuggaacaccacgauagcaguuucgauggcaaauaucuuuagagguaguuauuuagcaggagccggucuagcauucaguuuaaugaagucucuaggcggugguagaagggguaccggagcacaaggcgaaacucugggugagaaauggaaacgucaguuaaaucaacuuagcaaaagugaguuuaacacauacaaacguagugguauuauggaggucgaccgaagcgaagcuaaagaaggcuugaaaagaggagaaacaacaaagcacgcugugucucgugggacugccaagcuaagaugguuuguugaaagaaacuuaguuaaaccugaaggaaaaguuauagauuuagguugugggcgaggagguuggagcuacuauugcgccgguuuaaagaaaguaaccgagguaaaaggcuacacuaaaggugguccagggcacgaagaaccaaucccuauggcaacuuacggauggaauuuggucaagcuacauaguggaaaagauguauuuuucauaccacccgagaaaugcgauacucuucuaugugauauaggugaaucuagcccgaacccaacgaucgaagaggggagaacacuaagaguacugaaaaugguagaaccuuggcuacgcgguaaucaguuuuguauaaaaauacuuaacccauauaugccgaguguaguugaaacacuugaacaaaugcaaagaaaacaugguggaaugcugguacguaacccgcuaucuaggaacaguacccacgaaauguacugggugucaugcggcacagggaauaucguguccgcaguuaauaugacaucucguaugcugcuuaaccgauuuacgauggcccauagaaaacccacguaugaaagggacguagauuugggugcggguaccagacauguggccguagaaccugaagucgcgaacuuggauaucauuggucagagaauagaaaacauaaaacacgagcauaaauccacguggcauuacgaugaagacaauccauauaagacgugggccuaccauggaucguaugagguuaaaccgagcggguccgcuuccucaaugguaaauggagucgugaaauuacugacuaaaccuugggauguaauaccgaugguaacucaaauugcaaugacagacaccacuccauucggacaacaaaggguuuucaaagaaaagguagauacaagaacgccaaaagcaaaacgaggaacagcgcaaauaauggagguuacggccaaauggcuuugggguuucuuaucacgaaacaagaaaccaagaauaugcacaagagaggaauuuacacggaagguacgauccaaugcagcaauaggugcaguuuucguggaugaaaaccaguggaacucagcaaaagaggcgguagaagaugaaagauuuugggaccucguccaucgugaaagggaauugcacaaacaagguaagugcgccacguguguauacaauaugaugggaaaaagggagaagaaacuuggagaguucggaaaggcaaaagggagccgugcaauuugguauauguggcuuggagcuagguucuuagaauuugaagcccugggauuuaugaaugaagaucauugguuuaguagagaaaauagucuguccggaguagagggugagggauugcauaaauugggguacauccugagagauauuaguaaaauaccaggagggaauauguaugccgaugauacagcaggcugggauacgaggauuacagaagacgaucuccaaaacgaagcucgaauaacagauauaauggaaccugaacacgcauugcuagcacgcucuauauucaaauuaacguaccaaaauaaggucguccguguucaaagacccgcaaagaauggaacaguaauggacgugauaucacgacgagaucaaagagguuccggucagguuggaacguacggauugaauacauucacuaauauggaagcccaacuaaucagacaaauggaauccgaagguaucuucaguccuucugaguuagaaaccccaaacuuagcggaacguguccucgauuggcuagaaaaauaugguguagaacgccucaaaaggauggcaauaagcggagaugauugcgucgucaaaccgauagaugauagauuugcaaccgcacucacggcauugaaugauauggggaaaguaagaaaagauauuccacaaugggaaccaucuaaaggcuggaacgauuggcaacaaguaccguuuuguucacaucauuuucaccaguuaauaaugaaagacggaagagaaaucguaguaccuuguaggaaccaggacgaauuaguuggacgggcgcgaguuagccagggagcaggauggucuuuaagggagaccgcgugccuggguaagaguuaugcucagauguggcaauugauguauuuucauaggagagaucugcggcucgccgcaaacgcaauuuguagugcaguaccagucgauuggauaccaacaucacguacgacauggagcauccaugcacaucaucaauggaugaccacagaggacaugcuaagcguauggaaucgaguauggauagaagaaaauccauggauggaagauaaaacacauauuucaaguuggggagaugucccauaucuuggcaaaagggaggaccaaugguguggaucauugauuggauuaacagcucgggcuaccugggcuaccaacauacagguugccaucaaccaggugagaagauuaauuggaaacgaaaacuaucuggauuacaugacaucgaugaaaagauuuaaaaaugagucagauccugaaggagcccuaugguag

SEQ ID NO: 21857 - RNA, 9879 nt, Artificial Sequence
  derived and/or modified CDS sequence (opt6) from DENV-1__HM181968__SS-prME
ucgguaacaaugcuguugauguuaaugccaacagcauuggcguuucauuuaacuacacgcgggggagaaccccacaugauagugacgaaacaagaaaggggaaaaaguuuacuauucaagacauccgcgggcguuaauauguguacgcugauugcaauggaucuaggggaauugugugaagauacaaugacguauaaaugccccagaauaaccgaagcugaaccggaugauguugauuguugguguaacgcaacagauacuugggugacguaugguaccugcucccaaacuggagaacaucgucgugacaaaagaaguguugcacuggcuccacauguuggacugggauuggaaacaagaacugaaaccuggaugucaucagaaggcgcauggaaacaaauccaacgaguugaaacuugggcacuuaggcacccagguuuuacaguaaucgccuuguuucuagcacaugcaauagguacuagcauuacucaaaagggaauaaucuucauucucuuaaugcuaguuacaccuagcauggcaaugcgguguguuggcauaggaaguagagauuucguugaaggccugucaggagcaacauggguagacguuguucuagaacauggcucguguguaacaacaauggcaaaagacaagccaacacuagacauagaauuguugaaaacagaagugacaaauccagcuguuuuaagaaagcuauguauagaagcaaagauuucgaauacaacgacggacagccggugcccaacccaaggugaagcuacguuaauggaggaacaagacgcaaauuuugugugccgucgcacauucguugaucgcggcugggguaacggaugugguuuguuuggaaaagguaguuuaauaacgugugcaaaauucaaauguguaacuaagcuggaaggaaaaauagugcaauacgaaaauuuaaaauauucgguaauaguaacgguucacacuggcgaucaacaucaaguugggaaugaaucgaccgagcacggcacaacagcuacaauaacaccccaagcuccuacaagugaaauucaacuaacugauuacggagcauuaacccucgauuguagcccaagaacaggauuagacuucaacgaaaugguucuacuaacgaugaaggaaaaaucaugguuaguacauaagcaaugguuccuagaucugccccuaccauggacuucaggugcuaguacgucacaggaaacauggaauagacaggaccuucuuguuacguuuaaaacagcacacgccaagaaacaagaagugguaguacucggaucacaggaaggagccaugcacacugcacugacuggagcuacagaaauacagacaucugguacgacaacgauuuuugcaggacaccuaaaauguagguuaaaaauggauaaguuaacacuuaaaggaauguccuacgugauguguacagggucuuuuaagcuggagaaagaaguugcagaaacgcaacaugguacuguauuagugcaaaucaaguaugaaggaacagacgcuccuuguaaaauaccauucucaacacaagacgaaaagggagcgacacaaaauggacgguuaaucacugcaaaccccauaguaaccgacaaagaaaagccagucaacauagaagcggaaccaccuuuuggagagucauauaucguuauaggggcaggagaaaaagcauuaaaacuuuccugguucaagaaagguaguucgauaggaaaaauguuugaggcgacagcacguggcgcucgaagaauggcuauacuaggcgauacagcaugggauuuuggcuccguuggugggguauucacuagcgucgggaaauuaguucaucaaauuuucgguaccgcuuacgggguauuauuuuccgguguaagcuggaccaugaaaauugguaucggaguacuccuuaccuggcuaggucuuaauucaagaucuaccucacuaucuaugacauguauagcaguaggauuaguaacacuauauuuaggaguaaugguccaagccgacagugguuguguaauuaacuggaaaggacgagaguuaaaaugcggcaguggaauauuugugacuaacgagguacacacuuggaccgaacaguauaaauuccaagcagauucuccuaaaaggcuaucagcugcaauugguaaggcaugggaagaaggugugugcggaauacggucagcaaccagacuugaaaacaucauguggaaacaaauuucaaaugaguuaaaccacauacucuuagaaaacgauaugaaauuuacaguuguaguuggugacguaguugguauauuagcacaaggaaagaaaaugauuaggccccagccuauggaacacaaauauucuuggaaaucauggggaaaagcuaaaauaauaggagcggacguucagaacacuacuuuuauaauagauggcccaaauacaccggaauguccugaugaucagagagccuggaauauaugggagguagaagacuacggauucgguauauucgcaaccaacauaugguugaaauuacgagauucguacacacaagugugcgaccaucgauuaaugagcgcggccauaaaggauaguaaagcugugcaugccgauaugggcuacuggauugaaagugagaaaaacgaaacauggaaauuggcaagagcuaguuuuauagaaguuaaaacuugcauauggccaaaaucucacacuuuauggucgaacgguguguuagaaucagaaaugauuauuccuaaaauauauggaggucccauaagccaacauaauuauaggcccggguacuucacgcaaacagcagggccauggcacuuagguaaauuggagcuagauuuugaccuaugcgaagggacuacaguaguugucgacgaacauuguggcaaucgugguccgucauuaaggacgacuaccguuacaggcaaaauaauacacgagugguguuguagguccuguacacuaccuccgcuccgauucaaaggagaggacgguuguugguaugggauggaaauuaggccugugaaagaaaaggaagaaaaucugguuaagucgaugguaagcgcgggauccggagaaguagauucauucucuuuagggcuuuuaugcauaucaauaaugauagaagaaguuaugcgaagcagauggucuagaaaaauguuaaugacgggcaccuuagcggucuuccuauuacucauaaugggacaguugacuuggaacgaccuuauacguuuaugcaucauggugggcgcaaacgccagcgaucgcauggguauggguacgacauauuuggcauuaauggcuacauucaagaugcguccuauguucgccguaggacuucuauuaagacgguugacaucacgugaaguauuacuauuaaccauaggguuaucccuggucgccuccguugaauugccaaacucuuuggaagaauuaggcgacgggcuugccaugggaaucaugauccucaaauuauuaaccgauuuccaaagccaccaguuaugggcaacauuauugagccuaacuuucauaaagacuacacuaagucuucacuacgccuggaaaaccauggcgaugguuuugagcauuguaucacuuuuuccgcugugcuuaucuaccacaagucagaaaaccacaugguuaccuguucuucuaggaaguuuuggcugcaaaccucugacuauguuuuugaucacagaaaacaagauuuggggacgcaaaucauggcccuuaaaugaaggaauaauggcgguagggguugucaguauuuuauugagcucuuuacuaaagaaugacguuccauuggccgguccguuaauagccggggguaugcuaaucgcaugcuauguaauuaguggaucaucggcagaccugucccucgaaaaggcugcugaaguaucaugggaagaggaagcagaacauagcggggccagccacaacauuuuaguggaagugcaagacgauggaacaaugaaaaucaaagacgaagaacgugaugacacgcugacaauccuucugaaagccacccuucuagcuguaucaggugucuauccccuaucuaucccagccacauuauuugugugguauuuuuggcaaaagaaaaagcaacggagcgguguauuaugggacacaccuagcccuccugaaguagaaagagcuguguuagacgacgggaucuacaggaucaugcagaggggauugcuggggaggucucaaguuggaguaggcguauuccaagagaauguuuuucauaccauguggcauguaacaagaggggcuguacucauguaccaagguaaaagguuggaaccaucuugggcgagugucaagaaagacuugauaaguuacggcggaggguggaggcuacagggaucguggaauacaggagaagaaguacaaguaauugcaguagaaccagguaaaaacccuaagaauguucaaaccgccccagguacauuuaaaacgccggaaggagaaguuggagccauagcucuagauuuuaaacccggcacaucagguucaccuaucguaaacagagaagguaaaauuguaggucuguauggaaauggugugguaacuacuucuggaacauacguaagugcaauugcucaagcaaaagcaucccaagaagggccuuugccagaaauugaagaugaagucuuuagaaaaagaaaccuaacuauuauggaucuucacccuggcagcgguaaaacuagacgguaccuuccugcaaucguaagggaagcgauuaaaagaaaguugcgaacacuuauucuugcaccaacacguguaguagccagugagauggcagaggcauuaaaggguaugcccauaagauaucaaacgaccgcugugaaaagcgaacauacugguaaagaaauugucgaccugaugugccaugcaacauuuacgaugagacuucuaucaccaguacgcgugccgaauuauaauaugauaauuauggacgaggcccacuuuacugacccgagcucaauugcagcaagaggauauauaucgacacggguugguaugggugaggcagcggcaauuuuuaugacagcgacgccuccaggcucgguggaggcuuuuccucaaucaaaugccgugauacaggacgaagagagagauauaccggagcguuccuggaauaguggauaugaauggauaacagauuuucccggcaagacaguuugguuuguaccaucaauuaaaucaggcaaugauaucgcgaauugccugcgcaaaaacggcaaacgcgugauacagcuaucaagaaaaacguuugauacagaguaucagaaaaccaaaaacaacgacugggauuacguuguaacgaccgacauauccgaaaugggugcaaacuuuagagcugauagaguuauugacccucgaagaugucuuaaaccuguaauccucaaagaugggccugagaggguaauucuggcagguccgaugccugugacuguugcgucugcugcucaaaggcgagggagaauagguagaaaccacaacaaagagggugaucaauauauauauauggggcaaccuuuaaacaacgacgaagaucacgcgcauuggaccgaagcaaagaugcuauuagacaacauaaacacaccugaagggauaauucccgcauuauuugaaccagaaagggagaaaagcgcagcaaucgauggagaauaccgacuacguggggaggcuaggaagacguuuguagaacuaaugcgacgcggagauuuaccaguaugguugaguuacaaggucgccucagaaggauuccaauauucagauagacguuggugcuuugacggagagagaaauaaucaaguuuuagaagaaaacauggauguugagauauggacaaaagagggugaacgaaagaaauuaagaccuagauggcuugacgcccgaacauauucagauccacuggcacuacgugaguucaaagaauuugcugcggguagacguuccguaucuggugaucuaauacuggagauuggcaaguugccacagcaucuaacacaaagagcucaaaacgcccuagauaauuuaguuaugcuccauaauucugaacaaggaggacgagcuuacagacacgcaauggaggaauuaccagacacuauagaaacuuuaaugcuuuuagcuuugauugcaguucugacuggugguguaacacuauucuuucugaguggaagaggucuugguaaaacaucaauaggauuguuaugcgucauggcaucguccguuuuauuguggauggccucaguggaaccacacuggauugcagcaucaauuauacucgaguucuuucugaugguauugcuuaucccagaaccagauagacaaagaacuccgcaagauaaccaacuagcguauguaguaaucggccuacuauuuaugauacuaacagucgcagccaacgaaaugggacucuuagaaacaaccaagaaagaccuaggaauaggacauguugcaguugaaaaccaccaucacgccacaauguuagacguggaucuucauccugcuagcgcauggacucuauaugccguagcgacuacaauaauaacuccaaugaugcggcacacaauagaaaauacuaccgcaaacauuucauuaacugcaauagccaaucaagcugcaauccuuaugggauuagauaaggguuggccaaucucaaaaauggacauuggaguacccuuauuggcccuuggauguuauucacaagucaaucccuuaacauugacugccgcuguuuuaauguuagucgcacauuaugccauaaucgggccaggacuacaggcgaaagcaacuagggaagcucagaaacgaacggcggcaggaauuaugaagaauccaacgguggacgguauuguagccauagaccuggauccaguaguauacgacgcaaaauuugaaaaacaguuggggcaaaucaugcuauuaauacucuguacuucacaaauacuacugaugcguaccacgugggccuuaugugaaucuaucacccuugcaacaggcccuuuaacaacccucugggaaggaucccccgggaaauucuggaauacaacaauugccguuaguauggcaaacauuuucagggguucauacuuagccggagcuggcuuagcauuuucgcuaaugaaaucuuugggaggugguagaagaggaacaggggcacaaggagagacgcugggcgaaaaguggaaaaggcaauuaaaccaacucucgaaaagcgaauuuaauauuuacaaaaggucagguauaauggaaguggauagaucggaagcaaaagagggacucaagcguggagaaacaacaagacaugccgugagccgaggaaccgcaaaacuacgaugguuuguagaaaggaaccuaguuaaaccugaagggaaaguaauagauuugggcuguggaaggggaggguggucauacuauugcgccgggcuaaagaaaguaacagaagucaagggauauacuaaaggagggccgggacaugaggaaccuauuccaauggccaccuauggcuggaacuuaguaaaacugcacagcgggaaggacgucuuuuucacaccgccugagaagugcgauacacugcuuugcgauaucggagaaagcucaccuaacccgacaauugaagaaggaaggacucuucgaguucuaaaaaugguagagcccuggcuaagaggcaaucaauucugcauuaaaaucuuaaauccauauaugccgucagucguggagacucuagagcaaaugcaacgcaaacaugggggaaugcuaguacggaauccucucagucguaauaguacucaugaaauguauuggguaaguugcggcacaggaaauauugucucagcaguuaauaugacaagcaggauguuacuaaauagauuuacgauggcacaucgaaaaccaacguaugaacgagacguugauuuaggggcgggaacccgacauguagcaguugaaccugaaguagcgaaucucgacauuauuggucaacgaauagagaauauuaaacaugaacauaaaucuacauggcacuaugaugaggauaauccguacaaaacaugggccuaccacggcucauaugaagugaaaccaagcgggucagcaucuucuaugguaaacggugucgucaaacuguuaaccaaaccgugggaugugauucccaugguuacacaaauugcuaugacagacacaacaccauuuggucaacaaaggguauuuaaggagaaaguugacaccagaacgccaaaggcuaaacgaggcaccgcgcagaucauggaaguuacagcaagauggcucuggggauuuuuaucccgcaauaagaaaccacgaaucuguacgcgggaggaguucaccagaaaagugcgcaguaaugcagcaauaggagcaguauuuguugaugaaaaucaguggaacuccgcuaaagaggccgucgaggacgagagauuuugggaucuaguacaaaaagagcgugaauuacacaagcaaggaaaaugcgcaacaugcgucuacaauaugaugggaaaacgggagaaaaagcugggugaauuugguaaagcaaaaggcagucgagccauaugguauauguggcucggagcuagguuccucgaguuugaagcacuaggcuuuaugaacgaagaucacugguuuucaagagaaaauucauuaucagguguagaaggcgagggacuucauaaauuaggauauauacuaagagauauaucuaaaauaccuggugguaacauguaugcugacgacacugcagggugggauacgcguauaacggaagacgaucugcagaaugaagcuaaaauaaccgacauaauggagccagaacaugcacuauuagcuacaucuauuuucaaacucacauaucaaaacaaagucguaagaguacagagaccagccaaaaauggcaccgugauggacguaaucagucguagagaccaaagggguucaggacaagugggcacuuauggcuuaaauacuuucacuaauauggaagcacaacuaauccggcagauggagucugaaggaauuuucuugcccagugagcuagaaacaccuaauuuagcagagagggugcuggacuggcucgaaaaguacggaguggagcgcuuaaaacguauggcaauaagcggggaugacuguguaguuaaaccuauagaugaccgauucgcaacggcucuaacagcccuaaaugauauggguaaaguaaggaaagauauuccacagugggaaccgagcaaagguuggaacgauuggcaacagguuccuuucugcagccaccauuuccaucaacuaauaaugaaagacggaagagagauugugguuccaugucggaaucaagaugaauuaguggggcgggcccguguuagucaaggagcuggauggagucuuagagaaacugcuuguuuaggcaagucauaugcccagauguggcaguuaauguauuuucauagaagggaucuaaggcuggcggcaaacgcaaucuguagcgcuguuccuauagauugggugccuacaucuagaacaacuuggucuauucacgcacaccaucaauggaugacaacggaagacaugcugucaguuuggaacagaguauggauagaggagaacccguggauggaagauaaaacucacgugucaucuuggggcgacgugccauaucugggaaaacgugaggaucaauggugcggaucguuaauaggauuaacagcccgugcuacaugggcuagcaauauucagguugcaauaaaucaaguacggagauuaauugggaacgaaaauuauuuagacuacaugaccaguaugaagagauucaaaaaugagggagauccggagggugcgcuuugguaa

SEQ ID NO: 21858 - RNA, 9879 nt, Artificial Sequence
  derived and/or modified CDS sequence (opt6) from DENV-1__GU131789__SS-prME
aguguuacuaugcuucuuauguuaaugccgacagcacuagcauuucaccuaacaacccgggguggggaaccacacaugaucguuucuaaacaagaaagggggaaaaguuuauuauuuaaaacuuccgccgguguaaauaugugcacauugauagcaauggacuuaggggaacuuugugaagauacaaugacguacaaaugccccaggaucaccgaaacagaaccggaugacgucgauuguuggugcaacgcaacagacacauggguuacuuacgguaccuguucacaaacaggagaacacaggagagauaaaagaaguguagcuuuagcgccacaugucggucuagggcuagaaacccgaacagaaacuuggaugucuagcgaaggggcauggaaacagauccaaaggguagaaacuugggcacuuagacacccaggauuuacggucauagcgcuauuccuagcucaugcgauaggaacaaguauaacucaaaaaggaaucauauuuauacuacuaauguuaguuacaccgagcauggcaaugcgguguguaggaauuggcuccagggacuuuguugaaggguuaaguggugcaacguggguugaugugguacuagaacauggcucauguguuacaacaauggcuaaagacaagccgacauuagauauagaacuccuaaaaacagaaguaaccaauccagcaauacugaggaaacuuuguauugaagcuaaaauuucaaauacaacuacagauagucguuguccaacacaaggagaagcuacccuaguagaagaacaagacgcaaacuucgucugccguaggacguucguagauagaggcuggggaaauggcuguggacucuucgguaaggguagccuuaucacaugugcgaaauucaaaugugugacaaagcuagaagggaaaauaguucaauacgaaaaucucaaauauucgguaauaguuacugugcauacgggagaucaacaucaaguagguaaugaaucuacagaacacgguacgacggcaacaauaacaccacaagcaccuacaacugaaauucaacuuacagacuauggagcauuaacauuagauuguaguccaagaacaggauuagacuuuaaugaaaugguauuacucacaaugaaggaaaaaucauggcuaguacauaaacaaugguuccuagaucuuccgcuuccauggacgaguggggcaucuacuagccaagaaacguggaacagacaagaccugcugguaacuuuuaaaacugcacacgccaagaaacaagaaguagugguacuggguucucaagaaggagcaaugcacaccgcacuaacuggagcuacagaaauacaaacaucaggcacaaccaccauuuucgcuggacauuugaaaugccgauugaagauggacaaacuuacgcuaaagggaaugucauacgucauguguacgggauccuucaaauuagaaaaagaaguagcagaaacacagcacgguaccguccuagugcagauuaaauaugaagguacugaugcaccuuguaagauaccguuuucaacccaggacgaaaaaggagucacacagaacgggcggcuuauaacggcaaauccuauagucacggacaaagagaaaccaguaaauauugaagcagagccgccguucggggagucauacauagucaucggagccggagaaaaagcgcucaagcuaaguugguuuaaaaaggguucauccauuggaaaaauguucgaagcuacggcucggggugcaagacgaauggcuauacuaggggauaccgccugggacuucggcaguauuggaggaguauuuacaucagucgguaaacuuguacaucaaauuuuuggaacggccuauggggucuuauuuagcggagugucuuggacaaugaaaauuggcauaggcguguuauuaacuuggcugggauuaaauucucggucaacuucuuugucaaugacaugcauagcuguaggacucguuaccuuguaccuaggaguaaugguacaagcugacagcggguguguuauuaauuggaaaggacgagaacuaaaaugugggucaggaauauucguaacaaaugaaguacauaccuggacggaacaauauaaauuccaagcggauucaccgaagcgcuuauccgccgcaauaggaaaagcaugggaagaaggaguaugugggauaagguccgcaacucgucuagaaaacauuauguggaagcaaaucucaaacgaauugaaucacauucuauuagaaaacgacaugaaauucacuguaguuguaggcgauguagcaggaauuuuggcacaagggaagaaaaugauaagaccucaaccaauggaauauaaauacucuuggaagucuugggggaaggcuaaaaucauaggcgcugauguucagaauacaacauucauaauugaugggcccaauacaccagaauguccggacgaucaacgagcauggaauaucugggagguggaagauuauggcuucgguauuuucaccacaaauaucuggcuaaaauugcgugacaguuauacacaaguaugcgaucauagauuaaugucugcagcgaucaaagacagcaaagcaguccacgcugauaugggauacuggauugaaagugagaaaaaugaaacguggaaauuagcccgugcgucuuucauagaaguuaagacguguauuuggccaaaaagucacacgcucuggucuaaugguguccuugaaagugaaaugauaauccccaaaauuuauggaggaccuauuagccaacacaauuauagaccaggauacuuuacucaaacagcuggcccguggcauuugggaaaauuagaacuagauuuugaucuaugcgaagggacaacaguaguaguagacgagcauugcggcaaucgugggccguccuuaagaacuacaacaguaacuggaaaaaucauacaugaaugguguugccgaaguugcacacuuccgccguugcgauuccggggugaggacggaugcugguauggaauggaaauacgaccaguuaaagaaaaagaagaaaaucuagugaaaucuaugguuagcgccggaucaggggaaguggauaguuucucuuugggauuguuaugcauauccauaaugauagaggaaguaaugaggucccguuggaguaggaaaaugcuuaugacaggaacacuagcuguguuucuacuauuaauuaugggacaacugacuuggaacgauuuaauacgccugugcaucaugguaggcgcaaaugccagugauaggaugggaaugggcacuacuuaucuugcguuaauggcuacauuuaaaaugagaccuauguucgcugugggacugcuauuucguagauuaacaucaagagaaguccugcuacucacaauuggacugagccugguagcgucgguagaacugccaaacagcuuagaggaacuaggagaugguuuagcaaugggaauaaugauucucaaacuucucacagacuuucaaucacaucaauuaugggcaacucuacuuucacugacauucauuaaaacaacuuuuucuuuacacuaugcauggaagacaauggcuaugguacuuagcauaguaucacucuuuccuuuauguuuaucgacaacaagucaaaagacaacuuggcuaccuguauuauugggaaguuuaggcuguaagcccuugacaauguuuuuaauugcggaaaauaaaauuuggggacgccgaucuuggccgcuaaacgaagguaucauggcaguggggauagucaguauacuucucagcaguuuauugaaaaaugacguaccauuagccggaccguugauagcaggaggcauguugaucgcauguuaugucaucucggguuccagugcagaucuuuccuuggaaaaagcagcagaagucagcugggaagaggaagcagaacacaguggugcuucccacaauauacuuguggaaguacaagacgauggaaccaugaaaaucaaagaugaagagagagacgacacguuaacgauccuccuaaaagcuacguuauuagccgugucuggaguguacccauugagcaucccugcaacauuguuuguuugguauuucuggcagaaaaagaaacaacguuccggaguacuaugggacaccccaucaccaccagaaguugaaagggcuguucuugaugaugguauuuaucgaauaaugcaacgagguuugcuuggacgaucacaaguagguguaggaguauuucaagaaaauguuuuucauacuauguggcacguuacccgaggagcagucuugauguaucagggcaaacgccuagaaccaucaugggcaucagugaagaaagauuugaucucuuauggaggcggguggagacugcagggaucuuggaacacgggugaggaaguccagguuauugcgguagagccaggcaaaaacccgaaaaauguacaaacaacaccugguacguucaaaacaccagaaggagagguuggagcaauugcacucgacuuuaaaccuggaaccaguggaagucccaucguaaauagagaaggaaaaauagucggauuauauggaaauggaguaguuacaacaaguggaacauacguauccgccaucgcacaagcgaaagccucacaggaaggaccgcuuccugaaaucgaggacgaaguauuucgaaaaaggaaucuuacaaucauggauuuacauccaggcuccggaaagacuagaagauaucucccagcaauaguccgcgaagcaauuaaacguaaauuacggacccuuauuuuggcacccacuagaguaguugccagugaaauggccgaagcauugaaggguaugcccauaagauaccagacaacagcgguaaaaucagaacacacgggcaaagaaauuguagaucuaaugugucaugcaacauucacgaugaggcuguuaaguccgguacgaguaccaaauuacaauaugauaauaauggacgaagcacauuuuaccgauccaucuaguauugccgcuagaggauauauuucgacgaggguagggaugggcgaggcagcagcaauauucaugacagcgacaccuccaggaaguguagaagcauuuccacaaaguaaugcaguaauacaggacgaagagagagacauuccugagagaaguuggaacuccggcuacgaauggauaacagacuucccuggcaagacuguuugguuuguuccgaguauaaagucaggcaaugauauagcuaauugccuaaggaaaaaugggaaacggguaauacaacuaagucgaaaaacuuuugacacagaguaucagaaaacuaaaaauaaugacugggauuaugugguaacaacugauauaagugaaaugggugcgaacuuucgagcugauagaguuauugacccaaggagaugucuaaaacccguuauacuuaaggacggaccugagcgaguaauacuagcaggaccuaugccaguuacaguagcuucugcagcucaaaggagggguaggauuggaaggaaccauaacaaagaaggagaucaguacauauacauggggcaaccucuuaauaacgaugaagaucaugcgcauuggacagaagcaaaaaugcuccuagauaacauuaauacuccagaaggaauuauaccagcucuguucgaaccagaaagggagaaaagugcggcgauugauggugaguaccgacuacguggugaggcacgaaaaacauucguggaauuaaugcgaaggggcgaucucccgguguggcuaaguuauaaaguugcaucggaaggcuuucaguacucugauagaagauggugcuuugauggagagaggaacaaccaaguuuuagaggaaaauauggacguugaaaucuggacuaaggaaggggagaggaagaaacugaggccgagaugguuagaugcucgaacauacucagacccgcuagcguuaagagaguucaaggaguucgcagcgggaagaaggaguguaaguggagauuuaauccuagaaaucggcaaacuuccacagcaccugacgcagagggcgcagaaugcccuggauaaucuagugauguugcauaauuccgaacaagggggcagggcauacagacacgcaauggaagaauuaccugacaccauugagacacuuaugcuacuagcgcuaauugccgugcuuacugggggcguaacgcuauuuuuccuaucugguagaggauugggaaagaccagcauuggcuuauuaugugugauggcuucgagcguuuuacuauggauggccucuguagaaccccacuggauagcugcuucaauaauucuagaguucuuucuaaugguacuauuaauaccagaaccagaccggcagaggacuccccaagauaaucaauuagcauauguuguaauagguuuauuauuuaugauauugacaguagcagcaaaugaaaugggccuacuugagaccaccaagaaagaucuugggauaggccacguggcuguagguaaccaucaccaugcagcaauguuggacguugauuuacacccggccucagcuuggacauuguacgcgguugccacaaccauaaucaccccaaugaugagacacaccauugaaaacacgacagcaaacauuucucuuacggcaauagccaaccaggcggcuauccuaaugggauuggacaagggauggcccauauccaaaauggacauuggcgucccgcuuuuagcucuagguuguuauucucaaguaaaucccuugacacuuacagcagcuguauugauguuaguagcacauuaugcaauaauaggaccaggguuacaggcgaaggcaacacgugaggcacaaaaacguacugcggcagggauaaugaagaauccaacuguugacggaauagucgccauagauuuggacccagucgucuacgaugcgaaauuugaaaaacaauuaggacaaauuauguuguuaauauuguguacaagucagauuuugcuaaugcgaacaacuugggcacucugugaauccauaaccuuagcuaccgguccacugacaacuuuaugggaggguagcccggguaaguucuggaauacuacaauugcggucucuauggcaaauauuuuucgagguucguaccucgcgggagcuggccucgcguucuccuuaaugaaaucucuaggcggagggcguagaggaacaggggcgcaaggugagacacugggggagaaguggaaaagacaacuaaaccaauuaucaaaaucugaguucaauacuuauaaaagaagcggaauaauggaaguagaccgaucagaggccaaggagggucuaaaaagaggagaaacaacuaaacaugcugucuccagaggaacagccaaacuucgcugguuuguugaaagaaaucuagucaaaccagaaggaaaaguaauagaccuugggugcgguagaggggguuggucguacuauugcgcaggccuuaagaagguaacagaagugaaaggcuauacaaaaggcggaccaggacaugaagaacccauuccaauggcaacuuauggguggaacuuaguaaagcugcacagugggaaagacguauucuuuauaccaccagaaaaaugcgacacacuucuaugugacauuggugaguccucaccaaacccaacuauagaagagggcagaacgcuuagaguguuaaaaaugguagaaccauggcuuagggguaaucaguuuugcauaaaaauacuaaaccccuacaugccuucaguugucgaaacuuuggaacagaugcaacguaaacacggaggcaugcuggugagaaauccgcuaaguaggaauagcacacacgaaauguauuggguuuccuguggaaccggaaacauaguuucugcuguuaauaugacgucacgaaugcuauuaaauagguucaccauggcacaucgaaaaccaacuuacgagagagacguugaucugggugcagguacccgucaugucgcugucgaaccagaagucgcaaaucuagacauaauaggacaaaggauugagaauauuaaacacgaacauaaaaguacauggcacuaugaugaagauaacccauacaaaacgugggcuuaucauggaagcuaugaggucaaaccgucuggcagugcgaguucuauggugaauggugucguaaaacuucugacuaaacccugggauguaauaccuaugguaacacaaauagcaaugacggauacaacgcccuuuggacaacaacgaguauuuaaggaaaaagucgacacuagaacaccaaaggccaaaagaggaacugcacaaauaauggaaguuacagcuaagugguuauggggguuucuaucucguaauaagaagccaagaauauguacaagggaagaguuuacaagaaaaguacgaucaaaugcagcaauaggugcgguauuuguggaugaaaaucaauggaauagugccaaagaggcuguugaggacgagcgcuucugggaccuagugcacagggagagagagcuucacaagcaagguaagugugcaacaugcguauacaauaugaugggaaaaagagagaaaaagcucggugaauuugggaaggcaaaggguuccagagcaauaugguauaugugguugggggcuagauuuuuggaguucgaggcauuaggguuuaugaaugaggaccacugguucucgagggaaaacagucuuagugguguugagggugagggccuucauaaacuaggguauauacuuagagauauuuccaaaauacccggaggcaacauguaugcagaugauaccgccgguugggauacuagaaucacugaagacgacuuacaaaacgaagcuaggauaacagacauuauggaaccagaacaugcuuuacuagcaaaaagcauuuuuaagcuaacguaucaaaauaaaguaguaagagugcaaagaccggcuaagaauggaacagugauggauguaauuucuagacgagaucaaagagggaguggucagguuggcacauauggcuugaauacauuuacuaauauggaagcacaguuaauaaggcaaauggagucagaggguauauucucaccuuccgaacuagaaacaccaauccuugccgaacgaguacuagauugguuagagaaauacgggguagaacguuuaaaacgcauggcgauaucgggugacgauugugugguuaaaccaauagaugauagauuugcuacugcuuugacugcauugaaugauaugggaaaaguaagaaaagacauaccacaaugggaaccuucaaaaggauggaaugauuggcagcagguuccuuuuuguucucaccacuuccaucaguuaauuaugaaggauggcagagaaauuguggucccuuguagaaaccaagaugaacucgucgggcgcgcccgcguuucacagggagcgggguggagccugagggaaacagcaugccuagguaagucauacgcccaaauguggcaacuaauguauuuucaccgaagggacuugagauuagcagcaaaugcgauauguagcgccguaccagucgauuggauuccaacuagcagaacaacauggucaauccaugcacaucaccaauggaugacgacagaggauauguuauccgucuggaauagaguuuggauugaggaaaaucccuggauggaagauaagacacauauauccagcuggggugacguaccguacuuggguaaaagagaggaucaaugguguggaagccuaauaggcuugacugcacgugcaacgugggcuaccaacauacaaguagccauaaaucaaguaagaaggcuuauugguaaugagaacuaccuagauuauaugacgucuaugaaacgguucaagaaugagucagacccagaaggugcacuaugguga

SEQ ID NO: 21859 - RNA, 9879 nt, Artificial Sequence
  derived and/or modified CDS sequence (opt6) from DENV-1__GU131790__SS-prME
aguguaacaauguuauugaugcuagugccuaccgcacuugcauuucaucuaacaacaagggguggagaaccucauaugauuguaaguaagcaggagagagggaaaucuuugcucuucaaaacaagugcgggaguaaauauguguacauugauagcaauggauuuaggggaacuuugugaagauaccaugacguauaaauguccuagaauaacugagacggaaccugacgacgucgauugcuggugcaaugccacugacacuugggugacuuauggaacgugcagccaaacaggcgaacaccgucgugacaagagauccguagcccuugcuccacacgugggccucggacuugaaacaagaacagaaacauggaugaguagugaaggugcauggaagcaaauccaacgaguagaaacaugggcauuacgucauccuggauucacaguaaucgcacuauucuuagcucaugcaaucgguacauccauaacacagaaagguauaauuuucaucuuauuaaugcuuguuacucccucgauggcuaugaggugcgugggaauagguucuagagacuucgucgaaggguuaaguggugccacgugggucgauguuguuuuggagcacggaagcugcguaacuacgauggccaaagauaaaccaacucuagacauugaacuacuaaaaacagaaguaacaaaucccgccgucuuaagaaaacuuuguauagaagcaaaaauuaguaacacgacgacagacucacgcugcccaacgcaaggugaggcaaccuugguagaagagcaagaugcaaauuuuguaugccgaaggacguuuguagauagaggcugggguaauggaugcggacuauucggaaaggguucucuaauaacaugugccaaguuuaaaugcguuacaaaacuagaaggaaaaauaguucaauacgaaaaucuuaaguauagcguaaucguaacagugcauacuggcgaccaacaucagguaggaaaugaaucaacggaacacgggacaacugcuacuauaacaccacaagccccaacaaccgaaauacaacucacagauuacggagcacuuacuuuagauugcuccccucguacaggacuugacuucaaugaaaugguacuacugacaaugaaagaaaaaucauggcuaguacauaaacaaugguuuuuggacuuaccguuaccauggacaagcggugcuuccaccagucaggagacguggaaccgacaggacuugcuaguaacauuuaaaaccgcucaugccaaaaagcaagaggugguaguacuuggcucucaggagggagcuaugcacacagcuuuaaccggggcuacagaaauucaaacuagcgggacaacgaccauuuuugcaggucacuuaaaaugucggcuaaaaauggauaaacuaacguuaaaagguaugaguuaugucaugugcacaggcucauuuaaacuugaaaaggagguagcugaaacgcagcacggaaccgucuuagugcaaauaaaauacgaaggaaccgaugcgccuuguaaaauuccguucaguacacaggaugaaaagggagucacgcagaacgguagauuaauuacagcaaauccaaucgucaccgacaaagagaaacccgucaacaucgaagcggagccgcccuuuggagaaucauacauaguuauuggagcuggagaaaaagcccuuaaauuaucuugguucaaaaaggguaguucuauuggaaaaauguucgaagcaacagcaagaggcgcaagaagaauggcgauauuaggggauacggcgugggauuuuggaucgaucggcgguguauucacuuccgucggcaagcuaguacaucaaaucuucggcacagcguaugggguacucuucucgggugucagcuggacgaugaaaauugggauuggcgugcuccuaaccuggcuagggcuaaauagucgaagcaccucgcugagcaugaccuguauugcaguaggguuaguaacucuauaucuaggugugaugguacaagccgauucaggauguguaauuaauuggaaaggacgugaguuaaaaugcgguagcggaauauucguuacuaacgaaguccauacauggacagaacaauauaaauuccaggcagacagccccaaaagacuuucugccgcgaucggcaaggccugggaagaagguguaugcggcauucguagcgcuaccagauuagaaaauauaauguggaagcaaauuucgaaugaauuaaaucauauacuucuagaaaaugacaugaaauuuacaguaguaguaggagacguagcagguauuuuagcucaagggaaaaaaaugauacguccccagcccauggaauacaaauauucuuggaaaaguuggggcaaggcaaaacucauaggcgcugauguacaaaauacaacuuucauuauagauggccccaauacgccugaaugcccugacgaccaaagagcauggaacauaugggaaguagaagacuacggguuuggaaucuuuacuacaaauauuuggcuaaaacugagggauuccuacacucaggugugugaucacagguuaaugucagcugccaucaaagacucuaaagccguccaugccgauaugggguacuggaucgaaucagagaaaaaugaaacuuggaaacuagcgagagcaucguucauugaaguaaagacuuguauauggccgaagucacauacccuuuggucuaauggaguacucgaauccgaaaugauaauaccaaaaaucuauggcgguccaaucucacagcacaauuacaggccuggguauuucacucaaacugcagggcccuggcaccuaggaaaauuggaauuagauuuugaucuuugugaagguacuaccguagugguggacgaacauugugguaauaggggaccuagucuccggacaacaacugugacggguaaaauaauccaugagugguguugucgcaguuguacccuuccuccgcuaagauuucggggagaagaugguugcugguaugguauggagauacgaccagucaaggagaaggaagaaaacuugguaaaaucuauggucucagcgggaucaggugaggucgauucuuuuagcuuaggacuccucuguaucucaauaaugauugaagaagucaugcguaguagauggucaagaaaaaugcuuaugaccggaacccuggccguguuuuuuuuguuaaucaugggccaacuaacauggaaugauuuaauucgauuaugcauuaugguaggcgccaaugcguccgaucguauggguaugggcacaacguauuuggcccuuauggcaacauucaaaaugagaccuauguucgccgugggucuacuauuuagacggcuuacaucucgugaaguccuucuccugacaauaggucucucccuaguugcuucgguagagcuuccaaacagcuuggaagaauugggagacggacuggcaaugggcauaaugauucucaaauuguugacagacuuccaaagccaucaacuuugggccacacuucugucgcuuaccuucaucaagacaacauuuagccuccacuaugcauggaagacaauggcaaugguauugucuaucguaaguuuauuuccuuuaugcuuaaguacuacgagucagaaaacaacguggcucccaguacuucuaggcagccuagguugcaagccauuaacuauguuucuaauagcugaaaacaagauauggggccgaagaucuuggccuuuaaaugaagggauaauggccguagguaucguuucaaucuuacuaucuagucuauugaagaacgauguaccauuagcaggcccacuaauagcgggcggaaugcuuauagcauguuacgucauaucagguaguagugccgaucugucauuagaaaaggcggcggaaguaucuugggaggaagaagcagagcauaguggagcaagucacaauauucuaguagagguucaggaugaugguaccaugaaaaucaaagacgaagaaagagaugacaccuuaacuauauuacugaaagcaacguugcuugcaguaucugguguuuacccccuaucaauaccggccacauuauuugucugguauuuuuggcaaaagaaaaaacaaagaucaggaguccuaugggacacuccgagcccuccagaaguagagcgugcaguguuagaugaugguauuuaucgaauuaugcaaaggggcuuacuuggucgaagccaaguagguguggguguuuuccaagaaaacgucuuucacaccauguggcauguaacaagaggggcagucuuaauguaucaaggcaagaggcuggaaccuagcugggcuaguguaaagaaagauuuaaucagcuauggcgggggauggagauuacaagguaguuggaacacaggagaggaggugcaggucaucgcagucgaaccagggaaaaaccccaaaaauguucaaacagccccgggaacauucaagacaccagaaggcgaaguaggggcgaucgcacuagauuucaagccuggaaccucaggaucaccaauaguaaaccgagaagguaaaauaguugggcuauacgguaauggagucguaacuacgagcggcacuuauguaucagcaaucgcucaagcuaaagcuucucaggaaggcccacuacccgaaauugaagacgaagucuuccguaaacgaaaccugacuauuauggacuugcacccagguucugggaaaacgcgucguuacuuacccgcuauugugagagaagcaaucaaaagaaaacuaagaacucuaauacuggcucccacucgcguuguagcaagugaaauggcagaagccuuaaaggguaugccgauacgguaucaaacuacagcagugaaaucagaacauacuggaaaggaaauuguugaccuaaugugucaugcuacauucaccaugcgauugcuaagccccguacgagucccgaauuauaacaugauaaucauggacgaagcgcauuuuacugaucccucaaguauugcagcacgaggguacauaagcacuagaguaggaaugggagaagcagcggcgauuuucaugacugcuaccccacccggcucaguggaagccuucccgcaaucuaaugccgugauacaagacgaagaaagagauauaccagaacgaagcuggaauucugguuaugaauggauaacggauuucccagguaaaacuguaugguucguaccaucaaucaaaucaggcaacgacaucgcgaacugcuuaagaaaaaacgggaaacgaguaauucaacucaguagaaaaacauuugacacagaauaucaaaaaacaaaaaacaacgauugggauuacguagugacaacagauaucagugaaaugggagcaaacuuuagagcugauaggguaauagauccacgacgcugcuuaaaaccggugauacuuaaagacgguccugagagagucauacuagcagggccuaugccagugacuguagcuagcgcagcacaaagaagaggacgaauagggagaaaucauaauaaggagggagaccaguauauuuauaugggucaaccacuaaacaaugaugaagaucaugcacauuggacugaggcgaaaaugcuauuagacaauauaaauacgccagagggaaucaucccggcauuauuugaaccagaaagagaaaaaucggcugcaauagauggugaauauagauugcgaggagaagcacgaaaaacauuuguagaguuaaugcgcagaggagacuuacccguuuggcuaucuuacaaagucgcuucugaaggguuucaauauucagauagaagaugguguuuugauggugaacgaaacaaucagguguuagaagaaaacauggacguugaaauuuggacuaaagaaggugaacgcaagaagcuaagaccccguuggcucgaugcuagaacauauagcgacccauuagcauuacgggaauucaaagaauucgcugcaggucgccguucugucuccggagaucuaauucucgaaauagguaaauuaccacaacaccuaacacaaagagcccaaaaugcccuugacaauuugguaaugcuucauaacucagaacagggaggaagggcuuacaggcaugccauggaggaauugcccgauacaauagaaacccugauguuacucgcacuaaucgcaguguugacuggcggaguaacacucuucuuuuuaaguggucguggacuaggcaaaaccaguauaggcuuguugugcguaauggcuucauccguauugcuauggauggcuagcguugaaccacauuggauagcagccagcauaauacuggaauucuuucuaaugguccuacucauaccggaaccggauagacaaagaacaccucaagauaaccaauuagccuauguaguaaucggacuacuuuuuaugauauuaacuguggcagccaaugagauggggcuacucgaaacgacaaaaaaagaucucggcauuggacauguugcuguggaaaaccaccaccacgcggcuaugcucgacguggaccuacauccugcguccgccuggacacucuacgcuguagcgacgacaauaauuacgccaaugaugcgacacacaaucgaaaauacaacugcaaauauuagcuuaacugccauagcgaaccaagcugcuauccugaugggacuagacaaaggguggccaauaaguaaaauggauauuggcguaccacuacuagcuuuaggauguuauucccaaguaaauccauuaaccuuaacggcugcaguuuugauguuaguagcgcauuaugcaauuauaggaccgggacuacaagccaaggcuacuagagaggcacaaaaaagaacugcugccgguaucaugaaaaaucccacgguggauggaauaguagccauagacuuagauccugugguguacgaugcaaaauucgagaaacaauuaggacagauaauguuguuaauucuauguacaagucagauucuuuuaaugagaacgacgugggcauuaugcgagagcauuacacucgcaacagguccguuaacuacuuuaugggaggguucgccaggaaaauucuggaauacuacaauugccguuucgauggcuaauauuuuucgugguagcuaucuugcuggugcaggcuuagcauucucacuaaugaagagccuugggggugguagacguggaacuggcgcccaaggagaaacauuaggagaaaaguggaagcggcaauugaaccaauuaagcaaauccgaauuuaauaccuacaaaagaucugguaucauggagguagauagaagugaagcuaaagaaggacuaaaacguggugagacaacuaaacaugcagugucacgaggaaccgcuaaacuaagaugguucguagaaagaaaccuaguuaaacccgagggaaaaguaauugaccuaggaugcgggagaggaggauggucuuacuauugugcuggacuuaaaaaggugacggaaguaaagggauacacaaaaggaggaccgggacaugaggagccaauaccaauggcaacauaugguuggaaucuuguuaaacuucauagcggcaaagaugucuuuuuuauuccaccugaaaaaugcgacacucuauuaugcgacauaggggaaaguagcccuaacccuacgauugaagaaggaagaacuuuaagaguauuaaagaugguagagccguggcugagaggaaaucaguucuguauaaaaauuuugaacccauauaugcccucuguugucgaaacucucgaacaaaugcaacgaaaacauggaggaauguuagugagaaacccauuaucaagaaacaguacccaugaaauguauuggguaaguuguggcacuggaaacauugucucagccguuaacaugacaagccgaauguuacuuaacagguucacuauggcgcaucgaaaaccuacauacgaaagagauguugaucuaggagcggguacaagacacguugccguugaacccgaaguugcaaaccuagauauuaucggacaacgaauagagaacauaaaacaugaacauaagucgacauggcacuacgaugaagacaauccauauaaaacgugggcauaccacggguccuacgaaguaaaacccucaggcucugcgucaucgaugguaaacgguguugugaaacugcuaaccaaaccaugggacguaauuccaaugguuacccaaauugcaaugaccgauacuaccccguuuggacaacaaagaguauucaaggaaaaaguggauacuaggacaccaaaagcgaaacgagggacagcccagauaauggaaguaacagcgaaaugguuauggggcuuccuaagccggaauaaaaagccaaggauaugcacgcgggaagaguuuacacgaaaagugaggagcaaugcagccaucggagccgucuuugucgacgagaaccaguggaauagcgccaaagaggcagucgaagacgagcguuuuugggaccuuguucacagggaaagggaauuacauaaacaaggaaagugugccacuugcguguauaacaugauggguaaaagggagaaaaaauugggugaauuuggaaaagcaaaaggauccagagcaauuugguauaugugguuaggagcacguuuucuggaguuugaagccuugggauuuaugaaugaggaccauugguucucacgagaaaacucccuuucuggaguagaaggagagggguugcacaagcucgguuauauauuacgagauauaucaaaaauucccggaggaaauauguacgcugacgauacugcagguugggacacacgaauaacagaagacgaucuacaaaacgaagcaagaauaacagauauuauggaaccggaacacgcacucuuagcuaagagcauuuuuaaguugacuuaucagaacaaaguagugagaguccaacguccugcaaaaaauggaacuguuauggaugugauuucacguagagaucaaagaggaaguggacaaguagguaccuauggcuuaaacacauuuacaaacauggaagcacaauuaauacgacaaauggagucagaaggaaucuucucgccuucugaauuagagacacccaaccuggcagaacgaguguuagacuggcuagaaaaauacggcgugaaacgguuaaaacgaauggcaauaucaggagacgauugcgugguuaagcccauagacgauagauuugcaacugcucuaacagcauugaacgauaugggcaagguaaggaaggauauaccacaaugggaacccuccaagggcuggaacgauuggcagcaagucccauucugcucgcaucauuuccaccaacuaaucaugaaagauggacgagagauaguaguaccgugccguaaucaggacgaauugguuggucgcgcccgaguuucgcagggggcaggcuggucacuaagggaaacagcaugccuagggaaaucauacgcacagauguggcaacuaauguacuuccauaggcgggaccugagauuagcggcaaaugcaauuugcagcgcaguaccagucgauuggauacccacaucgcgaacaaccuggucuauucaugcgcaucaucaguggaugaccacggaagauaugcuaagcguuuggaauaggguauggaucgaagagaaccccuggauggaggauaaaacacauauaucaucauggggggacgugccauauuugggaaaacgagaagaucaauggugcggguccuuaauuggucuuaccgcacgugccacgugggcaacaaauauucaaguagcaauaaaccaaguucgaagacugauaggcaaugaaaacuaccucgacuauaugacgagcaugaaaagauucaaaaacgaauccgacccugaaggugcccugugguag

SEQ ID NO: 21860 - RNA, 9879 nt, Artificial Sequence
  derived and/or modified CDS sequence (opt6) from DENV-1__GU131791__SS-prME
ucaguaacaauguuacuuauguuaaugccaaccgcucuagcuuuucaucugacuacuagaggaggagaaccacauaugauaguaaguaaacaagaaagaggaaaaucgcuucuauuuaaaacaucggcuggcguaaauauguguacccuuauugcaauggaccuuggagaacuaugugaagacacaaugaccuauaaauguccaaggauuacugaaacugagccggaugauguagacuguuggugcaacgcuacagacacgugggucacguacgguaccuguucucaaacuggagaacaucgcagagauaaacgcucuguugcauuggcuccacacgugggccucgguuuagagaccagaacagaaacauggauguccagugagggagcauggaaacaaauacaacggguagaaacgugggcauugcggcauccgggauuuaccgucaucgccuuauuccuggcccaugcaauaggcacaucuauaacacaaaaaggaauaauuuucauuuuguuaauguugguaacuccuuccauggcaaugagaugcgucgggauagguucuagagauuucguugaaggauuaucaggggcaacauggguagaugucguucuggagcacgggaguugcguaacaacaauggcaaaagacaagccaacgcuugauauagaacuuuuaaaaacagaagucacuaauccugcuguccuacgaaaauuauguauagaggccaaaauaucuaauacgacgacugacagcagauguccaacacaaggugaagcaacauuaguggaagaacaagaugcaaacuucguaugccggcgaacuuucguugaucgaggauggggaaacgguuguggacuguuuggaaaaggaucauuaaucacaugugcgaaauucaagugcguuaccaagcuggaggguaagauaguccaauaugaaaaccuaaaauacagcgugauugugacgguacauacaggugaucagcaucaggucgguaaugaaucuacagaacaugguacuacagccacaaucacaccacaagcacccacuacugaaauacaauugacagauuacggugccuuaacacuggauuguucacccagaacaggccuggacuuuaaugaaaugguauuauuaacuaugaaagagaagaguuggcuaguacauaaacaaugguuucuagauuuaccacuaccauggacgucaggagcaucaacaucacaagaaaccuggaacagacaagaucuacuugucacauuuaaaacugcacacgcaaagaaacaagaaguuguuguauugggaagucaagaaggagccaugcauacagcguuaacuggcgcuacagaaauucagacaucgggaacuacaacuaucuuugcaggacaucuaaagugcagacugaaaauggauaaacuaacguuaaaaggaaugucauacguuaugugcacaggaucuuuuaaauuagagaaagaaguugcagaaacccaacauggaacaguguuaguacagauuaaguaugaaggaacagacgcuccauguaaaaucccguucucaacacaagaugaaaaagggguaacacaaaacgggcgcuugauuacugcaaacccgauuguaacugauaaagaaaaaccagugaauaucgaagcugaaccaccuuucggagaauccuacauaguuaucggugcuggcgagaaagcucuaaaacuauccugguucaagaaagguucaucuauugguaagauguucgaagcuacugccagaggugcgcgcaggauggcgauacuaggagacaccgcuugggauuuuggcaguauaggaggaguuuucacuucaguuggaaaacugguacaucaaauauuugggacagcauacggcgugcuauuuagcggaguaucauggacaaugaaaauaggaauuggaguccucuuaacaugguuggguuuaaauucgagaucaacaucauuaagcaugaccugcauugcgguuggauuagugaccuuauauuuagggguaauggugcaagcggacucaggcugcguaauaaauuggaagggacgugagcugaaaugugggaguggaauuuuuguuacuaaugaaguacauacuuggacagaacaauacaaauuccaagcagauucaccaaaaagacuuagugccgccauagguaaagcaugggaagaaggaguauguggaauaaggagcgcaaccagauuggaaaauaucauguggaagcaaauauccaaugagcuaaaccauauucuauuggaaaaugauaugaaauuuacaguagucguaggggauguugcagggauauuagcacaagggaagaaaaugaucagaccgcagccaauggaauauaaguacucauggaaaagcuggggcaaagcaaaaauaauaggggccgacguccaaaacaccaccuuuauuauugauggaccaaauacaccagaaugcccagaugaccaacgcgcuuggaauaucugggaaguggaggacuauggcuuugggauuuuuacuacaaauaucuggcucaaacuaagagauucuuauacacaaguaugugaucaccgguuaaugucagcagcuaucaaggacaguaaggcuguacacgcagacaugggguauuggauagaauccgagaaaaacgagacauggaaacuugcgagagccucuuuuauugaaguuaaaacuuguauuuggccaaaaagccauacacuuuggaguaaugggguucuagaaucugagaugauuaucccaaagaucuacggaggaccgaucucucaacauaacuacagaccagguuacuucacgcaagcugcagguccauggcacuuagggaaacuugaacuagauuuugacuuaugugaaggaacuacgguuguuguagaugaacacugcggaaauagaggcccaaguuugaggaccacuacagucacuggaaaaauaauucacgaauggugcugcaggaguuguacuuuaccgccacuucgcuuuagaggcgaagacggauguugguaugguauggagauacguccaguaaaggaaaaggaagaaaaucuagugaagucuaugguuucugcagggucuggagaaguagauucauucucacugggacuauuauguauuucaauaaugauugaagaaguaaugagaucuagguggucacgaagaauguuaaugacuggaacacuagcaguauucuuucuuuuaauuaugggacagcugaccuggaaugauuuaauuagacuauguauuauggugggagcgaaugcaucagaccguaugggcaugggaacaacguauuuagcguugauggcuacuuuuaagaugaggccaauguucgcggucggucuccuuuuucgaagacuaaccucuagggaaguauuauuacugacaaucggucuuucauuaguugcaucagucgaauugcccaauucuuuagaagaauuaggugauggccuugcaaugggaaucaugauucugaaacuuuugacugacuuucagucgcaucagcuuugggcaacacugcugagucuaacauuuaucaaaacaacguucucacuacauuaugcuuggaagacuauggcaauggugcuuucaauuguaucacuguuuccguuaugucuaaguacaacgucucagaaaaccacauggcuuccaguacuacuaggcucucuuggaugcaaacccuuaacaauguucuugauagcagaaaauaagauaugggggaggagauccuggccgcuaaaugaagguauuauggcuguuggaauaguuagcauacuacuauccucccuacucaaaaaugacguuccacuagcagguccuuuaauagcgggaggaaugcuuauugcauguuacguaauuucagguucuagugcagauuuaucauuggaaaaagcagcagaggugagcugggaggaagaagcagagcacaguggugccucacauaauauauugguagaaguucaagaugacggaccuaugaaaauaaaagaugaagagagagacgauacguugacgauacuacuaaaggccacauugcucgcuguguccgguguauauccucucaguauucccgcuacccuuuucguuugguauuucuggcaaaagaagaaacaaagaaguggaguauuaugggacacacccucaccgcccgaaguugaacgugcuguucuagacgauggcauuuauagaaucaugcaacggggucuacuugggagaagucagguaggaguaggaguuuuccaagaaaacguauuucacaccauguggcacguuacaagaggugccguguuaauguaucaagguaaaagacuagaaccuucuugggcuucaguuaagaaagaccuaauuucauacggcgggggauggcguuuacaaggaagcuggaauaccggagaagagguucaggugaucgcuguugagccaggcaaaaacccuaaaaaugugcaaacugcuccgggcaccuuuaagacuccagaaggcgagguuggugcuauagcucuagacuuuaaaccugguaccucggguaguccuauuguaaacagagaagggaaaauaguaggauuauaugggaacgggguaguuacuacgucaggcacuuacguaucagccauagcccaagcaaaagcaagccaagagggaccacugccagaaaucgaggacgaaguauuccggaaacguaacuugacuauaauggauuugcauccaggcaguggaaaaaccaggagauacuuacccgccauaguacgugaagcaauaaaaaggaaacuaagaacacucauacuggcaccgacacgcguaguagccucagagauggccgaagcucugaaggguaugccuauaagauaucaaacaacagcaguuaaaucagaacauacaggcaaagagauaguggauuuaaugugccaugcaacguuuacaaugaggcuuuuaucucccgugaggguuccaaauuauaacaugaucauaauggacgaagcgcauuuuaccgauccaucaagcauagccgcacgcggauauaucagcacgagaguaggcaugggcgaagcggcagcgauauucaugacggcaacuccucccgggaguguagaagcguucccucaaaguaaugcgguaauccaagaugaagaaagagauauaccagagaggucauggaacaguggcuaugaauggauaacagacuuuccagguaaaacaguaugguuuguucccucuaucaagucaggaaacgauaucgcgaauugucuaaggaaaaacggaaagaggguaauacaacuaaguagaaaaacuuucgauaccgaauaccagaaaacuaaaaauaaugacugggacuauguagugacuacagacauaucugaaaugggcgcuaauuuucgagccgaccgggugauagacccccgaagauguuuaaagccggucauauuaaaagacgguccugaacgagucauucuggcagguccaaugccaguaacaguggccagugcagcucaaagacguggacguaucgggagaaaccauaauaaagaaggcgaccaauacauauauaugggacagccgcuuaacaacgaugaagaccaugcccacuggacugaagcaaaaaugcugcuggauaauaucaauacuccagaaggaauuauaccagcacuuuuugaaccugaacgagagaaaagugcggcuauugacggagaguaccguuugagaggugaagcuagaaaaacuuuuguagaauuaaugaggagaggggaccugccaguguggcugucguacaaagucgccagcgagggcuuucaguacucagaccguaggugguguuucgacggggaacguaacaaccagguacuggaagaaaauauggacguugagauauggaccaaagagggagagaggaagaaacugcgaccaagauggcucgaugcacgcacuuauagugacccgcucgcacugagagaauuuaaagaguucgcagcagggagaagaagcguaucuggggaucuaauccuugaaaucgggaaguuaccacaacaucuuacacagagagcacaaaacgcguuagacaacuuaguuauacuucauaauuccgagcagggugguagagcuuaccggcacgccauggaagaauuaccugauacaauagaaacacuaaugcuucuagcccucauagccguacuaaccgguggagucacacuauucuuucuaagugggagaggucugggaaaaacgucaauaggucuauuauguguaauggcgucaucaguacucuuguggauggccucagucgaaccgcauuggauagccgccucuaucauucuggaguucuuuuuaaugguccuauuaauaccagaaccggacagacaacguacuccacaagacaaccagcuugccuacguggugauaggucuuuuauuuaugaucuugaccguagccgcuaacgaaauggguuugcuugaaacaacaaagaaagaccuuggaaucggucauguugcaguggaaaaccaccaccaugccgcaauguuagaugucgaucugcauccagccucagcauggacucuauacgcaguagcaacaacuauuauuacuccuaugaugagacauaccauagaaaacacgaccgcaaauauaucgcuuacagcgauugcuaaucaagcagcuauucuaaugggacuagauaaaggauggccaauaucaaagauggauauaggggucccccuccuagcuuuagguuguuacagccaagugaauccuuugacccuuacugcagcuguucuaauguuagucgcacauuacgccauaauuggaccuggauuacaagcaaaggcuacccgcgaggcacagaaaagaacggcggccgggauaaugaaaaacccaacaguagacggaauaguagcuaucgauuuagauccuguaguauaugacgcaaaguuugaaaaacaauugggacaaaucaugcuauugauauuaugcacaagucaaauauuacucaugaggacaacaugggcguuaugugaaucaauaacauuagccacuggaccccuaacuacauuaugggagggauccccaggaaaauucuggaauacaacuauagcaguuaguauggcaaauauauuccgcggaucauaucuagcaggggcggguuuagcguuuaguuuaaugaagucuuuagggggcgguagaagggguacaggagcacaaggagaaaccuuaggggagaaauggaaacgucaauugaaucaauugaguaaaucugaauuuaauaccuacaaacgaaguggcauaauggaaguggacaggagugaggcuaaagaggggcucaaaagaggagagacuacgaagcaugcuguaucuagaggaaccgcaaaauuaagaugguucguagaaaggaacuuggucaagccagaaggaaaaguuauugauuuaggaugcggaagggguggauggaguuacuacugugcgggguugaaaaaggucacagaagucaagggcuauacuaaggguggaccuggacacgaagaaccaauaccaauggccaccuacgguuggaaccuuguaaaguugcauucaggaaaggauguauucuucauucccccggagaaaugugauacguuacucugugauauaggcgaaaguucuccuaauccaaccauugaggaaggaaggacacuucgcguacuaaagaugguugaaccguggcuacgagggaaccaguucuguauaaaaauucucaacccauacaugcccucaguugucgaaacguuagaacaaaugcaaaggaagcauggugguaugcuggugcguaacccauugucuaggaacuccacacacgaaauguauuggguuucauguggaacaggaaauauugugucggccguaaacaugacuucaaggaugcuuuuaaauagguuuacgauggcccaucguaaaccuacauaugaaagagauguagaucuaggcgcggguacccgacauguagccguggaacccgaagucgcuaaucuugauaucauuggacagcgaauagaaaauauuaaacaugagcacaagaguacauggcacuaugacgaagacaauccauauaaaaccugggcauaucacgguucguaugagguaaaaccuaguggaagugcgucaaguauggucaauggcgugguaaaacuucuaacgaaaccgugggauguaaucccaaugguaacacaaauagccaugacggauacaacgccauuuggacagcaaagaguauucaaagaaaaaguagauacccgaacaccuaaggcaaagagagguacagcacaaauaauggaggugacagcaaaauggcuauggggauuuuuauccaggaacaagaagccucgcaucuguacccgagaagaguucacacguaaaguucguucuaaugccgcuauaggcgcuguauucguagaugaaaaccaauggaacucugcuaaagaagcaguugaagaugaaagauucugggaccugguacaccgagaaagagaacuacacaaacaaggaaaaugcgcgaccugcguuuacaauaugaugggaaaaagagagaagaaacuaggggaauuugguaaggcuaaaggaucacgugcaauuugguauauguggcuuggugcacgauuccuggaauuugaagcucuaggauuuaugaaugaggaucauugguucucucgggaaaauaguuuaucagguguggaaggagaaggauuacauaaacuugguuauauauuaagggacauuucaaaaauaccuggcgguaacauguacgcagaugacacggcaggaugggacacgcgaauuacagaagaugauuuacaaaacgaagcaaggauaaccgauauaauggaacccgaacaugcgcuauuagcaaaguccauauuuaagcucacguaccaaaauaaggugguccggguacaaaggcccgccaaaaaugguacaguuauggacgugaucagucgacgagaucaacgcggcagcggacaaguagggacuuauggguuaaacacauucacuaacauggaagcucaacuaauucgacaaauggaaucagagggaaucuucucaccaagugagcuagaaacuccuaaccucgcagaacgggucuuggacugguuagaaaaguaugggguagaacgucuaaagcgaauggcuauaucuggagacgauugcgucguuaaacccauugaugaccgauuugcaacagccuuaacagcguuaaaugauauggggaaaguacgaaaagacauuccucaaugggaacccaguaaaggauggaacgacuggcaacaaguccccuuuuguagccaucacuuccaucaguuaaucaugaaggacggaagagagaucguagugccuugccgcaaucaggacgaauuaguagggagagcaagaguaagccaaggugcaggauggaguuugcgagaaacggcuugccuuggcaaauccuacgcucaaauguggcaacucauguauuuucauaggagagacuuaaggcuagcugcgaaugccauuugcuccgcugugccaguggauuggauccccacgucacguacaaccuggucaauucaugcgcaccaccaauggaugacuaccgaagacaugcuaucgguuuggaaucgaguauggauugaggagaacccauggauggaggauaaaacgcauauauccagcuggggagauguaccauacuuagggaagcgugaagaccaauggugcggcucuuugauaggucuaacugcgagagcaacgugggcgacaaauauacaaguugcuaucaaccaaguccgucgacucaucggcaaugaaaauuaucuagauuacaugacaucgaugaaaagauuuaaaaacgagagugauccggagggggcuuuaugguaa

SEQ ID NO: 21861 - RNA, 9879 nt, Artificial Sequence
  derived and/or modified CDS sequence (opt6) from DENV-1__GU131792__SS-prME
ucaguaacuaugcuucuaaugcuuaugccaacugcucuggccuuucauuuaacgacuagagguggggaaccccauaugauaguaacuaaacaagaacggggaaaaucacuacuuuucaaaacaagcgccggaguaaacauguguacuuuaauugcaauggaccugggagaacugugcgaagacacuaugacauauaaauguccaagaauaacagaagccgaaccagaugauguggauuguugguguaacgcgacggauacauggguaacuuacgggacgugcagccaaaccggggaacaccgcagagauaaacgaucaguggcauuagcgccacacguaggacuaggauuagaaacaagaaccgaaacuuggaugucaucggaaggagcuuggaaacaaauacaaagaguugagcccugggcucuuagacauccaggauuuacggugauugcguuauuuuuggcacaugcuauugguaccucgauaacacaaaaggguaucauuuucauacuucuaauguuaguaacaccaucgauggcuaugcgcugcguaggaauaggcagccgagcuuuuguugaagggcuuaguggagcgacuuggguagacguaguacuagaacacgggaguuguguuaccacaauggccaaagacaaaccgacgcuugauauagaguugcuaaaaacugagguaacaaaucccgcagucuuaagaaaauuauguauagaagcaaaaauaaguaauacgacaacagauucucgcugucccacccaaggggaagcuacauuaauggaggaacaagaugcgacguuuguauguagaaggaccuucgucgaccgagguuggggaaauggauguggucuauucggaaaaggcagcuuaauaacaugcgcaaaauuuaaauguguaacgaaacuagaaggaaagauaguucaauacgaaaaucucaaauauuccgucauaguaaccguccauacuggugaucaacaucaaguggguaaugaaucgacagagcauggcaccacggcgaccauaacuccucaagcacccacgucagaaauacaauuaccggauuacggagcacucaccuuggauuguuccccaagaacaggucuggacuuuaaugaaaugguucuauugacaaugaaagagaaaagcuggcuuguacacaaacaaugguucuuagaucuaccgcuucccuggacgucaggagcaagcacaucacaagaaaccuggaauaggcaagaucuguuaguuaccuucaaaacugcacacgcuaagaagcaggaggucgugguacucggaucucaagagggggcaaugcauacaggacucacaggcgccacagaaauacagacaaguggaacaacgacaauauuugcaggacauuuaaaguguagacuuaaaauggacaaauugacuuuaaaagguaugucuuauguaauguguacaggcucuuucaagcuggaaaaagaaguugcugaaacgcaacacgggaccgucuuaguccaaauaaaauacgaggguacagaugcaccaugcaaaauuccuuucaguacucaggacgaaaaagggguaacucagaacgguagacuuaucaccgcuaauccgauaguaacagauaaagaaaaaccggugaauauagaagccgaacccccauucggugaaucguacauaguuauuggagcuggugaaaaagcgcuaaaguuaagcugguuuaagaaagggucuaguauaggaaaaauguuugaagcuaccgcucgcggugcacgacgcauggcaauauugggcgacacagccugggauuuugggucuguaggagggguauuuacaucaguagguaaacugguccaucaaauauuuggaacagcauacggaguauuauuuagcggcguaucauggacaaugaaaauagggauaggaguguuacucacuugguuaggauuaaauucacgaucgaccucucugucaaugacuugcaucgcgguagguuuggugacguuauaucucgguguaaugguucaagcugauagcggaugugugauaaacuggaaaggaagagaguuaaagugugguaguggaaucuucgggaccaaugagguacauaccuggacggaacaguacaaguuccaagcagauuccccuaaaagacuaucugcugcaauuggcaaaccuugggaggaaggaguaugcgguauacgaucagcaacaagauuagaaaauauaauguggaaacaaauaucaaacgaauuaaaucauauccuccuagagaacgauaugaaguucacagugguugucggcgacguaguaggaauacuagcucaaggcaagaaaaugauccggccgcaaccaauggagcacaaauauucauggaaaagcuggggaaaagcaaagauaauaggugcggacgugcaaaauacaacauuuauaaucgacggaccgaauaccccagaauguccugacgaccagagagcguggaacauaugggagguggaagauuacggcuucggaauuuuuacaacaaacauaugguuaaaacucagagacucacacacacaggugugugaucacaggcuaauggccgcagcuauaaaagauagaaaggcaguccaugcugauaugggauauuggauagaaagcgagaaaaaugagccauggaaacuugcucgugcuagcuuuauagaaguuaagacauguauauggccaaagucucauacauuauggaguaauggagugcuagagucggaaaugauuauaccgaagauauacggugguccaauuagucagcacaauuaucguccuggauauuuuacccaaacugccggaccauggcaucuaggaaaauuagaguuagacuucgaucuuugugaagguacgaccgugguuguagaugagcacugugggaaccgaggaccuucgcuaagaacaacaacgguuaccggcaaaauuauucacgaauggugcuguagaagcuguacacucccucccuuaagauucaagggagaagaugggugcugguauggaauggaaauaaggccgguaaaagagaaagaggaaaaucucgucaaaagcauggucagugcaggcaguggggagguugacuccuucaguuugggucuucuauguauaucuauaaugauagaagaaguaaugagaagucgauggagcaggaaaaugcuaaugaccgguacucuagcgguuuuucuucucuuaaucaugggccaacuaacguggaacgacuuaauacgauuguguauaaugguuggugccaacgcaagugaucgcaugggaauggggacaacuuacuuggcuuuaauggcuacuuucaagaugcgaccgauguucgcaguuggucuccuauuucgcagauugacuucaagagaaguuuuacuucuuacuauaggccugucacuuguagcaucuguugaauuaccaaacucgcuagaggaacuuggagauggacuugcaaugggcauaaugauucugaaacuguugacugauuuucaaucucaucaacuuugggcaacauugcuaucucuuacauuuauaaaaacaacucuauccuuacacuacgccuggaaaacgauggcaaugguccuuaguauagucagucuuuuuccauugugucuaaguaccacaagucagaaaacuacauggcugccaguacuuuuaggaaguuuaggauguaagcccuuaaccauguuucugauuacagaaaauaaaaucuggggucguaaauccuggccucugaaugaaggaauaauggcagugggaguagugucgauucuacuuucuucgcuucucaaaaaugacguaccacuagcagguccucucaucgcaggaggaaugcucauagcaugcuaugugaucaguggauccucagcagaucuuaguuuagaaaaggcagcagaaguaucaugggaagaagaagcugaacacuccggagcaagccauaauauucucguagaaguacaggacgacgggacgaugaaaauaaaagaugaagaaagggaugacacccuaacuauauuguugaaagcuacacuccucgcuguauccgggguguauccucuaucgaucccagcaacuuuauuugucugguauuucuggcagaaaaagaaacagagaagcgguguucuuugggauacaccuagucccccugaagucgagagagccguucuagaugaugggauuuauaggauuaugcaaagaggccuucuagcaaggucgcaaguaggaguaggcguauuucaggaaaaugucuuucauacaauguggcacguuacccggggagcgguuuuaauguaucagggaaaaagauuggaaccaucuugggccuccgucaagaaagaucuaauuuccuacggcggaggauggcgacuacaaggcucuuggaauaccggagaagaagugcaagucauugccguggaaccuggcaaaaauccuaaaaacgugcagacugcgccuggcacauucaaaacgccagaaggugagguaggugcuauagcacuagauuucaaacccggaacaucggggaguccuauaguaaaucgagaggguaaaauagucggauuauauggcaacggagucguuacgacaucaggaacuuauguaagugccaucgcacaggcuaaagccucacaagaaggaccccuuccagaaaucgaagaugaagucuuuaggaaaaggaaccucacaaucauggaucuacacccggguucgggaaaaacuagaagguaucuccccgccauuguaagagaggcaauaaaaagaaaauuacgaacuuuaauacuugcuccaacacgagugguggcaucagaaauggcagaagcucucaaagguaugcccauacgguaucaaacaaccgcgguuaagagugagcauacagggaaagaaaucgucgacuuaaugugccacgcaacauuuacgaugcggcuacuuagcccaguuagaguacccaacuauaacaugaucauuauggaugaagcacauuucaccgacccaucgucuaucgcugcaagagguuacauuagcacuagaguggguaugggagaagcagcggccauuuuuaugacugcuacacccccaggcucuguagaagccuuuccgcagucaaacgcaguaauccaagaugaagaaagggauauaccugaaagaagcuggaauaguggauaugaauggauaacagacuuuccgggaaagacgguaugguuuguuccaucuauaaaaagugguaaugauaucgcaaacuguuuaaggaaaaacgguaaacguguaauucaauuaucacgaaaaacguucgauacagaauaucaaaagacuaaaaacaaugacugggacuaugucguaaccacugauauuucggaaaugggugcaaauuuccgcgcggaucgaguaauugauccgcgccgcugccugaaaccuguaauacuaaaagauggcccugaaagaguaauauuagcuggaccaaugccaguuacagucgcaagcgcggcucagcgaagaggacgaaucggucgcaaucauaauaaggaaggcgaccaguacauauauaugggacaaccucuuaauaacgaugaggaucaugcacauuggacggaagcaaagaugcucuuagacaacauaaacacgccagaagguauaauacccgcucuauucgaaccagaacgagagaaaagcgcagcgauagacggugaauacagauuacguggcgaagcgcguaaaacuuuuguagaauuaaugcgacguggugaucuuccuguuugguuaucguauaaagucgccagcgaaggauuucaauacucagacagaagaugguguuucgacggagagcgcaacaaucaaguucuugaagaaaauauggaugucgaaauuuggacaaaagagggagaacgaaagaaacugcggccacgguggcuagacgccagaacauauucggauccguuggccuuacgagaauuuaaagaauuugcagcagggaggagaucugucucaggagacuuaauacuugaaauugguaaacugccgcaacacuuaacucaaagagcccaaaaugcguuagacaauuugguuaugcuacacaacuccgagcagggcggacgagcauaucgacacgcaauggaagaacugccugacacaauagaaacuuuaauguuauuagcacuuaucgcggucuuaacaggcgguguaacccuauucuuuuugucgggacgaggauuaggaaaaacauccauagguuuacuaugcgugauggcaucaucgguuuuauuauggauggccagugucgaaccacacuggaucgcugccaguaucauauuggaguuuuucuuaaugguacuacugauuccagaaccugaccgacaaaggacgccccaagauaaccaauuggcuuauguaguaaucggucucuuauucaugauacuuaccguggcagccaaugaaaugggauugcuggaaacaaccaaaaaggaucuaggaauaggucauguggcgguagagaaucaccaucaugcgaccauguuggauguagauuugcacccugcguccgcguggacccucuaugcaguugcuacaacuauaauaacuccaaugaugagacacacaauagaaaacacuaccgcuaauauaucccugacugcuauugcuaaucaagcagcaauccuaaugggucuggacaaaggguggccaauuagcaaaauggacauuggaguccccuuacuagcacuaggguguuacucucaaguuaaucccuuaaccuugacagcugcuguacuaaugcuuguugcacacuacgcgauaauugggccaggacuacaagcuaaagccacaagagaagcccagaaaagaacagcagcaggcaucaugaaaaaccccaccguggacggcauagucgcuauagaccuugacccuguuguuuaugacgccaaauuugaaaaacaacugggacaaauaauguugcuaauacugugcacuucccaaauucuuuugaugaggaccacuugggcacucugugagucuauaacuuuggccacaggaccguuaacaacucuuugggaagggaguccaggaaaguuuuggaauacuaccaucgcagucucaauggcaaauauauuccgugggaguuaucucgccggagcuggucucgccuucucucuaaugaaaagccuaggaggcggucgacgagggacuggagcucaaggagagacauuaggagagaaauggaaaagacaacuaaaucagcuaagcaaaagugaguuuaacauuuacaaacguuccgggauaauggagguagauaggagcgaagcuaaggaagguuugaagagaggggagacaacacgacaugccgucucaagaggaacugcuaagcuacgcugguuuguugaaaggaauuuaguaaaaccagaaggaaaggucauagaccugggaugugggcgaggaggauggucuuauuauugugcuggucuaaagaaaguuacagaaguuaaggguuauaccaaaggaggaccaggucaugaggaaccuauuccuauggccaccuauggauggaauuuaguaaaauuacauagugggaaggaugucuuuuucaccccaccugaaaagugcgacacucuauugugcgacauuggcgagaguuccccaaacccaaccauagaagaaggaagaacacugaggguuuuaaaaauggucgagccuuggcugagggggaaucaauuuugcauaaaaauccuaaacccuuauaugcccagcguugucgaaacccuagagcaaaugcaaagaaaacacgggggaaugcuugugaggaacccacuaagucgaaauucgacucaugaaauguauuggguguccugugguacaggaaacauaguaucagcaguuaauaugacauccagaaugcuucugaauagauuuacuauggcccauaggaaaccgacguacgaacgugacguugaucuuggagcugguacgcgacauguggcgguugaaccggaaguugcgaaccuugacauuauuggacaaagaauagaaaacaucaaacacgaacauaaguccacauggcacuaugaugaagacaauccguacaaaacuugggcauaucacgguagcuaugagguaaaaccaaguggaagugcaucaucaaugguuaacggaguaguaaaacuucuaacgaaaccaugggacgucauaccgauggucacacagauagccaugacagacacaacuccuuucggacagcaaagaguguuuaaagaaaagguggauacccguacuccaaaagcgaagagaggaaccgcccaaauaauggaggucacggcuagauggcuauggggauuccuaucaagaaauaagaaaccgcgcauauguacacgugaggaguucacccgaaaaguacguucgaaugcagcuaucggcgcuguuuuuguugacgaaaaccaauggaacucugcaaaagaagccgucgaagacgagagauuuugggauuuaguucaaaaagaacgcgaauuacacaagcaaggaaaaugcgcgaccuguguguauaauaugaugggaaaaagggaaaagaaacuaggagaguucggaaaagcuaaagguucaagagcaaucugguauaugugguuaggcgccagauuccuagaauuugaagcauuaggauucaugaaugaggaucauugguucucuagagaaaauagccuaaguggaguugaaggugaaggucuacauaagcuaggcuauauacuucgcgauaucagcaagauaccgggagggaacauguaugccgacgauacagcaggaugggauacgaggauuaccgaggaugauuuacaaaaugaagcaaaaaucaccgauauuauggaaccggaacaugcacuccuugcuacaucaauauuuaaauuaacauaucaaaauaagguaguacguguccaaaggccagcuaaaaacgguacuguuauggacguuauaagcaggcgagaucaacggggcucaggucaagucgguacguacggauugaauacauucacgaauauggaggcucagcuaauacgccagauggaaucagaagggaucuuucuuccuagcgaguuagaaacgccaaaccuagcugaacgaguguuagauugguuagaaaaauauggagucgaaagauuaaaaaggauggcaaucucaggugaugauuguguuguuaaaccuaucgaugaucgauuugcaacagcacucacagcauuaaacgauaugggaaagguaagaaaagacauaccacagugggaaccgagcaaagguuggaaugauuggcagcaagugccauucuguucacaccacuuccaccaauuaauaaugaaagauggccgagaaauuguuguaccuugucguaaucaagaugaguuaguaggcagagcgcgugugagucaaggcgcaggauggucguuacgagaaaccgcgugcuuggggaaaaguuaugcgcagauguggcaauuaauguacuuucaccgucgagauuuaagauuagcagcuaaugccaucuguagugcgguccccguggauuggguaccgacaagucggacaacguggucaauucaugcacaccaucaauggaugacaacugaagacaugcuaucagucuggaaucgaguauggauagaggagaauccuuggauggaagauaagacgcaugugucauccuggggagaugugccguaucucggaaaaagagaagaccaauggugcgguucauuaauaggacuaacggcgagagcaacaugggcaaguaauauucaaguugcgauaaaucaaguaagaagauuaaucggaaacgagaauuauuuagauuacaugacaucgaugaagagauuuaagaacgaaggugauccagaaggugcucuaugguaa

SEQ ID NO: 21862 - RNA, 9879 nt, Artificial Sequence
  derived and/or modified CDS sequence (opt6) from DENV-1__HM488256__SS-prME
ucagucacuauguuauuaauguuaaugccaacagcccuugcauuccacuuaacuacgcgcgggggugaaccgcacaugauaguaaguaaacaggaaagaggaaaaucuuuauuauucaaaacaucagcaggagucaacauguguacuuuaauagcuauggaucuaggagaauuaugugaagauacuaugaccuauaaaugcccaagaauuacggaaacggaaccagaugauguggacuguugguguaacgcuacggauacaugggugacguauggaacuugcagccaaacaggugaacaccgucgcgauaaacgaucaguugcccuagcaccacauguaggguuaggacuagaaacgcgaacagaaacauggaugagcuccgaaggggcauggaaacaaauucaacgugucgaaacaugggcccugaggcacccuggauuuacuguuauugcguuauuucuggcccaugccauuggaacaaguauaacccaaaaagguauaauuuuuauucuauuaauguuaguaacaccuucaauggcaaugagaugugucggcauuggcucaagagauuuuguagaagguuugucaggagcaacuuggguugacguuguacucgaacacggauccuguguuacuacaauggcgaaagacaaaccaacccuggauauagaacuuuuaaaaacagaaguaacuaauccggccgugcuacggaaauuaugcauugaagcgaaaauuucgaacacuacgacugacucgagaugucccacacagggcgaagcgacucuaguagaagaacaagacgcaaauuucguauguaggcgaacuuucguagauagaggcuggggcaaugguugcggguuauuuggaaaggguaguuugauuacaugugcaaaguucaaaugcguuacgaaguuagagggaaagaucguucaguaugagaauuuaaaauauucugugauaguaacaguacauacaggagaccaacaucaaguaggaaacgaaagcaccgaacaugguacaacagcaacaauaacuccucaagccccaacuacagaaauccaauugccggauuauggagcuuugacguuagauuguucaccaagaacuggacuugacuucaaugaaaugguauuauuaacaaugaaagaaaaaucuugguuaguacacaaacagugguuuuuagaccugccauuaccguggacgucaggugccucaacgucucaagaaacauggaaccgucaagaucuccuugugacauuuaaaacagcgcaugcaaagaagcaagaagugguaguauuaggaucgcaagagggagcaaugcacacugccuuaacaggagcuacggaaauccaaacgagcggaacuacuacuauauucgcgggccaucucaaaugucgauugaaaauggauaagcuaacuuuaaaggguaugagcuauguuauguguacagggagcuuuaaauuggaaaaagaacuggccgaaacccaacacgggacggugcuagugcaaauaaaauacgaggguacagaugcaccgugcaaaaucccguucucaacgcaggaugaaaaaggcguuacacagaauggaagguugauaacugcuaauccuaucguuacugauaaagagaagcccguaaauauagaagcugaaccaccguucggagagaguuauauagucauuggugcaggcgaaaaggcguuaaaguuauccugguuuaagaaaggaucaucuauaggaaaaauguucgaagcuacggccagaggggcacggagaauggcgauacuaggugccccugcaugggacuuuggaucaauuggaggaguauuuacaagcguuggaaaacugguacaucaaauauuuggaacugcauacggaguacuauuuucugguguaucguggacaaugaaaauagggauaggagugcuccuaaccuggcucggacucaauaguaggucuaccucccuaucgaugacauguaucgcaguaggccuaguaacuuuauauuuaggcguaauggugcaagcagauucaggcugcguaauaaacuggaaaggaagagaacuaaaaugugguucagggauauucguaacuaacgaagugcauacguggaccgaacaauacaaguuccaggcugauucgccuaagcgucugagcgcagcgauagguaaagcaugggaagaaggaguaugcggcauucgaagugccacuagguuagaaaacauaauguggaagcaaauaaguaaugaacuuaaccauauucuacuagagaaugauaugaaauuuacgguggugguaggcgauguagcuggcauacucgcucaaggcaaaaagaugauaagaccccaaccaauggaacauaaguacucauggaagucauggggaaaagccaaaauaauuggggcggacguucaaaauaccacauucauuauagacggaccuaauaccccggaauguccugacgaucaaagagcauggaacauaugggaaguugaagacuacggcuuuggcauauucacaacaaacauaugguugaaauugagggacaguuacacacaaguuugcgaucaccggcuaaugagugcagcuauuaaggauucgaaagcaguacacgcugauaugggguacuggauagaaucugaaaagaaugaaacauggaaauuagcaagagccucguucauagaaguuaagacauguauaugggcaaaaagucacacacuuuggaguaaugggguauuggaaucagaaaugauuauaccuaaaaucuauggcggaccaauuucgcaacauaacuacagacccgguuauuucacgcaaaccgccgggccuuggcaucuuggaaaacuugaacuagauuuugauuuaugcgaaggcacaacaguaguaguagacgaacauugcggaaauaggggcccaucgcuucggacaacuacaguaacggggaaaauaauucaugaaugguguuguagguccuguacucuacccccucugagauuuagaggugaggacggauguugguacggaauggagauaagcccugucaaagagaaagaggaaaaucuggugaaaucaaugguuagcgcuggaaguggugagguagauuccuuuucucucggccuucuuuguaucuccauuaugauugaagaaguuaugcgaucgagauggucccguaaaauguuaaugacgggaacacuagcuguguuuuuccuacuuauugucggacagcucccguggaacgaucucauaagacuauguauaauggugggggccacagcaucggcaaggaugggaaugggcacaacaagucuugcgcucauggcuaccuuuaaaaugcgccccauguucgcaguagguuuauuauuccgacgucuaacaucaagggaaguacuauuguugacaauuggacuuucgcuaguggcuucagucgaauugccaaauucauuagaggaacugggugacggcuuggcaauggggauaaugauauuaaaacuacuuaccgauuuccagucacaucaacuuugggcaacuuuauugagucuuacguucauaaaaacgacauucagucuucacuaugcuuggaaaaccauggcaauggguuuaagugucguuaguuuguucccauuaugcuugucuacaacaucacaaaagaccacauggcugccaguuuuacuagggucauuagguuguaagccacucacaauguucuuaauagcagaaaauaaaauauggggacgacggaguuggccguuaaaugaaggaauaauggcgguagggauaguaaguauucuacuauccucccuccuaaagaaugauguaccacuagcagguccauuaauagcaggcggaaugcuaauagcauguuaugucauuucagggucaucggcagacuugagcuuggaaaaggcugcagaagugagcugggaagaagaagcugaacauagcggugcuucacacaauauucucguugagguccaagacgaugggaccaugaaaaucaaggaugaggagcgagacgauacacuuacgauuuuauuaaaagcaacauuacucgcaguguccgggguguauccuuuaucuauaccagcaacccuauuuguuugguauuucuggcagaagaagaaacaacguucgggagucuuaugggacacgccaucgccaccggaaguagagcgcgcggucuuagacgacggcauuuauagaauaaugcagcguggucuccuaggcagaagucaaguagggguggguguauuucaagaaaacgucuuccauacaauguggcacguaacccgaggagcagucuugauguaccaagguaaacgacucgagccuucaugggcaucaguuaagaaagaucuaauaaguuacggagggggcuggagacuucaaggaucauggaauacaggugaggaaguacagguuauagcaguagaaccaggcaaaaaucccaaaaauguucaaacggcaccgggcacguuuaaaacuccugaaggcgaaguaggagcaauugcguuagacuuuaaaccaggaacauccgguaguccuauuguaaacagagaaggaaaaauuguaggacuuuacggaaacggaguugucacaaccucagguaccuauguaucugccaucgcccaagcgaaagcuagccaggaaggcccauugcccgaaauugaggaugaggucuuucguaagagaaaccucaccaucauggaccuacacccaggaaguggaaaaaccaggagauauuugccggccaucguaagggaagcgauuaaaagaaagcuaaggacguugauacuagcuccaacccgaguuguagcgucagaaauggcugaagcucucaaagguaugccaauaagauaccagacuacggcuguaaaaagcgaacacacaggaaaagagauuguagaucucaugugccaugcuacguuuacaaugcgguuguuaucuccaguaagaguuccaaauuacaauaugauaauaauggacgaagcacacuucacagacccuagcucaauugcagcgagaggauacauuaguacaaggguuggaaugggcgaagcagcugcuauauucaugacagcgaccccaccagguucuguagaagcauuuccacaaucuaaugcuguuauucaagaugaagaacgugacauuccagaaaggagcuggaacucaggguaugaauggaucaccgauuuucccggaaagacugugugguuugucccaucuauaaaaucuggcaacgauauugcuaauuguuuacguaaaaauggaaagagaguaauacaguuaaguagaaagacguuugauaccgaguaucagaaaacuaaaaacaaugacugggauuauguuguuaccacagauauaagcgagaugggugcaaauuuucgcgcugacagaguaauagauccaagaagguguuuaaaaccaguaauucuuaaagauggaccagaaagagugaucuuagcgggacccaugccugucacaguagcuucagcagcacaacgcagaggcagaaucggcagaaaccauaacaaagaaggggaucaauauauauacaugggccagccgcuuaauaaugaugaagaccacgcgcauuggacugaggcaaaaaugcuuuuagauaacauaaauacucccgaaggaauaaucccagcauuauucgaaccugagcgggaaaaaucugcagcaauagauggagaauaucgguugagaggggaggccagaaaaacauuuguagaacucaugcguagaggagaucuucccguauggcuuagcuauaaggucgccagcgaagguuuucaauauagugaucgaagauggugcuuugauggggaacguaauaaucaagugcuagaggaaaauauggacguagaaauauggacaaaggaaggagaaagaaagaaauuaagaccuaggugguuagacgcuagaacauauagugauccacuugcacuccgcgaguucaaggaauuugccgcaggaagacgaagugugaguggagaccuaauacuagaaauagguaaauugccgcagcaccucacucagcgugcgcagaacgcauuagauaaccuaguaauguuacacaauagugaacaagguggccgagcuuaucgucacgcaauggaggaguugccugacacuauugaaacacuaaugcucuuagccuuaaucgcuguuuuaacgggaggugugacccuauucuuuuuaaguggcagaggacuaggaaaaaccagcauuggguuauuaugcguuauggcuaguagugugcuccuauggauggcuagcguugaaccucacuggauagcagcuucaauaauuuuagaauuuuuccucaugguuuuauuaauaccagaaccugauagacagagaacuccgcaagacaaucaguuagccuaugucguuaucgguuuacuguuuaugauuuugaccguugcugcgaaugaaaugggguugcuagaaacaacaaagaaagaccuaggcauaggucauguugccguugagaaucaccaucacgccgcuaugcuagacguagaccuccacccagccucagcauggacucucuaugcuguggcaaccacuauuauaacucccaugaugagacauaccaucgaaaacacuacugcgaauauaagucuaacggcuauugccaaucaggcagcaauacuaaugggccuagacaaaggauggccaauaucuaaaauggauauuggaguccccuugcuagcguuaggaugcuacucccaaguaaacccgcuaacucuaacugccgcuguacugaugcugguugcccauuacgcaaucaucggaccaggguuacaggcuaaagcaacaagagaggcgcaaaagagaaccgccgcuggcauaaugaaaaacccgaccguagaugguauaguugcuauagaccucgauccagucguuuaugaugcaaaauuugagaaacaacugggucagauaaugcuguugauauuaugcacaucccaaauauuacugaugaggacuacuugggcucucugcgagagcauuacuuuagcaaccgggccacuaaccacucuaugggagggaucuccaggaaaguuuuggaauacaacaauugcaguuaguauggcaaauauauuccggggcaguuauuuagcuggggcaggauuagcguuuucauugaugaaguccuuagguggggguagacgagguacaggggcacagggugaaaccuugggagagaaauggaagagacaacuaaaccaacuaucgaagucagaguucaacacuuacaagaggagcggcauuauggaaguugauaggucagaagcaaaagagggauuaaaaaggggagaaacaacuaaacacgcgguaucucgagggacggcaaaguuaaggugguucguugagaggaauuugguuaagccagaagggaaaguuauagacuuagguugcggccgaggaggcugguccuacuauugugcagggcugaagaaaguaacagaggucaaaggauauaccaagggaggacccggucaugaagaaccaaucccaauggccacuuacggcuggaaucuuguaaaguuacauagcggcaaagauguauucuuuaucccgccugaaaaaugcgauacauuauuaugugacauaggugagucaagcccgaacccaacaaucgaagaaggcagaaccuuaagagucuuaaaaaugguagaaccauggcuucgaggaaaucaguuuugcaucaagauacuuaauccguauaugccuagugugguagaaacucuagaacaaaugcaaagaaaacauggcgguauguuaguacguaacccauuaagccgaaacuccacacacgaaauguacuggguaucaugcgggaccggcaauaucguuucagccgugaauaugacuucacgaauguugcucaauagauuuacuauggcucauaggaaaccaacauacgagcgggauguggaucuaggugcgggaacacgacacguagccguagaacccgaagucgcuaauuuagacauuauaggccaaagaauagaaaauauuaaacacgaacacaaauccacauggcauuacgaugaggauaauccauacaaaacaugggcauaucacggaucauacgaagugaaaccaucggguucggccucaagcaugguuaauggcguaguaaaauuacuaaccaaaccgugggacguuauuccaauggugacccaaauagcgaugacagauacuacccccuuuggacaacaaagaguauucaaagaaaaaguggauacaaggacgcccaaagcgaaaagaggaacagcccaaaucauggaaguaaccgcaaagugguuauggggguucuuaucacguaacaagaaaccaagaauuuguacgcgagaggaauuuacuagaaaaguacguaguaaugccgcgauuggagcugucuuuguagaugagaaucaauggaacucagcuaaagaagcagucgaagaugaaagauuuugggaccugguucaccgggaacgcgaauugcauaaacaaggaaagugcgcaacauguguuuauaauaugaugggaaagagagagaagaaauuaggagaguucggcaaagcuaaagggucaagagccauaugguauauguggcuaggagcaagauuucuagaauuugaagcacuagguuucaugaaugaagaccacugguuuucacgugaaaacagucuaaguggaguagaaggagaaggacuucauaaacuaggcuauauauuaagagauauuuccaaaauaccaggagggaauauguacgcugaugauacagcggggugggauacacguauuacugaagacgaucuacagaacgaagcacggauaaccgauauuauggagccagaacaugccuuacuagccaagaguauauucaaacugacauaucagaacaagguagucaggguacagcguccagcgaaaaaugggacuguaauggaugucauuucaagacgugaucagagaggaagcgggcagguugguaccuacggauuaaauacauuuaccaauauggaagcucaauuaauaagacaaauggagucugaggggauauucucaccuagcgaacucgaaacaccuaauuuagccgaaaggguuuuagauuggcuagaaaaguauggugucgagaggcugaaacgaauggcgauuucgggagaugacugugucgucaagccaauugacgauagguucgccacugcgcuaacggcuuugaacgauauggguaaaguccguaaagauauaccgcagugggaaccaagcaaagguuggaaugauuggcaacaaguaccauuuugcucgcaccauuuucaccagcuaauaaugaaagauggucgggaaauaguaguaccuugcaggaaccaagacgaacuggucggcagagcuagaguaucacaaggggcuggaugguccuuacgggaaacggcuugcuugggaaaaucauaugcgcagauguggcaacuaauguacuuccaucgcagggaucuacguuuggcugccaaugcgaucuguucagcuguuccaguagacuggauuccgacaagucgaacuaccugguccauacaugcacaucaucaauggaugacgacggaggauaugcucucaguauggaaccguguauggauagaagagaacccauggauggaagauaagacacauauuaguucauggggagacgucccauaccuggguaaacgugaagaucaauggugcgguucauuaauagguuugacugcuagggcuaccugggccaccaauauacagguggcuauaaaccaaguuagaagauuaauaggaaaugaaaauuaccucgauuauaugacgaguaugaaacguuucaaaaacgaaucugauccugaaggagcacugugguaa

SEQ ID NO: 21863 - RNA, 9879 nt, Artificial Sequence
  derived and/or modified CDS sequence (opt6) from DENV-1__GU131793__SS-prME
ucggugacgaugcuccugauguuaaugccaaccgcuuuagcauuucaccucaccacuagaggaggugaaccacauaugaucgugucaaaacaagaaagagggaaaucauugcuauuuaaaacuagcgcugggguaaauauguguacucuaaucgcuauggaucuaggugaauuaugcgaggauacuaugacuuacaaauguccgaggauuacugagacagaaccggacgauguagacugcugguguaaugcaacagacaccuggguuacauauggaacaugcucucaaacgggagaacauaggcgagauaaaagaagcguagcacuggcaccacacguaggguuaggccuggagacccgaacagaaacuuggaugucaagugaaggcgcuuggaaacagauccagaggguugagaccugggcgcugcgacacccuggguucacaguaaucgcacuuuucuuagcucaugcaauaggcaccaguacaacucaaaaagguauaaucuuuauacuacuuaugcugguaacaccaucaauggcuaugagaugugucggaauagggucuagggauuucguugaagguuugucuggagcaacuuggguagacgucguccuugagcaugggaguugugucacaacuauggcaaaagauaaaccgacccuagauaucgaacuguugaaaacugaaguaaccaauccggcagugcuacguaaacuauguauagaggcaaaaauaagcaauacaacaaccgacucccgauguccuacgcaaggggaggcuacccuaguagaagaacaagacgcaaacuuugucugucgcaggacauucguagauagaggaugggguaaugggugcggacucuucgggaaagggagucuuauaaccugcgcaaaauuuaaguguguuacuaaacucgaaggaaagauugugcaauacgagaaucuuaaauacucuguuauaguaacaguacauacaggugaucaacaucagguagguaacgagucuacagaacacggaacaacggcuaccauuacgccgcaagcgccaacaacagaaauacaguuaacagauuauggugcacuaacacuugauuguagcccucgaacuggucuagauuuuaaugaaaugguccuacuuacaaugaaggaaaaaucuuggcucguccacaaacaaugguuuuuagaccuacccuuaccuuggacaagcggugcaucaacgucacaggaaaccuggaaucgacaagauuuacuuguaacauuuaagaccgcacaugccaagaaacaagaaguagucguauuaggaucgcaggagggugcaaugcauaccgcauugacaggagcuacugaaauucagacaucggguacaacuacuaucuucgcaggccaccucaagugcagauuaaaaauggacaaguugaccuuacgugguaugaguuauguaaugugcacaggcaguuuuaaauuggaaaaagaagucgcagagacacaacacgguacaguauuaguucaaauaaaauaugaagguacagaugcuccuugcaagauaccuuuuaguacgcaagacgaaaaaggcguaacucagaauggaagacucauuacggcaaaucccaucguaacagauaaagaaaagccuguaaauauugaagcagagccaccguucggagaaagcuacaucguaauaggagcaggggaaaaggcccuaaagcuaagcugguuuaaaaaggggucaaguauaggaaagauguucgaagccacggcacggggagcuagacguauggccaucuugggggacacagcaugggacuucggaaguaucgggggugucuucacaagugucgggaaguuagugcaucagaucuucggaacugcauauggaguacuuuucaguggaguuaguuggacaaugaaaaucggaauaggugugcuucuaacuuggcuuggacuaaauucuaggucuacaucauuaucuaugacauguauagccguaggcuuagucacauuauaucugggaguuauggugcaggcagauaguggaugugucauuaacuggaaaggucgcgaacugaaaugugggucagggauauuugucacaaacgaaguacauacauggacagagcaauauaaauuucaagcugacagucccaaacgacucucagcugcaaucgguaaagcaugggaagaagggguaugcgggauucgaagugcuacuaggcuugagaauauuauguggaagcaaauaucuaacgaacuaaaccacauacuacucgaaaacgacaugaaguuuacgguaguugucggcgacguagcggggauccuugcacaagggaaaaagaugauaagaccacaaccuauggaauauaaauauagcuggaagucguggggcaaagcgaaaauaauaggcgcugaugugcagaauacaacauuuauuauagacgguccaaacacgcccgaaugucccgacgaucaaagagcuuggaauauaugggaaguggaagauuacgguuuuggaauuuucaccaccaauauauggcuaaaauugagggauaguuauacucaagucugugaccaccguuuaaugagugccgccauaaaagacucaaaagcugugcaugcggauaugggauauuggauugaaagcgagaaaaaugaaacuuggaaacucgcuagggcuaguuuuauugaaguaaaaacauguauauggccuaaaucccauacccuguggucaaauggaguuuuagaaagugagaugauaaucccaaaaauauacggagguccaauuucccaacauaacuauagaccuggauacuuuacacaaacggcaggaccuuggcacuuaggcaaauuagaacuugacuucgaucugugcgaggggacgacgguaguaguagacgagcauugcgguaacagaggcccgucauugcggacgacaacuguaacagguaagauuauacacgaauggugcugccggucauguacacuacccccauuacgcuuucgcggagaagacggaugcugguaugguauggaaauaagaccugucaaagaaaaagaagaaaauuuaguuaagaguaugguaucggcuggaucaggugagguugauuccuucuccuuaggguuacuuuguauaucgauuaugauagaagagguuaugcgaaguagauggaguagaaaaaugcucaugacgggaacacucgcuguauuuuucuugcuuauaaugggucaguuaacauggaacgacuuaauaagacuuuguaucaugguaggugccaaugcaagugaucgaaugggcauggguacgaccuauuuggcuuugauggcuaccuucaaaaugaggccgauguucgcagugggacuacuuuucagaagauuaacuucacgggaggugcuacuucucacaauagguuuaagucugguagcaaguguagaacuccccaauagccuggaagaauuaggagacggucuagcaaugggaauuaugauuuuaaaguugcugacggauuuccaaagccaccaacucugggcaacucuuuugucacuaacauuuaucaaaacaacauucucacuucauugugcguggaaaacuauggccaugguucuuagcauaguaucuuuauuuccccuaugcuuaucaacuacuagccagaaaaccacuuggcuuccgguuuuguugggaucuuuaggaugcaaaccuuuaacaauguuucuaaucgcugaaaauaaaauauggggccgacgaucauggccuuugaacgaagguauaauggcgguagguauaguuagcauucuuuugucaucgcuauugaaaaaugaugucccacuagcagggccguugauagcaggagggauguuaaucgccuguuacguuauaucaggaucgucagcugauuuaucucuagaaaaagcugcagaagugucuugggaagaagaagcagaacacaguggcgccagucauaacauccuuguugagguucaagaugaugggacuaugaaaauaaaagacgaagaaagagacgacacuuuaacaauauuacuaaaagcaacauuauuggcagugagcgguguuuacccgcuaucaauaccagcgacauuauuuguaugguauuucuggcagaagaagaaacaacgaagcgguguucuuugggacacgccaucuccaccagaagucgaacgugcaguuuuggacgacgggauauaucguauuaugcaacgcgggcuucuaggucgcagucaaguuggugucggcguuuuucaagaaaacguauuccacaccauguggcauguaacucgaggagccguauuaauguaucaaggaaaacgcuuagaaccuucaugggcaagugucaagaaagacuuaaucucuuauggugguggguggcgauugcaaggaucuuggaauacaggagaagaagugcaaguaauagccgucgagccaggcaaaaauccuaaaaauguccaaacggcaccagguacauucaaaacaccggagggugaagucggugcaauagcauuagacuucaaacccggaacaaguggauccccuauuguaaacagagaaggaaagauaguuggacuauacggaaacggcgucgucacaacaaguggaacuuauguuucagcuauagcacaagcaaaagcaagucaggaagguccucuuccagaaauagaggacgaaguuuuuagaaagagaaauuuaacuauaauggaucuacacccgggaagcggaaaaacacgcagauaucuaccugcaauagugcgcgaagcuauaaagcgaaaauuaagaacacucauacuugcuccaacuagagugguagccagcgaaauggcagaggcauuaaaagguaugccgauucgcuaucaaacaacugcugugaaaucugaacauaccggcaaggaaauagucgacuugaugugucacgcuacuuucacgaugcgauuauuaaguccgguacgaguuccuaacuauaauaugaucauuauggaugaagcacacuuuacagacccgaguucaauagcagccagagguuauaucucaacaagagugggaaugggugaagcagcagcaauauucaugacagcaacaccaccgggaagcguggaagcguuuccccaaucaaacgccgucauucaagaugaagaacgagacauuccggagcgaucuuggaacagcgguuacgaguggauaacggauuucccggggaagacagucugguucguaccuucuauaaaaaguggaaaugauauugcaaauugucuccguaaaaacggaaagagaguaauucagcuuucuagaaaaacguuugacacugaauaccagaaaaccaaaaauaacgacugggacuauguuguaaccacugauauuucagaaaugggcgcgaauuuucgggcggauaggguaauugauccuagaagguguuuaaaacccgugauacugaaagaugguccagaaagagugauucuagcuggaccgaugcccguaacuguagccucagcggcacaaagaaggggacguauagguagaaaucacaacaaagaaggggaucaauacaucuacaugggacagccgcucaauaaugacgaggaccaugcgcacuggaccgaagcuaaaaugcuccuggacaauauuaacacaccagaaggaauuauaccagcguuauuugagccagaaagagaaaaaucagcggcuaucgacggggaguacaggcuacguggugaagcgaggaaaacauucgucgaguuaaugaggcgcggugaucuucccguauggcuaucauauaaaguagcaucggaaggauuccaauacucugaucguagguggugcuucgauggagaaagaaauaaccagguacucgaagaaaauauggacguugaaauuuggacaaaagagggggagaggaagaaauugaggccucgcugguuagaugcuagaacuuauagugaccccuuggcuuuacgagaauuuaaggaguucgcagcagguagacgauccguaaguggagauuugauauuggaaauaggaaaauuaccucaacauuugacacaacgagcgcagaacgcuuuagauaaucucguaaugcugcauaacucagaacaaggaggacgagcauaucgucaugcaauggaagaacuuccggauacaauagaaacauuaauguuacuugcccuaauagcuguacuaacaggcggaguaacucucuuuuucuuaagcggacgagguuuaggcaaaacaucaauaggauuauuauguguaauggcguccaguguauuacuuuggauggcaagcguugaaccccacuggauugcugcaagcauaauucuggaguucuuuuugaugguauuacuaauaccugaaccugacaaacaacgaacuccucaagacaaccaauuagccuauguuguaaucggucuucuauucaugauacuaacuguugcagcaaaugaaaugggacuacuagaaaccaccaagaaggacuuagguauagggcacguagccgucgaaaaucaucaccaugcagccaugcucgacguagaucuacauccggcaagcgcuuggacguuauaugcuguagcuaccacaauuauaacaccaaugaugcgacauacaauagaaaauacuacagcuaacauuagucuaacugcaauagcaaaucaagcugcgauuuugaugggacuagauaagggcuggccaauuagcaaaauggauaucggcgugccccuauuagccuuagggugcuauucacaaguaaauccauuaaccuuaacagcagcaguucucaugcuaguggcccacuacgcuaucaucggaccaggucugcaggcaaaagcuacaagagaagcacaaaagaggacugcugcuggcauaaugaaaaaucccaccguagauggcauuguggcaauugaccuagacccgguuguguacgaugcgaaauucgaaaaacagcuaggacagauuauguuacucauauuauguacuucucaaaucuuacuaaugcgaacaacaugggcacugugugaaagcauuacucuugcaacggguccacuuaccacacugugggaaggcagcccgggcaaguuuuggaacacaacaauugcaguaucaauggccaacauauuuagaggaaguuaccucgccggugcagggcuagcauuuagucuaaugaaaagccuaggaggagguagaagggguacaggcgcucaaggagaaacccuuggcgaaaaguggaagagacaacuuaaccaacugagcaagagugaguucaacacuuacaaaagaagcggaauuauggaggucgauaggagcgaagcgaaagaaggccugaaacggggagaaacuacuaagcaugcuguuucuagagggacugcaaagcuacguugguucguagaaagaaauuuaguaaaaccggagggaaaagucauagaucuagguuguggacgaggaggguggucauauuauugcgcaggacuaaagaaaguaacagaaguuaagggguacacaaaaggggguccuggacacgaagaaccuauaccaauggcgacauacggguggaaucuugugaaacuacauucaggaaaagaugucuucuucaucccaccagaaaagugcgacacucugcugugugauauuggagaaucuucuccaaacccuacuauugaagaaggacgaacucuacguguacucaaaaugguagaaccuuggcuacgagguaaccaauucuguaucaaaauauuaaacccauauaugccaucgguaguagaaacgcuggaacagaugcaaaggaaacauggugggaugcuuguuagaaauccauuaaguagaaacucaacccacgaaauguacugggucucaugugguacuggcaacauaguauccgcaguuaauaugaccucuagaauguuauugaaucgauuuacuauggcacacaggaaacccacuuaugaacgagauguugacuuaggugcugguacaagacauguagcaguagaaccagaaguagcaaaucuagauauaauaggacagaggauagaaaacauuaagcaugagcauaaaucuacuuggcacuacgaugaggacaauccauacaaaacuugggcguaucauggcucuuacgaggugaaaccaucuggaucugcaucuaguauggucaacggcguugucaaacuccuuacuaaaccaugggaugugauacccaugguaacgcagauagccaugacggauacuacaccuuucggucagcagagagucuuuaaagaaaagguggauacgaggacuccaaaagcaaaaagaggaacggcacaaauuauggaagucacagccaaguggcuuuggggauuucucucucguaacaagaaaccacgaauaugcacgcgugaggaguucacgagaaaggucagaucgaaugcagcaaucggugcgguguucgucgacgagaaccaauggaacucagcgaaagaagcaguagaggacgaacgcuuuugggacuuaguucaccgugaacgagaacuucauaagcaaggaaaaugugcgacauguguauacaauaugaugggcaaaagagagaagaaauuaggugaauuugguaaagccaaagguucucgggccauuugguauaugugguugggagcaagauuuuuggaauuugaggcuuugggauucaugaaugaagaccauugguuuucgcgugaaaauaguuuaucaggaguagaaggagaaggauugcauaaauuaggauacauauuacgcgauauaucuaagauuccugguggcaauauguacgcagaugauacagcuggaugggauacucguaucacggaagaugaccugcaaaaugaggcaaggauuacagacaucauggaacccgaacacgcacuacuugcuaagucuauauuuaaauuaacuuaucaaaauaaaguuguuagagugcaaagaccugcuaaaaacggaacaguuauggauguaauaagucggcgugaucagcguggaaguggacaagugggaaccuacggcuuaaauaccuucacuaauauggaagcucaguuaauaagacaaauggaaucugaagggauauucucccccucggaacuugagacgcccaacuuagcugagaggguccucgauuggcuggaaaaauauggagucgaacgacuaaaaagaauggcaauaucuggugacgauugugucguuaaaccgauagaugauagguucgccacugcgcugacugcacugaaugacaugggaaagguaagaaaagauauaccacagugggaaccaucuaaaggauggaacgauuggcaacaaguaccauuuuguucccaccauuuucaucaacuuauaaugaaagauggaagggaaauaguaguaccuugucggaaucaggacgaauuaguagggagggcuagagugucacaaggugcaggauggagccucagagagacagcaugccugggaaaaucuuacgcucaaauguggcaguugauguauuuucauaggcgugaucuaagauuagccgcaaacgcaauaugcagcgcggugcccguagacuggauuccuacaucgagaacgacauggagcauacaugcucaucaccaauggaugaccacggaagauauguuaagugucuggaaccgagucuggauagaggaaaaucccuggauggaagacaagacacacaucagcaguuggggagacguuccguaccuugguaaacgugaagaucaauggugcgggucauugauugggcucaccgcgagagcuacgugggcuacuaauauccaaguagcaaucaaccaaguacgucgacuuauagggaaugaaaacuaccuugacuauaugacuucaaugaagcguuuuaaaaaugaaagugaccccgaaggagcccuaugguag

SEQ ID NO: 21864 - RNA, 9879 nt, Artificial Sequence
  derived and/or modified CDS sequence (opt6) from DENV-1__GU131794__SS-prME
ucaguuacuaugcugcuuaugcuuaugccuacggcgcuugcauuccaccugacaacgaggggcggagagccgcacaugauaguauccaaacaagaacggggaaaaaguuuauuauucaaaacauccgcuggaguaaacauguguacacuaaucgcaauggaucuaggagaauuuugugaggauacaaugacauauaaauguccaaggauaacggaagccgaaccggacgauguagauuguuggugcaaugcuacugauacauggguuacauaugguacgugcagucaaacaggagaacaccgacgcgauaaaagaucagucgcucuagcaccucauguaggcuuaggacuugagacgcguacagaaaccuggaugaguucagaaggugcuuggaaacaaauccaaaggguugaaacuugggcacuaagacaucccgguuuuacagucauagcauuguuucuugcucaugcuauagggacaucuauaacucagaaaggaauuauauucauacuacuuauguuaguaaccccaagcauggccaugagaugcguuggcaucggcagucgugauuuuguugaggguuugucaggagccacauggguggacgugguguuggaacacggcucaugcgugacaaccauggcaaaagauaaacccacgcucgacauagaacugcucaaaacagaaguuacaaauccagcaguccuaaggaaauuauguauagaagcaaaaauaucuaacaccacuacagacagucgguguccuacacaaggugaagcaacauuaguagaggaacaagacgccaauuucgucugccgaagaacauucguggaccgcggauggggaaauggcuguggccuauucggaaaaggaucacuaauaacuugcgccaaauucaaaugugucacuaaauuagaaggaaaaaucguccaauaugaaaaucuuaaauauucaguaaucguaacggugcacacgggugaccagcaucagguugguaacgagucgacagagcauggcacaacagccacgauaacgccacaagcaccuucgaccgaaauucagcuaacagauuauggcgccuuaacauuagauuguucgccuaggacgggacucgacuucaacgaaaugguucuuuuaacuaugaaggaaaagucauggcuaguucauaaacaaugguucuuagaccuaccccuucccuggacaucgggagccaguacuucccaagagacauggaaucgacaggaccuuuuaguaacauuuaagaccgcacacgccaaaaagcaagaaguuguaguacucgggucccaggaaggcgcaaugcauacugcuuuaacuggggcuacagaaauucagacaagcggcacaacgacaauauuugcuggucaucucaaguguagguuaaagauggacaaacucacuuuaaaagggauguccuacgucauguguacaggcuccuuuaagcuagagaaagaaguugccgaaacucaacacgguacgguauuaguacagauuaaauaugaagguacagacgcaccguguaaaauaccguucagcacucaggaugaaaagggcguuacccaaaaugggcguuuaaucaccgcuaauccgauaguuaccgacaaagaaaaaccagucaauaucgaagcagaaccaccuuuuggugaaucauauaucgucaucggagcgggagaaaaagcguuaaaacuaucaugguuuaagaaagguucuucaauaggaaaaauguuugaagcaacagcucgaggugcacgaagaauggcuauacucggagacacugcaugggauuucgggaguaucggcggcguuuucaccucugucggaaaacucguccaucaaauauuugggacagccuauggugugcuguuuucgggagucuccuggacgaugaagauagguaucggaguauuacuaaccugguuaggacuaaauucacggaguacuucauugaguaugacauguauagcuguaggacuugucacauuauaucuuggagugaugguucaggcagauaguggaugcguuauaaauuggaaagggagagaauugaaaugugguucugguauauuuguaaccaaugaaguacauaccuggacagaacaauauaaauuucaagcagacucacccaaacgcuuaucugcagcaauaggcaaggcuugggaagaaggcguaugcggcauacgaucggcgacuagacuagaaaauauaauguggaaacaaauuagcaaugaacuuaaccacauauuauuggaaaaugauaugaaacuaacagucguuguuggagauguagccggcauacuagcacaaggcaaaaagaugauacgaccacaaccaauggaauacaaauauagcuggaagucuugggguaaagcaaaaauuauuggugccgauguacaaaauacaacuuucauaauagauggaccaaacacacccgaauguccggacgaccaaagggcuuggaacauaugggaagucgaagauuacggauuuggcauauucaccacgaauauaugguuaaagcuaagagacagcuacacacaaguaugugaucauagguuaaugucagcggccauaaaagacagcaaggcugugcaugcagacauggguuauuggauagaaucugagaagaaugaaacauggaaguuggcacgagcaucauucauagaaguaaaaacuugcaucuggccgaaaagucauacuuuauggaguaauggaguauuagaaucugaaaugaucauaccgaaaaucuaugguggaccaauaucccaacacaauuaucgcccuggauacuuuacacaaacagcagguccauggcacuugggaaaauuagaacuugauuucgauuugugcgaggguacgacgguuguaguggaugagcacugcgguaacagagggccaagccuacguacgaccacaguuacuggaaaaauuauucaugagugguguugccggaguuguacacuuccaccacuuagauuuaaaggagaggauggauguugguaugggauggaaauaagacccguaaaagaaaaggaagaaaacuugguaaaauccaugguauccgccgggucgggggaaguagauaguuuuucauuaggucuacugugcauaucaauaaugaucgaagaaguaaugcggagccgauggaguaggaaaauguuaaugacggguacucucgcaguguuuuucuuauuaauaaugggucaacucacuuggaaugaucugauaagauugugcauaaugguaggagcaaaugcaucugaucguauggguaugggcacgacauacuuagcauuaauggcaacauucaaaaugcgaccaauguuugcaguaggacuccuauuuaggagacuuacaagcagagaggugcuauuauuaacaauaggacugucauuaguagccagugucgagcuuccuaacaguuuggaagaacugggcgacggccucgcuaugggaauuaugauccuaaaacuauuaacugauuuccagagucaccaauuaugggcaacauuacuaagccuuacauuuauucgcacaacauucucgcuucauuacgcauggaaaacaauggcgaugguccuuuccauaguauccuuauuuccucuguguuuaaguacuacaagccagaaaaccaccuggcuuccgguccuacuuggcucccuaggauguaaaccucucacaauguuuuuaaucgcggaaaacaagauauggggccgaaagaguuggccgcuaaaugaagggauaauggcaguaggaauagugucuauccuccuuucuucccuucugaaaaaugaugucccacucgcgggaccucugauugcgggagggauguuaauagcuugcuauguaauaaguggaaguucugcugaucuaagucuggaaaaggccgcuguagugucuugggaagaagaagccgaacacucaggugccagucauaauauacuuguugaaguucaagacgacgggaccaugaaaaucaaagacgaagagagagaugacacuuuaaccauauugcugaaagcgacauuguuagcagugucgggaguguauccgcuuucaauacccgcuacucuauuuguaugguauuuuuggcagaagaagaaacaaagaucuggcguucuuugggauaccccaucaccaccagaggucgaaagggcagugcuagaugauggaauauauaggauaaugcaacgaggucuccuaggaagaagccagguaggaguaggaguauuccaagaaaacguguuucauacgauguggcauguaacgcguggcgcaguuuuaauguaucaagguaagcguuuggaaccuaguugggcaucugucaagaaagauuugauaucauauggagguggauggcgacuucaaggaucuuggaacaccggcgaagaaguacagguaauagcugucgagccuggcaaaaaucccaaaaauguacaaacagcuccagguacuuuuaagacaucugagggagaggucggagccauagcauuggacuucaagccuggaacgucuggguccccuauagugaauagagaaggaaaaauugugggauuauaugggaacggaguuguaaccacaucugggacauacguuagcgccauugcucaagcaaaagcaagccaggaaggaccacuaccagaaauugaagaugaggucuuucguaaacgcaaucugacuauaauggauuuacauccaggaaguggcaaaacacggagguaccugccagcaauagucagggaagcaauaaaaagaaaauuacgaacauuaauauuagcuccaacgagagucguugcuagugaaauggcggaggccuuaaaaggcaugccuauuagauaccaaacaacagccguaaaaucagaacacacaggcaaagaaauuguagaccuaaugugucacgcuacauuuacaaugagauugcuauccccuguccgcgugccaaacuauaacaugauaauaauggaugaagcgcauuuuacugaucccuccucuaucgcggcaagaggcuauauaaguacccgaguggguaugggagaagcugcagccauuuuuaugacugcgacacccccgggaucagucgaggccuuuccacaaagcaaugcaguuauccaagacgaggaacgcgauauaccagaacguucauggaacaguggauacgaauggauuacagacuucccaggcaaaacuguaugguuuguaccuaguaucaagagcggcaaugacauagcaaauugucuccggaaaaacgguaaaagagugauucaacucucaagaaagacuuuugauacugaguaccagaaaacuaaaaauaaugacugggauuauguggugacgacggauauuagugaaaugggugcaaacuuccgcgcugacaggguaauugacccaagacgaugccugaaaccaguaauuuuaaaagaugggccugagagaguaauuuuagcgggcccuaugccuguaacggucgcgagugcugcucaaaggcgcgggcguaucggaagaaaucacaacaaggaaggagaucaauauaucuacaugggacaaccgcugaacaaugaugaagaccaugcucacuggacugaagcgaaaaugcuucuagacaauauaaauacuccagagggcaucauaccagcccucuuugaaccugagcgggagaaaucugcggccaucgacggagaguaucgucuacgcggagaagcaagaaagacauucguugaacuuaugcgucguggcgauuuaccaguaugguuaucuuacaaaguugcuucagaggguuuucaguauuccgacagaagaugguguuuugauggggaaagaaacaaucaagugcuagaagaaaauauggacguagagaucuggacaaaagagggagaaaggaagaaacuaaggccuagauggcuggacgcccguacguacuccgauccucuggcacuacgagaauuuaaagaguuugcagccggucgaagaaguauaaguggcgaucugauacuugagauagguaaguuaccgcagcaucuuacacagcgagcgcaaaaugcuuuggacaacuugguuauguuacauaacucagaacaaggaggaagggcauacagacaugccauggaagaguuaccagauacaauagaaaccuuaauguugcuagcauugauagcagucuugaccggagguguuacucuuuucuuucuaaguggcagagguuuagguaagacgaguauaggacuacuauguguaauggcgucgagugugcuucuguggauggcuucuguagaaccacacuggauagcagcaagcaucauccuugaguucuucuuaaugguacuacuuauaccagaaccugauagacaaagaacaccacaggauaaccaacuagcauauguagucauaggacuacucuucaugaucuuaacuguagcggcaaaugagaugggacuacuggaaacuacaaagaaggaucuggguauuggccacguggcaguggaaaaucaccaccaugcugccauguuagacgucgaucuacacccagcgagcgcauggaccuuauaugcgguugcgacuacaauuauaacaccaaugaugagacauaccauagaaaauacaacagcuaauauaucauugaccgcaauugcaaaucaagcagcaauccugaugggacuugacaaaggauggccaauaaguaagauggauauagggguaccauuauuagcacucggcugcuauagucagguaaaucccuuaacccucacagcugcaguccuaauguuaguggcacacuacgcgauaauaggaccaggccuacaagccaaagcgacaagggaagcacaaaagcggacagcugcuggaauaaugaagaacccgaccguagauggcaucguagcaauugaucuagacccuguuguuuacgacgcaaaauuugaaaagcaauuagggcaaaucauguuacuuauauugugcacaagucagauucuacucaugagaacgacuugggcuuuaugugaaagcaucacacuagcuacaggaccccuuacaacucucugggaaggcucaccaggaaaauucuggaauacuacgauagcaguuuccauggcuaauauauucagaggauccuauuuagccggugcaggacuugcauucucucuuaugaaaucgcugggaggcggaagaagagguacaggugcacagggagagacuuuaggagaaaaauggaaacgucagcuaaaucagcuaucuaaaucugaauuuaacaccuacaagagaucagggauaauggaaguugauagauccgaagcgaaagaagguuuaaaaagaggugaaacuacaaaacacgcagucucgcgcgggacagcaaagcuaagaugguucguugaaagaaaucuaguaaaaccggaaggaaaagucauagacuuaggaugcggucgugggggaugguccuacuauugcgcugggcucaagaaagucacagaaguuaagggauacacaaagggaggacccggucacgaagaaccuauacccauggcaacauauggcuggaaucuugucaaguugcauucaggaaaagacguuuucuucauaccacccgaaaagugugacaccuuauuaugcgacaucggugagaguagcccaaauccaacuauagaggaggggagaacguuaaggguucucaaaauggucgagcccuggcuaagaggaaaccaauucuguauaaagaucuugaauccguacaugccauccguaguggagacgcuagaacagaugcagcgaaaacacggagggauguuaguucgaaauccguuaagcagaaauucaacccacgaaauguauugggugucguguggaacaggaaauauaguaucagcaguaaauaugacgucuagaaugcuauuaaaucgauuuacaauggcccacaggaaaccaacuuacgaaagagacgucgacuuaggggcagggacuagacauguagcgguagagccugagguagcaaacuuagauauuaucggacagagaauagaaaacauuaaacacgagcauaagucaacguggcauuacgacgaagacaacccguauaaaaccugggcguaccaugguucauacgagguuaagccuaguggcagugcaaguuccaugguuaauggugugguaaaauuauuaacuaaaccaugggauguuauaccaaugguaacucagaucgcuaugacagacacaacacccuucggacaacaaagaguuuuuaaagaaaaaguagauacuaggacaccaaaggcuaaaagagggacugcucaaaucauggagguuacagcaaaauggcuauggggguuucucucuagaaauaagaaacccagaauuuguacgagagaagaguucaccaggaaaguacgaagcaacgcggcaauuggagcaguauucguagaugaaaaccaauggaacucggccaaggaagcuguggaagaugaacgguucugggauuuaguucauagggaaagagaacuacacaagcaaggaaaaugugcgacauguguauacaauaugauggguaaacgagaaaagaaauuaggugaguucggaaaagcuaaggguuccagagccaucugguauaugugguuaggugcaagauucuuagaguuugaagcacuagguuuuaugaaugaagaccauugguuuucgagggaaaauagccuaucagguguugaaggggaggguuuacauaaauugggcuacauuuugagggacauaucaaaaauuccagguggaaauauguaugcggacgacaccgcuggaugggacacaagaaucaccgaagaugaucuacaaaacgaggcaaagaucaccgauauaauggagccagaacaugcacuauuagccaaauccauauucaaauuaacuuaucaaaauaaaguggugcgcguccaacgucccgccaaaaacggaacuguaauggauguaauaaguaggcgagaucaacgugggaguggacaaguuggaacauacggcuuaaauacuuuuacuaacauggaagcccaacugauaagacagauggagagugagggcauauucaguccuucagagcuugaaaccccaaaccuagccggccgaguguuggauuggcuagaaaaacacgguguugagagguuaaaacgaauggcaauaaguggcgaugauuguguaguaaaaccuaucgaugaucguuuugcuacggcacuaacugcccuaaaugauaugggaaaaguaaggaaggauaucccucagugggaaccaucuaaaggauggaacgauuggcagcaaguuccauucugcagccaucauuuucaucaauuaaucaugaaggauggaagagagauugugguaccaugcagaaaccaagacgaguugguagguagggccagaguaucgcaaggagcggguugguccuuacgugaaacugcgugccuaggcaaaucauacgcucaaauguggcaauugauguauuuccacagaagggaucuaaggcuagcugcaaacgcaauuuguucggcggucccaguggauuggguuccuacaucucgaacgacauggucaauacaugcgcaucaucaauggaugacaacugaagauauguuauccgucuggaauagggucuggauugaagagaauccuuggauggaagacaagacccacaucucaucuuggggugacguucccuaucuaggcaagagggaagaccaauggugcggaucgcuuauuggcuuaaccgcgagagcuacaugggcaacaaauauacaagucgcaaucaaccaaguacgcagacugcuagguaaugaaaacuaucuugauuacaugaccaguaugaaaagauuuaaaaacgaaucggaucccgaaggagcauuaugguga

SEQ ID NO: 21865 - RNA, 9879 nt, Artificial Sequence
  derived and/or modified CDS sequence (opt6) from DENV-1__GU131796__SS-prME
agcguaacuauguuacugaugcuaaugccuacugcccuugcauuccaucugacaacacguggaggggaaccacacaugauaguuagcaaacaagaacgaggaaagagcuuacuauuuaaaacaagugcuggcgugaacaugugcacucuuaucgcaauggaccuuggagaauuuugugaagauacaaugacauacaaauguccuagaauaacagaagcagaacccgacgauguagauuguugguguaacgcgacugacacauggguaacauacggaacauguucgcaaacuggggaacaucggagagauaaaagaucuguugcuuuagcaccgcauguaggauuagggcuugaaacacguacagagacauggaugucaagcgaaggagcauggaaacaaauucaaaggguagaaacgugggcuuugcgccacccaggauuuacaguaauagcauuauuuuuagcccacgcaauagguacaaguaucacacaaaaaggaauaauauuuauccuauuaaugcucguuaccccuucuauggccaugcgcuguguugguaucgggucgcgagacuucguagagggguuguccggcgcaacguggguagacgugguucuagaacaugggucgugugugacaacuauggcgaaagacaaacccacacuugauauagaacuacucaaaacugaggucacggaccccgccguguugcgcaaacuaugcgucgaagcuaagauaagcaauacaacaacagauagucgaugcccaacgcaaggagaagccacccuaguugaagaacaagaugcaaauuucguaugucguagaacuuuuguagauagaggcuggggcaaugguugcgggcuuuuuggaaaagguucacuaaugacaugcgcaaaauuuaaaugugugacaaaacuagaaggaaaaauugugcaauacgaaaaucuaaaauacagcguaauuguuacgguacauacuggugaccagcaucagguggggaaugaaucaacagaacaugggacaacagcaacaauuacuccacaagcuccgucgacggaaauucaauuaaccgacuacggagcacuaacauuagacugcucaccacguaccggauuggauuuuaaugagauggucuuacuaacaaugaaagagaaaucaugguuagugcacaaacaaugguuuuuagaccugccccugccguggacuagcggagcguccacuucacaagagacauggaacagaaaagaucuacuugucacguucaaaacagcucacgcaaagaaacaagaaguuguaguacugggaagucaagaaggagcuaugcacacagcccuaacaggugcaacugagauacagacuucagguacuacaacuauuuucgcuggucacuuaaaaugucguuuaaaaauggacaaauuaacgcugaaggggaugucauacgucauguguacagguagcuuuaaacuggaaaaagaaguagcugaaacccaacacgggacagucuugguucagauuaaauaugaaggaacugacgcaccgugcaaaauaccauuuucaacgcaagaugagaaaggagucacgcaaaacggacgacuaauaacagccaacccaauaguaacagauaaagagaaaccaguaaacauugaagcagaaccuccauuuggugaguccuacauaguuauaggggcuggugagaaagcguuaaaacuauccugguuuaagaaagggucgaguauuggaaaaauguucgaagcaacggcacguggggcacggagaauggcaauucucggagauacugcgugggauuucggaaguaucggaggcguuuuuaccucgguagggaagcuagugcaccaaauauucggcacugcauacggaguucucuucaguggcguuucuuggacgaugaagauaggcaucggaguauuguuaacguggcuaggguuaaauucaagaucaaccucuuuaucaaugacuuguaucgcaguugguuuagucacucucuauuuaggugugaugguucaagcugacucgggauguguaauaaauuggaaagggagggaacugaaauguggauccgguauuuuuguaacaaaugagguacauacauggacagaacaauacaaauuccaagcagauaguccuaaaagauuaucugcagcgauagggaaggcgugggaagaagggguuugcggaauuagaagugcaacucgauuagaaaauaucauguggaaacaaauaucaaaugaguugaaccauauauuacuagagaaugacaugaaacuaacugucguuguaggagauguagccggaauccuagcgcaaggcaagaaaaugaucagaccacaaccuauggaauauaaauauucuuggaaaucauggggaaaagccaaaaucauuggagcagacguacaaaauacaacauucauuauagauggccccaauaccccagaguguccagacgaucaaagagcauggaacaucugggaaguggaagauuaugguuuuggaaucuucacaacaaauauaugguuaaaacuuagagauuccuauacccaagucugugaucaucgucucaugucugcagcuaucaaggauaguaaagcgguacaugcagacaugggauauuggauugaaucugagaagaaugaaaccuggaaauuagcuagagccagcuucauagaagugaaaacauguauauggcccaaaucucauacacuauggaguaauggaguuuuagaauccgagaugauaauaccuaaaauauacggagggccuauuagccaacauaauuaucguccgggauauuuuacgcagacagccggucccuggcauuuagguaaacuagaacuggacuucgaucuuugcgagggcacaacaguagugguagacgaacacugcgguaaucgaggaccaucccuccguacaacuacaguaacuggaaaaaucauacaugaaugguguugucgcagcuguacguugccuccacuuagauuuaaaggggaagacggauguugguacgguauggaaauacgaccagucaaagagaaggaggaaaaccuaguaaaaucaaugguuagugcagguuccggagaaguagauucuuucagucuagguuuauuauguauaucgauuaugauugaagagguuaugaggaguagauggagcagaaaaauguugaugacaggaacacuggccgucuucuuucuuuuaauaaugggucaauugacauggaacgaucugauaagguuauguauaauggucggugcaaaugccucagacagaaugggcaugggaacaaccuaucuugcacugauggcaacuuucaagaugaggccaauguuugcuguuggcuugcuguuucgcagacucacuucaagagaaguauugcugcuaacaauuggcuugucgcuuguagccuccguggaauugccgaacucucuugaggaacuaggugauggacuagcaauggggauaaugauucuaaaguuguuaacugauuuccaaucacaucaacuaugggcgacauuacuuucuuuaacauuuauaaaaacgaccucaucuuugcacuacgcuuggaagacgauggccaugguacuaucaauagucucccuauuuccacuaugucuaucaacuacgagucagaaaacgacuugguuaccgguauuacuuggaaguuuaggauguaagccacuaacuauguuccucauagcagaaaauaaaauuugggguagaaagucguggccuuuaaacgaaggcaucauggcaguaggaauaguaucuauacuauuaucggcacuccugaagaaugauguaccacuugccggaccccuaauagcgggaggaaugcucauugcaugcuauguuauaucgggauccuccgcggauuuaucccucgaaaaggcagcagagguaagcugggaagaagaagccgaacauucaggcgcuagucauaacauuuuaguagagguccaagacgauggcacgaugaaaauaaaggacgaagaaagagaugacacacuuacaauacucuugaaagcgacucuauuagcuguaucagguguauaucccuuaaguaucccggcgacuuuguuuguuugguacuuuuggcagaaaaagaaacaaagaucagguguuuuaugggacacuccaucaccgcccgaaguugaaagagcaguuuuagaugacgguauuuauagaaucaugcagagaggguuacucgguaggucacaagugggcgugggugucuuccaagaaaauguauuucacacuauguggcauguaacacguggugcaguucuuauguaucaaggcaaacgcuuggaaccauccugggcuaguguaaagaaagauuuaauaaguuacggagguggauggagauuacaggguuccuggaauacaggagaagaaguccaaguuauagcagucgagccaggcaaaaauccuaaaaaugugcagacugccccaggcacuuuuaaaacgagugagggugaggucggagcgauagcucuggauuuuaaacccggaacuucaggaucacccauaguaaaucgcgaaggaaaaauaguuggacuauauggaaacgguguaguuacaacuucagggacauaugugucagcaauugcgcaagcaaaggcuucacaagaaggaccauuacccgaaaucgaagaugaaguuuuccgaaaaagaaaucuuacaaucauggacuugcauccggguagcgggaaaacaaggagguacuuaccagcgauagucagggaagccauuaaaaggaaacuuagaacuuuaauacuugcuccuaccagagugguggccagcgaaauggcugaagcucuaaaaggaaugccaauucgcuaucagaccacggcaguuaaaucggagcacacuggaaaagaaaucgucgauuuaaugugucacgcuacuuuuacaaugcgccuuuuaucucccguaagggugccgaacuacaauaugauaauuauggaugaagcccacuuuacagacccaucaaguauugcggcccgaggauauauuaguacaagaguggggaugggagaagcagccgcuaucuuuaugacagcaacacccccaggcucaguugaggccuucccccagucgaacgcgguaauacaagacgaagaacgagauauaccugagagaagcuggaauaguggguaugaauggauuacugacuuuccaggcaaaacuguuugguuugugccgucuaucaagucgggaaacgacauugcgaacugucucaggaaaaacggaaaaagagugauacagcuuucgcggaagacauucgacacggaauaccagaaaacgaagaauaacgauugggacuauguuguaacaacugacauuagugaaaugggagcgaauuuucgagcagaccgaguaauugauccgagaaggugucuuaaaccaguaaucuugaaagauggaccagagagaguaauacuagcaggaccuaugccaguaaccguugcaucugccgcccaaaggagaggacguauaggccggaaccacaacaaggaaggagaucaauauauauacaugggacaaccacuaaauaaugaugaagaccaugcucauuggacagaagcaaaaauguuauuggacaacauaaacacaccugaaggaauaaucccggcccuuuuugagccagaacgggagaagagugcagcgauagacggugaauaucguuugcguggcgaagcaagaaaaacguuuguagaauuaaugcgcagaggagaccugccgguauggcuaucauauaaaguagccagcgaaggauuucaguauagcgaucgacgaugguguuucgauggagaaaggaauaaucaaguguuagaagaaaauauggacguggaaauauggaccaaagaaggcgaaaggaaaaaguuaaggccucguugguuagaugcuagaacauacucggauccucuggcucuacgagaauuuaaggaauuugcugccggaagaagaucugucaguggagaccuuaucuuagaaauagguaaauuaccccaacaucuuacccagcgugcacaaaaugcacucgacaaccuaguaaugcuacauaauagcgaacaaggaggccgagcuuaccgccacgcuauggaagaauugcccgacacaauagagacucuuaugcuguuagcccucaucgcgguccuaacuggcggaguaacuuuauucuuucuaucagguagggggcuaggaaaaacaucuauuggucuacuaugcguaauggcuagcucgguauuauuauggauggccuccgucgagccacacuggaucgcagccaguauaauuuuagaguucuuuuuaauggugcuauugaucccagagccugaucgacaaagaacaccgcaagauaaccagcucgcauacguaguuauuggccuucuguuuaugauccuuaccguugcugcaaacgaaaugggauuacuugaaacgaccaagaaagauuuagggauaggucauguagcaguagaaaaucaccaucacgcggcuauguuagacguugaccuacaucccgcaucagccuggacuuuauacgcuguugcaacaacuaucauaacgccaaugaugcggcacacuauagaaaauacaaccgcaaauauaagucucaccgcgauugcaaaccaagcugcuauauuaaugggauuagauaaaggauggccaauauccaaaauggauauaggagugcccuugcucgcacuagggugcuacagucaaguaaauccuuuaacacugacagcagcaguacucaugcucguggcacacuaugcgauuauaggaccgggacuacaagccaaagcaacuagggaagcacaaaaacgaacagccgcaggcauuaugaaaaauccgacaguggaugguauuguagcuauugaucuggauccaguaguauacgacgcuaaauucgagaaacaauuaggacagaucaugcuccugaucuugugcacgucacagauacugcuaaugagaacuacuugggcauugugcgagagcauaacuuuagcuacaggaccauuaacuacguuaugggaaggaucacccggaaaguucuggaauacuacaaucgcuguuaguauggccaauaucuuucgaggaaguuaccuugcaggagcaggguuggcauucaguuuaaugaaaucacucgguggcgggagaagaggaacaggggcacaaggcgagacacucggagaaaaguggaaaagacaacuuaaucaauugaguaaaucugaauuuaacacauauaagaggucggggauaauggaaguggaucguucggaagccaaagagggauugaaacguggugaaacgacaaagcaugcuguaucgagaggcacagcuaaauuacgcugguuuguugaaagaaauuuaguaaaacccgaagguaaggugauagacuuagguuguggcagaggaggcuggagcuauuacugcgccgggcuaaagaaaguaacagaagugaaaggcuauacgaaaggagggcccggacacgaggagccaauaccaauggcuacauacggcuggaaucugguaaaauuacacucaggaaaagauguauucuuuauaccgccagagaagugugacacccuacucugcgauaucggcgagagcucacccaauccuacaauagaagagggacguacuuugcgaguucuaaaaaugguagaaccuugguugagaggcaaucaauucugcauuaaaauauuaaauccauacaugcccucuguuguagaaacauuagaacagaugcaaaggaaacauggaggaauguuggucagaaauccauuaucgcgaaacuccacucaugaaauguacuggguaucaugcggaacagguaacauaguuagcgcgguaaacaugacaucucgaauguuauugaaucgcuucacaauggcccaucguaagcccacguacgagagagauguggaucuuggugcugguacgcggcaugucgcaguugaacccgaaguagcaaaucuugacaucaucggucagcguauugaaaauaucaaacaugaacacaaaagcacauggcacuacgaugaagauaauccauacaaaacaugggcguaucauggcagcuaugaaguaaaaccuagugggucagcauccucgaugguaaacggaguaguaaaacuccugacaaaaccgugggacguaauuccaaugguaacucaaauugccaugacggauacaacgccguuuggacagcaaagaguauucaaagaaaaaguugacacuaggacuccgaaagcaaagagagggacggcucagaucauggaagugacugcgaaaugguuauggggauuuuuaucuagaaacaagaaaccccgcauuuguacgagggaagaauuuacacgcaagguaagauccaaugccgcgauaggcgcugucuucguugaugagaaucaauggaacucagcuaaagaggcagucgaggaugaaagauucugggaccucguccaccgcgagagggaguuacauaaacaggguaaaugugcuacaugcgucuacaacaugaugggaaaaagggagaagaaacuaggugaguucggcaaagcaaaaggaagucgagcaaucugguauauguggcuaggggcgcgauuucucgaguucgaggcacuaggauuuaugaaugaagaccauugguucucgcgugaaaauucccuuaguggaguagaaggcgagggauuacauaagcuagguuauauacuacgagauaucucuaagauuccuggagggaauauguaugcagacgacacagccggaugggauacacgaauaacagaagaugauuugcagaaugaagcuaaaauaacagacauaauggagccagagcaugcacuauuagccaagucaauuuuuaaacuaacauaucaaaacaagguaguaagaguucaacgaccggcaaagaaugguacaguuauggacgugaucagucgacgagaucaaagaggcucaggacaagucggcacauauggucuuaauacuuucaccaacauggaggcgcaacuaauuagacaaauggaaagugaaggcauauucucaccuagcgaacuugaaacaccaaacuuagcagggagaguauuggauuggcuagaaaagcacggaguagaaagguugaagcgaauggcaauaagcggggaugacugcguagugaaaccaauagacgacagauuugcagcggcauugacagcccuaaaugauauggguaaagugaggaaagacauaccacaaugggaaccuucaaaaggguggaaugauuggcagcaagugcccuuuugcagucaccauuuucaucaacuuaucaugaaagaugguagagaaauuguggugccaugccgaaaucaagacgaauuagucgguagagcuagagugucccaaggagcuggauggucccugagagaaacugcaugccuuggaaaaucauacgcccagauguggcagcugauguauuuucacaggagagauuugcgauuagcugcaaaugccauauguagugcaguuccgguagacuggguacccacaagucggacaacuuggaguauucaugcacaccaccaauggaugacaacagaggauaugcuaucagucuggaaccgaguauggauagaagaaaauccuuggauggaagauaaaacgcauauauccucuuggggagauguuccauaucuaggaaaaagagaggaccaaugguguggcucacucauuggucuaacugcuagagcuaccugggcaacaaauauucaaguggcaauaaaucagguaagacggcuuauaggcaaugaaaauuauuuagauuauaugaccucaaugaaaagauucaaaaaugaaucagaucccgagggugcccuaugguaa

SEQ ID NO: 21866 - RNA, 9879 nt, Artificial Sequence
  derived and/or modified CDS sequence (opt6) from DENV-1__GU131797__SS-prME
uccgugacgauguuauugaugcucaugccuaccgcauuagcauuccacuugacgacgagaggaggggaaccucauaugauuguaucaaaacaagaaagagggaaauccuuacuguuuaaaacuucagcgggugugaauauguguacguuaauagcaauggacuugggagaacucugugaagacacgaugacuuacaaauguccaagaauuacugaaacugaaccagaugauguagacugcuggugcaacgccacagacacguggguuacuuaugguacguguagccaaacuggugaacaucggagggacaaacgguccguagcuuuagccccucauguaggucuagguuuagaaacacgaacggaaacguggaugagcagugagggagcuuggaaacaaauucaaaggguugaaacgugggcccuuaggcauccgggcuuuacgguaauagccuuauuucucgcucacgcuauagguacaucuauaacacaaaaagguauaauauucauccuauuaauguuagucacgccgucgauggcuaugcgaugcguaggaauugggucuagggauuucguggaaggucucagcggggccacuuggguugaugugguacuagaacacggauccugcgugacgacaauggcgaaagacaaaccaacgcuugauauugaacuauugaaaaccgaagugacuaauccagcaguacuacgaaaauuauguauagaagcaaaaaucuccaauacaaccacugauagccguugucccacucaaggcgaagcuacacuuguagaagaacaagacgcaaauuucguuugucgaagaacauuugucgaucgugguugggguaauggaugcggacuauuuggcaaaggauccuuaauuacaugugcaaaauucaaaugcguaacaaaacuugaggguaaaauaguccaauacgagaacuuaaaauauucggugauaguuacuguacauacgggugaucaacaucaaguaggaaaugaaagcacggaacaugguacaacugcaaccaucacaccacaagcaccaacuacugaaauacaauuaacagacuauggugcucuuaccuuggauuguucaccgcgaaccggauuagauuucaaugagaugguacucuuaacgaugaaagagaaaucgugguugguacacaaacaaugguuccuugacuugccccucccauggacuucgggagcuaguaccucucaagaaacuuggaauaggcaagacuugcuggucaccuuuaaaacagcacaugcaaagaagcaagaaguaguaguacuaggaucacaagaaggugcuaugcauaccgccuuaaccggggcaacagagauucaaaccagcggaacgacaacgauuuucgccggccaccuuaaauguagguuaaaaauggauaaauuaacuuuacgcgggaugaguuacgucaugugcaccggcagcuucaaacucgagaaagagguagcagaaacucaacacgggacaguccuaguucaaauaaaauacgaagguacugacgcaccauguaaaauaccauucucaacccaagaugagaaaggggugacgcaaaauggacggcuuaucacugcaaauccaauuguaacagacaaggaaaaaccugugaauauagaggcagaaccuccauucggagagucuuacauaguuaucggugcaggcgagaaagcucucaaacucucaugguucaagaaagggaguucaaucgguaaaauguucgaagcaacagcacguggcgcuagacgaauggcuauacuaggagacacugcaugggacuuuggcaguauaggugguguuuuuaccucaguggggaagcuaguacaucaaauuuucggaacagcuuauggggugcuauuuaguggaguaucuuggacaaugaaaauaggaauaggaguguuauuaacauggcuuggucuaaauucuagguccacaucauuauccaugacuuguauagccguaggccuaguuacauuauaucucggcguuaugguacaagcugacagcgggugugugauaaacuggaaagguagagaacuuaaaugcgggucagguauuuucguuacaaacgaaguacauacauggacagaacaauacaaauuccaagccgacagcccaaaacgauugagugcugcaauaggaaaagcaugggaagagggcguaugugggauucguagcgcuacucgauuagaaaauauuauguggaaacaaaucuccaacgaguuaaaucauauuuuacuagaaaaugacaugaaguuuacuguuguaguaggagauguagcugggauacuagcucaagggaaaaagaugauccgaccgcagccaauggaauacaaguacucauggaaaucuuggggcaaagcuaaaauaaucggagcagacguacaaaauaccacuuucaucauagacgguccgaauacaccggaguguccggaugaucaaagagcuuggaauauaugggaaguagaagauuacgguuuugguauauuuacaacaaauauauggcuaaaacuuagagacucauauacucaagucugugaucaccgacuuaugucagcagcaauaaaagacucgaaagcgguacaugcagacaugggauauuggauagaaagugagaaaaaugaaacuuggaaguuagcaagagccucauuuauagaaguaaaaacuugcauauggccaaaaucccauacguuguggagcaauggaguauuagaaucagaaaugauaauucccaagauauacggaggcccaaucagccaacacaauuaucgaccuggauauuucacacaaacugcaggucccuggcauuuaggaaaauuggaguuggacuuugauuuaugcgaagguacuacgguuguugucgaugaacacugcggaaauagaggacccaguuuaagaacaacaacuguaacaggaaaaauaauacacgaguggugcuguagaucuuguacuuuaccgccccucagauuucguggagaggauggcuguugguacggaauggagauucgcccagucaaggaaaaagaagaaaaccuuguuaaaucuaugguaucagcgggcaguggagagguagauucauuuucucucgguuuauugugcaucaguauaaugauagaagaaguaaugcgaucacgauggucacgaaaaauguugaugacuggaacacuggcugucuucuuucuucuaaucauggggcaacuaacuuggaaugaccuaauucguuuauguaucaugguuggcgcaaacgcgagcgacagaaugggaauggggacaacuuauuuggcguugauggcaaccuuuaaaaugcgaccuauguuugccgucggacuauuauucaggcgcuuaacgucaagggaaguccuuuuacuaaccaucggcuuaucauuaguagcgagcgucgaacuaccuaacucgcuagaggaacuaggugauggacuugcaauggguaucaugauauugaaacugcuaacggacuuccagucucaccaacugugggcgaccuuacuaagccugacauuuauaaaaacaacuuucucgcuacauugugccuggaaaacaauggcgauggucuugucuaucguuucuuuauucccgcuaugccugaguacgacaagucagaaaacuacaugguugccuguuuuacuaggaagucucggauguaaaccauugaccauguuccuaauagccgagaauaagauaugggggagacgaaguuggccgcuaaaugaggguauuauggcgguaggaauaguuucgauacuuuuaagcucuuuauugaaaaaugauguuccucuugcuggucccuuaauugcgggagggaugcucaucgcuuguuacguuauaucagguucguccgcagacuuaucucuugaaaaagccgcagaaguuuccugggaagaagaagcagaacacucuggcgcaagucacaacauccuuguagaggugcaggacgacgggacuaugaaaaucaaggacgaagaacgcgaugauaccuugacaaucuuauuaaaagcaacucucuuagccguuagugggguuuauccacuaaguauaccagcgaccuuauucguuugguacuucuggcagaagaagaaacaacggagcggaguccuaugggauacgccguccccaccugaaguagaaagagcaguucucgacgauggaauauacaggauaaugcaaaggggguuauuaggcaggucucaagugggcgugggggucuuucaagaaaauguuuuccacacuauguggcauguaacacgcggagcgguacucauguaccaagggaagagacuggagcccuccugggccagugugaagaaagaccugauaucauauggcggcggcuggagacuacaaggaaguuggaauacgggagaagaaguacaggugaucgcuguagagccaggcaaaaaccccaaaaauguacaaacugcacccgggacauuuaagacgcccgagggagaggugggggcuauugccuuggacuuuaaacccggaacaucggguaguccuaucguaaauagggaagggaaaauagugggcuuauaugggaaugguguuguaacaacauccggcacguauguaucagcaauugcucaagcaaaggcaucacaagaagggcccuuaccagaaauagaagaugaaguauuccgcaaaaggaaucuaaccauuauggaccuacaccccgggucgggcaaaacgagaagauaucuaccggcaauuguaagagaagcgauaaaaaggaaguugcggacacuaauacuggcacccacccgggucguugccucggaaauggcagaggcguuaaaaggaaugccuaucagauaucaaaccacagcagugaaaucagaacauacaggaaaagaaaucguagacuuaaugugucaugcaacuuuuacaaugagauuauuaucgcccguacguguaccaaauuauaauaugauaaucauggaugaagcccauuuuacagauccuagcucaauagcugcgaggggauacauuucgacaagaguaggcaugggggaggccgcugcaauauuuaugaccgcaacgcccccgggaaguguugaggcguuuccacaaucuaacgccguuauccaagaugaggaaagggauauucccgaacguaguuggaauagcggauaugaauggauaacugacuuucccggaaaaacaguuugguucguaccuucaauaaaaucaggaaacgacauagcuaauuguuugcguaagaauggaaaaaggguaauacaacuaucuagaaaaacuuucgauacagaguaccagaaaaccaaaaauaaugacugggauuacgucguaacaacagacauaucugaaaugggggcuaacuuucgagcagaucguguaaucgacccacgaaggugcuuaaaaccaguaauucugaaggauggaccagaaagaguuauccuagccggacccaugccaguaacaguugcuagugcggcacaacguaggggcagaauagguaggaaccauaauaaagagggugaucaauauauauacauggggcaaccacuuaacaaugaugaagaccaugcacauuggacagaagcaaaaauguuauuagauaacauuaauacaccugagggaauaauuccagcacuuuuugagccagaaagagaaaaaucggcagcuaucgacggugaguaucgauugcgcggugaagcccguaaaacauucguggaacuaaugcgaaggggugaucugcccgucuggcuaucauauaaaguugccucggaggguuuucaauauucggauagaagguggugcuucgacggagaaaggaauaaccaagugcuggaggagaauauggacguagaaauuuggacaaaagaaggagaaaggaagaaacuaaggccaagauggcuugaugccagaacauauucggacccucucgcguuacgugaauuuaaggaauuugcagcaggaagacgaucaguuuccggagacuuaauucuugagauagguaaacuuccacagcaccuuacacaaagggcacaaaaugcguuagacaacuuaguaaugcuacacaauagcgaacaaggagggcgagcauacaggcacgccauggaagaacugccagauacaaucgaaacucuaaugcuuuuagcauuaauagcuguauuaacaggagggguaacguuauucuuucuaagcggacguggguuaggcaaaacgucaauaggauuacuaugcguaauggcuucuagcguacuccuauggauggcaucgguagaaccccauuggauagcagcaaguaucauucuugaauuuuuccugaugguauuauugauaccugagcccgauaaacaaaggacaccccaagacaaccaacuagcauacguugucaucggauugcuguucaugauacugacuguagcugcuaaugaaaugggauugcuugagacuacuaagaaagaccuagggauaggacacguugccguugaaaaucaccaccaugcugcuaugcuggaugucgauuugcacccagccucggccuggacacuauaugcaguugcgacuaccauaauuacccccaugaugcgccauacgauagagaauacuacagcaaauauaucguuaacagcgaucgcuaaccaagcugcaauacugaugggacuggacaaaggguggccgaucucuaaaauggauauaggugucccauuacuugcguuaggcugcuauagccagguaaacccuuugacacuuacagcagccguucuaaugcugguagcgcacuacgcaauuauagguccuggcuuacaagcaaaagcaacaagggaagcgcagaaaagaacagcagcgggaauuaugaaaaaccccacgguugaugguauuguagcgaucgaccuugaucccguuguauaugacgcaaaauuugagaaacaacuaggccaaaucaugcuacuuauacugugcacgucucaaauauuacuuaugcgaacaacuugggcucuuugcgagagcauuacauuggcaacaggcccacuaacuacccuaugggagggaaguccgggaaaguucuggaauacaaccauugcagugucgauggcaaauauauuuagaggauccuauuuagcaggagcggggcuagcuuucuccuugaugaaaucauuagguggcggaaggcggggaacaggugcucagggugaaacucuaggagaaaaauggaaacgacaacuuaaucaauuaucaaaaucggaguuuaacaccuauaagcgaagcgggauaauggaaguugaucgaucugaagcaaaggaaggcuuaaaaagaggggagacuacgaaacaugccgugucacguggaacugccaaauuacggugguuugucgaaaggaaccuggucaaaccagaagggaaaguaauugauuuagguugugggagaggaggcuggagcuauuauugcgcagguuuaaagaaaguuacagaaguaaaaggauacacuaaagggggaccaggacaugaggaaccgauaccaauggcuacuuaugguuggaauuuaguuaaacuacacucaggaaaagacguauucuucauucccccugaaaaaugugacacacuccucugcgauauuggagaaucuaguccaaauccaaccauagaagaaggucgaacauuaagagucuugaaaaugguggaaccauggcuacguggcaaccaauucugcauuaagauccuuaauccuuauaugccuagcguaguagagacacuagagcaaaugcaaagaaaacauggagguaugcuaguaaggaaucccuuaucucggaauaguacgcacgaaauguauugggugaguuguggaacaggaaauauaguaucugcuguaaauaugacuagcagaauguuauugaauagauuuacuauggcucaccgaaaaccaacguaugaaagagaugucgauuuaggggcaggaacuaggcauguugccguggaaccagagguagcaaaucuagauauaaucgggcagcgcauagagaauauuaagcacgagcauaaaagcacuuggcauuacgacgaagauaacccguacaaaacaugggcguaccauggcagcuacgagguaaaacccucgggaagugcaucaucuaugguuaacggcgugguaaaacuuuugaccaaaccaugggacguuauaccuauggucacgcaaaucgcaaugaccgacacaacaccguucggacaacaaaggguauuuaaggaaaaaguagauacuaggacuccaaaggcaaaacgggguacugcacaaauuauggaaguaacugccaagugguuauggggauuuuuaucucguaacaagaaaccccgcauaugcacaagggaagaauuuacuagaaaaguacgaucgaacgcagcuauuggggcggucuucgucgaugaaaaucaguggaacucagcgaaagaagcaguagaagaugaacgguuuugggauuuaguacauagggagagagaacuccauaaacaagguaaaugugcuacaugcguuuacaauaugauggguaaaagggagaagaaauuaggagaauuuggcaaagcuaaaggaucccgagccaucugguauauguggcuaggagccagauucuuagaauuugaagcauuaggguucaugaacgaagaucauugguuuucacgggaaaauagucuuucagguguagaaggagagggauuacacaaacuuggauauauauugcgagauauaucaaagauuccaggcggaaacauguacgcagaugacacggccgguugggauacacgaauaacggaagacgaucuacaaaacgaagcgcguauaaccgauaucauggaaccagaacaugcacuacuagcuaaaaguauauuuaaauuaacguaccagaauaaagugguaaggguucaaagaccggcaaagaaugggacuguuauggacguaauuucacgaagagaucaacggggaucuggacaaguuggaacuuauggguuaaauaccuucaccaauauggaggcacaauuaauuaggcagauggaaucagaaggcauauuuucgccaucugaacuugaaaccccaaauuuagcagagagaguauuagauuggcucgaaaaauaugguguggagcgacuuaaacgaauggcaauaagcggcgacgauugugucgugaaacccauugaugauagauuugcaacagcucugacggcacugaacgauaugggaaaaguaagaaaagauauuccccaaugggaaccgucuaaagguuggaacgacuggcagcagguaccauuuuguucucaccauuuucaucagcucauuaugaaagacggacgggaaauaguuguaccaugcagaaaccaggaugaauuaguaggacgagcacgcguaagccaaggagccgguuggagucuuagagaaacggcuugccuggggaagucguacgcacaaauguggcaauugauguacuuucaucgaagggaucuucgucuagccgccaacgcuauaugcagcgcggugccagucgauuggauuccaacaaguagaacuacuuggagcauacacgcgcaucaucaauggaugaccacugaagauauguuaucgguauggaauagaguauggauagaagagaaccccuggauggaagauaaaacucacauuucuucauggggcgauguuccauacuuaggaaagcgugaggaucaauggugcggaucucuuauaggauuaacagcuagagcaacuugggcuacuaacauacaaguggcaauuaaucagguucgacgucuaaucggaaacgaaaauuauuuagacuauaugacuuccaugaagagauucaaaaaugaaucugacccagagggggcauuaugguga

SEQ ID NO: 21867 - RNA, 9879 nt, Artificial Sequence
  derived and/or modified CDS sequence (opt6) from DENV-1__GU131801__SS-prME
uccguaacuaugcuucuuaugcuuaugccaacugccuuagcauuccaccuaaccacgcgcgggggugaaccucacaugauuguuaguaaacaagaaagagguaaauccuuacucuuuaaaacaagcgcugguguaaacaugugcacccugauugcaauggaccuaggagaauuaugugaagacacuaugacauauaaaugcccacggauaaccgaagcagaaccagaugauguagacuguugguguaaugccacagauacauggguaaccuaugguacaugcagccaaacaggagaacaucgaagagagaaaaggucgguugcacuagcaccgcacguggggcuaggacuugaaacaaggaccgagacauggaugaguagugaaggcgccuggaaacaaauucaacgaguugaaacaugggcacuacggcacccaggauuuacagugauagcauuauuucucgcucaugcaauugggacgucuauaacacaaaaagggauuauauuuauauuguuaauguuaguaacucccaguauggcuaugcgaugcgucgggauaggaucgagggauuucgucgaaggccuguccggcgcaaccuggguagauguagucuuagaacacggaaguuguguaaccacaauggcaaaagacaaaccaacccuugauauugaacuucuaaaaaccgaaguaaccaauccugccguauugcguaaguuaugcauugaagcaaaaauaagcaacacuacaacugacagucgcuguccaacucaaggugaagcuacgcuuguagaagaacaagaugccaauuuugucugcagaagaacguucgucgaucgaggaugggggaacggcugugggcuguuuggcaaggggucauuauugacgugcgccaaauuuaaauguguaacaaaauuagaagguaaaauuguacaauaugagaauuuaaaauauucaguaauuguaacagugcauacaggagaccaacaucaaguuggaaacgaaucgacugaacauggaacaacagccacaauuacaccccaagcaccgacaacugaaauucagcuuacggauuauggugcuuuaaccuuggacuguucuccacgaacaggucuagauuuuaaugaaaugguucuacuaacuaugaaagagaaaaguuggcuaguacacaaacaaugguuuuuagacuuaccauugccguggacuucuggggcaaguacaagccaagaaacguggaauagacaagaucuucugguaacuuuuaaaaccgcacaugcuaagaaacaagaaguaguaguccuaggaucacaagaaggugccaugcauacugcacuaacuggugccacagaaauacagaccucagguacaacaacuauauuugcagggcauuuaaaaugcagacucaaaauggacaaguugacuuuaaaagggaugucauacguaauguguaccgggagcuuuaaacuagaaaaagaggucgcugaaacccagcacgggacaguauuaguucagauuaaauaugaaggaaccgaugcuccaugcaaaauccccuuuucuacucaagaugaaaaaggcguaacccaaaauggcaggcuaauuacagcaaauccaauaguaacggacaaagaaaaaccgguuaauauagaagccgaaccgcccuuuggcgaaagcuacauugguauuggagcgggagaaaaagcacucaaauuaucuugggucaagaagggaagcucaauaggcaagaugguugaagcaacggccaggggugcuaggaggauggcuauucuaggugacacggccugggacuuuggaucuauaggcggaguauuuaccucuguagguaaauuagugcaucagaucuuugggacggcuuauggaguucucuuuucugguguaagcuggacgaugaagauugguauugguguauuauugaccugguuaggcuuaaacaguaggucuaccucacucucuaugacuuguauagcaguaggacucguuacacuauaucuaggcguuaugguacaagcagauagcggcugcguuaucaauuggaaaggaagggaauugaaguguggaagugguauauucguuacaaaugaggugcauacguggaccgaacaauacaaauuucaagcggacucucccaaacgguugagugcagcaauaggcaaggcaugggaagaaggaguaugcggaauccgaucagcuacaagauuagaaaauaucauguggaaacagauaagcaaugaacuaaaccacauucuuuuagaaaacgauaugaaauuuacgguagugguaggcgacguggcagggaucuugguucaaggcaagaaaaugauacgaccucaaccuauggaauacaaguauucuuggaagucuuggggaaaagccaaaauaauuggagcagauguucagaacaguacauucauuaucgauggcccaaauacaccugaauguccggaugaucagagagcguggaauauaugggaaguugaggauuauggauucgguauauucacaacuaauaucuggcuuaaacuuagggauucauauacacaaguaugcgaucauagauuaaugagugcugcaauaaaggacucaaaagcaguccaugcugacaugggguauuggaucgaaucagagaaaaaugagacuuggaaauuagcaagggcuucguuuauugaagugaaaacauguauauggccaaagagucacacacucuggaguaaugguguuuuggaaagcgaaaugauaauuccgaaaauacauggcggaccaaucucucaacauaauuaucgcccaggcuacuucacacagacagcuggaccauggcaucuugggaaacuagaacucgacuucgauuugugugaaggaacuacggugguaguugaugagcauuguggaaaccgaggucccagucuucgaacgacaacagugacugggaaaauaauacaugaauggugcuguagaaguuguacacucccacccuuaagauuccggggagaagauggcugcugguaugguauggaaauacgcccuguaaaagagaaagaagaaaaucuagugaaguccauggucuccgcuggcaguggagaaguagacuccuuuagucuaggauuacucugcauaagcauaaugauagaagaagugaugcggucuagauggaguaggaagaugcuuaugacgggaaccuuggcgguauucuuucuuuugauuaugggccaacuuaccuggaaugaucucauacgacuaugcauaauggugggcgcuaaugcuucugauagaaugggcauggggaccacauaucucgcauuaauggcuacauuuaaaaugagaccaauguuugcgguagggcugcuguuucgucggcucaccagcagagagguacuacuauuaacuauuggauugucuuugguagcuaguguugaacucccaaauagcuuggaagaacuuggugauggauuagcgauggguauaaugauauuaaaauuauuaacugacuuccaaucauaucagcuaugggcgacacuauugucauuaacguucaucaaaaccaccuucaguuuacacuaugcauggaagacuauggcuaugguguuaucaauuguaucucuauucccuuuauguuugaguacaacaucccagaaaacuacaugguuacccguacuauuagguucacuuggaugcaaacccuugacuauguucuuaauugcugaaaauaaaaucuggggacguaaaucauggccauuaaacgaggguaucauggcaguagguaucguuucuauucuuuuaagcucccuauugaaaaaugauguacccuuagcaggcccguuaauagcgggugggauguuaauugcaugcuauguuauuaguggaucgucugcggauuugucacuugaaaaagcugcagaagugucaugggaggaagaagcagaacauucuggcgccagccauaacauccuaguugagguucaagaugaugggacaaugaagaucaaagaugaagaaagagaugauacccuuacaauacuccuuaaagcaacauuguuagccguuucaggaguuuauccguuaucaauuccagccacacuauuuguauggcauuucuggcaaaagaagaaacagcgaagcgggguacuuugggauaccccaucuccuccggaaguugaaagggcuguauuagaugacgguauuuacaggauaaugcagagaggauuguuaggccgaagccaaguaggaguuggugucuuccaggaaaauguuuuucauacaauguggcaugugacacgaggagcaguguuaauguaucaagguaagcgcuuagaaccuucuugggcaaguguaaagaaggauuuaauaucauauggcgguggauggcgauuucagggcucauggaacacaggggaagaaguacaggugauugcagucgagccagguaaaaaccccaaaaacguacagacggcacccgguacauuuaaaacaccggaaggagaaguaggagcaauugccuuggauuuuaagccagguacaagugguagcccaaucguaaacagagaagggaaaauuguaggucucuauggcaauggggucguaacuacaaguggcacguacguauccgcaauugcucaggcgaaagcaagucaagaggguccauuaccagaaauugaagacgaaguuuucaggaaaaggaacuuaacgaucauggacuuacacccuggaagcggcaaaacgcgaagauaccuaccagcuauaguaagagaagcaaucaaaagaaaacuaagaacauugauccuagccccaacaagaguuguggccagugaaauggcagaggcacuaaaaggcaugcccauaagauaccaaaccaccgccgucaaaucagaacauacaggaaaggaaauuguagauuuaaugugucaugcuacguuuaccaugcgcuuauuaucaccuguaagaguaccuaacuacaacaugaucauuauggacgaggcucauuuuaccgacccuucaaguauagccgcccguggauacauaucuacucggguaggaaugggcgaggcggcagcaauuuucaugacagcgacaccaccaggaaguauggaggcauucccccaaaguaacgcagucauucaagaugaggagagggauaucccagaaagaagcuggaacaguggauacgaauggauaacugauuuuccggguaagacuguaugguuuguuccaucuaucaaagcggguaaugauaucgcaaauugccuacggaaaaaugguaaaagagugauccaacuaucucggaaaacuuuugauacagaauaucagaaaacuaagaacaacgauugggacuauguaguaacgacagauaucagcgaaaugggugcaaauuuccgagcugaucgcguuauugacccaagaaggugcuugaaacccguuauacuuaaagacgguccagaacgaguaauacuugcugggccgaugccgguuacaguagcaagugcagcacaacgaagaggccguauuggacgaaaucacaauaaagaaggagaucaguacauuuacaugggucagccacugaauaacgaugaggaccaugcgcauuggacugaggcgaagaugcuucucgauaacaucaauacaccagaagguaucauaccggcguuauuugaaccagaacgcgaaaagucagcagcgauagauggugaauauagguugcgaggagaagccagaaaaacguucguggaacuuaugagaagaggagauuuaccuguaugguugucauacaaaguagcgucggaaggcuuucaauacucggacagacgcuggugcuucgacggagaaaggaacaaucagguccucgaagaaaacauggauguugaaauauggacaaaagaaggagagcggaagaaauuacgaccaagaugguuagacgcgagaacuuacucagauccguuagcacuacgugaauuuaaagaauuugcagcggguagaaggaguguuaguggagaucucauccucgaaaucggaaaacugccacaacacuuaacucagcgugcucaaaaugcucuggauaaucuagucauguugcacaauucggaacaagguggcagagcauaucgccaugccauggaagaacuuccagauacaauagaaacauuaaugcuauuagcucuuaucgccguacugaccggcggcguaaccuuguuuuuccuaucgggcaaagggcuaggcaaaacuagcaucggauuauugugcgucauggcauccucaguucuacuauggauggcaagcgucgagccacacuggauagcggcaaguauuauacuagaguucuuccugaugguauuacuuauaccggaaccugauaggcaaaggacaccacaagauaaucaauuggcguacguggugaucggacuuuuauucaugaucuuaacgguagcagcaaacgaaaugggacuucucgagacaacgaaaaaggaucuggguaucggacacguggccgucgaaaaucaccaccaugccgcaauguuagaugucgauuuacacccugcaagcgcuuggacuuuauaugcugucgccacgacuaucaucacgccgaugaugaggcacacaauagaaaacacuaccgcgaacaucagucuaacagcaaucgcaaaucaagccgcaauauugaugggguuagauaagggauggccaauaucgaaaauggauauaggaguuccuuuauuagcucuugguugcuauagucagguuaauccacugacacucacagcagcaguuuuaauguuaguugcccauuacgcaaucauaggccccggccuacaagcaaaagcaacaagagaagcucagaagagaacugcagcaggaauaaugaaaaacccgacuaucgacgguauagucgcgaucgauuuagauccagucgucuacgaugcaaaauuugaaaagcaacucggccaaauaauguuguuaauauuaugcacaucgcagauauuauugaugcguacuacuugggcuuuaugcgaguccaucacacuggcaacugggccacuaacaaccuuaugggaaggcaguccuggaaaauuuuggaacaccaccauagcaguaagcauggccaauaucuucagaggaucauauuuagcaggagcgggucucgcuuuuucuuuaaugaaaagccuaggaggggguagacgcggaacuggcgcgcaaggggaaacacucggugaaaaguggaagcgccaacuuaaccaauuaagcaagagugaguucaacacuuacaaaagaagcgggauaauggagguagacaggagugaagccaaagaaggauuaaaaagaggggagaccacgaaacaugcaguaucaagaggaacugccaaacuuagaugguuuguggaaaggaaccuaguaaaaccagaagguaagguuauagauuugggguguggaaggggcggcugguccuauuacugugcuggauuaaagaagguuaccgaaguaaaaggguauacaaaaggaggacccgggcacgaagaaccaauuccaauggcuacauacggguggaaccuaguaaaauuacauaguggaaaagauguguucuuuauucccccugaaaaaugugacacucuguuaugcgacauaggugaaaguuccccuaacccuacaauagaagaaggcagaacacugagagucuuaaaaaugguggaaccuugguuaagaggcaaucaauuuugcauuaaaauucugaauccuuauaugccgucuguaguagaaacgcuugaacaaaugcaaagaaaacacggcggaauguuaguucguaacccgcugucucgcaauaguacccacgagauguauuggguuaguugcgguaccggaaacauagucagugcugugaauaugacaagucggauguuacuaaauagauuuacaauggcucaucguaaaccaacauacgagagggacguagaucuaggagcugguacaagacauguggccguugaaccugaggucgcuaaccuagauauuauagggcaacguauugagaauauuaagcacgaacacaagagcacuuggcacuaugaugaagacaauccauauaaaacaugggcauaucauggaucauaugaaguuaaaccguccgguagugcuucuaguauggucaaugguguggucaaauuauugaccaaaccaugggacguaauuccaaugguuacacaaauugcaaugacugauacgacgcccuuuggacaacaacgcguauucaaagaaaaagucgauacucgaacuccaaaagccaagcgugguacugcgcaaaucauggaggugacagcacgaugguuauggggguuuuugucgcgcaauaagaaaccucgaauauguacacgcgaggaguucacaagaaagguaagaagcaaugcagcaauuggagcaguuuucguugaugagaaucaauggaacagugccaaggaagcugucgaagacgaucgauuuugggacuuaguacauagagaaagagaguugcacaaacaggguaaaugcgcaacauguguguauaauaugaugggaaaacgagaaaagaaacucggagaguucgggaaagcaaagggcucucgagcaauaugguauauguggcuuggcgcuagauuuuuagaguuugaggcguuaggauuuaugaaugaggaucauugguucagccgagaaaacucuuugaguggagucgagggugaggguuuacauaaguuaggauacaucuuaagggacauaagcaaaauucccggagguaacauguaugcagaugacacugccgguugggauacuagaauaacugaagaugauuuacagaaugaagcgaagaucacagacauaauggaaccugaacacgcauugcuugcgaaaucuaucuucaaauugacauaucaaaauaaagucguuagggugcagagacccgcuaagaacgggaccguaauggacguaauaucuagacgugaucaaagaggaucaggucaaguugguacuuaugggcuuaauacuuuuaccaauauggaagcccagcuaaucagacaaauggaaucagaaggaauuuuccuccccaaugaauuagaaaccccgaaucuagccgggaggguuuuagauuggcuagaaaaauacggaguagaacgacucaaaaggauggccauaaguggcgaugauuguguggucaaaccaauugaugaucgauuugcuacggcacuaacugcucuuaacgacauggguaagguaagaaaagauauaccacaaugggaaccuagcaaaggguggaacgauuggcagcaaguuccuuuuuguagccaucauuuucaccaacuaauuaugaaggacgggcgugaaauaguaguaccaugccgaaaucaggaugagcuaguuggucgagcaagaguuucacagggugcaggcuggucauuacgcgagaccgcauguuuaggaaaaucauaugcacaaauguggcaauuaauguacuuucaucgucgagaucugcgauuagcugcuaacgcuauauguucggcaguaccuguugacuggguacccacaagcaggacuacauggucgauccaugcgcaucaucaauggaugacgacagaagauaugcuaagugucuggaauagaguuuggauagaagaaaauccuuggauggaagauaaaacacgcauaaguuccugggaagaugugccauaccugggaaaaagagaagaucaaugguguggaucacucauaggucuaacagcacgagcgacgugggcaacaaauauucagguagcgauaaaccaggugcgaagacuaauaggcaaugaaaacuacucagacuauaugacuuccaugaaaagauuuaaaaacgagagugaacccgaaggagcguugugguga

SEQ ID NO: 21868 - RNA, 9879 nt, Artificial Sequence
  derived and/or modified CDS sequence (opt6) from DENV-1__GU131804__SS-prME
ucagucacaauguuuuuaaugcuuaugccaaccgcguuagcauuucauuugacuacacgaggaggggaaccacauaugaucguaaguaaacaagaacggggaaagaguuuacuauucaaaacuagugcaggcguaaauauguguaccuuaauugcaauggaccuuggagaacuaugcgaggacacgaugacauauaaauguccaagaauuacagaaacagaaccagaugacguagacuguugguguaaugccacugacacaugggugacauauggcacuuguagccaaaccggagaacauagaagagauaaaagaaguguugcacuggcaccucacguuggccuagggcuagaaacacgaacagaaacguggaugagcucggaaggugcauggaaacagauccaacgaguagaaacgugggcacugcggcauccuggcuuuacaguuauagcauuauucuuagcucaugcgauagguacaaguauaacacaaaaaggaaucaucuuuauuuuacucaugcuaguaacgccauccauggcaaugagaugcguggguauuggcucaagagacuuuguugaaggacucucuggagccacauggguggacguuguguuagagcauggaucgugcguaacaacuauggcuaaagacaagccuacuuuagauaucgaacuauuaaaaacagaagucacaaauccagcaguuuuaaggaaacuaugcauagaagcaaaaaucaguaacacgacaacagauagcaggugcccaacacaaggggaggccacuuuaguggaagagcaggaugcaaacuucguuugcagacgcacauuuguugacaggggauggggaaaugggugugguuuguuugguaaagggucacuaauaacaugugcaaaauuuaaauguguuacuaaacuugaaggcaaaauaguacaauaugaaaauuuaaaguauagcgugauagugacaguucauacuggagaucaacaccaaguugggaaugagaguacagaacauggcacgacggcaacgauaaccccucaagcuccuacaacugagauucaacuaaccgauuacggagcauugacuuuggauuguaguccaaggacgggacuggauuuuaaugagaugguacuacuaacaaugaaggaaaaaagcuggcuaguucauaaacaaugguuccucgaccuccccuuaccauggacaagcggcgcuaguacgagucaggagacuuggaacaggcaggaucuacucguaacauucaagacggcgcaugcuaaaaaacaggagguuguuguauugggcucgcaggaaggagcaaugcacaccgcguuaacaggagcaacugagauucaaaccucagguaccacaacgauauucgcuggucacuugaaaugucgguuaaaaauggauaaguuaacuuuaaaaggcaugucauacguaauguguacugguagcuuuaaguuagagaaagaauuagccgaaacacaacauggaacuguuuuaguucagauaaaguacgaggguacagaugcuccaugcaaaauucccuucagcacacaagacgaaaaaggaguuacacaaaacggcagacugaucaccgcuaauccuaucgugacggacaaggaaaaaccggugaacauagaagcugagcccccuuuuggugaaaguuacauagugauaggagcuggcgaaaaagcgcuaaaauuaagcugguucaagaaagguagcaguaucggaaagauguuugaagccaccgcccggggcgcucgcaggauggcgauacuuggagauacugcaugggauuucgggagcaucggcggcgucuucacaagcgucggaaaauugguccaccaaauauuugguacagcauauggaguucuuuuuucagggguauccuggacuaugaaaaucgguaucggaguucuauuaacaugguuaggacuaaacucgcgaucgaccucauugucaaugacauguauugcuguuggacucgugacuuuauaccugggggucaugguacaggcggauaguggauguguaauuaauuggaaaggaagagaacuaaagugugguagcggaauauuuguuacaaacgaaguucauacuuggacggaacaauauaaauuccaggcagacaguccgaagagauuguccgcagccauugggaaagcaugggaagagggcgugugugggauacgaagugcaaccagauuggaaaauauaauguggaaacaaauaucaaaugaauuaaaccauauacuuuuggagaaugacaugaaauuuacugucgugguuggagauguagcuggaauacucgcccaagguaagaagaugauuagaccucagccaauggaguauaaguauucuuggaaaucgugggggaaggcgaaaaucaucggggcugauguucaaaauacuacuuuuauaaucgauggccccaauacuccggaaugcccagaugaucagcgagccuggaacauuugggaaguagaggauuacggguuuggaaucuuuacaacaaacauaugguuaaaacuccgagauuccuacacacaagugugugaucacagguuaaugagugcugcaauaaaggauucuaaggcagugcaugcugauauggguuacuggauagaaucugagaaaaaugagacauggaagcuugcacgagcaucuuuuauugaaguuaaaacaugcauauggcccaaaucucacacacuauggaguaacgguguuuuagaaucagaaaugauaauucccaagaucuauggagguccuauaucacaacauaauuaucgaccgggauauuuuacccaaaccgccgggccuuggcacuuaggaaaacuugaauuggauuuugacuuaugugaaggcacaacaguagucguagacgaacacugcgggaacagaggcccuucgcuaagaaccaccacuguuacugggaagauaauacaugaguggugcuguagaaguugcacguuaccaccucucagauuuagaggugaagaugguugcugguauggcauggaaaucaggccaguuaaagaaaaggaagagaauuuaguuaagucuaugguaucagcgggaucgggagagguagacagcuucagccuaggccuacuguguauaucaauaaugauugaggaaguaaugagaucaagguggucaagaaagaugcucaugaccggaaccuuagcuguguuuuuucuuuuaaucaugggccaguuaacauggaacgaucuaauaagguuauguauuaugguaggagcaaaugcaucagacagaauggguauggggacgaccuaccuugccuuaauggcaacuuucaaaaugagaccaauguucgcgguuggauuauuauuucgaaggcuaacaagucgcgaaguccuacuuuugacgauaggacugucacucguagcaagcguagaacuaccaaauagucuggaagaacucggugacgguuuagcaauggggauuaugaucuuaaaacuacuaacagauuuccaaucccaucaacuuugggcgacgcugcuaagcuuaacauuuauuaagaccacauuuucauugcauuacgcguggaaaacuauggcuaugguuuuaucaauaguaucccuuuuuccacugugcuugaguacuaccucacaaaagacaacuugguuaccgguucuacugggaagucuuggaugcaaaccccucacuauguucuugauagcagaaaauaaaaucuggggaaggcgaucuuggccucuaaaugaaggcauaauggcaguagggauugugucuauauuacuuaguucguuacuaaaaaaugauguaccguuagcugggccacuaauugcgggugguauguuaauagcaugcuaugucauaaguggaagcagugcggauuugucacuugaaaaggcagcagaagucaguugggaagaagaggcugaacauucgggggcaagucauaauauucucguugagguacaagaugacgguacuaugaagauuaaagaugaagaaagagaugauacauugacaauccuguuaaaggcaacauuauuagcaguuaguggaguauauccucuauccauaccagcaacauuauuuguaugguacuuuuggcagaagaaaaagcaaagaagcggcguccugugggauaccccguccccaccggaaguugaaagggccguauuagacgauggaauuuaucguaucaugcaacgaggacuguuagggagaagccaagucggaguaggaguauuucaggaaaauguuuuccauaccauguggcauguuacacgaggagccguacuaauguaccaaggcaaaaggcuugagccaaguugggccagugucaagaaagauuuaaucucuuaugggggagguuggcgacuacaaggaagcuggaacacaggugaggaagugcaaguaauagcuguugaaccuggaaaaaacccaaaaaauguacagacagcgccaggaacauuuaagacaccugaaggagagguaggggcaauugcuuuagauuuuaagcccggaacuagcggaaguccaauaguuaaccgggagggaaaaauaguaggacuuuacggaaauggaguagugaccacaucuggaacguacgugucggcuauagcccaagcaagagcgagccaagaagggccuuuaccagaaauagaagaugaaguauuucgaaaacgaaauuugacaauaauggacuuacauccaggaagcggaaagacgcgcagauacuuaccagcgauugucagagaggcaauaaaaagaaaauugagaacguuaauacuagcuccaacaagagugguugcaagugaaauggcggaagcauugaaaggaaugccaauacgauaucagacuacagcaguuaagagugagcauacagggaaggaaaucguugacuugaugugucaugcaaccuuuaccaugagacuauuaucaccaguucgggugccaaauuauaauaugauuauaauggacgaagcacacuucacggacccuucaucaauugcagcuagagguuacauuuccacgcgaguagguaugggggaagcagccgcgauauuuaugacugcaacccccccaggcagcguugaggcuuuuccucaaaguaaugcagugauacaagacgaagagagggacauaccagaaaggaguuggaauuccggauaugaauggauaacagauuucccuggaaaaacuguuugguucguacccuccauuaaaucuggaaaugacaucgcuaacugucuacgcaaaaaugggaagagaguaauucagcuaucacgcaaaacauucgauacagaauaccaaaaaacuaaaaacaaugauugggacuauguuguuaccacugacauaucugagaugggggccaauuuucgagcugaccgaguaauugauccacgacgaugucugaaaccuguuauacucaaagauggcccugaacguguuauuuuagcagggccgaugccgguaacaguagcuagugcugcacaacgccgaggaagaaucggccguaaucauaauaaagaaggugaccaauauauauauaugggccagccucucaauaacgaugaagaucacgcccauuggacagaagcuaagaugcucuuagauaauauaaauaccccggaaggcauaauaccagcacuuuuugagccagaaagagaaaaaagcgcagcaauagauggagaauacaggcucagaggagaagcacguaaaaccuucguagaauugaugagaagaggagaucucccuguauggcucucauacaaggucgcgucagaaggauuucaauauagugacaggcguuggugcuucgacggagaacgaaauaaucagguucuagaggagaacauggauguagagauauggacaaaggaaggggaaagaaaaaaauuaagaccucggugguuagaugcaaggaccuacucagauccuuuagcccugcgugaauucaaagaauuugcugccggacgucggaguguuucaggugaucucauacuagagauuggcaagcuaccacaacacuuaacacaaagagcccaaaacgcauuagacaaccuaguaauguuacauaacagugagcaaggaggcagggcauauagacacgcgauggaagaauugccagauacaauugaaaccuugaugcuacuagcacuaauugcaguauugacaggcggaguaacgcuguuuuuccucagcggacgaggcuuagggaaaacaaguauuggacuguuauguguaauggcuucuucagugcuauuguggauggcaaguguugaaccacacuggaucgcugcaucaauaauccuagaauucuuccuaaugguguuauuaaucccagaaccagauagacagaggaccccucaggacaaccaacuagcauacguuguuauaggauuacuuuuuaugauuuuaacuguugcagcaaaugaaauggggcuacuagaaaccacgaagaaagaucuuggaauaggccaugccgcuguugagaaucaucaucacgcagcaauguuggacguagacuugcacccagcgucugcuuggacacuguaugcaguugcaacaacaauaaucacaccaaugaugagacacaccauagaaaacacaacggcaaacauaagucugacagcgauugcgaaccaagcggcgauacuuaugggcuuggacaagggauggccaaucucuaaaauggauauugguguaccauuacucgcacuugguuguuauucgcaaguaaacccacuuacccuaaccgcugcgguuuuaauguuaguugcucauuaugcgaucauagguccugggcuacaagcaaaagcaacuagggaagcccagaaaaggacagcggcaggaaucaugaaaaaucccacaguugauggaauaguagcgauagaccuggauccaguaguauaugaugcuaaauuugaaaaacaacuaggacagauuaugcuucuaauauuaugcacaucacaaauacuacugaugcgaacaacaugggcuuuaugugaaagcauaacccucgcgacuggacccuuaacuacauuaugggaagguagccccgggaaguucuggaacacgacuauugcuguaucuauggcaaacauuuuuagaggaucuuacuuagccggggcaggguuggcuuuuaguuugaugaagaguuugggaggaggccgucgugguacaggcgcacaaggggaaacauuaggcgaaaaauggaagagacagcugaaccaauuaagcaaaagcgaauuuaacacauauaaaaggucggguauuauggaaguagacagaucagaagcuaaagaaggacuuaaaagaggagagaccacuaagcaugcaguuucuagagggacagcaaaacucagaugguuuguagagcguaauuuaguuaagcccgaaggaaaagugauugacuuaggcugcgguaggggaggaugguccuauuacugugcugggcuuaagaaagucacggaagugaaaggauacacaaaagguggaccgggccacgaagagccaauuccgauggcuaccuacggauggaauuuaguuaaacugcauucggggaaagacguauuuuuuauuccaccggaaaagugugacaccuugcucugugacauaggggaaucauccccaaacccaaccauagaggagggacguacacuacgagugcuaaaaaugguugaaccguggcuaagggguaaucaauuuuguauaaaaauauuaaacccauauaugccuucgguagucgagacauuagaacagaugcagaggaagcaugguggaauguuggugagaaauccgcuaucaagaaauagcacucaugagauguacuggguaucauguggcacaggaaauauaguuucggcagucaauaugacuucacgaaugcuguugaaccgcuuuacuauggcacaccgcaaaccuacauaugaacgagauguagaccuaggagcaggaacacgccauguagcaguagaacccgaaguggcaaauauagacauaauaggacaaagaauagaaaacauuaaacacgagcauaaguccacuuggcauuaugacgaagauaauccguacaaaaccugggccuaccauggaucauaugaagucaaaccaucagguagcgcuucaaguaugguuaaugguguuguaaagcuacuaacuaagccuugggauguaauuccuaugguaacacagauugcuaugacugauaccacgccguuuggacaacaaagaguuuuuaaagaaaaaguggacacacguacaccgaaagcgaaaagaggcacugcccaaauaauggaaguaacggcaaaauggcuauggggcuuucuaucgcguaacaaaaagccaagaauauguacgagagaagaauucacacgcaaaguacguucaaaugcagcaauuggagcaguauucguugaugaaaaucaauggaauucagcaaaggaggcugucgaggaugaaagguuuugggaucucguacauagagaaagagaauuacacaaacaaggaaagugugcuaccuguguuuacaacaugaugggaaagagggaaaaaaaauugggugaguucggaaaagccaaagguaguagggcaauaugguauauguggcuaggugcacgauuucucgaguucgaagcauuaggauuuaugaaugaagaccacugguucaguagggagaacucccuaucggggguagaaggggaaggguugcacaaacuagguuacauacuacgcgacauaucuaaaauuccagguggaaacauguaugcagaugacacugcggguugggacacgcgcauaacagaagaugaccuucaaaacgaagcacgcaucacagacauuauggaaccagagcacgcccuccuagcaaaaagcaucuuuaaauugacuuaccaaaauaaagugguccgaguacaacgcccagcaaagaacgggacuguaauggacguuaucuccaggagggaccaaaggggaucgggccaaguugguaccuauggucuaaacacauuuacgaauauggaagcucaguugauacgucaaauggaaagcgaaggaauuuucaguccaagugaguuggaaacacccaaucuagcagagcgaguauuagacugguuagaaaaguacgggguugagagguuaaagaggauggcuauuuccggagaugauugugucgugaaaccuaucgaugaucgauuugcaacagcauuaacugcucuuaaugacaugggaaaagugagaaaggacaucccacaaugggagccaucaaaaggauggaacgauuggcaacagguuccguucugcagucaucauuuucaccaauugaucaugaaggacgggagagaaauuguuguaccgugccgaaaccaggaugaauuaguaggaagagcacggguaagucaaggggcaggauggagucuaagggaaacagcuugcuuaggaaaaaguuaugcccagauguggcagcugauguauuuucaucggcgagaucuucguuuagcugcaaaugccaucugcagcgcagucccuguggauuggauaccuacaaguaggacuacauggucgauacaugcucaucaccaguggaugaccaccgaagauaugcuaagcguguggaacagaguuuggauugaagaaaacccauggauggaggauaaaacccacauaagcucauggggugauguaccauaucucgggaaaagagaagaucaauggugcggaucuuuaauugguuuaacagcgagagccacaugggccacaaacauucagguugcaaucaaucaagugcggcgauuaaucgguaacgaaaacuaccuggacuacaugacgucgaugaagagguucaaaaaugaaagugauccagagggugcucuaugguaa

SEQ ID NO: 21869 - RNA, 9879 nt, Artificial Sequence
  derived and/or modified CDS sequence (opt6) from DENV-1__GU131805__SS-prME
agugucacaaugcuauuaaugcuuaugccaacagcucucgcauuucaucucacgacucgaggaggggaaccgcauaugaucgugaguaaacaagagcggggaaagagucuacuuuuuaaaaccagugccggggucaauauguguaccuugaucgcaauggaccuaggagaauuuugugaagacacaaugacauacaagugcccaagaauuacggaagccgagccagacgauguagauugcugguguaaugcuacugacaccuggguaacauacgggacaugcagucaaacaggugaacaucgucgggauaaaagaagcguagcuuuagcuccucacguuggacugggauuggagacacggacagagacauggaugucaagcgaaggugcuuggaaacaaauccaaagagucgaaacaugggcuuuaaggcauccaggauuuacagucauugcacuauuuuuagcgcaugccauuggaacuucaauaacucaaaaaggaauaauuuuuauacugcuuaugcuaguaacgccaagcauggcaaugagaugcguaggaauaggaucgagggauuuuguugaaggacuaucuggagcaacguggguagacgucguacuugagcaugggucaugcguaacaacuauggccaaagauaaaccaacccuugauauugaacuauuaaaaaccgaaguaacugacccagcgguauuaagaaaacuuugcauagaagcgaaaaucagcaauacaacaacagacucccgaugcccuacccagggagaagccacauuagucgaagaacaagaugcaaauuucguaugcagaagaacuuuuguagauaggggauggggcaauggauguggucucuucggaaaagguagccuuaugacaugugcuaaauucaaauguguaaccaaauuggaaggaaaaauagugcaauacgaaaaucugaaauauuccgugauuguaacagugcauacuggcgaccaacaucaggugggaaaugaaucaacggagcauggaaccaccgcuacaauaacaccacaagcacccucuccagagauccaguugccagauuauggagcgcuuacucucgacuguucgccaagaccuggauuagauuucaaugaaauggugcuacuaccuaugaaagaaaaaucuugguugguucauaaacaaugguucuuggacuuacccuuaccguggacaucaggggcaucaacuucacaagaaacauggaaucguaaagaucuauugggaaccuuuaaaacagcucaugcuaaagaacaagaaguuguagugcuaggaagucaagagggagcaaugcauacagcauuaacuggcgcaacugagauccaaacuucagguacaacaacaauuuuugcaggucaccucaaaugcagguuaaaaauggauaaauugacacuuaaagggaugucauauguaauguguacaggcucauuuaagcuggaaaaagaaguugcagaaacgcaacauggaacaguauuagugcaaaucaaauacgaagguacagaugccccauguaagauccccuuuuccacucaagacgaaaaaggcgucacacagaauggaagacuaaucacagcuaauccuauagucacggacaaggaaaaaccuguaaacauagaagcagaaccggccuuuggagagucuuacaucguaaucggggcgggcgaaaaagcacuaaaacuaucguggguuaagaaagguagcucaauagggaaaauguucgaagcaaccgcuagaggugcccgaagaauggccauucugggggacacagccugggauuuuggaagcauuggugggguauuuaccaguguagggaaacugguacaccagauuuucggaacagcuuauggugugcuauucagcggcguaaguuggaccaugaaaauaggaauaggcguuuuacuaacaugguuagguuuaaacucucgauccacaagucuuucgaugacauguauugcaguaggccuaguaacucuuuaccucggaguaaugguacaagccgauagcggcugcguaauaaauuggaaaggacgggaauuaaaauguggguccgggauauucgggacaaaugaaguucauacauggacagaacaauauaaauuucaagccgacagccccaaaaggcuuuccgcugcaauaggaaaggcuugggaagaaggggugugcggaauaagaucugcaacuagacuagaaaauauaauguggaaacaaauaagcaaugaacuaaaucauauucuauuagagaaugcuaugaaauuaacaguuguagucggcgauguugccggaauauuagcacaaggaaagaaaaugauucguccgcaaccaauggaauacaaauauagcuggaaaucuugggguaaagcuaaaauaauaggagcggauguccagaacacgacauuuaucauugauggaccaaacaccccagaauguccagaugaucaaagagcauggaacauaugggaaguagaagacuauggguucggcauauuuacaacaaacaucuggcuuaaacucagagacaguuacacucaagugugugaucaccguuuaaugagcgcggccaucaaagacuccaaggcaguccaugccgauauggguuacuggauagaaucggagaaaaacgaaccuuggaaauuggcucgcgcuucauuuauagaagucaaaacuugcaucuggccgaagucacacacuuuauggaguaacgguguuuuagaaagcgaaaugaucauaccgaaaauuuauggaggacccauuucccagcacaacuaccggccaggguacuucacacaaacagcgggaccuuggcaccuaggcaaauuagaauuagauuuugaucugugugaaggaacgacaguuguuguagaugaacacuguggaaaucgaggaccaagucuacgaacaacuacugugccaggaaaaaucauucacgaauggugcugcaggucauguacauuaccaccuuuaagauucaaaggcgaagacgguugcugguaugguauggaaauaucgccggugaaagaaaaagaggaaaauuugguaaagaguaugguaucugccggauccggugaaguagauagcuuuucccucggacuucugugcauaaguauaaugauagaggagguuaugcgcucaagauggaguagaaaaauguuaaugacgggaccacuaccagucuucuuucuacuaauaauggggcaacuuccuuggaaugaucuaaucagguuaugcaucaugguaggcgcaaacgcgagugacaggaugggaauggggacaccguauuuagcuuuaauggcaacauuuaagaugagaccaauguuugccguaggguuacuuuuucgacgacuaacaucacgagaagguuuauuacuaacgauaggacuuucacuugucgcgagcgucgaacuucccaacucccuggaagaauuaggagaugguuuagcuauggguaucaugauucucaaauuauuaacugacuuccagagccaccaacuuugggcuacacuccucgcacugacauuuauuaaaacgacauuuagucucgacuaugcauggaaaacuauggcuaugguccuaagcaucguuucguuauuuccacuaugucucucaacaacaucgcagaagacuacaugguuaccuguuuuacuggggucacugggauguaagccauuaacaauguuuuugauagccgaaaacaaaauuuggggaaggaaaucauggccacuaaaugaaggcauaauggcuguuggcauaguuuccauuuuauuaagugcauuguuaaagaaugacguaccucucgcuggaccauuaauugcaggagggauguugauagcauguuauguuauuucagguucuagugcggauuugucgcuagaaaaggcggcagaaguaucaugggaagaagaagccgaacacucagguggcucucauaacauucuaguagaaguacaggaugacggcacaaugaaaauaaaagacgaggaacgggacgcuacacuaaccaucuugcuaaaggccaccuuacuagcuguaagcgguguauauccacugagcauaccagccacuuuauuuguaugguauuucuggcagaaaaagaaacagaggagcgguguuuugugggauacgccaagucccccugaaguugagagagccguucuagacgacgguauuuacagaaucaugcagagaggucuacuaggacgaucacaagucggcguagguguauuccaagagaauguuuuucacaccauguggcacgugacuaggggagcagugcucauguaucaggguaagagguuagaaccaucuugggccaguguaaagaaagaucuaauaaguuauggaggaggguggcguuuacaagguucauggaacaccggagaagaaguucaagucauagcuguagaaccuggcaaaaauccgaaaaauguucaaacggcgccggguacauuuaaaacaucggaaggugaagugggagcgauagcgcucgacuucaaacccggaacuucugguucccccauagucaauagagaagggaagauuguuggguuauacgguaauggaguuguaacaacaagugguacguaugucucugcaaucgcucaagccaaagcaucacaggaaggaccauuacccgaaauugaagaugaaguguuccgcaagagaaacuugaccauaauggauuuacauccagggucagguaagacaaggagguaucugccugcaauuguacgggaagcaauaaaaagaaaauuacgaacguuaauccuggcaccuaccagaguaguagccucggaaauggcagaggcauugaaaggaaugccuauaagguaucaaacuacggcugucaagagugaacauacugguaaagaaauagucgaucuaaugugucaugcaacauuuaccaugcgacuccucucaccaguaagaguacccaacuauaacaugaucauuauggaugaagcacacuuuacugauccaucgucaauugcagcucguggauauaucagcacacgagugggcaugggggaagcugcagcaauuuucaugacugcgacacccccugggucaguagaggccuuuccacagucaaaugcuguaauucaagacgaggaacgugauauaccugaaagaucauggaacucuggauacgaguggauaacugauuucccggguaaaacgguaugguuuguaccuucaaucaaaaguggaaacgauauagcuaauugucugcguaaaaacggaaaaagagucauacaauuaaguagaaagacauucgacaccgaauaccagaagacaaagaauaaugacugggacuauguaguaaccaccgauauaagcgaaaugggugcaaacuuccgugcagacagaguaaucgauccaagaagauguuuaaagccuguuauauuaaaagacgguccggagcgaguaauauuagccgguccaaugcccguaaccguagcuucugcugcgcaaaggcgagggcgaaucggacguaaucauaacaaggagggagaucaauauauuuauaugggccaaccacugaauaaugaugaagaucaugcacauuggacagaggcaaaaaugcuguuagacaauauuaauacaccggaaggcauaauaccugcucucuucgagccggaaagggagaaaagcgcagcaauagacggugaauaucgacuacguggugaggccaggaaaacuuuuguagaauuaaugcgacgaggugaucuaccaguguggcuuaguuacaaaguggcuagugaagguuuucaguauagcgaucggcgaugguguuucgauggcgagcguaacaaccagguacuugaagaaaacauggauguagaaauauggacaaaggaaggagaaagaaagaaacuccguccgcguuggcuagaugcucgcaccuacagcgacccauuagcuuuaagagaauuuaaagaauuugcagcgggaaggcgaucugucaguggugauuuaauccuugagauuggaaaauuaccgcagcaucucacacaaagggcgcaaaaugcguuagacaaccuaguaaugcuacauaacagugaacaggguggccgagcauaccgucacgccauggaagaacuacccgauacaauugagacgcuuauguuacuagcacugauagcaguauuaaccggagguguuacacuauucuuucucuccggacgcggacuggguaaaacgucaaucggcuuacuaugugucauggcaucaagcguacuguuguggauggcaucgguugaaccacacuggauagcggcgaguauuauccuggaauuuuucuugaugguauuguugauuccagaacccgauagacagagaacuccgcaggauaaccaauuagcuuauguuguuaucggcuuacuauuuaugauauuaacgguagccgcuaacgaaauggguuuacuggaaacuacaaagaaagacuuggggauuggucauguggcgguugaaaaccaucaucacgcugcaaugcuagacguagauuuacacccagcaagugcguggacacuguacgcggucgcaacuacaaucauuacuccgaugaugagacauacuauagagaauaccaccgcaaauauuagucuaacggcuauagcuaaucaagcugccauacuuaugggcuuagauaaaggauggccuauaucaaaaauggauauuggaguaccccuuuuagcuuuaggauguuauucccaaguaaauccccuuacuuugacagccgcaguauuaaugcucguagcucauuacgcaauaauugguccaggccuccaggcuaaagcaacacgagaagcccagaaaaggacagcagcgggaauuaugaagaauccaacuguagacgguauaguagccauagaccuugacccuguaguuuaugacgcuaaauuugaaaaacaauuaggccaaaucauguuauuaauuuuguguacaagccaaauucuauuaaugcgaacuacaugggcauugugugaguccauaacccuagcgacggguccguuaaccacucuaugggaaggaagccccggcaaauuuuggaauacaacuauugcgguaagcauggcuaacaucuuuagaggcaguuaucuggcuggcgcaggauuggcguuuagccuaaugaaaucacuaggagggggccgacgaggcacaggagcccaaggagaaacacugggagaaaaguggaaaaggcagcuaaaccaacuaagcaagagugaguucaauaccuacaaaaggucuggaauuauggaaguagaccgaagugaggcaaaagagggacuaaaaaggggcgagacaacuaaacacgcgguaucucggggaaccgcaaaacugagaugguuuguugaaagaaaucuaguaaagccugaaggaaaaguaauugaucuagguugcggaagaggggguuggucauauuauugcgcagggcuaaagaaagucacagaaguaaaaggauauacaaagggaggccccggacacgaggaaccaaucccgauggcaacauaugguuggaauuuggugaaacuacauucgggcaaagacgucuucuuuaucccaccagaaaaaugcgacacauuguuaugugauaucggcgagucuagccccaacccuacgauagaagagggcagaacucuaagagugcugaaaauggucgagccuuggcuacgugguaaucaguuuugcauaaaaauauuaaauccuuauaugccaaguguuguugagacgcuagaacagaugcagaggaaacacggagggauguugguuaggaaucccuuaaguagaaauuccacacacgaaauguacuggguuuccuguggaacugggaacauagucucagcagugaacaugacgaguagaaugcuauuaaaccgcuuuacaauggcacacaggaaaccuacguaugagcgggauguggauuuaggagccgggacacggcacguugccguagaaccugaggucgcaaauuuagauauaauaggucaaagaaucgaaaauauaaagcaugaacauaaaucaacuuggcauuaugacgaagacaacccuuacaaaaccugggcauaucauggcuccuaugaaguuaaaccaagugggucagcaucaagcaugguuaauggcgucgugaaacucuugacgaagccaugggauguaaucccaaugguaacccaaaucgcaaugacugauaccacaccauucggacaacaacgaguuuuuaaagaaaaaguugacacaagaacaccgaaggcgaagagaggaaccgcccaaauuauggaaguuacagccaaguggcuauggggauuucuaagccgaaacaaaaagccacgcauaugcaccagagaagaauuuacaaggaaaguaagaucuaacgcggcuauaggcgcaguguuuguggaugaaaaccaauggaacucugccaaagaagcggucgaagaugaacgauucugggacuuaguacauagagagcgagagcugcauaaacaaggaaaaugcgcaacauguguguauaacaugauggggaaaagggaaaagaagcuaggcgaauuugggaaagcaaaaggguccagagcaauuugguacauguggcuaggagcaagauuucuagaauuugaagcacuuggauucaugaaugaagaucacugguuuucccgugaaaauucacuuuccgguguugaaggugaaggacugcauaaacuuggauacauauugcgggauauuucuaaaauuccaggugguaacauguaugcugaugauaccgccggaugggauacacggaucacggaagacgauuuacagaaugaagccaaaauuacagauauaauggagccggagcacgcacuccuggccaaaagcauauucaaacuaacguaccagaauaaaguaguuaggguucaaagaccugcgaaaaacgguacagugauggacguuauuucaagacgugaccagagagggaguggucaaguugggaccuacgguuuaaauacauuuacgaauauggaagcucagcuuauuagacaaauggaaucugaaggaaucuuuucgccgagugaauuagaaacuccuaauuuagcugguagaguucuggauuggcuugaaaagcaugguguagaaaggcuuaaacguauggcuauuucuggugaugauuguguuguaaagcccauugacgaucgauucgcagcugcauuaacagcacuaaaugauaugggaaaaguucgaaaagauauaccucaaugggagccaucaaaaggauggaaugauuggcaacaagucccguuuuguucacaccacuuucaccaacuaauuaugaaagacggucgagagauuguagucccaugccguaaucaggaugaacuuguagguagagcuagaguaucucagggggcagguuggucccuuagagaaacugcgugucucggaaaaaguuaugcucaaauguggcaauugauguauuuucaucguagagauuuaagauuggcagcuaacgccauuuguagugcaguaccgguugauugggugccaacaucaagaacaacuuggucaauacacgcgcaucaucaauggaugacuaccgaggauauguuaagugucuggaaccgugucuggauagaagaaaacccauggauggaggauaaaacgcauauaaguaguuggggugauguaccguaccucggcaagcgugaagaucaaugguguggguccuugauaggacuuaccgcaagggcuaccugggcuacaaacauucaaguggcaauuaaccaaguacggagacuaauagggaacgaaaacuacuuggauuacaugacauccaugaagcgguuuaaaaacgaaagugauccagaaggggcccuaugguaa

SEQ ID NO: 21870 - RNA, 9879 nt, Artificial Sequence
  derived and/or modified CDS sequence (opt6) from DENV-1__GU131806__SS-prME
aguguuaccauguuccuaauguuaaugcccacugcacucgcauuccaucuaacuacuagagguggagaaccacauaugauuguaagcaaacaagaacgcggaaaaagucuacuuuucaaaacgucagcaggaguuaacaugugcacauuaauagcaauggaucuaggagaacucugugaagauacuaugacguauaaauguccuagaaucacagaaacagaaccugacgacgucgacugcuggugcaaugcuacagauacaugggucacguacggaaccugcagucaaacuggagaacacaggcgugacaaaagaagcguugcacuggcuccucacgugggcuuagguuuagaaacacggacagaaacauggaugaguucggaaggggcuuggaaacaaauacaaagaguagaaacaugggcguugaggcaccccggauuuacaguaauugcgcuuuuucuugcucacgcaauaggaacaucgauaacacaaaaaggaaucauuuucauccuacucaugcuuguaacacccaguauggcaaugagauguguggguauuggaucacgagauuucguugaaggcuugucaggagcgacguggguugaugucgucuuagaacaugguucguguguaacaaccauggcuaaagauaaaccgacucuagacauagaacuacuuaaaaccgaaguaacgaauccggcuguucuaagaaagcucuguaucgaagccaagauuucuaauacaacuacugauagucguugcccuacucaaggugaagcuacguuaguagaagaacaagaugcgaauuuuguaugcaggaggacuuuuguugaucgcggauggggcaacggauguggacuuuuuggcaaagggucauuaauuacuugugcaaaauuuaaaugcgugacaaaacuggaaggaaaaaucguacaauacgaaaacuugaaguauuccguuaucguaacgguucacacgggugaucaacaucaagucggaaacgaaucaaccgaacaugggacaacugcaacgauuaccccacaagcgccuacaacugaaauacaacuaaccgacuacggcgcacuaacguuggauugcucaccaaggacaggccuggauuucaacgaaaugguauuauugacuaugaaagagaaaucaugguugguccacaaacaaugguuccuugacuuaccguuagcuuggaccagcggaggcagcacaucacaggaaaccuggaaucgacaagaucucguagugacauuuaagacugcgcacggcaagaaacaggaaguaguaguacucggaagucaagaaggcgccaugcauacugcacucacgggagcgacugaaauacaaacaaguggcacgaccacaauauucgcugggcaucucaaaugcagauugaaaauggauaaacuaacguuaaaagguaugaguuacguaaugugcacuggaucauuuaaguuagaaaaagagcuugcggaaacacaacacgguaccguccuuguucaaauaaaauaugaaggaacagacgcgccgugcaaaauucccuuuaguacgcaagaugagaaggguguuacacagaacgguagacuaauaacugcaaacccaauaguuacggauaaagaaaagcccguaaacauagaagcagaaccuccauucggggagucauacauagucaucggggcaggcgagaaggcacugaaauuaaguugguucaaaaagggcucuaguauuggaaaaauguuugaggcaacagcgcgaggugcuagacgcauggcgauacucggagauacagcaugggacuuuggcagcauuggagguguauuuacgucuguaggcaaacuggugcaccaaauauuuggaacagcauauggaguucuauuuagugguguaucuuggacgaugaaaaucggcauagguguacuacuaacauggcuuggacuaaacucaagauccacaucauugaguaugacaugcauagcagucggccuagugacauuauauuuaggaguaaugguucaagcugauaguggcugcguaauaaauuggaagggacgagaguugaagugugguucgggaauauuugucacaaacgaggugcauaccuggacagagcaguauaaauuucaagccgacucaccuaaaagauuauccgcggcuaucggaaaagccugggaagaggggguaugcgguauaagauccgcaacucgguuagaaaauauaauguggaaacagauaucaaaugaacuuaaccacauucuauuggaaaaugacaugaaauucacggucgugguaggcgacgucgcagguauauuagcacaggguaaaaagaugauacgaccacaaccaauggaguacaaguauucuuggaaaagcugggguaaggcuaagauuauaggugcugacgugcaaaacacaacauucauaauagauggcccuaacacgccagagugcccggaugaucagagggcauggaauaucugggagguggaagauuacggguuugggauuuuuaccaccaacaucugguuaaaauuacgcgauucauacacccaaguaugcgaucaucgcuuaaugagugcagcaauuaaagacucuaaagcaguacaugcagacaugggauauuggauagaaucagagaaaaaugaaaccuggaaguuagcacgagccucuuuuaucgaaguaaaaacaugcauauggccuaagagccauacuuuauggucaaauggaguucuggaaucagaaaugauaauaccgaagauuuacggagguccgauuucucagcauaacuauaggccaggauauuuuacucaaacugcaggaccguggcaucucgcgaaacucgaguuagacuucgaucuuugcgagggcacgacaguuguuguagaugaacauugcggaaaccgaggacccucguuaagaacgacaacuguaacagguaaaaucauacacgaauggugcuguagaaguugcacuuuacccccucuuagauucagaggugaggacggaugcugguacggcauggaaaucagacccguuaaagaaaaagaagaaaauuugguuaagagcauggugucagcagguucaggugaaguggauucauuuucccuaggguugcuauguaucagcauaaugaucgaggaaguuaugagaucgagguggucacguaaaauguugaugaccgguacgcuugccguauucuuucuacuaaucaugggacaauuaacauggaaugaucucauacgacuguguauuaugguaggagcaaaugccuccgauaggauggggaugggcaccacuuauuuggcauuaauggcuacguucaagaugagaccaauguucgccguuggucugcuguucagaagacuaacaucuagagaaguguuacuacugaccauuggacugucacuuguugcaagcgucgaacuaccaaacucauuggaagaacuaggagauggacuggcaaugggaauaaugauauuaaaauugcucaccgauuuucaaucccaucaguugugggccacauuauuaucauugacauucauuaaaacuacauucucucuacauuaugcauggaaaaccauggcaaugguucuauccauuguaaguuuauucccacuaugcuuaucgacaacaagucagaaaacgacuugguuaccaguacucuuaggaucuuugggauguaaaccgcuaacaauguuuuuaauugcggaaaauaaaauuugggguagacgauccuggccuuuaaacgaggggauaauggccguaggaauuguuagcauucuucucucgucucuucugaaaaaugauguuccauuagcagggccucuaauugcuggcggcauguuaauagccuguuauguaauaagcggaucuucggccgacuuaucauuagaaaaagcggcagaaguaucuugggaagaagaagcagagcauaguggaccaagucacaacauucuuguggaaguacaagaugaugggccaaugaaaauuaaagaugaagaaagggacgauacucucacgauauuacucaaagccacacuauuggccguaagcggagucuauccauuaagcauaccugcaacacuauuugucugguauuucuggcaaaagaaaaagcaaaggucuggggucuuaugggacacucccucaccuccugagguugagcgcgcaguucuugaugacgguauauacagaauaaugcaacguggucuucuaggacgaucccagguggggguugguguuuuucaagagaauguauuccauacuauguggcaugucacucgaggugcgguacugauguaccaaggaaaaagacucgaacccucgugggcaucagugaagaaagacuugauaucauacgggggagguuggcguuuacaagggaguuggaauacaggugaggaagugcaaguaaucgccguagaaccggguaaaaauccuaaaaacguucagacagcuccuggaaccuucaaaaccccugaaggugaagucggugcuauagcuuuagauuucaaacccggaaccucuggaagccccauagugaauagggaaggcaaaauucuuggcuuguacggaaauggaguuguaaccacuucaggaacguaugugagcgccauagcccaagccagagcuucccaagaagguccccuaccggagauagaagaugagguuuuuagaaaacgaaaucucacuauaauggauuugcauccaggcucugggaagacucggcgauauuuaccugccaucgugagggaagcgauaaagagaaaauugaggacauuaauuuuagcuccuacaagaguaguugcaucugaaauggccgaagcccuaaaggggaugccaauaagguaucaaacaacagcagucaagagugaacacacggguaaagaaauugucgaucugaugugucaugccacuuuuacgaugcgacuacugaguccuguaaggguccccaauuauaauaugauaauuauggaugaagcgcauuuuacagacccgucaucaauagcugcccgaggauacauaagcacaagagucggcaugggggaagcagcggcaauuuuuaugacagcaacacccccagguaguguagaggcuuuuccgcagaguaaugcaguuauacaggacgaggagagagauauuccugaacgaaguuggaacaguggauaugaauggauaaccgauuuuccuggcaaaacaguaugguuugucccuucaauuaaaaguggcaaugauauagcuaacuguuugcgaaagaacgggaagcgaguuauacaacuaucaagaaaaacauucgauacagaauaccagaagacuaaaaauaacgauugggauuacguaguaacgacugauauaucagagaugggcgcaaauuucagagcagaucgcguaauagauccgagaagaugccuaaaaccugugauacucaaagauggaccagaaagggugauucucgcgggaccaaugccaguaaccguagccucugcagcccagagaagaggucgaauagggagaaaccauaauaaagagggcgaccaguacauauauaugggacagccguuaaacaaugaugaagaucaugcucacuggacagaggcaaaaaugcucuuagauaacauaaauacgccugaagggaucauuccagcacuguucgaaccagaacgagagaaaucagcagcuaucgauggagaguauagacuaaggggcgaagcacgcaaaaccuucguagaacuuaugaggagaggggauuuaccaguuuggcugagcuauaaaguagcaagugaggguuuccaauauagugacaggcgaugguguuuugauggugaaaggaauaaccaaguucuugaagaaaauauggauguugagauauggacaaaagaaggagagcguaaaaagcuaagaccuagaugguuagacgcccguacauacagugauccguuagcuuuacgagaguucaaagaauuugccgcagggagaagaagugucaguggugauuuaaucuuagaaaucgggaaauuaccacaacauuuaacgcagagggcacaaaacgcacuagauaacuuggucauguuacauaauagugaacaaggagggcgggcauaccgucaugcgauggaggagcuuccugauacgaucgaaacucugaugcuguuagccuugauagccguuuuaacaggagguguaacacucuucuucuugucaggucgaggccugggcaagacaaguauaggacuacuguguguuauggccagcucgguucuuuuauggauggccaguguagaaccacacuggauagcugcaucaaucauacuagaauuuuuccugauggucuuguuaaucccugaaccugacagacaaaggaccccacaagacaaccaguuggcuuacguaguuaucggacuacucuucaugauccucacugucgcggcaaacgagaugggacuacuggaaacgacaaagaaagacuuaggcauuggacacguagccguagaaaaccaccaccaugcugcuaugcuagacguugaucugcacccagccucagcuuggacauuauacgcaguugcaacaacuauaauuacccccaugaugcgucacaccaucgaaaauacaacugcuaauaucagcuugacugcuauugcaaaccaagcggccauauuaaugggguuagauaaaggauggccaaucaguaaaauggauauagguguaccacuucucgcccugggaugcuauagucaaguuaauccguuaacgcucacggcagcgguacuaauguuaguagcacacuacgcaauaauaggcccaggucuucaagcaaaagcaacucgggaagcucagaaaaggacggccgcuggaauaaugaagaacccaacuguagacggcaucguagcaaucgaucuugacccggugguauacgaugcaaaauucgaaaaacaacuaggacaaauuaugcuacugauccucuguacaucucaaauccuuuuaaugagaacaacuugggcacuuugcgaaagcauaacccuugcuacugggccccuaacuacacuuugggaagggagcccuggaaaauuuuggaacaccaccauagcuguaucaauggcuaacauuuuuagagguucauacuuggccggugcgggguuggcuuucucguuaaugaaaucacuaggaggcggucggagagggacuggagcucaaggggagaccuuaggagaaaaguggaaacgacaacucaaucaauuaaguaaaagugaguuuaauacauauaaacgaagugguauuauggaagucgauagaucugaggcaaaggagggauuaaagcgaggugaaacuaccaaacacgcaguaucucggggcacugcaaaauugagaugguuuguugagagaaaccucguaaaacccgaagguaaaguaauugaccucggauguggaagaggagguuggaguuauuauugcgccgggcuuaagaaagugacggaaguuaaagguuauacaaaaggcggcccuggucacgaggagccuauacccauggcaacauauggauggaaccuaguuaaauuacauucaggaaaggaugucuucuucauaccuccagagaaaugugacacuuuacuaugcgauauuggggaaucaagucccaauccaacuauagaggaaggcaggacucuaagagugcuaaaaaugguggaaccaugguuaagaggcaaucaauucuguauaaaaauauugaacccuuauaugccaucaguugucgaaacuuuagaacaaaugcaacguaaacacggcgguauguuaguuagaaaucccuuaaguaggaacaguacucaugaaauguauugggucaguuguggaacagguaauauaguaucugcaguuaauaugacaucuagaaugcuauugaaccguuuuaccauggcccauaggaaacccacauaugaacgggacguagaucuuggagcagguacucgacauguagcgguugaacccgaggucgccaaccucgacaucauaggacaacgaauagaaaacauuaaacaugaacauaaauccacauggcauuaugaugaggauaaccccuacaagacaugggcuuaucaugguucguacgaaguuaaaccgucgggaagugcaucgucaaugguaaaugguguuguaaaacuauuaacaaaaccuugggauguuauaccaauggugacacaaaucgcaaugacagacacaacuccauucgggcaacaaagaguauuuaaggaaaaaguagacacacgaacuccgaaagcuaagagagguacugcgcagauuauggaagucacagcuaaauggcuauggggauuuuugaguaggaacaagaaaccacguaucuguacuagagaggaauuuaccagaaaaguaagaucaaacgcagcgauaggugccgucuuuguagacgaaaaccaauggaauagugcaaaagaagcgguugaagaugaacguuuuugggaucuaguccacagagaacgagagcugcauaagcaaggaaaaugugcaacaugcguauacaacaugauggguaaacgggaaaagaagcugggagaguucggaaaagcaaaaggguccagggcuaucugguacaugugguuaggagcucgguuucucgaauuugaagcacucggauuuaugaaugaggaucacugguuuucuagagagaacuccuugaguggcguagaaggcgaagguuugcauaaauuagguuauauacuuagggauauuagcaaaauacccggaggcaauauguaugcagaugacacggcagguugggacacaagaauaacugaagaugaccuccaaaaugaagcaagaaucacagacauaauggaaccagaacaugcccuucuagcaaaaucaauauuuaaauuaacauaccaaaacaaaguaguucguguccaaaggcccgccaaaaaugggacaguuauggauguuauaucacggcgggaccagagagguucaggucaaguagguacuuauggguuaaauaccuuuacaaauauggaggcccaacuaaucagacaaauggagucugaaggaaucuuuucaccuagugaauuagaaacgccaaaccuggcagaaagaguguuagacugguuggagaaauacggaguugaaagguugaaaagaauggcuauaagcggugaugauugcgucguuaaaccuaucgaugauagguucgcgacagcucuuacagcccucaacgauaugggaaaaguacgaaaggauauaccgcaaugggaaccaucuaagggguggaaugacuggcaacagguuccguuuugcagucaucauuuucaccaauuaauuaugaaagacggacgcgaaauaguagucccaugucgaaaucaagaugagcuaguuggccgugccagagugucacaaggugcgggauggucuuugagggagacagcaugccuaggcaaauccuacgcgcagauguggcaacuaauguacuuucacaggagagacuugagauuagccgcaaaugcaauuugcuccgcagugccaguggauuggauaccuacuucacgcaccacuuggaguauacaugcacaucaccaauggaugacgacugaagacaugcuuagugucuggaaucgaguuuggauagaagaaaauccguggauggaagauaaaacacacauaaguucauggggagacguuccauauuuaggaaaaagagaggaccaauggugcgggucauuaauugguuuaacagcaagggcaacaugggcgacaaauauccaagucgcaauaaaccagguaaggcgacuuauagggaaugaaaacuauuuagauuauaugaccucaaugaaaagauucaaaaaugaaagugauccagaaggagccuuaugguaa

SEQ ID NO: 21871 - RNA, 9879 nt, Artificial Sequence
  derived and/or modified CDS sequence (opt6) from DENV-1__GU131807__SS-prME
aguguuacaaugcuccuaaugcuuaugccgacggcacuagccuuucaucuuacaacaaggggaggagaaccgcauaugauuguuaguaaacaagaacgaggaaaaagucucuuauucaaaacaagcgccgguguaaacaugugcacacucauugcuauggaccugggagaacuaugugaagacacaaugacuuauaaaugcccacguauaacagaaacagagccagaugauguggacugcugguguaaugcaacugacacgugggugacguaugguacguguagucaaacuggagaacaucgccgagauaaaaggaguguagccuuggcaccacauguuggacuaggacuugaaacaaggacagagacauggaugaguagugagggagccuggaaacagauacagcgcguggaaacaugggcucuaagacaucccggauucacuguuauagcucucuuucuagcgcaugcaauaggaacgucuauuacgcaaaaagggauuauuuuuaucuuguuaauguuaguuacuccuucuauggcuaugcggugcguaggaauuggcagcagagacuuuguagaaggacuaagcggcgcuacuuggguggacguaguuuuagaacaugguucaugugugacuacaauggccaaagacaaaccaacauuagauaucgaacuacugaaaccugaaguaacaaauccagcuguacugagaaaacugugcauagaagcaaaaauaucaaacacgaccaccgauuccagaugcccaacacaaggggaagcuacacuugucgaagaacaagacgcgaacuucguuugccgucgcacauucguagauagaggcugggggaauggcuguggacucuuuggaaaaggaucacuaauaacgugcgcuaaauucaaauguguuacuaaacuugaaggcaaaauuguucaauaugaaaaucucaaauacagcgugauaguuacaguucauacuggagaucaacaucaaguaggaaaugaaucaaccgaacaugggacaacugcaacaauaacuccgcaagcaccgacaacggaaauacaauuaacagauuauggagcucuaacccuggacugcagcccgcggacaggacuggauuucaaugaaaugguccuuguaacuaugaaagaaaaaucuugguuaguucauaaacaaugguuuuuagaccuaccccuuccauggacgagcggugcuucgacaagucaagaaaccuggaacagacaagaucuucuaguuacguuuaaaacugcacacgccaagaaacaagaaguuguagucuuggguucacaggaaggagcaaugcacacagcccuaacgggugcaacagagauccagacuuccggcaccacuacuauuuuugcaggucacuuaaaauguagauuaaaaauggauaaauugaccuuaagaggaaugagcuauguaaugugcacgggaaguuucaaauuagagaaagaaguagccgaaacgcaacauggcaccguauuagugcaaauaaaauacgaagguacagacgcaccguguaaaaucccauuuucuacacaagaugaaaaagggguaacgcaaaauggacgucugaucacggcgaauccgauuguuacagacaaagaaaaaccaguaaauauagaagcagaaccaccuuucggcgaaaguuacauagugauuggagcaggagaaaaggcuuuaaaacuuuccugguuuaagaaaggcucuagcauuggaaagauguuugaagccacagcccgcggggcgcgcagaauggccauucuuggugacacagcaugggacuuuggaaguaucggaggaguauucacauccguuggaaaacuuguacaccaaauuuucggcccggcguacgggguucuauuuucgggaguuucuuggccaaugaaaaucggaauaggaguuuuauuaacuuggcuagguuuaaacagccguaguaccuccuuaaguaugacauguauagcugucgggcuaguaacucuauacuugggcgucauggugcaagcggacucuggaugcgugauaaauuggaagggaagggaacuuaagugugguagcggaaucuuuguaaccaaugaaguucacacauggacugagcaguauaaguuccaagcugauucaccgaaacgauuaagcgccgcuauuggcaaagcgugggaagaaggcguaugugguauuaggagugcuaccaggcuugaaaacauuauguggaaacaaauuucaaaugaacuuaaccauauauuauuggaaaaugauaugaaauuuacgguagucguuggcgacguggcaggaauccuagcacaagguaaaaagaugauucguccgcaaccuauggaauacaaauacagcuggaaaucaugggguaaagcaaaaauaauaggagcugauguucaaaacacaaccuucauaauugauggaccuaacacgccagaaugccccgacgaucaacgagcauggaauauaugggaaguagaagacuacgguuucgggauuuuuacgacuaacauauggcucaaauugagagacagcuauacccaagugugugaucacagauugaugagcgcggcaauuaaagacagcaaggcuguccaugcagacaugggcuacuggauagaaucagagaaaaaugaaacauggaaacucgccagagcaucuuuuauagaggugaagacuuguauauggccuaaaucacacacguuauggagcaauggcguuuuagaaucagaaaugauuauaccgaaaauuuacggggguccgauaucacaacauaacuaucguccugguuauuucacacaaacggcaggaccuuggcaccuagguaaauuagaacuagacuuugaccuaugugaaggaacaacagucguaguagaugaucauugcggaaaccgaggaccaucuuuaagaacgacuacagucacaggaaaaauaauacaugaaugguguugcagaucuuguacguuacccccucuaagguucagaggggaagacggcugcugguauggcauggaaauuaggccaguuaaagaaaaagaagaaaaccuagugaagucuauggucucggccggcucuggagaaguagauaguuucucauuaggauuguuaugcauuucaauaaugauugaggaaguuaugcguucacgauggucacguaaaauguuaaugacuggcacauuagcuguauucuuuuuguuaauuaugggacaacuuacguggaacgauuuaaucaggcuauguaucauggucggugcaaaugcguccgaccggaugggaauggggacaaccuaucucgcccuaauggcaacauuuaaaaucaggcccauguucgcgguaggacuccuuuuucgacgauuaaccagucgggaaguuuugcuacuuacgauugguuuaagucucguggcuucaguggaguuaccaaauucucuagaagaacuaggagauggauuagcgaugggcauuaugauauuaaaacugcugacggacuuccaaagucaucaauugugggcaacauuauuaagccuaacuuuuauaaaaacgacuuuuucuuugcacugugcauggaaaacgauggcaauggucuugagcauugucucccuauucccauuaugcuuaucaacaacaucucagaaaacuacaugguuaccuguuuugcuugggucacuuggguguaaaccucuaacaauguuucuaauagccgaaaauaaaauuugggggagaagaucauggccccuuaacgaaggaauaauggcggucggaaucguaucuauacuauuaagcagucugcucaaaaacgacgucccuuuagcaggcccacuaauugcaggaggaaugcugauagcaugcuacguuaucuccggaagcucagcagaucugucgcuggaaaaagcggcagagguguccugggaagaagaagcugaacauucgggugcuagccauaacauacugguagaagugcaggaugacggaacaaugaaaauaaaggacgaggaaagagaugauacauuaaccauucuguuaaaggcaacuuuauuagccgucucagggguauacccgcucaguauacccgcuacccuguucguaugguauuucuggcagaagaagaaacagcguagcggaguacuuugggauaccccaagucccccugaaguagagagagccguacuugacgacggaaucuaucggaucaugcaacgcggacuucugggaaggucacaagugggaguagguguuuuccaagagaauguuuuccauacuauguggcauguuaccagaggagccguucuaauguaucaagggaaaagauuagagccuucgugggcaagugucaagaaagacuugauaucauacggcgguggguggcgccuccaagguuccuggaauaccggcgaagaaguacaaguaauugccgucgaaccgggaaagaauccgaaaaauguacaaacugcuccugguacauucaaaacgccugaaggagaaguuggugcgaucgcauuagauuucaaaccaggaacgucaggauccccaaucguaaauagagaggguaaaauugucggucucuacggaaaugguguuguuacgacgaguggcacuuacguaagcgcaaucgcucaagcuaaagccucacaagaagggccacuuccagagauagaagacgaaguauucagaaaaaggaaucuuaccauaauggauuugcacccaggcucaggcaaaacaagaagguauuuaccagcaaucguacgggaggcuauaaaacgaaaacuaagaacgcugauauuggccccaacucgaguuguagccucagaaauggcagaggcacugaagggaaugccaauacgguaucagaccacugcgguaaaaagugaacauaccgguaaggagauuguagauuuaaugugccacgcaaccuucacuaugaggcuacuaagucccgucagagugccuaacuauaacaugauuauaauggacgaagcucauuucacagauccaaguaguauagcugcaagagguuauauuagcacgaggguagggaugggagaagcggcagccauuuucaugacagccacaccaccuggguccgucgaggcuuucccucaaaguaaugcaguaauacaagacgaagaacgagauauuccagagagaucauggaacucaggauaugaauggauaacagacuuuccugguaaaacuguuugguuuguaccaaguauaaaaucuggcaacgauauugccaacugccuuaggaaaaacgggaagagagucauacaacucucacguaagacuuuugauacagaauaccagaaaaccaaaaauaacgauugggauuacguagucaccaccgacauaagcgagaugggagcaaauuuccgugcagaucgaguaauagauccucggagguguuuaaaaccagugauacuaaaggaugguccagaacgaguaauauuggcuggacccaugccaguuacuguagcaucugccgcucaaagaagaggacgcaucggacggaaucacaauaaagaaggagaucaauauauauacaugggacaaccccucaauaacgacgaagaccaugcucacuggacagaggcgaaaaugcucuuggacaacaucaacaccccugagggaauaaucccggcacucuuugagccugagagagagaaaagcgcagccauagauggagaauaccgauugcguggugaagccagaaagacuuucguggaacucaugagaagaggcgaucuaccagucugguuaaguuacaaaguugcaucagagggcuuccaauauuccgacagaaggugguguuuugauggugaaaagaacaaccagguacuagaggaaaacauggauguagaaauauggacaaaagaaggagaacggaaaaagcuaagaccgagauggcuggacgcaaggacauacucagauccguuagcuuuacgcgaguuuaaagaauuugcggccgguagaagaucuguuucuggugacuuaauuuuagaaaucgguaaacuuccacagcaccugacacaacgagcucaaaaugcccuugacaauuugguaauguuacauaacagugaacaaggaggucgggcauacagacaugccauggaggaauugccggacaccauugaaacucugauguuacuggcucugauugcaguauuaacuggaggggucacguuauucuuucuaaguggacgugggcuaggaaagacaucuauuggauuacuuugcguaauggcaagcagugucuugcuauggauggcaucaguugaaccgcacuggauugcggcauccauuauccuagaguuuuucuugaugguacuguuaaucccagagcccgacaagcaaagaacgccacaagauaaccaguuggcauacguaguuauaggccuucuuuuuaugauccuaacagucgcagccaaugagaugggacuccuagaaacaacuaagaaagaccuagggauuggacacguggcggucgagaaucaucaccacgcagcaauguuggauguagaucuucacccagcuuccgcauggacuuuauaugcaguagcuacaacuauuauuacgccaaugaugagacauacuauugaaaauacuacugccaauauuucacugaccgccauugcaaaucaagcugcaauccucaugggucuagacaaaggauggccaauauccaaaauggacauuggaguaccacuauuagcuuuaggcugcuauagucagguuaauccucuaaccuuaaccgcagccguacuaaugcuuguugcgcauuaugcuauaauugguccaggacuacaagcgaaggcaacaagagaagcccagaagagaaccgccgcaggaauaaugaaaaaccccacaguggauggcauaguagcuauagaucucgacccagugguguacgacgcuaaauucgaaaaacaacuaggccaaauaaugcuauuaauauuauguacuucucaaauuuuauuaaugcgaacgacuugggcucuuugugaaaguauaacucuggcuacuggaccauugaccacacucugggaagguucgccuggaaaguucuggaacacaacuauagcagugaguauggcaaacauauuucgaggaucguaccucgcgggugcaggcuuagcguuuucgcucaugaaguccuuggguggagggagacguggaaccggcgcacagggagaaacuuuaggggaaaaauggaaaaggcagcucaaucaauuauccaaauccgaguuuaauacauauaaacgaucaggcauuauggagguugacagaucagaagcaaaagaaggacugaagagaggggaaacgaccaagcacgcagugagucgagggacugcaaaacuacguugguucguagaacgaaauuuaguuaaaccagaagggaaaguaauagauuuaggauguggacgaggaggauggucauacuauugcgcaggcuuaaagaaaguaacggagguuaaaggguauaccaaaggagguccaggucaugaagaaccuauaccaauggccacguacggauggaauuuaguuaaauuacauucuggcaaagacguauuuuucauucccccagaaaagugugacacgcuucuaugugauauuggagaaucaucuccaaauccaacuauagaagaaggucgaacguugcgaguauuaaagaugguagagccaugguuacgagguaaucaauucuguaucaaaauucuuaauccauauaugccuucaguugucgaaacucuagaacaaaugcaacgaaaacacggugguauguuggucagaaaucccuugaguaggaacaguacccacgaaauguacuggguuaguugcggaacugguaauauagugucugcaguaaauaugacaucucgaaugcuauuaaauagguuuacuauggcgcaucgcaaacccacuuaugagcgcgauguagacuuaggcgcaggaacacgacauguagccguagagccagagguagcuaacuuagacauuauuggacaaagaauugagaauauuaaacaugaacauaaaucgacuuggcauuacgacgaggauaacccauacaaaacuugggcuuaccauggaucuuaugaaguaaagccuaguggcucagcaucaaguaugguaaauggagucguaaaacucuugaccaagccgugggacguuauaccaauggucacacaaauugcgaugacagauacaacaccguucggacaacaacgagucuucaaagagaaaguugauacacgaacucccaaggcuaaaagagguacugcccaaauaauggaaguuacggcaaaguggcucuggggauucuuaucccguaacaagaaaccaagaauaugcacuagagaagaguuuacaagaaaagugcgaaguaaugcagccauuggggcuguuuuugucgacgaaaaucaauggaacucugcuaaagaagcaguugaagaugagagauucugggaccugguucaucgggaaagagaacuacauaaacaggguaagugugccacauguguauauaacaugauggguaaaagagagaagaaauuaggugaauuuggaaaagcgaaaggcucgagggcaaucugguauauguggcuaggagcgagauuuuuagaauuugaggccuuagguuuuaugaacgaagaucauugguucucaagagaaaacucucuuaguggugucgagggugaggggcuccauaaacuuggauauauucucagggauaucucuaaaauaccuggcgguaauauguacgcggacgauacagccggcugggacacaaggauaacagaagacgauuuacaaaaugaagcucguaucacagauauaauggaaccagagcacgcucuuuuagcaaaaucgauauuuaaacuaacguaucaaaauaaagucguaagaguccaacgcccagccaaaaauggaacaguaauggacgugauuuccagacgugaccaaagggguucgggccaagugggaacauaugguuuaaacaccuucacuaacauggaagcgcagcuuauaagacaaauggaaagugaagguauauuuucacccucagaacuugaaacaccuaaucuugccgagcguguucuggacugguuagagaaauaugggguagaacgccuaaagaggauggcuauuaguggugacgauuguguaguaaaaccgauagacgauagauuugcaacugcacuaacugcacuuaaugauaugggcaagguucguaaagacauaccucaaugggaaccuucaaaaggauggaaugauuggcaacaaguuccauucuguucacaccacuuucaucagcuaauaaugaaagacggacgagaaauuguuguacccuguagaaaucaagaugagcuagucggcagagcucguguaucccaaggcgcgggauggucgcugagagaaacagccuguuuaggaaaaucuuaugcgcaaauguggcagcucauguacuuccaccgcagagaucuacgucuagcagcaaaugcaauuugcucugcugugccaguagauuggauccccaccucccguacaacauggucaauucaugcgcaccaccaauggaugacaacugaagacaugcuauccguuuggaaccgagucuggauagaagagaauccauggauggaagacaagacccauauuucuaguuggggugacguuccauaucuagguaaacgggaagaucaaugguguggaagucuuauuggauuaaccgcacgagcaacuugggcuacaaacauacaaguagcaauuaaucaaguacgucgacuaauaggaaacgaaaauuaccuugauuauaugacgucaaugaaacgauuuaagaacgagagcgauccagaaggagcacugugguga

SEQ ID NO: 21872 - RNA, 9879 nt, Artificial Sequence
  derived and/or modified CDS sequence (opt6) from DENV-1__GU131811__SS-prME
ucggugacuauguuauuaaugcuuaugccaacugcucuagcauuucauuugacgacgcgagguggagaaccacauaugauaguuucaaaacaagagaggggaaaaagucuucuauucaaaacgucugcaggcguaaauaugugcacacugaucgcaauggacuuaggcgaguucugugaagauacaaugacauauaaauguccaagaaucaccgaagcggaaccagacgauguugauuguuggugcaacgccaccgauacguggguaacauacggcacaugcucucaaauaggcgaacaccgucgugauaaacggucgguagcucuugccccacacguuggccucgggcucgaaacacgaaccgagacauggaugucaucugagggcgcauggaaacagauacaacggguggaaacaugggcacuuaggcauccgggauucacuguuaucgcauuauuuuuagcacaugcaauaggaacuagcaucacgcaaaaaggaaucauauuuauccuucuaaugcuagucacacccucaauggcaaugcguugcgucggaauaggaucgagagacuucguugaaggguugucgggugcaaccugggucgauguaguacuugaacacgguaguuguguaacaaccauggcaaaagacaaaccuacuuuggauaucgaauuacucaaaacagaggugacuaacccugccguauugagaaaauuguguauugaagccaaaauuaguaacacaacgacagacagucgcugccccacccaaggagaggcuacguugguugaagaacaagacgcaaacuucguuugucgacgaacauucguagaccgugguuggggcaaugguugugggcuguuuggcaaaggcucucuaauuacuugugcuaaauuuaaauguguaacaaaacuugaaggaaaaauaguucaauaugaaaaucuaaaauacucagucauaguaacgguacauacgggggaccaacaccaaguugggaacgagucaacugaacauggaaccacagcaacuauaacuccacaggcucccucuacugagauccaauuaacugacuauggcgcauuaacauuggauuguucuccaagaaccggucuggacuuuaaugaaaugguccuauuaaccaugaaagagaaaucuugguugguacauaaacaaugguuucuggaucuaccacucccauggacaagcggcgcaucuacuucacaagaaaccuggaaccgccaagaucuauugguaacauuuaaaacagcccaugcgaaaaagcaggaaguagucgugcuuggcucacaagaaggugcgaugcauaccgcacuuacuggggcuaccgaaauacagaccucagguacaacgacuauuuuugcaggucaucuaaaauguagauuaaaaauggauaaacuuacgcuuaaaggaaugaguuauguaauguguacgggauccuuuaaauuggaaaaagaagucgcagagacgcaacauggaacaguguuagugcaaaucaaauaugaggguacugaugcgccauguaaaauuccauucagcacgcaagacgaaaaaggugugacucaaaacgguagauugauuacggccaauccgauaguaacagacaaagaaaaaccugugaauauagaggcagagccuccauuuggugaaucauauauaguaauaggcguuggagagaaagcccuaaaacucucaugguuuaagaaaggaagcucaauaggaaaaauguuugaaacaacagcacguggugcccgacgaauggcaauauuaggugacacugcgugggauuuuggaaguauaggugguguauuuacaaguguagguaaguuaguacaucaaauuuucggaacagcauacgguguacuauuuucaggcgugagcuggacgaugaaaauaggaauagggguacugcuaacaugguuagggcuuaauucccguucgacauccuuguccaugacuugcauugcggucgggcuaguuacccuuuaucuuggcgugaugguucaagcagauaguggcuguguaauuaacuggaaaggucgcgaacuaaaguguggcucgggcauuuuuguuacaaaugaaguacauacauggacagaacaauacaaauuccaggcugauucgccaaaacguuuaagcgcagcaauagguaaagccugggaagaaggaguuugcgggauacgguccgcuacuagauuggaaaauauuauguggaagcaaauuucuaaugaguugaaucacauucuacucgaaaacgauaugaaauuaacaguaguaguuggcgacguagccggaauacuagcacaaggaaagaagaugauucgaccucagcccauggaguacaaguacagcuggaaaaguuggggaaaggcaaagauaaucggggcggauguucaaaauacaacauuuaucauugacggcccaaacacaccugaaugcccagacgaucagagggcuuggaacauuugggaaguagaagauuauggguuugggauuuucacaacuaauauaugguuaaaauuaagagauagcuauacgcaaguuugugaucacagacuuauguccgcggcuauuaaggacagcaaagcuguucacgcugauaugggcuacuggauugaguccgagaaaaacgaaacuuggaaguuagccagagcuucguuuaucgaaguaaaaaccuguauuuggccaaaaucacauacccuguggaguaacggaguacuagaaucggaaaugauaauaccaaaaauauacggagguccuauaucacaacacaacuaccggccggguuauuuuacacaaacagcaggucccuggcaccuaggcaaauuagaacuugauuuugaucuaugugaaggcacaacggugguaguagacgagcacugcggaaacagggguccaagccuaagaacaacaacgguuacuggcaaaauaauacacgaaugguguugucgaucguguacgcucccuccacuaagauuuaaaggagaggacggguguugguacgguauggaaauacgaccaguaaaagagaaagaagaaaaccuagucaagucgaugguaucagcaggaucgggagaaguagacuccuucagcuuggguuuacuuugcaucucaaucaugauagaagaagucaugaggagccguuggagucguaaaaugcuaaugacugguacacuggccguauuuuuccuuuuaauaaugggccaacuaacuuggaaugacuuaauuagacuguguaucauggucggagcaaaugcgucugaccgcaugggaaugggcacgacauauuuagcucugauggcaacauuuaaaaugagaccgauguucgcaguaggucuauuguuuagacgacuaacaucacgagagguacugcuacuaacgauugguuugagucuagucgcuagugucgaguugccaaauucucuugaggaauugggagacggcuuagcuaugggaauaaugauauuaaaacuguugacagacuuccaaagccaucaacuaugggcuacgcuucuuaguaugacguuuauuagaacgacguuuucauugcauuaugcuuggaaaacuauggcaaugguguuaucaauuguaucauuguuuccauuaugccugucgacuacuucacagaaaacuacuuggcugccuguccuucuagguagucuggguuguaagccauuaacaauguuucucauagcggaaaacaaaauuuggggaaggaaaucuuggccuuuaaaugagggaauuauggcgguggggaucgucucaauucuguuaucuucuuugcucaaaaaugauguaccguuagcgggaccucuaaucgccggugggaugcuaauagcgugcuauguuauuaguggaagcucagcagauuugucauuagagaaagcagcaguuguaagcugggaagaggaagcagaacauucgggagcaagucauaauauuuugguugaaguucaagaugacggcaccaugaaaauaaaagacgaagaacgcgaugauacacuuaccauccuccuuaaagccacucuccuagcaguuuccgguguauauccacuuuccauaccagcaacacuuuuuguaugguacuucuggcaaaagaagaagcaaagguccggaguacugugggauacuccaagucccccggaaguagagagagcuguauuagacgacgggaucuaucgaaucaugcaaagaggacuacucggacggucacaggucggaguaggugucuuucaagagaauguuuuccauacgauguggcauguaacacguggagccguauuaauguaccaagggaaaagauuggaaccuagcugggccuccgucaagaaagaucuaauaucuuaugguggcggguggagauugcaaggauccuggaacacaggugaggaaguccaagucaucgcugucgaaccagguaaaaaccccaaaaacguacaaacugcgccugguacuuuuaagacuucagaaggagaaguaggggcuauagcgcuggacuuuaaaccagguaccagugggagcccaauaguuaaucgugaaggaaaaguaguuggucuguacggcaacgguguaguaacaacaagcggaacuuauguuagcgccauugcacaggccaaagcaucacaagagggaccacugccugaaauagaagacgaaguauuuagaaaacguaaccuaacaauaauggaccugcauccaggaaguggcaagacuagaagauacuugccagcaauugugagggaggcaauaaagcgaaaacugagaacacuaauacuagcuccuacaagaguagucgcaucagaaauggccgaagcacuaaaaggaaugccuauacgauaucaaaccacagcaguaaagucagaacacacgggaaaagaaaucguugauuuaaugugucaugcuacguuuacgaugaggcuguugagucccguacgaguaccaaacuacaacaugauaaucauggaugaagcacauuuuacugauccaucuuccauagcagcacguggguauauaucaaccagaguuggaaugggagaagcagccgcgauuuuuaugacagcaacaccucccgggucagucgaagcauuuccccaauccaacgccguaauacaagacgaagaacgcgauauuccagaaagaucuuggaacucuggauaugaauggauaacggauuuuccgggaaaaacagugugguucgugccgucgauaaaguccgggaacgacauagccaacuguuuacggaaaaauggaaaaagaguaauacaauuaucuaggaagacauucgauacugaauaucagaaaaccaaaaacaacgacugggauuacguagugaccacagauauaagugaaaugggggcaaauuuuagagcggauaggguuauagaccccaggagaugccuaaaaccgguaauuuuaaaagacggucccgagaggguaauacuugcuggaccaaugccuguaacaguggcuagugcagcccaacgacgagguagaauuggccgaaaccauaauaaggaaggagaucaauauauauauaugggucaaccacuaaacaaugaugaagaccaugcacauuggacggaggcgaaaaugcuacuagauaacauuaacacaccggaggguaucauaccagcguuauucgaacccgaaagagagaaaagcgcugcaauugauggagaauacagacuaagaggcgaagcgcguaaaacuuucguugaacuuaugcgaagaggggauuuaccaguauggcucaguuauaagguagcaucagaaggauuucaauacucagaucgaagaugguguuuugacggugagcgaaauaaucaggugcucgaagaaaacauggacguagaaauuuggaccaaagaaggcgagagaaagaaauuaagaccuagaugguuggacgccagaacguauucugauccuuuagcauuacgagaguuuaaagaguucgcugcaggaaggagaucgguuucuggagaucugauacuugaaauuggcaaauugccacaacaucuuacacaaagagcucaaaaugccuuagacaaccuaguaauguuacauaauagcgaacaaggagggagagccuauaggcaugcuauggaggagcuuccagauacaauugaaacauugaugcuuuuagcguuaauugcgguauuaacgggcgggguaacuuuauucuuucuuucaggucgcgggcuuggcaaaacgucuauaggucuacucugcguuauggcaucaucaguccuccuguggauggcuucaguagaaccccauuggauugcugcaucuauuauauuggaguucuucuuaaugguuuuguuaauaccugaacccgacagacagaggacuccacaagauaaucaauuagcguaugucguaauuggucuacuuuuuaugauacuaacaguagcagcuaaugagaugggauuacuggagacaacgaagaaagauuuaggcaucgggcauguggccguggagaaccaucaucacgcugcgaugcuagauguggaucugcacccagcuagcgcuuggacucucuacgcaguagcgacaacaauaauaacuccaaugaugagacacacuauugagaacacuacugcgaauauuagccuuacagcaaucgcaaaccaagccgccauacuaaugggauuagacaaaggcuggcccauuucaaagauggauauaggagugccacuacucgcacuugguugcuacagccaaguaaauccccuuacacuaacagcugcagugcuuauguuaguggcacauuacgccaucauuggaccuggguugcaagcaaaagcaaccagagaggcacaaaaacgaaccgcggcuggcaucaugaagaacccgacuguugacggaauuguagcuauugacuuagauccaguaguauacgaugcaaaauucgagaagcaacuaggacaaauaaugcuuuuaauccuuuguacuucacaaauucucuuaaugagaacaacuugggcauuaugugaaaguauaacacuugcuaccgguccgcuaacaacgcuaugggagggaagcccuggcaaauuuuggaauacaacuauagcaguguccauggcuaauauauuucggggauccuaccucgccggagccgguuuggccuucagccucaugaaaucacuaggaggugggcgccgugggacaggggcgcagggagaaacguuaggagagaaauggaaacgccaauuaaaucaauuaaguaaaagugaauuuaauacuuauaaacgaucagggauaauggagguagaucgaagcgaagcuaaagaaggauugaaaaggggagagacuacuaaacaugcuguuuccagaggcacagcaaaauugagaugguuuguugaacgcaaucugguaaaaccagagggcaaagugaucgaucuaggaugcgguagaggggguuggucguauuacugugcaggucugaaaaagguuacagaagucaaagguuacacaaaaggugggcccgggcacgaagaaccaauaccuauggcaacuuauggcuggaaccuugugaaauuacauuccggaaaagauguauucuucauuccaccugagaaaugugauacacuauuaugugacaucggcgagucgagcccaaaccccacaaucgaggaaggccgcacacuaagaguucuaaagaugguagaaccuuggcuacgagguaaccaauuuugcauuaagauacugaacccauauaugccuucuguuguagaaacuuuagaacagaugcaaagaaagcauggugggauguuagugaggaauccccucucaagaaauagcacccaugagauguacugggugucauguggcacuggcaacauuguuucugccgucaauaugacuucaagaauguuauuaaacagguuuacaauggcucaucguaaaccaacauacgaaagagacguagacuuaggagcagguacacgucauguugcaguggaaccugaaguggcaaaucucgacauuauugggcaacgcauagagaauauuaagcaugaacacaaaagcacuuggcacuaugacgaagauaacccguacaaaacaugggcauaucauggaucguaugaaguaaaaccgucaggaagcgcuucuuccauggucaaugguguugugaaacuuuuaacaaagccuugggacguaauaccgaugguuacucaaauagccaugacagauacgacccccuuuggacaacaaagaguauucaaagaaaaaguagacacaaggacuccaaaggcuaagagagguacagcccagauaauggaagugacagcuaaauggcuguggggauuuuugucaaggaacaagaaaccaaggauaugcacaagggaggaauuuaccaggaaaguacguaguaacgcggcaauuggagccgucuucguagaugaaaaccaauggaauagcgcuaaagaggcggucgaagaugaaagauuuugggaccuaguucacagggaaagagaauuacauaaacaagguaaaugugcgacuugcguguacaacaugauggguaaacgcgagaagaaauuaggagaauuuggcaaggccaaagguaguagagcaaucugguauaugugguuaggagcgagauuuuuagaguuugaggcauuggguuucaugaaugaagaucacugguuuucaagagaaaauucuuuaagugguguagaaggagaagggcuccauaaacuaggguauauucuaagggauauaaguaaaauaccaggaggcaauauguaugccgaugauacagcuggaugggacacuagaauuaccgaagacgauuuacaaaacgaagcgaaaauuacagacaucauggagccggaacaugcacuccuggccaaaaguauauuuaagcugaccuaccaaaacaagguaguaagaguucagcgaccagccaaaaacgguacuguaauggaugucauaucuaggagagaucaaagagggucaggacaaguaggaacguacggucuaaacacauucacaaauauggaagcccagcuaaucaggcaaauggaaucggagggaauauuuucacccucagaacuugaaacuccaaaccuggccggacgcgcgcuggacuggcuagaaaagcaugguguagaacgguuaaaaagaauggccauaucaggcgacgacugugucguuaaaccuauagaugaccguuuugcaacugcuuuaacggcucuaaaugacauggguaaaguaaggaaagacauaccucaaugggaaccaucaaaagguuggaaugacuggcaacaggucccauucuguucacaucauuuucaucagcuuauaaugaaagauggacgggagauuguaguaccuugucggaaucaagaugagcuaguaggacgugcuaggguaucacagggagcaggauggucauuaagagaaacagcgugccuggguaagaguuacgcucagauguggcaacuuauguacuuucaccguagagacuuacgacucgcggcgaaugcaauuuguagugccguuccaguggauuggguuccaacaucaaggacgacuuggucuauacacgcacaucaucaauggaugacaacagaagauaugcucaguguguggaauagaguuuggaucgaagaaaacccauggauggaggauaagacgcauauaucguccuggggugauguacccuaccuaggaaaacgggaagaucaauggugugguucauugaucggcuuaacggcaagagcaacaugggcgacuaacauucaaguugcaauaaaccaaguaaggagauuacucgguaacgaaaacuauuuagauuacaugacaaguaugaaacguuuuaagaacgaaucugacccugaaggagcauuaugguaa

SEQ ID NO: 21873 - RNA, 9882 nt, Artificial Sequence
  derived and/or modified CDS sequence (opt6) from DENV-1__JF937615__SS-prME
ucuguuacgaugcuacuaauguuaaugccuacagcauuagccuuucaccuaacuacaagagguggugaaccccauaugaucgugucgaaacaggaaagggggaaaucacuauuauucaaaacuucagcugguguaaacaugugcaccuuaauagcaauggaccuaggggaauucugugaagauacgaugaccuauaaaugcccucgcauaacagaagcugagccagacgacguagauuguugguguaacgcgaccgacacauggguaacauacggaacauguucucaaacaggugaacauagaagagauaaacgauccguagcauuggcgccacacgucggauuaggacuagaaacacguacagaaacguggauguccucugaaggagccuggaaacaaauacaaaggguagaaacuugggcacuucgacacccuggauuuaccguaauagcuuuauuuuuggcccacgccauaggaacuucuauuacucaaaaggguauaauauucauauuacucauguuagucaccccuucgauggcaaugcgauguguaggcauaggcucaagggauuuuguagagggacuuagcggagcgacaugggucgauguuguauuagaacaugggaguuguguaacaacuauggcaaaagauaaaccaaccuuagacauagaacuccuuaaaacagaaguaacagauccugcgguacuaagaaaacuauguauugaggcaaaaaucaguaauacuacuacggacagucgaugcccaacgcaaggggaggcuacauuaguugaagaacaggaugcuaauuuugugugucgaaggacguucguugaucguggcuggggaaacggauguggucuauuuggaaaaggcaguuuaaugacaugugcaaaauucaaaugcguaacaaaauuggaaggcaaaauuguucaauacgaaaauuugaaguacucggucauagucaccguccacacgggagaucagcaucaaguaggaaacgaaucgaccgaacauggaacgacagcaacuaucacuccccaggcacccuccacagaaauacaacucacagauuauggcgcccucacacuugacugcucaccacguaccggccuugacuucaaugaaaugguauuguugaccaugaaagaaaaaaguugguuggugcacaaacaaugguuuuuagaucugccucuccccuggacaaguggagcgucaacaucccaagagacauggaaucgaaaggacuuacuuguaacuuuuaaaacagcgcacgcaaaaaaacaagaaguagucguucuuggcagccaagaaggagccaugcacacagcauugacaggugcaacggaaauacaaaccagcgguacaacaacuaucuucgcuggacacuuaaaguguaggcugaaaauggauaaacuuacacugaagggcauguccuauguaauguguacagacucauucaaauuagaaaaagaaguagcggagacacagcacggaacaguucuaguucagauuaaguacgaaggaacagacgcuccauguaaaauaccauucagcacacaagacgaaaaaggagugacacaaaauggucggcuuaucacggcaaauccaauugucaccgacaaggaaaagccaguaaacaucgaggcugaaccuccuuucggagagucguauaucgucauuggggcaggagaaaaggcacuuaaacugagcugguucaaaaaaggaaguucaauugggaagauguuugaagcuacagcucgaggagcaaggagaauggcaauauuaggugauacagccugggauuucggaucaauuggaggaguauuuacaucaguugguaaauuaguccaccaaauuuuuggcacagcuuacggaguuuuguucucagguguguccuggacaaugaaaauaggaauuggagucuuauuaacaugguuagggcuuaauucgcgaaguaccucgcucaguaugacauguauagcgguagguuuaguaacgcuauacuuaggaguuauggugcaagcugacagugguugugugauaaacuggaagggucgagagcuaaaauguggaaguggaaucuuuguaaccaaugaaguccacacuuggacagaacaauauaaauuucaagccgauucuccaaaaagauuaucggccgcgauugggaaagcuugggaggaaggcguuuguggcauucguuccgcaacuagauuggaaaacauuauguggaagcaaauuaguaaugaacuuaaccauauauugcuugagaaugauaugaaauuuacagucguagucggugacgucgcuggaauauuggcacaagguaaaaaaaugauaaggccucaaccaauggaauauaaauauagcuggaaaucuugggguaaagccaaaaucauaggcgcagauguccaaaauacuacuuuuauuauagauggacccaacacaccagaauguccagaugaucaaagagcauggaauauaugggagguggaggauuacggguuugguauuuuuacgacuaauauauggcuuaagcugagagauaguuauacucaaguuugugaccaccgacuaaugucugcugccauaaaagauaguaaagcgguacacgcugauaugggauauuggauagagucugagaaaaacgaaacuuggaaacuagcgcgugcgucauuuauugaaguaaagaccuguauuuggccaaagucucauacuuuguggucuaacggaguuuuagagagugaaaugauaauacccaaaauauacgguggacccauaucucaacacaacuacagaccaggauauuucacacagacugccggaccuuggcaccucgguaaacuagaacuugauuuugaucuaugcgaggguacgacggucguaguugaugaacauuguggcaauagagggcccucccuucguacuacaacagucacaggaaagauaauucaugaauggugcugccguucauguacauuacccccgcucagauuuaaaggagaagaugguuguugguacggaauggaaauccgaccaguaaaagaaaaagaagaaaaucucguaaagucaaugguaagugcaggcaguggagaaguugauuccuuuagucugggauugcuauguaucucaauuaugauagaagaagugaugagaucucguuggagcagaaaaauguugaugacgggcacacuagcaguguuuuuucuuuuaauaauggggcagcuuacguggaaugaucuaauacgacuaugcauaaugguuggagcaaaugcaagugaucguaugggaaugggaacgacauaucuggcuuuaauggcuacuuucaaaaugaggccaauguuugcggugggacuacuuuucagacgguugaccagucgagaaguauuacuauuaacaauaggacuaagccuaguugcuucuguugaauugccaaacaguuuagaagaacuuggagauggacuugcgaugggaauuaugauccuaaaauuacuuauagauuuucaaagccaucaacugugggcaacucucuuaagucuaacuuuuauaaaaacaacuuucuccuuacauuaugcguggaaaacgauggccauggugcuaaguauugugagccuauuucccuugcugccagugcacgaucucccuaagaagacaacgugguugccuguauuacuagguagccuaggguguaaacccuuaaccauguuucuaauagccgagaauaagaucuggggccgaaaaucguggccucucaaugaaggaauaauggcagugggcauaguuaguauuuuacuaagugcucuguugaagaacgacguuccgcuagcugggccguugauagcuggugguaugcugauugcgugcuaugugauuagugguucuuccgcagaucugagcuuagaaaaagcggcagagguuucaugggaagaggaagcggaacauaguggggcuagucacaauauacugguggaaguacaggaugacggaacgaugaaaaucaaggaugaggaacgagacgacacuuuaacgauauuacuaaaagcaacacuacuagcugucuccggcguauauccccuuucaauaccugcuacacuguucgugugguauuuuuggcaaaaaaaaaaacaaaggucugguguauuaugggauacgccaucaccaccagagguagaaagagcgguacuggaugacgggauauacagaauuaugcaaagaggacuccugggccgaagccaaguuggaguuggaguguuccaagagaaugucuuucacacaauguggcacguaaccagaggggcaguucucauguaccagggcaaacgucuugaaccgagcugggcaaguguuaagaaagaucuaauaagcuaugggggaggcuggagacuucaagguucuuggaauaccggagaggaaguucaaguaauagcaguggaaccaggaaaaaacccuaagaauguccaaacugccccuggcacguuuaagacaagugagggagaagugggggcgauugcacuugacuuuaaaccgggaaccucuggaagcccaaucguuaaccgcgaaggcaaaauaguaggauuauauggaaaugguguggugacuacuucgggaaccuauguaagugccauugcucaggcaaaagcgagucaagaggguccucuccccgaaauagaagacgaaguuuuccgaaaaagaaauuuaacuauaauggacuuacacccuggcucugguaaaacuagaagguauuuaccugcgauuguaagagaggcaauaaagaggaaguugcgaacccuuauauuagccccaacuaggguaguagcaucagagauggcggaagcacuuaaagguaugcccauccgguaucaaacaacagcuguaaaaucagaacauacuggaaaggaaaucguagaccuaaugugucacgcaacauuuacuaugcgccuauuaucaccuguaaggguaccaaauuauaauaugauuauaauggacgaagcacauuuuacggacccaucaucuauagcagcuagaggauacauuaguaccagaguugguaugggugaagccgccgccauauuuaugacugcaacaccuccuggaaguguugaagcuuuuccacagucaaaugcuguuauacaagaugaggaaagagauauuccagaacgaaguuggaacaguggcuaugaguggauaaccgauuuuccuggcaaaacagucugguucguuccuucaauaaagagcgggaaugacauagccaacugccuaagaaaaaacgggaaacgaguuauucaacucucucgcaaaacauucgauacugaauaucagaagacaaagaauaaugauugggacuaugucgucacuacagacauaucggaaaugggugcaaauuucagagcugaccguguaaucgacccgagaaggugcuuaaaaccaguaauacuaaaagacgguccagagagaguaauucucgcaggcccaaugccagucacaguugcuuccgccgcacaaagaaggggacgcauuggacgaaaccacaauaaagaaggagaccaauauauauauaugggucaaccacucaauaacgaugaagaucacgcccauuggacugaagcgaaaaugcuauuggauaauauaaauaccccugaaggaauaauuccugcacuauuugagccagaaagagagaaaagugcggcaauagauggcgaauaucgacugcguggugaagcgaggaagacguucguagaguuaaugcgcagaggagaccuaccugucuggcuaucuuauaaaguagcaucggaagguuuucaauauagugauagacguuggugcuuugauggagaaagaaacaaccaagucuuggaagagaauauggacguagaaauuuggacaaaagaaggugaaaggaagaagcucagaccacgauggcucgaugcuagaaccuacagugacccacuugcucucagggaauucaaagaauuugcagcaggaagacguucgguaucaggagaucucauauuggaaauaggaaaauuaccacaacacuuaacgcagagggcacaaaaugcauuagacaacuuagugauguugcacaauagugaacaagguggaagagcguauagacacgcaauggaagaacugccagacacaaucgaaacgcuuauguuuuuagcacuuauugcaguacugacaggaggaguaacuuuauucuucuuaucaggaagaggauuagguaagacauccauuggguugcuuugugucauggcgaguucaguauuacuauggauggcgucgguagagccccacuggauagcagccagcauuauauuagaguucuuucuaauggugcugcuaauuccagaaccugauaggcaaagaacuccacaggacaaucaacuugcauaugugguuauugguuuauuauucaugauucuaacuguagcggccaaugaaauggguuuacuggaaacaacuaaaaaagaccugggaauaggucauguagcaguagaaaaucaucaucaugcugcaaugcuugaugucgauuuacauccugccucugcuuggacucuauacgcuguagcaaccacaauaaucacaccgaugaugcgacauacgauagagaauacgacagcuaauauuaguuuaacugcuauagcuaaccaagcagcuauccuaauggguuuagauaaagguuggccaauaagcaaaauggauauagguguuccuuugcuggcacuagguugcuauagucagguaaacccauuaacuuuaacagcagcagucuuaaugcuaguugcccauuaugcaauaauuggaccgggcuuacaagccaaggcgaccagagaagcacaaaaaagaacagcagcgggaauuaugaaaaacccaacuguugaugggauaguagcaauagaccuggauccaguaguauaugacgcaaaguuugagaaacaauuaggccaaauaaugcuacuaauacuguguacaucacaaauucuauuaaugagaacuacaugggcacuaugcgagaguauaacuuuggcaacugggccacuuaccacacuaugggaaggcagccccgguaaauuuuggaauaccacaauugcagucucaauggcgaacauauuucgagggaguuaucucgcgggugcagguuuagcauuuucucucaugaaaucuuuaggagguggaagacgaggcaccggagcccaaggagagaccuuaggugagaaauggaagagacaauugaaccaauuaucuaaaagugaguucaauacauacaagagaagcggaauaauggaggucgaucguucagaggcaaaagagggacuuaagcgaggggaaacuacaaaacaugcuguaucucgcggaacagccaaauuaaggugguuuguugagagaaacuuaguuaaaccggagggaaaaguaauugaccuuggguguggaagaggcggauggucauauuacugcgcaggacuaaaaaaaguuaccgaggugaaaggguauacaaaaggagguccaggucaugaagaacccauaccuauggcaacauacggauggaacuuagucaaacuacauucuggaaaagacguauuuuuuaucccucccgagaaaugcgacacacuucucugugauaucggagaaucuuccccaaacccuaccauugaagaagguaggacgcuaagaguacugaaaaugguugaaccuuggcuaaggggaaaccaguuuugcauuaaaauucugaauccguauaugccgagcguggucgagacacuagagcagaugcagcguaaacacggcgguaugcuugugcgaaaucccuugagccggaauaguacgcaugagauguauuggguaagcuguggcacuggaaauauaguuucggccguuaauaugacuucacggauguuacuuaaccgguuuacaauggcacacagaaagccgacauaugaacgugacguagacuugggggcaggaacgcgacauguagcaguugagccagagguagccaaucuagacauaauuggacaaaggauagaaaacauaaagcaugagcauaaaagcacauggcacuacgaugaagacaaucccuacaaaacgugggcuuaucacggcucauaugagguuaaaccaucuggcucugcaagcucaauggugaacggaguuguuaagcuacucacgaaaccuugggacguaauacccaugguuacacaaauugcgaugacagauacuacaccguuuggucagcaacgaguguucaaggaaaaggucgauacacguacuccuaaggccaagcgcggcaccgcucaaaucauggaaguaacagccaaauggcuauggggauuuuugucgagaaacaaaaaaccacguauuuguacgagggaggaauuuacaagaaaaguaagaucaaaugcagcuaucggugcaguguucgucgaugaaaaccaauggaacucagcaaaagaagccguagaagaugagagguucugggaucucguacaucgagagagagaauuacacaaacaggguaaaugugcuaccuguguguacaauaugaugggcaagagagaaaaaaaauuaggcgaauuuggaaaagcaaaaggaagcagagcaaucugguauaugugguuaggagcucgauuccuggaauuugaagcucucggguuuaugaaugaagaucauugguuuuccagggagaauagucuuagcgguguagaaggugaggggcuacauaaacuugguuacauauuaagagauauuaguaaaauucccggugguaacauguacgcagacgauacagcugguugggacacacgaauaacugaagaugaccuucaaaaugaggcgaaaauuacugauauaauggaaccggaacaugcuuuacuggcaaaaucaaucuuuaaacuuacauaucaaaauaaaguaguacggguacagagaccugcaaagaaugguacuguaauggauguaauaucacgaagagaucaacgcggcucugggcagguuggaacguaugguuuaaacacuuuuacuaacauggaggcucaacugauccggcaaauggaaagugaaggaauauuuagcccuuccgaacuggaaacacccaaccucgcaggaagaguacucgacugguuagaaaaacauggaguugaaagauugaaacggauggcaauaucaggagaugauuguguuguaaagccuauugacgaccgauucgccgcggccuuaacagcucugaacgacauggguaaaguaagaaaagacauuccgcaaugggaacccagcaaaggauggaaugauuggcaacagguccccuucuguagccaucauuuccaucaacuuauaaugaaagauggucgggaaauuguaguaccaugucgaaaccaagaugaacuugucggacgagcucgcgugagucaaggugcaggauggagucuaagagaaacagcaugucuaggcaaaucuuaugcgcaaauguggcaacucauguauuuucaucguagagauuuaaggcuggcggcaaacgcaaucuguucugcagucccgguugauugggucccaacuagccgaacuacauggucaauccacgcacaccaccaauggaugacaacagaggacaugcuuaguguauggaaucgaguauggauagaagagaauccuuggauggaggauaaaacacacauaucaucauggggggacguuccuuaucuaggcaaacgugaagaucaaugguguggaucgcuaauuggguugacugccagggcaacgugggcaacaaauauacaaguugcgauuaaucagguacggaggcucauagggaaugaaaauuaccuugacuauaugacaaguaugaaaagauucaaaaaugaaucggacccugaaggagcuuuaugguag

SEQ ID NO: 21874 - RNA, 9879 nt, Artificial Sequence
  derived and/or modified CDS sequence (opt6) from DENV-1__GU131814__SS-prME
agcgugacaaugcuguuaaugcuaaugccaacagcacuugcguuucaccuuacuacacgaggaggagaaccacauaugauuguaagcaaacaagagagaggcaaaaguuuauuguuuaaaacgagcgcgggcguaaacaugugcacguuaauagccauggaccuaggugaacuaugcgaagacacaaugacauacaaaugcccacguauuacagaaacugagccugacgauguggacuguuggugcaacgcaacugacacuuggguuacauacggaaccuguagucaaacaggugaacauagacgagacaaaaggucugucgcuuuagcgccacauguuggacuuggcuuagaaacgcggacggaaacguggaugagcagcgaaggagcauggaaacaaauucagaggguagagacgugggcacugagacacccuggauuuacaguaaucgcuuuauuucuggcacaugcaauaggcacaaguauaacucaaaaagggauaauauuuauucuacuuaugcuaguuacaccuuccauggcuaugagaugugucggaauugggucccgugauuucgucgagggauugagcggagcaacguggguagauguaguccuagaacaugguaguugcgugacaacgauggccaaagauaaacccacguuagacauagagcuauugaaaacagagguuacuaaccccgcaauuuuaagaaagcucuguauagaagcaaaaauaucgaauacaaccacggauaguagauguccgacgcagggagaagcaacucugguggaagaacaagaugcgaauuucguuuguagaaggacuuucguugaucgugguuggggcaauggaugcggacuauucgguaaagggucgcuuauuacaugcgccaaguucaaauguguaacuaaauuggaagggaaaauaguacaguaugaaaaucuaaaguacucgguaauuguaacaguacacacaggagaucagcaucagguggguaacgagucuacagaacaugguacuaccgcuaccauaaccccacaagcacccacaacugaaauacagcuaaccgauuauggcgcauuaaccuuggauuguagccccagaacaggauuagauuucaacgaaaugguauuguuaacgaugaaagaaaagucgugguuagugcacaaacaaugguucuuggauuuacccuugccguggacgucaggugccucaacaagccaagaaacuuggaauaggcaagaucucuuagucacauuuaaaacagcacacgccaagaaacaggaaguuguaguauuagggagucaagagggagcaaugcauacugcgcugacaggagcaacugaaauacaaaccuccggaacaacaacaauuuuugcgggacacuugaaauguagauugaagauggauaaauuaacauugaaagguaugucguacgucaugugcacaggaucuuucaaacuggaaaaagagguagcugagacgcagcacggaacggugcuuguacagauaaaauaugaaggcacugacgcaccuuguaaaauacccuucucaacccaagaugaaaaaggcguaacgcaaaauggccgacuaaucacugcuaacccaauaguaacagauaaagagaaaccgguuaauauagaagcugaaccgcccuucggagaauccuauauaguaauuggugccggcgaaaaagcacuaaaacuaagcugguucaaaaagggguccucaauuggaaaaauguuugaagcaacagcucgaggugcaagaagaauggcaauauuaggagauacagcaugggacuucgguucuauugggggagucuuuacaucagucggcaaguugguccaccaaaucuuuggaacugcguaugggguauuauucucaggagucucauggaccaugaagauaggaaucggagugcuauuaacuuggcucggacuaaauucaagaagcacaagccuaaguaugacguguauagcagugggacucgucacucuauaucuuggagucaugguacaggcggauuccggguguguaauuaauuggaaagguagggaguugaaaugcgggucugguauuuucgucacaaacgaaguacauacuuggacagagcaguauaaguuucaagcagacucuccaaaaaggcugucagcugcuauuggaaaggcuugggaagaggguguuugcggcauacguagugcaacgaggcuagaaaacauuauguggaagcaaauaaguaacgaauugaaucauauauuauuagaaaacgacaugaaauucaccguugugguuggcgacguagcggggauuuuagcacaagguaagaaaaugauaagaccacagccuauggaauacaaguacaguuggaaaucuuggggaaaggcuaagauuauaggagcugacguucaaaauacaacguucauaaucgauggccccaauacaccagaauguccagaugaccaaagagccuggaacauuugggaagucgaggauuauggauucgguauauucaccaccaauauaugguuaaaacuaagggacagcuauacacaagugugcgaccauagauuaaugucagcugccauaaaagauucaaaggcaguucacgcugauaugggauauuggauugaauccgaaaagaaugaaaccuggaaauuggcaagagcuucauucauugaggucaagaccuguauauggccaaaaagucauacucuuuggucaaacggaguacuugaaucagaaaugauaauccccaaaaucuauggaggaccuauuucucaacauaauuaccgcccaggguauuucacucaaacugcaggaccauggcauuuagguaaauuggaacuggacuucgacuuaugugaagggaccacaguaguaguagaugaacauugugguaaucgugggccuagccuuaggacaacaacaguaacugguaaaauuauacaugagugguguugucggucuugcacuuuaccacccuuacgguucagaggugaagacggcuguugguacgguauggaaauaagaccgguaaaagaaaaagaagaaaaccucgucaaaagcaugguaucagcuggaaguggcgaagucgauuccuucucucucggauuacuguguaucaguaucaugauagaagaagucaugcgcucacguuggucaagaaaaauguugaugacaggaacccuagcaguguuccuucuucucauaaugggacaauuaacauggaaugacuuaauaagauuguguaucaugguuggagcuaaugcuuccgacaggaugggaaugggaacuacuuauuuagcucuaauggcaacauucaaaaugcgacccauguuugcuguuggacuacucuuucguagacuaacaagccgugaaguacuacuauuaaccaucggguugagccuaguagcuucaguagaacuacccaacucgcuggaggaauugggugauggcuuagccauggguauuaugauauuaaaauugcucaccgauuuccagucccaucaacuuugggcuacucuguuaucccuuacguuuauaaaaacuacuuuuucauugcauuaugcauggaaaacgauggcaaugguguugaguaucgucucucucuuuccauugugcuugaguacaaccagucagaaaacgaccugguuaccaguacuacuggguagucuagguuguaagccacuaacuauguuccugauagcugaaaauaaaauauggggaagaagaaguuggccccugaacgaaggaauaauggcuguaggaaucguaagcauacuuuugucaagccuauugaaaaaugacguuccacuagccggaccauugauugcuggcgguaugcuuauagcauguuacguaauuucugggagcucagcagaccucagcuuagaaaaagcugcagaagugaguugggaagaagaagcggaacauagcggagccagucacaacauauuaguagaaguacaagacgacggcacuaugaagaucaaagaugaagaacgagacgacacucucacaauauugcugaaagcaacacuccuugcaguuucaggggucuacccacugagcauaccggccacacuuuucguuugguacuuuuggcaaaagaagaaacaaagaagcggaguuuugugggauaccccaucaccuccugaagucgagcgcgcuguacuagacgaugggauauaccgaauuaugcagagaggucucuuaggaagaucacaagucggagugggaguuuuucaagagaacguuuuucauacgauguggcauguaaccagaggugcuguucucauguaucaggguaagcgauuagaacccucaugggcaucuguuaagaaagauuugauaagcuauggugggggcuggagacuacaaggaaguuggaauacaggugaggagguucaagucaucgcgguagagcccggaaagaaucccaaaaaugugcagacaacacccggaacuuuuaaaacgccagaaggagaaguuggggcaauugcucuugacuucaagccaggcacaucaggaaguccaauagucaacagagaaggaaaaauagucggacuauauggaaacggcguaguuacuaccagcggcaccuacgucagugcuauagcacaagcuaaagccucucaagaaggacccuugccugaaauugaagaugaaguuuuccggaaacguaaucuaacaaucauggaucuccauccgggauccggcaaaacaagacgauaucuaccagcuauaguaagagaagcaaucaaaaggaaacuucgcacucuuauccuugcucccacucguguaguggcaagcgaaauggcagaagcccuaaaaggaaugccaauucgcuaucagaccacggccgugaaauccgagcacaccggcaaggaaauagucgaucuaaugugucaugcaacuuucacaaugagauuauuauccccuguaaggguuccaaacuauaauaugauuauuauggacgaagcucacuuuacagaucccucaucaauugcagcccgaggcuauauaaguacacgaguugguaugggcgaagcugcagccauauucaugacugcaacuccacccggaucaguagaggccuuuccccaaaguaacgccgucauacaagaugaagaacgggauaucccugaaaggucauggaacucagguuaugaauggauaacugacuucccugguaagacuguaugguuugugcccaguaucaaaucaggcaaugauauagcaaauugucuaagaaagaacgguaaaagaguaauacaguuaaguaggaaaacauucgauacggaauaucagaaaacuaaaaauaacgauugggauuaugucguaacgacggauauuagugaaaugggcgcaaauuucagggccgacagggugauugauccacgaagauguuuaaaacccgucauauuaaaggacggcccagaaagggucauacuugcuggaccaaugccugugacgguagcuagugccgcacaaagaagaggaagaaucggccggaaucacaauaaggagggugaucaauacauauacaugggacaaccccuaaauaaugacgaagaccacgcucacuggacagaggcuaaaauguuacuggacaacauaaauaccccagaagggaucaucccagcucucuucgagccagaacgagagaagucagcugcaaucgacggagaauaucgucuacggggagaggcgagaaaaacuuuugucgaacuaaugagaagaggggaccucccaguuuggcuaucauauaaaguugcgucugaagguuuucaauacucggauagaaggugguguuuugacggggaacgcaacaaucaggucuuggaagaaaacauggauguugaaauauggacaaaagaaggugaaaggaagaaacuucguccaagauggcuggacgcucgaacauauucugaucccuuggcauuacgcgaauuuaaagaguucgcagcgggucgcagaucgguaagcggagacuuaauauuagaaaucggaaaacuuccgcagcaccuaacgcaacgagcacaaaaugcgcuugacaaucuuguaaugcugcauaacagugaacaaggagguagagcguaucgacaugccauggaagaauuacccgauacuauagagacguuaaugcuacuugcucugauagccguuuuaacagguggcguaacgcucuuuuuccuaucagggaggggucuagggaaaacaaguauuggauugcuuugcguuauggcuucgucagugcuccuauggauggcgaguguggaaccacacuggauugcagcaaguaucauauuagaauuuuuccugaugguucuuuuaauaccugaaccugaucgccaacguacuccacaagauaaucaauuggcauauguuguuauaggguugcuauucaugauauuaaccguggccgccaaugaaaugggacuucuagagacgacaaagaaagaccuuggcauaggacauguagcaguuggaaaccaccaucacgccgcgaugcuggauguagauuugcacccagccucagcauggacauuguaugcugucgccacaacaaucauaacaccuaugaugagacacacaauagaaaauacgacggccaacauuagucuuacagccauagcaaaccaagcugcgauauuaaugggguuggauaaagguuggccuauaagcaagauggauauaggcguaccauuacucgccuuagguuguuauucgcaaguuaauccacuaacgcuuaccgcagcuguccuaaugcuagucgcccauuaugcuauaauagggccuggucuacaggcuaaagcuacacgggaagcacagaaaagaaccgcagccggaauaaugaaaaacccuacgguugaugggauuguugcgauagaucuagacccuguaguauacgacgcuaaguuugaaaaacagcugggccaaauaaugcuuuugauauuaugcacaagucagauucuacuaaugagaaccacgugggcauugugugaaaguauuacuuuggcaacuggaccgcugacaacccugugggaggggucaccugggaaguuuuggaauacuacuauagcagucucgauggcaaacauauucagaggcagcuaccucgcgggcgcaggauuggcauucucacucaugaaaucauuaggcggcggaaggcggggaacaggagcgcaaggagagacacuaggugaaaaguggaaacgucaacugaaucagcuaucaaagucagaguuuaacacauauaaaaggaguggaauaauggaaguagauagaagcgaggcaaaagagggauuaaaaagaggcgaaacuaccaagcaugccguaucacgggggacagcuaaacuacgaugguuuguagagcggaaucugguaaaaccagaagguaaaguaauagacuuaggaugugggcgagggggauggucauauuauugugcaggucucaagaaaguaacagaggugaaagguuauacaaagggaggcccuggccaugaggaaccgauaccgauggcaacauacggauggaaucugguuaagcuacacucaggcaaagacguauucuuuauaccaccagagaagugcgauacacuuuuaugcgacauuggugaaagcagucccaauccaacuauagaagaagggcggacacuuagaguuuugaaaaugguagaaccaugguuacgaggcaaucaauucuguaucaaaauccuaaauccuuauaugccuagugucguagagacacuagagcaaaugcaaagaaaacauggaggaaugcuagucagaaauccacucucaagaaauucuacccacgaaauguacuggguaucauguggcacaggcaauauaguuucagccguaaauaugacaaguagaauguuguuaaacagauucacaauggcacaccgaaaaccuacguacgaacgggauguagaucuuggagcaggaacgcgacauguagcugucgaaccagagguagcaaacuuagacaucauagggcagagaaucgaaaauauuaaacacgaacaugaaucaacuuggcacuaugaugaagauaauccauauaaaaccugggccuaucauggcucguacgaagugaaaccaaguggaucggcaagcagcaugguaaauggagugguaaagcuguuaacuaaaccuugggauguuauaccaaugguaacccaaauagccaugacggauacgacgccuuuuggucaacaaagaguuuuuaaggaaaagguggauacuagaacaccgaaagcaaagcguggcacugcacaaauaauggaggugacugcaaaguggcuauggggauuuuugagcagaaauaagaaaccaagaauauguacaagagaggaauuuacgagaaaagugagaaguaaugcugcaauaggagcaguuuuuguagaugaaaaucaauggaacucugcuaaagaggcggucgaagaugaacgcuucugggauuuaguucaccgagagagagaguugcauaaacagggaaaaugugcgacgugcguuuauaauaugaugggaaaacgugagaagaaacuaggugaauuuggcaaagcuaaaggcagccgcgcgauaugguauauguggcugggggcgagauuucucgaauuugaggcccucggauuuaugaaugaggaucauugguuuucacgagaaaauucacuuucuggaguagaaggugagggauuacacaaguuagguuacaucuuaagggauaucaguaaaauaccgggagguaauauguaugcugaugauaccgcaggaugggauacaagaaucaccgaggacgauuuacaaaacgaggcucgcauaacagauauaauggaaccagaacaugcauuacuagccaaaucaauauuuaaguuaacauaucagaacaaaguuguacguguucagcgaccagcgaaaaaugggacaguuauggauguaauaaguagacgagaucaaagaggaaguggacagguaggcacuuacggcuugaauacauucacaaauauggaagcgcaacugauuaggcagauggaaucugaaggaauuuucagucccucagaacuggaaacgccaaauuuggcagaaagaguuuuagacugguuagaaaaauauggcguagaacgucugaaaagaauggcuauaucuggugaugauugugucguaaaaccuauagacgauagguucgcuaccgcucuuaccgcucuaaaugacaugggaaagguacgaaaggacauuccucaaugggaaccaaguaagggguggaaugacuggcaacagguuccauuuugcagccaccacuuucaucaauuaauaaugaaagacggcagagaaauugucguaccuugccgaaaucaagacgaauugguagguagagcacggguuucucagggagcgggcuggagucucagagaaacagccugccuuggaaaaucauacgcacagauguggcaacuaauguacuuucaucgucgagauuuaagauuagcggcuaacgcaauaugcuccgccguacccguugauuggauuccgacaaguagaaccacaugguccauacacgcucaucaccaauggaugacaacugaggauaugcugagcguauggaaccgaguauggauagaggagaauccauggauggaggauaaaacacacauaucaucauggggugacguuccuuaucuaggcaaacgugaggaccaaugguguggauccuuaauaggguugacagcucgcgcuacaugggcuacaaacauacaaguugcaaucaaucagguaaggcgauugauagguaacgaaaacuaccuagacuacaugacaagcaugaagagguucaaaaacgagucagacccugaaggggcucuuugguga

SEQ ID NO: 21875 - RNA, 9879 nt, Artificial Sequence
  derived and/or modified CDS sequence (opt6) from DENV-1__GU131815__SS-prME
agcgugacgaugcuccucauguuaaugccuacggcacuugcguuucaucugacaacccgaggcggugaaccucacaugauuguaaguaaacaagaaagagguaaaaguuuacuauucaaaacaagugcugguguaaauauguguacccuaauagcaauggaucuuggugaauuaugugaagauacaaugacauauaaaugcccgagaauaacugaaaccgaacccgacgauguugauugcugguguaaugcuacugauacauggguaacauacggcacauguucacaaacgggggaacaucguagagacaaaagaaguguggcacucgcaccgcauguaggacuaggcuuggaaacaagaacagaaacuuggaugaguucagaaggagcuuggaaacaaauacaacguguagaaaccugggcuuuaaggcaucccggauucacagucauagcauuguucuuagcgcaugcaauaggaacgagcauaacacaaaaaggcauaauauuuauacugcugauguuagucacgccaucuauggcuaugagaugugucggaauugguucgagggauuucgucgaagguuuaucaggagcaacauggguugauguaguguuggaacacgguuccugcguaacuacaauggcaaaagacaaaccaacauuggacauugaauuacuaaaaacugagguuacaaacccagcaguucuaagaaaacuauguaucgaagcuaaaauaucaaacacuacuacggacucaagauguccuacccagggagaagcaacauuaguugaagaacaagaugccaacuuuguaugcaggcgaacuuuuguagauaggggauggggaaaugguugugggcuauucgggaaaggcucucuaauaacaugcgcuaaauucaaauguguuaccagacuugaggggaaaauaguucaauaugagaauuuaaaauauagcguaaucguaacaguccacacuggugaccagcaucagguuggaaaugagucuacagaacauggaacuacagcaacaaucacaccacaagcuccaaccacugaaauucagcucacggacuauggagcguuaaccuuagacuguucuccaaggaccggucuagacuucaacgaaaugguccugcucaccaugaaagagaaaagcuggcugguccacaagcaaugguucuuagacuugccuuuaccuuggaccucgggcgccaguacuagccaagaaaccuggaacaggcaggauuuguuagucaccuuuaaaaccgcucaugccaagaaacaagagguggugguauuaggcucacaagaaggcgccaugcauacagcauuaacgggagccacugagauacagacaucgggaacuaccacgauuuuugcggggcauuuaaaaugucguuuaaaaauggacaaauuaacacuuaaggguauguccuacguaauguguacgggaaguuucaaguuagaaaaagaaguggcggagacacaacacgguaccgugcuaguucagaucaaauacgaagguacagaugcaccaugcaaaauaccauuccuaacucaagaugagaaagguguaacacagaacggaagacuaauuacagccaacccuauaguaacugacaaagaaaaaccugucaauauugaggcugaaccgccuuuuggcgaaucauauauaaccauaggugcgggugagaaggcacucaaauuaucaugguucaagaaaggaucuaguauuggaaagauguuugaagcaacugcaagaggagcccggaggauggccauauuaggagacacagcuugggacuucggaagcaucgguggaguguuuacaucaguaggaaagcucguucaucagauauuuggaacagcuuacggaguacuuuuuagcggcguuucuuggacgaugaaaauaggcauuggaguuuuauuaacaugguugggucucaacucucggaguacaucuuugucaaugacgugcauugccguagguuuaguaacucuguaucuaggcgucaugguacaagccgacuccgguugcguuauaaacuggaaaggaagggaacuaaaaugcgguagcggaaucuucguuacaaaugaaguucacacuuggacggagcaguauaaauuucaagcggacucaccaaaaagacuuucugcagcgauagguaaggcuugggaggaagggguuuguggcauaagaucugcaacgcgacuagaaaacauaauguggaaacaaauaaguaaugaacuuaaccauauccuucuugaaaaugacaugaaguucacaguaguaguaggugauguagcuggcauucuugcacaggggaagaaaaugauacguccucagccaauggaauauaaguauucauggaaauccugggggaaggcuaaaauaauaggagcggauguucaaaacaccaccuuuauaauagacggacccaauaccccagaaugcccggaugaccagagagcguggaauauaugggaaguugaagauuacggauucgguauauuuacaacaaacauauggcuuaaacucagagauucauauacacaaguuugugaucacagacuuaugagcgcggccauuaaagauuccaaagcgguacaugcagacaugggauacuggauugagucagagaaaaaugagacauggaaguuagcacgcgccucauuuauagaaguaaagacauguauauggccuaagucgcauacauuauggucaaacggaguauuagaaucagaaaugauaauaccaaaaauauacggcgggccaauaucacagcauaauuauaggccagguuacuuuacccaaacagcagggccuuggcacuuggguaaacuugaauuagauuucgaccugugugaaggaacgacuguaguuguugaugaacauugugguaauaggggacccucacugcguacuacaacgguuacaggcaagauaauacaugagugguguugcagaucaugcacacuuccucccuuaagguuucggggagaagacgguuguugguauggaauggaaauucgcccagugaaagaaaaagaagaaaaucuaguaaagaguaugguaagugccggaucgggggaaguagacaguuucagucuuggauuauugugcauaucgauuaugauagaagaagugaugagaucacgauggucgaggaaaaugcugaugaccggaacacuugcagucuucuucuuacuaauaauggggcaacuaacguggaaugauuuaauccgauuauguauaaugguaggggcaaacgcaucugacaggauggguauggggaccacauaucucgcacucauggcaacauuuaaaaugaggccaauguuugcgguuggacuauuauuccgacgauuaacuucaagagagguccuccuguuaacgauuggacuaucauuaguugcuucgguugaacucccaaacucacuugaagaacucggggauggauuagcuaugggcauaaugauucuuaaauuacuaaccgauuuccaaucccaucaauuaugggcuacacuucugagcuuaacauuuauuaagacaacauucagucuccacuacgccuggaaaacaauggcgaugguccuaaguauuguuucucuauucccacuuuguuuaucuacuacaucacagaaaacuacuugguuacccguucuccuaggaucccuugguuguaagccguugacgauguuuuuaauagcugaaaauaaaauauggggcaggagauccuggccauuaaaugagggcauuauggcugucggaauuguuucaauauuauuaucuucauuguuaaagaaugacguuccucuagcuggaccacucauagcuggugggaugcucauugcuuguuaugucauuagcgguaguagugcugaucuaucacuagaaaaagcagcagaaguaucaugggaagaagaggcggagcacucuggggccagucacaauauccuaguagaaguacaagaugacggaacuaugaaaauuaaagaugaagaaagagacgauacucugacuauuuuauuaaaagcgacacuacuugcugcaucgggaguguauccccuuucaauuccagcuaccuuauuuguaugguauuucuggcagaaaaagaaacagagaucagggguucucugggacaccccaaguccuccggaaguugaaagagcuguccucgaugacggcaucuaucgaauuaugcaaagggggcuuuuagguaggucccaaguuggaguaggagucuuccaggaaaacguauuucacacuauguggcauguaacaagaggugcugugcuaauguaucaggguaaaagacuagaacccucuugggcuaguguuaagaaagaccuuauaucauauggggguggauggagacuucagggcagcuggaauacuggagaagaagugcaaguaauugcgguugaaccagggaaaaauccaaagaacguacaaacagcgccuggaacauucaagacacccgaaggagaagucggcgcaaucgcacuugacuucaagccuggcaccucaggauccccuauagucaaucgagaaggaaaaauuguugguuuauacgggaacgggguaguaacgacaaguggcaccuauguguccgcuauagcacaagcuaaagccagucaagaaggaccauuaccagaaauugaagacgaagucuuuagaaaaagaaauuugacuaucauggacuugcauccaggcucaggcaaaacccgacguuaccuaccagccauuguccgagaggcaauaaaaagaaaacuaaggacacuaauccuggcuccuacuagggucguagcuucagagauggcggaagcccuuaaaggaaugccuauaagguaccagacaaccgcagugaaaucagaacauacgggaaaggaaaucguagaucuaaugugucaugcaacauuuaccaugagauuacugaguccuguacguguaccuaacuauaauaugauuauuauggaugaggcccauuucacugaucccucuucaguagccgcucguggcuauauuucuacaagaguggguaugggugaagccgcugcaauuuuuaugaccgcuaccccgccuggaucgguagaagcauucccucaaucaaacgcugugauacaggaugaggagcgagacauucccgaaaggaguuggaauagugguuacgaauggauaacugacuuuccaggaaaaacgguaugguucguuccaaguauuaaaucagggaacgacauagcuaacuguuuaaggaagaaugguaaaagagucauacaauuauccagaaaaacuuuugacaccgaauaucaaaagacuaaaaauaacgacugggauuacguaguaacuacagacauaagcgagaugggagccaauuuucgcgccgaccguguaauagacccaaggaggugcuuaaagccagucauauuaaaagacgguccggaaagaguaauucuugcagggccuaugccggucacggucgcuucggcggcacagcggcgcggaagaauuggucgcaaucacaauaaagaaggugaccaauauauauacaugggucaaccucugaauaaugaugaggaucaugcccacuggacugaagcaaaaauguuauuggacaacaucaauacaccugagggaauuauucccgcacuauuugaaccagaaagagagaaaagcgcagcaauagacggcgaguauagacuacggggugaagcgagaaagaccuuuguugaauuaaugagaaggggugaccuaccaguuuggcuaaguuauaaaguugcgagcgaaggcuuccaguauuccgacaggagaugguguuuugauggagaacgaaauaaucaaguacuagaagaaaacauggauguugaaauuuggacgaaagaaggcgaaaggaagaaauugaggccgagguggcuagaugcaagaacauacucggacccacuugcgcuaagggaauuuaaagaguucgcagcgggucgacguucaguuagcggagacuuaauacuagagauugggaaacuuccccagcauuuaacgcaaagagcacagaaugcacuggacaaccugguaaugcuccacaauagcgaacagggaggccgagcguaccgucaugccauggaggaacuaccagauacaaucgaaaccuuaauguuauuggcgcugauugcaguccuaacgggaggcguaacccuauuuuuccuuagcggacgcgguuuaggaaagacaaguauaggucuacuuugugucauggcaucaagugucuuguuauggauggcuucaguugagccgcacuggauagcggccagcaucauucuagaguucuuccucaugguucuauugauaccagaaccagauagacaaagaacaccgcaagacaaucaacuugcauacguggucauaggucucuuguucaugauauuaacugucgcagccaaugagauggggcugcuagagacuacuaagaaagaucuagggauaggacacguagccgcugaaaaccaucaccaugcugcgauguuagauguagaucuccauccugcuagugcuuggacguuguacgcuguugccacuaccauaauuacgccgaugaugagacauacaauugaaaacaccacugccaauaucagcuugacagcuaucgccaaucaagcggcaauucuaaugggacuagauaaaggauggccuauaagcaaaauggauauuggaguaccucuacuagcucuuggcugcuacagucaaguaaacccacuuacucucacagcugcaguuuuaaugcuaguagcgcauuaugcgauaauaggacccggauuacaagcgaaagcaacgcgugaagcgcagaaaagaaccgcggcagguauuaugaaaaacccgacaguagauggaauuguggcuauagacuuggauccugucgucuacgaugcgaaauuugaaaaacaacuaggccaaaucaugcuauuaauauugugcaccucacaaauacuacucaugagaacaacgugggcucugugugaaaguauaacacuagccacaggacccuuaaccacucugugggaaggcagcccaggaaaguuuuggaacacuacaauagcggugucaauggcaaauaucuuccgaggaagcuacuuggccggagcaggucuagcauucucguuaaugaaaagucuaggaggggguagacgcgguacaggagcacaaggcgaaacgcuaggagaaaaauggaagcggcaacuuaaccaacugucaaaaagcgaauuuaacacauacaaaagaucggguauuauggaaguagauaggagcgaagcaaaagagggccugaagagaggugaaacaacaaagcacgccguuaguaggggcacagcaaaguuacgcugguucguggagcguaaccugguaaaacccgaaggcaaaguaauugaccuagguugcggacggggcggaugguccuauuauugcgccggcuugaaaaagguaacggaagucaagggguauacuaaaggggguccgggccaugaagaacccauaccaauggccacuuauggauggaaucuggugaaguuacacagcggaaaagacgucuuuuucauacccccagaaaaaugcgauacacuuuuaugugacauuggugaauccucaccaaacccaacgauagaagaaggacguacucugcgaguacugaaaaugguugagccuugguuacgugggaaucaauucuguauaaagaucuugaacccauauaugccgagcguaguagaaacacuagaacagaugcaacgaaaacacggcggaaugcuaguacgcaacccguuguccagaaacaguacucacgagauguauuggguaucauguggcacgggaaauauaguauccgccgugaacaugacaagcaggaugcugcuaaauagauucacaauggcccauagaaagcccaccuacgagagagacguagaucuaggagcaggaaccagacacgucgcagucgaaccagagguugcuaauuuagauauaauaggacagaggauugaaaacauaaaacacgaacauaaaucuacuuggcacuaugaugaagacaauccauauaaaacuugggcauaucauggaagcuacgaaguaaaaccaucagguuccgcaucuagcauggugaacggggugguuaaauuauuaacuaaaccuugggauguaauuccuaugguuacucaaauagcaaugaccgacacaacacccuuuggucaacagagagucuucaaagaaaagguggauacgagaacacccaaggcaaaacgagguaccgcccagauaauggagguaacagcgaaaugguuauggggauuccucucaagaaacaagaaaccaagaauaugcacaagagaggaguucacuaggaaaguaagaucgaaugcugcaauuggagcugucuucguagaugaaaaccaauggaauagcgcaaaagaagcaguugaagaugagagauucugggaucucguucaucgagaacgagaguuacacaaacaagguaaaugcgcuacauguguauauaacaugaugggcaaacgcgaaaagaaacuaggggaguucggaaaagcaaagggcucacgcgcuaucugguauaugugguuaggcgcuagauuuuuagaauuugaagcacucggauuuaugaaugaagaucacugguuuaguagagaaaauucauuaaguggcguagagggagagggcuuacauaaauuaggauacauuuuacgugacaucucaaaaauaccugguggaaacauguacgccgaugacacugcugggugggauacccguauuacggaagaugaccugcagaaugaggcaagaauuaccgauauaauggaaccagaacaugcauuauuagccaaaagcauuuuuaaacuuaccuaucaaaacaaagucguaagaguccaacgaccggccaaaaaugggacuguuauggaugucauaucaagacgggaucaaagaggaucaggacaaguaggaacauauggucugaauacuuuuacaaacauggaggcacaauuaauucgccagauggaauccgaaggaauauucucaccaucagaacuugaaacaccaaacuuggcagagcgagugcuagauuggcuagaaaaauauggaguugaaagguuaaagagaauggcaaucuccggcgaugauugugucguaaagccaauagacgauagauuugcuacagcccuaaccgcccuaaaugacauggguaaaguuagaaaagauauuccccaaugggaaccaaguaagggauggaaugauuggcaacagguaccauucugcagccaccauuuccaucaguugauuaugaaagacggacgcgaaauagugguuccguguagaaaccaagacgaguuagugggacgcgcaagagugucccaaggcgcaggauggucguuacgugaaaccgcuugucugggcaaaaguuaugcacaaauguggcaacucauguacuuucacaggagggauuugcgacuugcagcaaaugcgauaugcagugccguaccaguugacuggaucccgacaucgcgcacaacuugguccauccaugcacaucaccaauggaugacuacagaagauaugcuauccguuuggaauagaguuuggauugaagaaaauccuuggauggaagauaaaacacacauuucaaguuggggugacguccccuaucuggguaaacgagaagaucaguggugugguagccuaauaggacuaacagcucgugcuacaugggcaacgaauauccagguagcgauaaaucaagugagacgucucauugguaacgaaaacuacuuggacuauaugacaucaaugaaaagauuuaagaaugaaagugacccagaaggagcuuuaugguaa

SEQ ID NO: 21876 - RNA, 9879 nt, Artificial Sequence
  derived and/or modified CDS sequence (opt6) from DENV-1__GU131818__SS-prME
ucgguaacaaugcuuuuaaugcuuaugccuaccgcauuggcauuucacuuaacuacaagaggaggagaaccgcacaugauuguuucaaaacaagaacgagguaaaucguugcuauucaaaacauccgcaggaguaaacauguguacuuuaauagcaauggaccuuggggaguucugugaagauacuaugacguauaaauguccaagaauaacggaagccgaaccggacgauguagacuguugguguaaugcuacggacaccuggguaacuuauggaacauguucacaaaccggagaacaucgacgcgauaaaaggucuguagcuuuagcuccucacgucggauuaggacuugaaacccguacugaaacauggauguccuccgaaggagcauggaaacaaauucaaaaaguugaaaccugggcauuacggcacccaggauuuacuguaauagcucucuucuuagcccacgcuauagggaccucuauaacccaaaaaggaauaauuuuuauuuugcuuauguugguaacaccaagcauggcaaugagauguguagggauaggcuccagagauuuuguagaaggucucaguggggcaacauggguagauguggucuuagaacaugggucguguguuaccacuauggcgaaagacaaaccaacguuagacauagaacugcuuaaaacagaaguuacaaauccugcaguucugagaaaacuuuguauagaagcgaaaauaagcaacacaaccacggacucgagguguccgacucaaggagaagcgacauuaguggaagaacaagaugccaauuucgugugucgacggacguuuguugauaggggaugggggaauggauguggucucuuuggaaaaggcagcuuaaucacaugugcuaaauuuaaauguguuaccaaacuggaagguaaaacuguucagcaugaaaauuuaaaauauucagugauugugaccgugcacacgggagaucaacaccaaguuggaaaugaaucaacggagcauggaacuacagcuacuauaacaccucaagcacccuccacugaaauacaauugaccgauuacggugcccuaacauuagauugcagcccucguacuggauuagacuuuaacgagaugguucuuuuaacaaugaaagaaaaaucauggcuggugcauaagcaaugguuuuuagaucuucccuuacccuggacauccggggcaucaaccucccaagaaacauggaaucguaaagaucuccugguaacuuucaaaacagcgcacgcaaagaaacaggaagucguaguccuaggaucucaagaaggagcuaugcacacugcauugacuggcgccacugaaauacagacauccgguacuaccacgaucuucgcuggucaccuaaaauguagacucaaaauggauaaguuaacacuaaaaggaacaaguuaugugauguguaccggaucuuucaaauuggagaaggaaguagcagaaacacaacaugguacaguccuaguucaaauaaaauaugaggguacugacgcccccuguaagauaccuuucucaacucaagaugaaaaaggaguuacacagaauggucguuuaauaacugcuaauccgauaguuacugacaaggagaaaccugucaacauagaagcagagccacccuuuggugaauccuauauaguaauaggcgcaggagaaaaagcauugaaauuaaguugguuuaagaaagguucaucuauagggaaaauguuugaagcuacagccagaggcgcacggagaauggcuauccugggagacacagcgugggacuucgguaguauaggcggaguauuuacaucaguagggaaauugguacaccagaucuucgguacugcauauggaguuuuauucagcggugugucauggacaaugaagauuggaauagguguccuuuuaaccuggcuagggcucaacagcaggagcacaucgcuuucaaugaccuguauugcagucggccucguaacacuauacuugggaguaaugguucaagcugauagcggaugcguaauaaacuggaaagggcgagagcugaaguguggcuccggaauauucguaacaaaugagguccauaccuggacagaacaauauaaauuccaagcagauuccccuaaaagacugucagcggcgauuggcaaggcaugggaggaaggaguauguggaauaagaucggccacacggcuugaaaacauuauguggaaacaaaucucaaaugaguuaaaccauauauuacuagaaaacgacaugaaauucaccgucguaguaggcgacguagccgguauauuagcacaaggcaagaaaaugaucagaccgcaaccgauggaguauaaauacucauggaagucuuggggcaaggcuaagauaaucggugcagauguacaaaacacaacauuuauaauagacggucccaacacucccgaauguccggacgaccaacgggcauggaauauaugggaaguagaagacuacgguuuuggaauauuuaccacaaacauuugguuaaaacuuagagauagcuacacucaaguuugugaucaucgccuaaugucagcggcaauaaaagacuccaaagcaguucaugcugauaugggauacuggauugaauccgaaaagaaugaaacuuggaaacuggcaagagcaucauuuauagaagucaaaaccugcauuuggccuaagucacauaccuuauggaguaacgggguuuuagaaagugaaaugauaauucccaaaaucuacggcggaccaaucagccaacauaacuaucgaccaggauacuucacucaaaccgcuggaccauggcauuugggcaaauuagaacuugacuucgaccuaugcgagggaacuacuguuguaguugacgaacauuguggaaauagaggacccucauugagaacgaccaccguuaccgguaagauaauacaugaaugguguugccgcaguuguacucuuccaccgcucagauuuaaaggcgaagacggauguugguacggaauggagauuagaccugucaaagaaaaagaagaaaaccuugucaaaucaaugguaagugcgggaagcggggaaguugacucauuuucucuuggccuacuauguauuaguauaaugaucgaagaagugaugcgcagccgauggagcagaaaaauguugaugaccgguacgcuugcgguuuucuuucuguuaauaaugggucaauuaacuuggaaugaucuuauucgacuauguaucaugguuggcgcaaacgccucugauagaaugggaauggggacgacuuauuuagcguuaauggcaacguuuaagaugagaccaauguucgcgguuggcuuacuuuuuaggagacuuaccucacgcgaaguccuucuacucacuauaggcuuaaguuugguagcaaguguagagcugcccaauagccuagaagaauugggcgacggccuagcaaugggaauuaugauacuaaaguuguuaacagacuuucaaagccaucaauugugggcgacuuuacuuucguugacuuucauaaaaaccacuuuuucucugcauuaugcauggaaaacaauggcgaugguacuuagcaucguaaguuuauucccacugugucuaucgaccacaucucagaaaacuacaugguuacccgugcuccucggcucauuaggauguaaaccucuuacaauguuucucaucgcagagaauaaaaucuggggacgaaaaucuuggccacuuaaugagggaauaauggcugucggcauuguuucuauccuguuaagcucacuccugaaaaaugauguaccacuggccgguccgcucauagccggagguauguuaauagcauguuacguuauaucgggaaguuccgccgaccuaucauuagaaaaagcagcagagguuucaugggaagaggaagcggaacauagcggcgccagccauaauauacuggucgaagugcaagacgaugguacaaugaaaaucaaagacgaagaaagagacgacacacuaacaauauuacuuaaagcuacacuacuugcgguaagugggguuuaucccuuaucuauaccagcaacccuauuugucugguauuuuuggcaaaagaaaaagcaaagguccgguguacuaugggacacaccaucgccacccgaagucgaaagagcaguacuugacgacgguauauaccguauuaugcagagaggacuauuagggagaagucaagucggaguagguguuuuucaagaaaacguguuccauacuauguggcauguaaccagaggugcaguuuuaauguaccaaggaaaaaggcuugaaccaucaugggcaaguguuaagaaagaucuuauuuccuauggaggagguuggagacuucaagggaguuggaacacaggagaagagguacaggucauugcuguggagccaggcaaaaaucccaaaaauguacaaacugcccccggaacauucaaaacaagugaaggugaggucggggcaauugcccuagauuuuaagccugguacaaguggaagucccauuguuaauagagagggaaagauaguaggauuauaugggaacggagugguaacaaccagcggaacuuauguuucggcuauagcccaggcgaaagcaagucaagaagggccuuuaccggagauugaggaugaaguuuuucggaagcguaaucuaacaaucauggaccugcacccgggaucagguaaaacccgucguuacuugccagcaauagugcgcgaagcuauaaaaagaaaacuaagaacauuaauuuuagccccgacaagagugguugcaagugagauggccgaagcacuaaaaggcaugccuauaagguaccagacuacugccguaaaaucugaacauaccgggaaagagauugucgaucucaugugucacgcaacauucaccaugagauuacuuucaccaguucgagucccuaacuauaauaugauaaucauggaugaggcccauuucacggaccccagcagcauagcagcuaggggauauauaucaacaaggguaggcaugggugaagccgcugcaauauuuaugacugcgacaccuccaggaucaguagaagcauuuccgcaaucuaaugcaguaauacaagaugaagaaagagauauaccugaacgaucauggaauagcggauacgaauggaucacggacuuccccgggaagaccguuugguuuguaccuaguauuaagucagggaaugauaucgcaaauugucuuaggaaaaaugggaaaagaguuauacaauuauccaggaagacuuucgacacagaauaccagaaaacuaaaaauaacgauugggauuacguaguaacgacagauauuucugaaaugggugccaacuuuagagcugaucgaguaauagauccgcggcgauguuuaaaaccuguuaucuuaaaagacggaccagaaaggguaauucuugccggccccaugccaguaacuguagcaucagcagcucaacgaagaggucgcauaggucgaaaucauaauaaagagggcgaccaguauauauauauggggcaaccgcucaauaacgacgaggaccacgcccauuggacugaagcaaaaauguugcuggauaacauaaacacccccgaaggaauuauaccagcccucuuugaaccugagcgugagaaaagugcggcaauagacggugaauauagacuacgaggugaagcucguaaaacauucguagagcugaugcgacgaggagaucuucccguuuggcuuaguuacaaaguugccucagaaggauuucaguauagugaucgaagauggugcuuugauggagaaaggaauaaccaaguacucgaagaaaacauggacguugaaauuuggaccaaggagggcgaaaggaagaaacuaagaccacguuggcuagaugcgaggaccuauucagauccauuggcauugcgcgaauuuaaagaguucgcugcaggcaggagaagcgucagcggugauuugauuuuagaaauaggcaagcuaccacaacaucuaacacaaagagcacaaaaugccuuagacaauuugguaauguuacacaauuccgaacagggcgguagagcguauaggcacgcaauggaggaauuaccugacacaaucgagacucuuauguuacuagcuuuaauagcaguacuaacaggcggagucacacuguucuuccuaaguggccgcgggcuagguaaaacaucgauuggccuucuaugcguaauggccucuucugcccuauuauggauggcgucugucgaaccacauuggaucgcagccaguaucaucuuagaguucuucuuaaugguauugcuaauaccagaaccggaccgucaacgaaccccacaggauaaccaauuagcauauguagugauaggauugcuauuuaugauuuuaacaguggcggcaaaugagaugggauuacuagaaacuacuaagaaagacuugggaaucggacauguagcaguugagaaccaccaucacgccgccaugcuagacguagaucugcauccugccucagcauggacacuuuacgccguugcaacaacuauaauuaccccgaugaugcgacacacuaucgaaaauacaacagcgaacauaucccuaaccgcuauugcuaaccaggcagcgauacuaaugggucuugauaaaggcuggccuauuucgaaaauggauauaggagucccguuguuagcccuaggaugcuauucacaaguaaacccucuaacauuaacagcugcgguauuaaugcugguggcacacuaugcuauaauuggaccgggcuugcaagccaaagcaacaagggaagcccagaaaagaacagccgcaggaaucaugaaaaacccaacaguggauggaauagucgcaaucgauuuagacccaguaguauaugacgcaaaauuugagaaacaacuaggucagauuaugcuauuaguucuauguaccucucaaauauuacucaugcgcacuaccugggcauuaugugaaucgauuacacuugcuacggggcccuuaaccacuuuaugggaggggagcccuggcaaguuuuggaauacuaccaucgcaguuucuauggccaauauauucagaggguccuaccuagccggcgccagucucgcauuuuccuuaaugaagucuuugggaggagggagaagggguacaggcgcacaaggugaaacccugggagagaaauggaaaagacaacuuaaccagcuaagcaaaucagaguuuaacacauauaaaaggucagguauaauggaaguugaccguagugaagcaaaagaaggguugaaaaggggagaaacaacaaaacaugcagugucucguggaacagcgaaauuacgcugguucguagaaagaaaucuugucaaaccugaaggaaaaguaaucgaucucggcugcggacguggaggauggucauacuauugcgcgggacucaagaaaguaacagagguuaaaggauacacuaaaggagguccuggacaugaagaaccaauacccauggcaacuuauggauggaaucuaguaaaacugcauaguggaaaagauguauuuuucauaccuccagaaaaaugugauacuuuguugugugauauaggagagucuucgccaaacccuacuaucgaagaaggaagaaccuuaagaguuuuaaaaaugguggaaccaugguugcgaggcaaucaauucugcaucaaaauacuaaaucccuauaugccuucaguaguggaaacacuugaacaaaugcaacguaaacauggagguauguugguacgaaacccucucagcaggaauagcacccaugaaauguauuggguaucuugcgguacugguaauauuguauccgccgugaauaugacuagcaggaugcuacuaaacagauucacgauggcacauaggaaaccuacguaugaaagggauguugauuuaggagccggaacccgacacguagccguagagccugaaguugcaaaucuugauauaauaggacaacguauugagaauauaaagcaugaacacaaaucgacauggcacuacgaugaagacaauccauacaaaaccugggcuuaccauggaucuuaugaaguuaagccaaguggguccgcaaguagcaugguaaaugguguugucaaacuucugacaaagcccugggacgucaucccaauggucacacagauagcuaugacagacaccacgccauuugggcaacaaagggucuuuaaagaaaaaguagacacaaggacgccaaaagcaaaacgagggaccgcccagauaauggaaguuaccgcaaaauggcugugggguuuccucucucgaaacaagaaaccucguauauguacacgugaagaauuuacacgaaaaguucguagcaacgcagcaaucggggcaguuuuugucgacgaaaaucaauggaacagcgccaaagaggcuguggaagacgaacgauucugggaucuagugcaucgcgaaagagaauuacauaaacagggcaaaugugcaacuuguguauauaacaugaugggaaaaagggagaagaaacuaggugaguuugguaaagccaaaggcucgcgagcuaucugguauaugugguuaggagcaagguuuuuagaguucgaagcucuaggcuucaugaacgaagaucacugguucagcagagaaaauucacugucaggaguugaaggcgaaggacuacauaagcuaggauauauacuacgggacauuagcaaaaucccaggagggaauauguaugccgaugacacugccgguugggauacuagaauaacagaagaugacuugcagaacgaagcuaaaauaacagauauaauggagcccgaacaugcacuacuggcuaaguccauuuucaaauugacauaccaaaauaagguuguacgcguucaacguccugccaaaaauggcacaguaauggacgucauaucccgaagagaucaaagaggaucagggcaagugggcacguacggauugaacacauucacaaauauggaagcccaguuaauaagacaaauggagucugaggaaauuuuuaguccaagugaacuagagacaccuaauuuagcgggccgaguauuagauugguuggaaaaacaugggguagaacgacucaaaagaauggcgaucucaggcgaugacugcguaguaaaaccuauagaugaucgcuucgcuacugcucuaacagcuuuaaacgacaugggaaaaguaagaaaggacauaccacaaugggaaccgaguaaaggcuggaaugauuggcaacaagucccuuuuuguagucaccauuuucaucaacuaaucaugaaagauggaagagaaauagucguaccaugucguaaucaagaugagcuagugggaagggcgcgcgugagccagggggcuggauggagccuaaaggagacagcuuguuugggaaaaaguuacgcacaaauguggcaacuuauguacuuccacaggagggaucugaggcucgcggcaaacgccauaugcuccgcaguaccuguagacugggugccuacaaguagaacuacuuggucaauucacgcucaucaucaauggaugacuaccgaagauauguuaucaguauggaaucgcgucuggauagaagaaaacccauggauggaagacaaaacacacauaucuucauggggcgacguucccuaucuuggaaaacgagaggaccagugguguggauccuugauuggguugacggcaagggcaacgugggcuacaaacauacagguagccauuaaucaaguacggaggcuuauaggaaacgagaauuaccuagacuacaugaccaguaugaaaagguucaaaaacgaaagcgauccagaaggagcauugugguga

SEQ ID NO: 21877 - RNA, 9879 nt, Artificial Sequence
  derived and/or modified CDS sequence (opt6) from DENV-1__GU131820__SS-prME
agcguaacuaugcucuuaaugcuuaugccaacagcuuuggcauuccacuugacaacgcgaggcggagaaccucacaugauagugacaaaacaagaacgaggcaaaucuuuacuauuuaaaacaagcgcuggaguaaacaugugcacauugaucgcuauggaucugggugaauuaugugaagauaccaugacauauaaauguccacguauaacagaagcugaaccugacgacguagauuguugguguaacgcaacagacacuuggguaaccuaugguacaugcucacagacuggugaacaccgccgcgacaaaagaucaguugcacuugccccacauguuggucuuggucuggaaacgagaacggaaacuuggaugucuucagaaggugcauggaaacaaauacaaagagucgagacaugggcacuucgacauccaggcuucacaguuauagcguuauuccuagcucaugccauagggacauccauaacccagaaaggaaucauauuuauacuucuaaugcuggucacgccaucuauggcaaugagguguguagggaucgguucacgagauuucguagaaggccuaucgggugcaacaugggucgauguggucuuggaacacggauccugugucacgacgauggccaaagauaaaccgaccuuggauaucgaacuauugaaaacugaggucacaaauccagcgguuuuaaggaaauuauguauugaagcgaaaauauccaacacuacaacggauucgagaugcccaacccaaggugaagcuacacuuauggaagaacaagaugcuaacuucguaugccgcaggacauuugucgaccgagguuggggaaacggguguggacuuuucgggaaagguuccuuaauuacaugugcaaaauuuaaaugugucacaaaacucgaggguaaaauagugcaguacgagaaucuaaaauacagcguaaucguaacaguacauacaggagaccaacaccagguaggaaaugaaucuacggaacacggaacaacugcaacaauaacgccacaagcaccgacaucagaaauacagcuuacugacuauggagccuuaacucuugacugcucacccaggaccggucuggacuuuaaugaaaugguacuacuaaccaugaaagagaaaagcuggcuaguccauaagcagugguuuuuagauuugccauuaccguggacaucaggugcuaguacuucacaagaaacauggaacaggcaggauuugcuaguaacauuuaagacagcacacgccaagaaacaggaaguggucguuuuaggaucacaggaaggugccaugcauacagcucuaacgggugcaacagagauucaaacaagcgggacuacaacaaucuuugcagggcacuuaaaauguagacuaaaaauggauaaacucacguuaaaagguaugucauauguaaugugcaccggcucauucaaguuagaaaaagaaguagcagaaacacaacaugggacaguuuuaguacaaauaaaauacgaagggacagaugccccauguaagauaccauuuucaacccaggaugaaaaaggugucacucaaaacggaagguuaauaacagcuaauccuauuguaacggauaaagaaaaaccaguuaauauagaagcugaaccaccuuuuggcgagagcuauaucgucaucggagcaggagaaaaagcccucaagcugucuugguucaagaaaggaaguucuauaggaaaaauguuugaagcuacugcacggggagcuagaagaauggcaauacuaggggauacagcaugggauuucggaucuaucggaggcguauuuaccaguguuggaaaacucgugcaccaaauuuuugguacagcguaugggguauuauuuucuggugugucauggaccaugaaaaucggaauuggaguauuauuaacgugguuaggucucaacucacggucuacgucguugucaaugacuuguauugcaguaggauuagugacguuguaccucgggguuaugguucaagcagauaguggauguguuauuaauuggaaggggcgagaacucaaaugugggagugguaucuuuguaacuaacgagguacauacauggacugaacaauauaaauuucaagcagauucaccaaagaggcuuucagcggcaauuggcaaagcaugggaagaaggaguauguggcauaagaucugcaacccgauuagagaacauuauguggaaacagauuucgaaugaacuaaaccauauauuauuagagaaugauaugaaguuuacaguggucgucggcgaugucgucggcauccucgcacaggggaagaaaaugauacguccgcagccaauggaacacaaauauucauggaaaaguugggggaaagcuaaaauuauuggcgcagauguucaaaacacaacauuuauaauagacggucccaacacuccagaauguccagacgaucagcgcgcauggaauauaugggagguagaggauuacggcuucgggauauuuacuacuaacauaugguuaaaacuaagagacaguuacacucaaguuugugaucaucgcuugaugucugcugccauaaaggauucuaaagcaguucaugcagacaugggcuauuggauugaaagugagaaaaaugaaacuuggaaauuagcucgagcaucauucauugaagugaaaacauguaucuggccaaaaagucauacucuaugguccaauggaguacuggagagugagaugauaauaccaaaaauauauggaggaccaauuagucaacacaacuaucguccgggcuauuuuacacagacugcgggaccguggcaucuggggaaauuggagcuggacuucgauuuaugugaaggcacaacaguagucgucgacgagcauugcggaaauagagguccaucucuucggacgacaacggugacaggaaaaaucauucacgaauggugcuguaggucauguacauugccaccacuacgauucaaaggagaagacggaugcugguacgggauggaaauuagaccaguaaaagagaaagaagaaaaucugguuaagagcaugguaagcgcaggacuaggugagguggacaguuucucacugggauuacuuuguauaagcauaaugauagaggagguuaugcgcucaagauggagucgcaaaauguuaauggcggggacccuugcuguguucuuacuauuaauuaugggacaauuaaccuggaacgauuuaauacggcuaugcauuauggucggugcaaaugcgagugaucguauggguaugggaacgacguaccuggcuuuaauggcuacauucaaaaugcgaccuauguuugcaguuggccugcuuuuuagaagauuaacaaguagagagguuuuacuccuaacaauagggcuaagccugguagcguccguugaacuacccaauaguuuagaagaacuaggggauggacucgcaauggggauaaugaucuuaaaacuucuaacagauuuucaaucgcaucaguuaugggcaaccuuauuaucauuaacauuuauuaaaacgacuuugucgcuccacuaugcguggaaaacaauggccaugguuuuaaguauugucagcuuauuuccgcucugccugagcacuacaucccagaaaacuacaugguuaccgguguuguuagguucacuaggauguaagccgcugacuauguuuuuaauugcugaaaacaagauauggggcagaaaaucauggccguuaaacgaagguauaauggcuguugggguaguaagcauauuauuaucuucacuacucaaaaacgacgucccauuggcgggaccccuaauugcaggagguauguugaucgcauguuacguaauaucaggcagcucugcagaccuuucgcucgagaaagccgcagaagucaguugggaagaggaggcagagcauucgggagccagccauaauauuuuaguggagguucaagaugacggaaccaugaagauaaaggaugaagaacgugacgacacgcugacgauuuuauuaaaagcgacucuuuuagccaucagcggaguauacccauuaucaauuccggcaacuuuauuuguaugguauuucuggcagaagaagaaacaacgaaguggagugcuaugggacacuccuucaccuccagaaguagaacgcgcuguacucgaugacgggauauaucguauaaugcaacggggacuauuagggagaagccaaguuggcguuggcguauuucaagaaaaugucuuucacacuauguggcauguuacuaggggagcuguuuugauguaccagggaaagcgauuagaaccaucaugggccagcguuaagaaagacuuaauaagcuacgggggagguuggagauuacaaggaucauggaauacuggagaagaaguccaaguuauagcuguugaaccgggaaagaacccaaagaauguccaaacugccccagguacauuuaaaacuccagaaggagaaguuggagccauagcacuugauuuuaaaccuggaaccagcggaagcccgauaguuaauagagaagggaaaaucguaggguuauauggcaauggaguaguaaccacgaguggaacauacguuucagcgauugcccaggcaaaagcuagucaagaaggaccacuaccugaaauagaagaugagguuuucagaaaaagaaaccuuacgauuauggaccuacauccugguagcgggaaaacgaggcgauaucugcccgccauaguaagagaggcaaucaagcgaaaacuaagaacccucauucuggcuccuacacgcguaguggcaucagagauggcagaagcguugaaagguaugcccauacguuaucagacaacugcagugaaaagcgaacacacuggcaaagaaauaguugaucuaaugugccaugcuacuuuuacaaugagacuucugucacccguaagaguaccaaacuauaauaugauaauaauggaugaagcgcacuuuacagauccuaguucuauagcagcaagaggguacauaucaacuagaguagguaugggagaagcugccgcaauauuuaugaccgccacaccgccuggcucaguugaagcauuuccucaaucaaaugcaguuauccaggaugaagaacgagauaucccggagcgcucauggaacucaggguaugaauggaucacugacuuuccagguaaaaccguaugguuuguacccagcauaaagucuggcaaugauauagcuaauugucuaagaaagaacgggaaaagagugauccaauuaaguaggaaaacauuugauacggaguaucagaaaaccaaaaacaaugauugggauuauguaguaaccacugauauuagugaaaugggggcuaauuuccgcgccgauagaguaauugacccccgaaggugucuuaaaccaguaauacucaaagauggucccgaacgagucauuuuagcuggcccuaugcccguaacugucgcuagugccgcacaacgcagaggccguauaggaaggaaucauaacaaagaaggggaucaauacauuuacauggggcaaccucuaaacaacgacgaagaccacgcacauuggacagaagccaaaaugcuacucgauaacauuaauacaccugaagggauuauaccugcauuauuugagccugaaagggaaaaaucugccgcuauugauggugaguaucgucuacgcggcgaagcccggaaaacuuuuguugaacuuaugagacgaggagacuugccaguauggcugucauauaaaguugcauccgagggauuucaauacucagaucguagguggugcuucgacggcgaaagaaauaaucaagugcuggaggaaaacauggacguugagauuuggacaaaggagggcgaaagaaagaaacuuagaccuagguggcuagaugcacggaccuacagugacccacucgcauuacgugaauuuaaagaauuugcugcuggacgacgaucuguaagcggagacuuaauacuagaaauuggcaaacucccgcaacauuuaacucaacgagcacaaaaugcuuuagauaaucucguaaugcugcacaauucugagcaaggaggucgggccuauaggcacgcuauggaagaacuacccgacacaauugagacacuaauguuguuggccuuaaucgcaguccugacuggcggaguaacgcuauucuuuuuaucaggaaggggauuaggaaaaaccucaauaggacuacuauguguuauggcuuccaguguucuuuuauggauggcauccguggaaccucacuggauugcggcaucaauuauuuuagaauuuuuccuaaugguauuacuaaucccagaacccgauagacagcgcacgccacaagauaaucaacuagcuuacguaguaauaggauugcuauuuaugauccuaacuguagcugcuaaugagaugggauugcuagaaacuacgaagaaagacuuagguauaggacaugucgccguugaaaaccaucaccacgcaacaauguuagacguagauuugcacccugcuagugcauggacacuauacgcgguagccacaaccauuauaacuccuaugaugcggcauacaauugaaaauacaacagccaauauaagccuuacugcuauugcaaaucaagcagcgauauuaaugggauuggauaaaggcuggccgauaucaaaaauggauaucggaguacccuuacuggcucucgguuguuacagucaaguaaacccguuaacgcuuacugcugcaguacuaauguugguugcucauuacgcgauuauaggaccaggacuucaagcgaaggcaacgagggaagcacagaagagaacggcagccgggauaaugaaaaacccaacgguugauggaauuguagcaauagaucuagaucccguagucuacgacgcuaaauucgaaaaacaauuaggacagauaaugcuacuaauccucugcacuucgcagauuuuacuuaugagaacaacuugggcacuaugugaaucuauuacgcuugcgacuggaccauuaacaacuuugugggaagggucgccgggaaaguucuggaacaccacuauugcaguaucuauggccaauauuuuucgagguagcuaucuugccggggcaggacucgcauucucucucaugaaaagccuaggaggaggaagaagggguaccggagcacaaggagagaccuuaggagaaaaauggaaaagacaacucaaucaacuaucgaaaucagaguucaacauuuacaagaggucaggaauaauggagguggauagaucagaagcuaaagagggauuaaagaggggagaaacaacuaggcaugcaguaagccgugguacugcgaaauuacguugguuuguagaacgaaauuuaguuaaaccagagggaaagguuauugauuuagguuguggaagaggaggguggucuuauuauugugcgggcuuaaagaaaguaaccgaagugaaaggauauacgaaagggggcccgggucaugaggaaccuauaccaauggcaaccuacggauggaacuuaguuaaguuacacucuggcaaggacguguucuuuaccccaccagaaagaugcgacaccuuacuaugcgauauaggagaaucaagcccaaauccuacaauagaagaggggagaacacuaagaguauugaaaauggucgagccguggcuucgaggcaaccaauuuuguauaaaaaucuuaaacccguacaugccguccguugucgaaacauuagagcagaugcaaagaaagcaugggggaaugcucguuaggaauccauugagucguaacucaacacaugagauguauuggguuuccuguggcacgggaaacauagugagugcuguuaacaugaccucaagaauguuauugaacagauucacgauggcacaucgcaagcccacauaugaacgcgacguagaucuuggggcagguacacgacacguagcuguggaacccgaaguagccaaucuggauauaaucggccaaaggauagaaaacauaaagcaugagcauaaaucgacauggcauuacgacgaagacaauccguacaaaaccugggcuuaucacggaaguuaugaaguaaaaccaucuggaucggcuucuaguauggucaacggaguuguaaaauuacugacuaaaccaugggaugucaucccaaugguaacacagauugcuaugacagauacuacuccguucggucaacaacguguauucaaggagaaaguugauaccagaacaccgaaagcgaaacgcggaacagcacaaauuauggaagucaccgcaaggugguuauggggauuuuuaucaaggaauaaaaagccuagaauauguaccagagaggaauuuacccgaaagguuagaaguaaugcagcgaucggggcuguuuucguugaugaaaaucaauggaacucagcaaaagaagcuguagaagacgaacgauucugggauuugguacaaaaagaacgagaguuacauaaacaaggaaaaugcgcaaccugcguguacaacaugauggggaagcgugagaagaaacugggcgaauuugguaaagcaaaggguucccgagccaucugguauauguggcuuggugcacgguuucuagaauuugaagcacucggauuuaugaaugaggaccacugguuuucgagagagaacaguuugucaggaguagaaggagaagggcuccauaagcuaggauacauauugagggauaucucuaaaauuccuggugguaauauguacgccgacgacacagcaggaugggacaccagaaucacggaagaugaucuacaaaacgaagcaaaaauaaccgacaucauggaaccugagcaugcgcugcucgcuacuucuauauucaaauugacauaccaaaauaaagucguacggguucaaaggcccgcaaagaaugggaccguaauggacguaauaaguaggagagaucaacgcggguccggacaggucggaacguaugguuugaacaccuuuaccaauauggaagcucaauuaaucagacaaauggaaagcgaggggauuuuucucccaagugaauuggaaacaccaaauuuagcagaacguguccuggauugguuagagaaacacggggucgaacgcuuaaaaagaauggccauuucuggugaugauugugucguuaaaccaauagacgacagauucgccacugcacuaacugcucuaaaugacaugggcaagguccgaaaagauauaccacagugggaaccuucaaagggauggaacgacuggcaacaaguaccauuuugcagucaccacuuucaucaauuaauaaugaaagacggcagggaaauaguugucccaugucguaaucaagacgaacugguuggcagggcuagggugagccaaggugcaggguggucuuugagagaaacggcuugccucgguaaaaguuaugcacagauguggcaguuaauguauuuccaucgaagagauuuacgucucgcugcaaacgccauuuguagugccguccccguagacugggucccuacuucgagaacaacuuggucaauccaugcgcaucaucaauggaugacgacagaagauauguuaucaguauggaauaggguauggauagaagagaacccauggauggaagauaagacccauguaucuucauggggagaugucccuuaccucggcaaaagagaagaucaaugguguggaagccugaucggauugacagcucgagcaacuugggcuucaaauauccaaguagcgauaaaucaaguaagacgacuuauaggaaaugaaaacuauuuggacuacaugacaaguaugaaaagauuuaagaaugaaggagauccagagggcgccuuaugguga

SEQ ID NO: 21878 - RNA, 9879 nt, Artificial Sequence
  derived and/or modified CDS sequence (opt6) from DENV-1__HM181970__SS-prME
aguguuacaaugcuacuaauguugaugccaacagcauuggcauuccauuuaacgacgcguggcggagaaccccauaugauaguaucgaaacaagaaagaggcaaaucgcuuuuguuuaaaacaucagccggagugaacauguguacauuaauagcaauggaccuuggcgaauuaugugaagacacaaugacauauaaauguccaagaauaacugaagccgaaccggaugacguagauuguuggugcaacgccacugacacuuggguuacauaugggaccugcucccaaaccggagaacaccgaagggacaaaagaucgguggcauuagcuccacacguagguuugggcuuggaaacgcgaacugaaacauggaugagcucagaaggagcauggaaacaaauacaaagaguagaaacaugggcacuaagacauccgggguuuacaguuaucgcguuauuuuuagcucacgcaauaggaacuucaaucacacaaaaagggauuauuuucauuuuauugaugcugguuacacccagcauggcaaugcgauguguaggaauaggaucucgagacuuuguagaaggacugaguggagcuacauggguugauguaguacuggaacaugggagcugcgugacaacaauggcgaaagacaaaccgacacuagauauagaacugcuaaaaacugaaguuacaaauccggcaguccuacggaaauugugcaucgaagcaaaaaucucuaauacuacuacggacucgcgauguccaacucaaggcgaagcgacccuaguagaagaacaagaugcaaacuucguaugcagaagaacguuuguagauagaggguggggaaauggcugcggguuguucggcaaaggaagucuaauaacuugugcgaaauucaaaugcgugacaaaauuagaagggaaaauaguccaauaugaaaacuuaaaauauucaguaauugucacuguccacacaggggaucaacaucaagucgguaaugaaagcacagaacacggaacuacagcaacuauuacuccacaagcuccaacaacggaaauucaacucacagacuauggggcgcugacucuugauugcucaccgcgaacgggucuagacuucaaugaaaugguauuguuaacaaugaaagagaaaaguuggcugguacacaaacaaugguucuuagaucugccauuaccauggacauccggugccagcacuagccaagagaccuggaauagacaagacuuacuuguaacguuuaaaacugcccaugccaagaaacaagagguagugguucuaggaagucaagaaggagcaaugcacacugcauuaacaggagcaacagaaauacaaacaagcggaaccacgacgauuuuugcgggacaccuaaaauguagacuuaaaauggauaaacuaacccuuaaagggaugucauauguuauguguacagguucuuucaaacucgagaaagaaguagcggagacucagcaugguacuguacuuguacaaaucaaauaugaaggaacugacgcuccaugcaaaauaccauucagcacacaagaugaaaaaggagucacgcaaaauggccgauuaauuacggcaaauccaauaguuacugauaaagaaaaacccgugaauaucgaagcugaaccaccauuuggcgaaagcuauauaguuaucggagcgggugagaaggcuuuaaaacucaguugguuuaagaaagggucaucaauuggcaaaauguuugaagcaacagcaagaggagcaagacggauggcaaucuugggagauaccgcgugggauuuuggauccauuggcggaguauuuaccaguguaggcaaacuaauacaucaaauauuugggacugcguacggagucuuguucaguggcguaaguuggacgaugaaaaucgggauaggaguuuuauugacauggcuggggcuaaauagcaggagcacuagcuuaucaaugaccugcauugcaguuggucuaguaacuuuauaucuaggagucaugguacaagcagauucaggaugugugaucaauuggaaaggacgagaacugaaaugcgggagugggaucuuuguaacaaaugagguacauacauggacagaacaauauaaauuucaagcugacucaccaaaaagguuaagcgcagccauaggcaaagcaugggaagaaggugugugugguauacgaagcgcuacaagacuagagaauauaauguggaagcaaauuucgaacgaauuaaaucacaucuuguuagaaaacgacaugaaauuaacaguuguaguaggagacguggcuggaauauugggacaaggcaaaaagaugauuagaccacagccaauggaauauaaauacagcuggaaaaguuggggaaaagcaaaaauuaucggugcagaugcccagaauaccacguuuauaauagacggaccuaacacaccugaguguccugaugaccaacgagcauggaacauaugggaaguggaagacuacggguuuggaaucuuuacaacaaacauauggcuuaaauuaagggacaguuauacacaagucugugaucacagauuaaugucagcagcaauaaaagauucaaaagcgguccacgcagacauggguuauuggauugaaucagagaaaaacgaaacguggaagcuagcuagggcaucauucauugaaguaaaaacuuguaucuggcccaagagucauacauuauggucuaacgggguauuggaaucagagaugauaauacccaaaauauacggcggaccgauaucucagcauaacuacagaccaggauauuuuacgcaaacugcugguccauggcauuugggcaaauuggaguuggauuucgaucuaugugaagguaccacaguaguaguugacgaacauuguggcaaccgugggccuagcuuaagaacaacaaccguaaccgguaaaauuauccaugaauggugcugucgaucuugcaccuuaccuccucuuagauuuagaggagaagaugggugcugguauggaauggagauccgaccuguuaaagaaaaagaggagaaccuaguaaaaaguaugguaucugcagguagcggggagguagacucauucucgcuaggacucuuaugcauuaguauaaugauagaagaaguaaugcguuccagguggucuagaaaaaugcuaaugacggguacauuagcuguauucuucuuguuaauaaugggucaacuaacauggaacgauuuaaucaggcuuugcauaauggugggugcuaaugcuuuugaucguaugggcaugggcaccacuuaucuagcucuuauggcgacauuuaaaaugagacccauguuugcaguagguuuauuguuuagacgccuaacaaguagagaaguucuucuacugacaauagguuuaagccugguagcaucaguggaauugccaaacagucuggaggaacucggugauggguuagcuaugggaauuaugauucuaaagcucuugacagauuuucaaagccaucaacucugggcaacacuacuaagucuaacuuuuauuaaaacgacauucucacuacauuacgcuuggaagacuauggcaaugguccugucaauugugucacuauucccuuuguguuuguccacaacuucccagaaaacuaccuggcuaccaguucucuuaggaucccuaggauguaaaccucucacuauguuucuaauagcagagaacaaaauauggggccgaaaaucguggccauuaaacgagggaauuauggcaguagggauaguaucuauucuacucucgagccuccuaaagaaugacgugccgcuagcuggucccuugauugcuggagguaugcuaaucgcauguuaugucaucuccggcucgucugccgauuuaagucuugaaaaagcagcugaaguaaguugggaggaagaagcggaacacucuggugcaucucauaauauccuaguugaaguacaagacgaugggacaaugaaaauaaaagaugaagaaagagaugacacucucaccauauuacugaaagcaacauuacuugcaguaagcgggguuuacccucuaaguauacccgccaccuuguuuguuugguauuucuggcagaagaagaaacaacguucagggguacuaugggauacaccaagcccaccagaaguggagcgugccguuuuagaugacggcauauaucgcaucaugcaaagaggccuuuuaggaagaagccagguaggugucggcguguuucaagaagacguauuccauaccauguggcacguaacgcguggagcaguacucauguaucaaggaaaaagauuggagcccucaugggcauccguaaagaaggaucucauaucuuacggcgguggauggcgacuacguggcucauggaacaccggugaagagguacagguaauagcuguagaaccuggcaaaaaccccaaaaacguacaaacugcaccuggaacuuuuaaaaccccagagggagaggucggugcaauagcuuuggacuucaaacccggcacgaguggaaguccuauagugaacagggagggcaagaucguuggacuauauggaaauggcguuguaacaacuucugguacauacguguccgcgauagcccaggcaaaagcaucucaagaaggaccacugcccgaaauagaagaugaaguuuuccguaaaagaaauuuaacaauaauggaucuucauccagguagcggaaagacaagacgauauuugccagcaauaguucgagaagccauaaaaagaaagcuaagaaccuugauccuagccccaacaagaguaguugccagugaaauggcagaagcauuaaagggaaugcccaucagauaucaaacaaccgccgugaaaucagagcacaccgggaaggaaaucguagaccugaugugccacgcaacauucacaaugagacucuuaucaccaguaagagugccuaacuacaacaugauaauaauggaugaggcacacuucacugauccaucuagcauugcugcuagagguuacauuaguacgagggucgguaugggugaagcugcagcaauauuuaugacggccacaccaccuggaucuguugaggccuuuccacaauccaaugcgguaauacaagaugaagaacgagacaucccggaacggagcuggaacagcggacacgaauggauaacagauuucccaggcaaaaccgucugguucgucccaucuauaaaaucaggaaaugauauagcuaauugccuaaggaaaaauggcaagcguguaauucaguuaucuagaaagacuuuugauacugaauaccagaaaacuaaaaauaaugauugggauuauguagugacaacugacauuagugagaugggagcuaauuucagagccgacagaguaauugauccgagaagaugucuaaaaccaguaauucuaaaagauggucccgaaagaguuauacucgccggaccaaugccagugacaguugcaagugcugcccaacgucggggaagaauuggucgaaaccacaacaaagaaggugaccaauacauauauaugggacagccgcuaaauaacgaugaagaucacgcccauuggacagaggcuaaaauguuacucgacaacauuaauacaccagaaggcauaauaccagcacuuuuugaaccagagagagaaaaaucagcagccguagauggggaauacagacucaggggagaagcacgcaagacuuucguagaacucaugagacgaggugaccugccagugugguugucuuauaaaguugccucagaaggauuccaauacucggaucgacgaugguguuuugacggagagcgaaauaaucagguucucgaagaaaauauggauguagagauuuggacuaaagaaggcgaaaggaagaaacuucguccgagguggcuagacgcgcgaacauacagugacccauuagcgcuuagagaauuuaaagaguucgcugcaggucggagaucuguaucgggagacuugaucuuagaaauaggaaaacuuccgcaacauuuaacacaacgggcucaaaacgcguuggauaaccuggucauguuacacaauagugaacaagggggcagggcauauagacacgcaauggaagaacuuccggauacaaucgaaacgcuaauguugcucgcauugauugcgguccucacuggagggguaacacuauucuuucuaaguggaagaggguuagggaaaacgagcauuggauuacucugugugauggcuaguaguguguuacucuggauggccagcgucgaaccacauuggauagcggcaucgaucauucuagaauuuuuccuuaugguucuccugaucccggaaccugaucgucaaaggacaccgcaagauaaccagcuugcauauguuguuaucggauuacuuuuuaugauauuaacuguagcagcuaaugaaaugggacugcuagagacaaccaagaaagaucuggggaucggccaugucgcaguagagaaccaucaccacgcugcaaugcuugauguagaucuacaucccgcgagugcauggacauuauacgccguagcaacaacgaucauaacuccgaugaugagacauacaauugagaacacaacagcuaauaucucccuuacggcgauagcaaaucaggcggcgauucuaaugggauuggauaaagguuggccuauuaguaaaauggauauagguguaccauuacuugcacuugguuguuacagccaagugaacccccugacauuaacagcagcggugcuaauguuaguugcacacuaugcaauuauaggaccaggacuacaagcaaaagcgacacgcgaagcacagaaacgaacggccgcaggaauaaugaaaaaucccacaguggacggcauuguagcaauagauuuagauccuguaguguacgacgcaaaauucgagaagcaguuaggccaaauuaugcuuuuaauacucuguacuucccaaauauuauugaugcgaacuacgugggcucugugcgaaaguauaacguuggccacaggaccacuaacaacguuaugggaaggcaguccuggaaaauucuggaacacaacaaucgcaguguccauggcuaauaucuuuagaggcucuuaucuugccggugcaggccuagcuuucaguuuaaugaaaagucucgggggagguagaagggggacaggagcacaaggagaaacucucggcgaaaaauggaaacgacaacuaaaccaauuaucaaaauccgaguucaauaccuacaagagaaguggcauaauggagguggacagaagcgaagcgaaggaaggguuaaaaagaggggagacuacuaaacaugcuguaucucgagggacugcaaaacuacgcugguucguggaaagaaauuuagucaagccugaaggaaaaguaauagauuugggaugcggaagaggaggauggagcuacuauugugcuggacucaagaaagugacagagguaaagggauauacgaaaggugggccaggacaugaagaacccauuccgauggcgacuuaugguuggaaucuuguaaaguuacacucaggaaaagaugucuucuuuaucccuccggaaaaaugugauacucuacuuugugacauuggcgaaucgucuccaaaucccacaaucgaggaaggaagaacccucagagucuuaaaaaugguugaaccauggcuuagggguaaucaguucuguauuaagauuuugaacccauacaugccaaguguuguagagacacuagaacaaaugcaaagaaagcacgggggaaugcuaguaaggaacccucuaaguagaaacucaacacaugagauguacuggguauccuguggcaccggcaacaucguauccgcaguuaauaugacaucucgaaugcuacuaaaucguuuuacaauggcacaccggaaaccaacguacgagagagauguagauuuaggaaccgguacgagacacguugcgguagaacccgagguggccaaccuagauauaauaggacaaaggauagaaaacauaaagcaugaacauaaaaguaccuggcauuacgacgaggacaauccguacaaaacgugggcauaucacggaucuuaugaaguaaaaccgucgggcagugcauccucuaugguaaauggcguuguuaagcuauuaacaaaaccuugggaugugauuccuauggugacucagauagcgaugaccgacacgacgccguuugggcagcagagaguauucaaagagaaggucgacacccgcacccccaaagcaaagagagguacugcacaaauuauggaggugacugcaaggugguuauggggauuccuaucacgaaauaagaaaccucggauauguacaagagaagaauuuacacguaaagugcgaagcaaugccgcgauaggcgcgguguucguugaugaaaaucaauggaauagugcuaaagaggcugucgaggaugaacgauuuugggaucuuguacauagagaaagagaacuucauaagcaaggaaaaugcgcaaccuguguauauaacaugaugggaaaaagagagaagaaacugggcgaauuuggcaaagcuaaagguucuagagcaauaugguauaugugguugggggccagguucuuggaguucgaggcgcucggauuuaugaaugaagaucauugguucuccagggagaacagccuguccggagucgagggagaagguuuacacaaauuaggauacaucuuacgagauauaaguaaaauaccaggaggcaauauguacgcagaugacacugcggguugggauacacgaauuacugaagaugaucuacaaaacgaggcaaagauaacugacauaauggaacccgagcacgcauuguuagcaaaagcaaucuucaaauuaacuuaucaaaauaaagucgucagaguucaaagacccgcuaagaacgguacgguuauggauguaauauccaggcgugaucaaagaggcucugggcaaguugggacuuauggccucaacacauuuacaaacauggaagcucaauuaauuaggcagauggagagugaaggaaucuucagcccaagcgaauuggaaacacccaaucuagcggaacgagcucuagauuggcuagaaaaauacgguguugaacgcuugaaaaggauggcaaucucuggcgaugacugcguagugaagccgauagaugacagguuugcaaccgcauuaaccgcacugaaugauaugggcaaaguaaggaaagacauaccacaaugggaaccgucaaaaggauggaacgacuggcaacaaguaccauuuugcagucaccauuuccaucaauugauaaugaaggauggaagagaaaucgugguacccugccguaaucaagaugagcuagucggacgagcacgcguaucacaaggugccggcuggucucucagggagacagcaugucuuggaaagucuuaugcccaaauguggcaauuaauguauuuucaccgacgagauuuaaggcuugcugcaaaugccaucugcucagcugugccaguggacuggguuccaaccuccagaacgaccuggaguauucaugcucaucaccaguggaugacaacagaggacaugcuaucaguauggaaccgggucuggauagaggaaaaucccuggauggaggacaagacacacauaagcucuugggaagaugucccauaucuugggaagagagaagaucaaugguguggaucauuaaucggacuaacggcaagagcaacgugggccacaaacauacaaguugcgauuaaccaaguucgcagguugauagggaaugaaaauuaucuagacuauaugacaucaaugaaacgauucaagaaugaaucagacccugaaggugcucuuugguaa

SEQ ID NO: 21879 - RNA, 9879 nt, Artificial Sequence
  derived and/or modified CDS sequence (opt6) from DENV-1__GU131821__SS-prME
aguguaaccaugcuucuuaugcuuaugcccacugcauuggcauuucaucuuacuacucgagguggggaaccccauaugaucguaucuaaacaagaaagagggaaaucucuucuuuuuaaaacaucggccgguguaaauaugugcaccuuaauugcuauggaucugggugaguucugugaggacacaaugacuuauaaauguccaagaauaacagaagcggagcccgacgacguagacugcugguguaaugcgacggacacauggguaaccuaugguacauguucgcaaacaggagaacaucggcgugauaaaagaucuguugcauuagcuccacacgugggacuaggccuagagacgcgaacggaaacauggaugaguagcgaaggugccuggaaacaaauacaaaaaguagaaacaugggcuuugcgacaucccggguuuacaguuaucgcacuauuucuagcccacgcuauaggaacuucaaucacucaaaaaggcaucaucuucauacugcucauguuaguaacaccauccauggccaugcgaugcguaggaauagggagccgagacuuugucgagggacuuuccggagccacguggguagaugucguauuagaacauggcaguuguguuacgacaauggcaaaagacaaaccuacuuuagauauugaguuauuaaaaacagaagugaccaauccagcuguccuacgaaaauuauguauagaagccaaaauuagcaauacaacuacugacucaagaugcccuacucaaggugaagcaacacucgucgaagaacaagacgcgaauuuuguauguagacggacauuuguagacagaggauggggaaacgggugcgguuuauucggcaaagguuccuuaauaacaugcgcaaaauucaaaugcguaacgaaauuagaaggaaaaacuguacagcacgagaaucugaaauacuccguaauaguaacuguacauacgggcgaucagcaucaagucggaaacgagaguacagaacauggaacgacggcuacaaucacuccacaagcaccuucuacugagauccaauuaacagacuauggagcgcuuacccuugauuguagucccagaacaggccuagauuuuaaugaaaugguucuucuaacgaugaaagaaaaauccugguuaguccacaaacaaugguucuuagaucucccccuaccauggacauccggggcaaguacaagucaagagacuuggaacagaaaagauuuauuagucacauucaaaacggcucaugcuaagaaacaggaaguaguaguacugggaucucaagaaggugccaugcauacugcccuaacaggggcuacagaaauacaaacaucuggcacaacaacaauauucgcaggucauuuaaagugccgucuuaaaauggauaaauuaacguuaaaagguaugaguuacguuaugugcacggguucauuuaaacuugaaaaagaaguggcugagacacaacauggaacggugcuuguacaaauuaaauaugaagguacagaugcgccuuguaaaaucccauucuccacccaagacgaaaaaggggugacucaaaauggaaggcuuauuacagcaaaucccauuguaacggauaaggagaaaccaguaaacauagaagcugagcccccuuucggagaaucauauauaguaauaggagcaggagagaaggcucuuaaauuaucaugguuuaagaaaggcaguucuauaggcaaaauguucgaagcaacggcccguggagcuagacgcauggcaauacuaggcgacacugcuugggauuuuggcaguauuggagguguguucacuucaguagggaaauugguccaccaaauauuugguacagcauacgggguccuuuuuaguggaguauccuggacuaugaagaucgggaucgguguauuauugacauggcuaggacucaauagucgauccaccucuuugaguaugacuuguauagcuguaggucucguaacgcucuaccuaggaguuaugguacaagcagauucugguuguguaaucaacuggaaaggcagggaacuaaagugcggcucuggcauauuuguaacaaaugagguacauacuuggacagaacaauauaaauuucaagcagacucacccaagcgauuaucagcagcaauaggcaaggcuugggaggaaggaguaugugggauacguagugccacacgucuggaaaacaucauguggaaacagauaagcaaugaacuaaaucauauuuuacuagaaaaugauaugaaauuuacuguaguagugggugauguugccggaaucuuggcacaagggaagaaaaugauucguccacaaccuauggaauauaaauacucauggaaaagcuggggaaaagcaaaaaucauaggugcggauguccaaaauacaacauuuauaauagaugguccaaauacaccugagugcccagaugaccaacgagcauggaacaucugggaagucgaggacuauggguuuggcauauuuacaacuaauaucugguuaaaacucagggauucuuauacacaaguuugcgaccacagguuaaugucagcggcuauaaaagauucgaaagcagugcacgcggauaugggguauuggauugaaucugagaaaaaugaaaccuggaaacuugccagggcuaguuucauagagguaaaaacaugcauauggccaaaaucgcauacacuguggucgaauggaguacuugaaucagaaaugauaaucccaaaaaucuacggcggaccaauaucgcagcacaacuaccguccggguuauuuuacacaaaccgcggggccauggcacuuggggaaguuggaacuugauuucgacuuaugcgaagguaccacuguagugguagaugaacauugcggaaaucgcggaccgucacucaggacaaccacaguaacaggaaaaauuauccacgaaugguguuguagaucgugcacacuaccaccguuaagauuuaagggcgaagaugggugcugguacggaauggaaauuagacccguuaaggaaaaagaagaaaacuuaguaaaaagcaugguaucagccggcagcggagaaguugacaguuucucauugggacuacucugcauuucaaucaugauagaagaaguaaugaggucccgcuggucuaggaaaaugcuaaugaccgggacacuagcagucuucuuuuuguuaaucaugggacaacucacguggaaugaccuuauccggcucuguaucaugguaggugccaacgcauccgauagaaugggaaugggaacgacuuauuuagcuuuaauggcgacuuuuaagaugcgcccaauguuugccguaggacuccuauuccguaggcuaacuucucgugaaguucuacuauuaacgauagggcuuaguuugguugcaucaguugagcuacccaauagucucgaagaauuaggggacggccuagcuaugggcauuaugauauuaaaacuauuaacggauuuucaaagucaccaguugugggccacauuacugucucuaacauuuauaaagacuacauuuucucuucacuaugccuggaagacuauggcaaugguacuaucaauaguaucccuuuucccauuaugccuaucaacgacuagccagaagacuacuugguuaccaguucuacucggcucguuaggcugcaaaccguugacgauguuuuugauagcggaaaauaagaucuggggaagaaaaucauggccguugaaugaaggaauuauggccguaggaauaguuucuauacuucugucaucguugcugaaaaacgaugugccacuagccgggccccuaauagccggagguauguuaauagcauguuacgucauuucggguucaucagcugaucuuucguuagagaaagcugccgaagucagcugggaagaagaagcggaacauucaggugccucccauaauauacucguggaaguacaagaugacggaacgaugaaaauuaaagaugaagagagggaugacacucuaacaauuuuguuaaaagcaacguuguuagcaguaucgggggucuauccguuaucaauaccggcaacccucuucguaugguacuucuggcagaagaagaaacagagguccgggguguuaugggauacuccauccccgccagaaguagaacgugcuguauuggacgaugguauuuauagaauaaugcaacgcggauuauuagggagaucgcaggucggcguaggaguuuuccaggagaacgucuuucacacuauguggcaugugacaagaggggccgucuugauguaucagggcaaacgacuugaaccaucaugggcuucggucaagaaagauuuaaucucauauggaggaggguggcguuuacaaggaucauggaacacaggcgaggagguucaaguaauugcggucgaacccggcaaaaaucccaaaaauguacaaacggcaccgggaacuuucaaaacaagcgaaggggaaguaggagccauugcauuagacuuuaaaccagggacguccggaucccccauagucaauagagagggcaagauuguuggacuuuauggaaacggaguggugacuacaucagguacauaugugucagccauagcucaagcuaaagcuagucaagagggaccuuuaccagaaauagaagaugagguauuccguaaaagaaaucuuacaaucauggauuugcauccagggucaggaaaaacucguagauaucuaccggcuauuguccgcgaagcuauuaaacgaaaauugcgaacccuaauucuagcucccacaagaguugucgcaagcgaaauggcagaagcacuaaaggguaugccaauucguuaucaaacaacagcggugaaaucagagcacaccgguaaagaaauuguggauuuaaugugccaugcgacguuuacuaugagauugcuaucaccagugagaguuccuaauuauaacaugaucauaauggacgaagcucacuucacugaccccucaagcauugcagcacgcgguuauauauccacacggguugguaugggcgaagccgcggccaucuuuaugacagcuacgcccccaggaagcguagaggcauuuccgcagaguaacgccguuauucaagaugaggagagagauaucccggaaaggucauggaacaguggauacgaauggauaacagauuuuccaggaaagacuguaugguuuguccccaguaucaagagugggaaugacauagcuaacugucuacgcaagaauggcaaacggguuauccagcuaucuagaaagacguucgacacagaguaucaaaagacaaagaauaaugacugggacuauguaguuacaacugacauaucagaaaugggggcaaauuuccgcgcggauagaguaaucgaccccagacguugccugaaaccuguuauacuaaaagauggucccgaacguguaauucucgcaggcccgaugccuguaacaguagcuucugcugcgcaaagacgaggaaggaucgguagaaaccacaacaaggaaggcgaucaguauauauauaugggacaaccauuaaauaaugacgaagaccacgcccauuggacugaagcaaaaauguuauuggacaacauaaacacaccagaagguauuauaccagcucuuuuugagccagaaagagaaaagucggcagcaauugauggagaguauagauuacgcggagaggcuagaaagaccuuuguugaauuaaugcgaagaggcgaucuaccuguauggcucucguauaagguagcgagugaaggauuccaauauucugacaggcgguggugcuuugacggagaacggaauaaucaaguccuugaagaaaacauggacguggagauauggacuaaagaaggugaaaggaagaaacucagaccccgauggcuagaugcgcgaacauauagugacccacucgcucuaagagaguuuaaggaauuugcugcugggcgaagaagugugagcggugauuugauucucgagauaggcaaauuaccucaacaccugacgcagcgcgcucagaaugcgcuagacaaucucgugauguuacacaacucagaacaaggcggcagagccuaccgacaugcaauggaggaauuaccagauaccauugaaacucuaaugcuccuagcucucauagcagucuugaccgguggaguaacacuauucuuucuaucaggcagaggguugggaaaaacuagcauuggguuacuuuguguaauggcaaguucagcccuacuauggauggcgucggucgagccgcauuggaucgccgccucaauaauauuagaauuuuucuuaaugguauuacuaauacccgagccggauaggcaaagaaccccucaagacaaucaacuugcuuauguaguaauaggucuacucuuuaugauucuuacaguagccgcaaacgaaauggggcuucuugaaaccacaaagaaagaucugggaauagggcacguggcaguagaaaaccaccaucacgcaacaauguuagacguugaccuacaccccgcuagcgcguggaccuuauaugcaguugcgacaaccauuauaacucccaugaugcgacauacgauagagaacacgacagcaaacauaucucuaacagcuauugcaaaccaagccgcuauacucaugggguuagauaaaggcuggcccauaagcaaaauggacauagguguacccuugcuagcauugggcugcuauucccaggugaacccucuaacguuaacagccgcgguccuaauguuaguugcucacuaugccaucaucgggccuggucuucaagcuaaagccaccagggaagcacagaaaagaacagcggcuggcauuaugaaaaauccaacuguagauggaauaguagcuauagaccuggauccuguaguguacgacgcgaaauucgagaaacaauuaggucaaaucauguuguugauauuauguacaucgcaaauauuacucaugagaacgacaugggcacuaugcgaaucgauaacguuagcuaccggaccuuugaccacauuaugggaaggaaguccaggcaaauuuuggaauacuacaauagcggugucuauggcuaauauuuuuagagggucguaccucgcaggcgcaggacuagcuuuuucuuuaaugaaaucucugggaggaggacgcagagggacaggagcacagggugaaacacuaggagaaaaauggaaacgucaguugaaucaguuaagcaaaucugaauuuaauacauauaagagaucaggaaucauggaaguagacaggucugaagcgaaagaaggacuaaagagaggagaaaccacaaaacacgcagugagucgaggaacagccaaauugcgaugguuuguugagaggaaucuuguuaagccagaagguaaaguaaucgaccuaggcuguggaagaggcggguggucauacuauugcgcaggccugaagaaaguuacagaagugaaaggauacacaaaagguggacccggacacgaagaaccuauuccaauggcgacuuacgguuggaauuuaguaaagcugcauucuggaaaagauguauucuuuaucccacccgagaaaugugauacuuuacuuugugauauaggcgagaguucgccaaaucccaccauagaagaaggaagaacacuuagaguccuaaaaaugguagagccauggcuuagaggaaaucaauuuugcauaaagaucuuaaauccguauaugccaagcguaguugaaacacuagaacaaaugcaacguaaacacggcggaauguuagucagaaauccauuaagccguaauaguacacaugaaauguacuggguaucaugugguacuggcaacauaguaagcgccgucaauaugacaaguagaaugcuauuaaauagauuuaccauggcccauagaaaaccaacauaugaaagagauguagauuuaggcgcagguacaagacacguagcuguagaaccggaaguagcaaaucucgauaucauagggcaaagaauugaaaauauaaaacaugagcauaaaaguacguggcauuaugaugaagauaauccuuacaaaacaugggcauaucacgguaguuacgaagucaagccgagcggaagugcauccucaaugguaaacggagucgugaaacuacuaacaaagcccugggauguaauaccaaugguaacucagauagcaaugaccgauacgacaccuuuuggucaacaaagaguguucaaagagaaagucgauacaagaacuccuaaagcuaaaagggggaccgcgcaaaucauggaggugacagccaaguggcuauggggauucuugagucgaaauaagaaaccacgcauaugcacaagagaagaauuuacucguaaaguuaggucaaacgcugcgauaggagcaguuuucguugacgaaaaccaauggaacucugcgaaggaagccguagaggacgaacgcuuuugggaccucguccacagagaaagagaauuacacaaacagggcaaaugugcuacuuguguuuacaauaugauggguaaacgugagaagaaacuaggagaauuuggaaaagcuaaaggaagucgugcgauuugguacauguggcuaggggcaagguucuuagaauuugaagcgcuagguuucaugaacgaagaccauugguuuucuagagaaaauaguuuaucagguguugagggggaagguuugcauaaauuagguuauauuuuacgagauauuucuaaaauacccgguggaaauauguaugcagacgauacagcaggcugggacacgagaauaacagaagacgaucuucaaaaugaagcaaaaauuacagacauuauggaaccugagcaugcucuguuagcgaaaucuauauucaaauugacuuaucaaaauaaaguagugaggguacaaagacccgcuaaaaauggaacaguaauggacgugaucucgcgucgagaucaaagagguagcggacaaguuggcacauacgguuugaauacuuucacaaauauggaagcacaacugaucagacaaauggaaucagaaggcaucuucucaccuagugagcuagagacaccuaacuuggcgggacguguacuugauuggcuugaaaagcauggcguagaacgucugaaacgaauggcuaucucaggugacgauuguguuguuaaaccaaucgacgaucgguucgcaacagcgcuuacagcauuaaaugauauggguaaaguaagaaaagacauuccacagugggagccauccaagggcuggaacgauuggcagcaagugccguuuugcucgcaccacuuccaucaacuaauaaugaaagauggacgcgaaauuguaguuccaugcaggaaccaagaugaacugguugggcgggcaagaguaagucaaggggcaggcuggagucuccgcgagacagcuuguuuaggaaaaucauacgcacagauguggcaacucauguauuuucacagacgcgaucuaagacuugcagcuaaugcaauauguucugcagugccuguagaaugggucccaacauccagaacaacauggucgauccacgcucaucaucaauggaugacaacagaagacauguuguccguauggaauaggguauggauagaggaaaauccauggauggaggacaaaacgcauaucucaaguuggggagaugucccguaucuaggaaagagagaagaucaguggugugggucccuuauagguuuaacagcgagagcuacuugggcaacaaauauccaaguagcuaucaaucaaguacgaagacugauagguaacgaaaacuacuuagauuacaugacaaguaugaaaagguuuaagaacgagagugacccagaaggagcacuaugguag

SEQ ID NO: 21880 - RNA, 9879 nt, Artificial Sequence
  derived and/or modified CDS sequence (opt6) from DENV-1__JF937617__SS-prME
ucgguuacgauguuacuuauguuaaugccuacggcacuagcauuccaucuuacuaccaggggaggagaaccgcauauggugguaagcaaacaagaacgagggaaaucucuacuguuuaaaacuucugcuggaguaaacaugugcaccuuaauagccauggaccuaggugaacuaugugaagauacaaugacauauaaaugcccaaggauaacagaagccgaaccagacgacguugauuguugguguaacgcaacagacacaugggugacauacgggacauguucacaaaccggggaacaucgacgagauaaacgcucuguugcacuugcaccccauguuggucuaggucuugaaacaaggaccgaaacuuggaugagcucagaaggcgccuggaaacaaauacaacggguggaaacgugggcuuugcgucaccccgguuucacagucauagcuuuguucuuagcccacgccauaggaacaagcauaacccagaaagguaucaucuucauuuuacucauguugguaacccccucgauggcuaugaggugcguaggaaucggaucacgagauuuuguagaaggacuaagcggggcuacguggguugacguugugcuugaacacggaucauguguuacgacaauggcuaaagauaaaccgacuuuggauauagaauuacuaaaaacggagguaacaaaccccgcaauccuaaggaaauuaugcauugaagcaaaaauaaguaauacuacuacugacucuagauguccaacucaaggagaggccacccugguagaggaacaagaugcuaacuuuguaugucggagaacguuugucgaccgcgguuggggaaauggauguggauuauuuggcaaagguucauugauaacgugugccaaguuuaaauguguaacgaaguuagaaggaaaaauaguacaguaugaaaacuugaaguacucuguaauaguuacaguacacacaggagaccaacaucaaguggggaaugaaaguacugaacacgggacuacagcuacaauaacaccccaggcgccaaccacagagauucaacucacagauuauggcgcacucacacuagacuguucaccaagaacaggauuagauuucaacgaaaugguccuauuaacaaugaaggaaaagucguggcuagugcacaaacaaugguucuuggauuuaccacuaccauggaccagcggagcaucgacaagucaagaaaccuggaauaggcaagaucuauuagucacauucaaaacagcucacgcaaagaagcaagaagugguaguacuuggaucccaagaaggggcuaugcauaccgcguuaacaggggcaaccgaaauucaaacuucggguacaacaaccauuuuugcaggucacuuaaagugcagauuaaagauggauaaacugacauuaaaagggaugucuuauguaaugugcacuggaucguucaaauuagaaaaagagguagcggaaacacagcauggcacuguccuaguacaaauaaaauacgaaggcacagacgcacccuguaagauucccuuuucgacacaggacgagaagggagucacucaaaacggacguuuaauuacugccaacccaauaguuacugacaaagaaaaaccagucaacaucgaggcggagccaccauucggagaauccuacauaguaauuggagccggugaaaaggcacuuaagcuaucaugguuuaaaaagggcucaucuauaggaaaaauguucgaagcuacagcccguggagcacgccguauggccauuuuaggagauacagcgugggauuucggcucaauaggaggaguuuuuacaaguguuggcaaauuaguacaccaaauuuuuggaacagcauauggagucuuguucagugggguaucuuggacuaugaagauuggccucggcgugcuauuaacguggcuagguuuaaauucucgaucaacgucguuaucuaugacuugcaucgcuguugggcuuguuacacucuacuuaggagugaugguucaagcugauagcgguugcguaaucaauuggaaaggucgagaauugaaauguggaucaggaauauucgugacaaaugaaguucacacauggacugaacaauauaaguuccaagccgauucaccgaagagacuuucugcagcaauaggaaaggcaugggaagaaggaguauguggaauacgaucugcuacuagacuagagaaugugauguggaagcaaauaaguaacgaacuaaaucauaucuuacucgaaaacgauaugaaauuuaccgucguuguaggcgauguggccggaauacucgcccaagggaagaaaaugauuaggccgcaacccauggaauauaaauacucauggaaaucuuggggaaaggcgaagauaaugggugcugacguacaaaauacgacauuuaucaucgauggaccuaauacgccggaauguccugaugaucagcgggcuuggaacauaugggagguagaagauuaugguuuugguauauuuacuacgaacauaugguugaaauugcgggauagcuauacucaaguaugugaucauaggcuuaugucagcugcaauaaaagauuccaaggcaguacaugcagauaugggauauuggauagaaagcgagaaaaaugaaacauggaaacuggcccgagcgagcuucauagaaguaaaaacauguauuuggccuaaaucgcauacacucuggucuaacgguguguuggaauccgaaaugauaauuccaaaaauuuacggaggccccauaagucaacacaauuaucgacccggguacuuuacacaaacagcaggacccuggcaccucggcaaauuagaacucgacuucgaccucugcgaaggaacgacuguaguaguagaugaacacugugguaauagaggcccaaguuuaagaacaacgacagugacagggaaaaucauucaugagugguguuguagaucuuguacauuaccaccauugcgguuuagaggagaagauggcugcugguacggcauggaaauucggccuguuaaagaaaaggaagaaaauuuggucaagaguaugguaagcgcaggaucuggugaaguugauagcuuuucacuggggcuuuuauguauaucuauaaugaucgaagagguaaugagaucccgguggaguagaaagaugcuuaugacagguacucuaguaguuuuucuucugcuaaucaugggucaauuaacauggaaugaucuaauaagauuauguauuaugguaggagcaaacgcgucagaucggauggguaugggaacaaccuaucuagcauuaauggccacauuuaaaaugagaccuauguuugcuguaggauugcuauucagacggcuaacaucgcgagagguucuauuacuaacuauagggcuaagccucguggcaucgguagaauuaccgaacagcuuagaagaguugggugacggacucgcaaugggaauuaugauucuuaaacuacucacugauuuucaaucucaucaacuaugggcgacacuucuaucacugacauuuauaaaaacuacauucucccuacauuaugccuggaagacaauggcaaugguccucucaauagugagccuuuuccccuuauguuuaucgacaacaagucagaaaacgacuuggcugccgguguuguuaggaucguuaggaugcaaaccguuaacaauguuccuaauugccgagaacaaaauaugggggagaagguccuggccucugaaugaaggaauaauggcugucgggaucgugucaauacuguugagcaguuugcucaaaaaugacguaccguuagcgggucccuuaaucgcuggaggcauguugauugcaugcuacguuauuucaggaaguagugcagaccuuaguuuggaaaaagcagcagagguaucgugggaagaagaagcagaacauucuggagcgucacauaacauacucguugagguccaagacgauggaaccaugaaaauuaaagaugaggaaagagaugacacguuaacaauacuacuaaaagcaacacuguuagccguaucaggcguauauccuuugaguauaccagccacccucuuuguaugguacuuuuggcaaaagaagaaacaaagaagcggaguuuugugggauacgccuaguccaccagaaguagaacgugcaguucuugaugacggaauauacaggauuaugcaaagaggcuuauuaggaaggucacaagucggaguagguguauuucaggaaaauguauuccacacuauguggcauguuacaagaggggcuguguugauguaucaaggaaaaagauuagaaccaucaugggcgagcguaaagaaagaucuuauuaguuauggcggaggcuggcggcuucaaggaucuuggaauacgggagaagagguacaaguaauagcuguugaacccggcaaaaaucccaaaaacguacaaacugcaccgggaacuuucaaaacgccagaaggagaaauaggcgccauagcacuugacuuuaaaccgggaacaaguggcaguccgauaguuaacagagaaggaaaaauaguaggacuuuacgggaacgguguagugacuacgucagggacuuauguauccgcaaucgcgcaagcgaaagcgucgcaagaaggcccucugccggaaauagaggaugaaguauuucguaaaaggaauuuaacaaucauggaccugcaccccgggucagguaaaacacggcgauaucuaccagcuauugugagggaggccaucaaacguaaacuacggacacugauauuagccccgacuaggguagucgcaucugaaauggcagaagcacugaaaggaaugcccauccgguaucaaacuacggcgguaaaaagcgaacacacagggaaagagauaguagacuuaaugugccacgcaacuuuuacgaugcgguuacuuucccccguacgagucccaaauuauaauaugauaaucauggacgaggcccacuuuacagauccuuccaguauagcggcaaggggauacauuaguacaaggguuggaaugggggaggcagcggcgauauuuaugacagccacuccgccugguaguguagaggcauuuccacaauccaaugcaguaauccaggacgaagaaagggauauuccggaacguucauggaacucggguuacgaauggaucaccgacuuuccagggaaaacaguaugguucguaccuucuaucaaauccggcaacgacauagcuaacugccugaggaaaaaugguaaacgaguaauacaacugucaaggaaaaccuuugacacagaguaucagaaaacuaaaaauaacgacugggacuauguagucacaacugauauuucugaaaugggagcaaauuucagagcagaucguguuauagacccgaggagauguuuaaaaccuguaauucuaaaagaugguccugaaagaguaauacuagcuggaccaaugcccgucaccguugcuagcgcagcucaacgacgagguagaauaggaagaaaccacaauaaagaaggcgaucaauacauauauaugggccaaccauugaauaacgacgaagaccaugcacauuggacugaggcaaaaaugcuucuggacaacauaaauacuccugaaggaauaauaccggccuuauuugaacccgagagagaaaagucugcugcuauagauggugaauaccgacuucguggagaggcccgaaaaacauuuguagaauuaaugagacgaggcgauuuaccaguauggcugaguuauaaaguagccucagaaggauuucaauauucugaucgccgauggugcuuugacggagaacgaaacaaucaagucuuggaagaaaacauggauguggagaucuggacgaaggaaggagaaagaaagaaacuccgaccaagaugguuagacgcuagaacauacucagacccauuggcccuucgagaauuuaaagaauuugcagcgggacgaagaucaguauccggggauuuaaucuuggaaauaggaaaauuaccgcaacacuuaacacaaagggcacaaaaugcuuuagauaauuuaguuaugcuucauaauucagaacaaggaggacgggcauaucgacacgcuauggaggaauuaccugauacuaucgagacucugaugcuacuagcccuuaucgcaguucuaacaggggguguaacgcuuuucuuccuuuccggcagagggcuagggaaaacaucuauaggauugcuuugcguaauggccucaagcguacugcuuuggauggcuuccgucgaaccucacuggauagccgcuagcauaauucucgaguuuuuccugaugguucugcugauacccgaacccgaucgacaacgaacgccucaagauaaccaauuggcuuacgucguuauagguuuacuuuucaugauccuuacaguugcagcuaacgaaaugggccuacuggaaacaacuaagaaagacuuagguauuggacaugcugcagucggaaaccaucaccacgccgcgaugcuagaugucgauuuacauccagcuagugcauggacacuauaugcaguugcgacaacaauuauuacaccuaugaugcgccacacgauagagaauacuacagcuaacauuagccuaacugcgaucgcuaaccaggccgccauauuaauggguuuagauaaaggauggccuauaaguaaaauggacauuggagugccacuacuugcauuaggaugcuacagccagguaaaucccuuaacauuaacagcugcgguucuaaugcucguagcucauuaugcuauaauugggccaggccuacaagcgaaagccacaagagaagcacaaaaacgaacugcagcaggaaucaugaaaaaccccacggucgauggcaucguugccaucgaccuggacccuguaguuuacgaugcgaaauuugaaaagcaauuaggccaaauuauguuacugauccuauguacaagucaaauuuuacucaugcgaacaaccugggcguugugugaaucaauaacuuuggcuacagggccacugaccacacuuugggaaggaagcccaggaaaauucuggaauacaacgauagcugugucaauggcaaauauuuucagggguaguuaccuagcuggagcuggcuuagcauuuagccuaaugaagucguuaggaggcgguagacgagguacgggagcacagggagaaacucuaggggaaaaauggaaaagacaacucaaucaacugagcaaaagugaauuuaauaccuauaaacgauccggcauaauggaaguagaccgcagcgaggcgaaagaaggcuugaaaaggggagaaacuaccaaacaugcuguuucacguggaacagcgaaacugcgaugguucguugaacguaauuugguaaaaccugagggaaaagucauagauuuaggaugugguagagggggauggucguacuauugcgccggucuaaagaaaguaacggaaguuaaagguuauacuaaagguggacccggacaugaagaaccgauaccgauggcaacuuauggauggaauuuggugaaauuacacucaggaaaagauguauuuuucaucccacccgaaaaaugugacaccuuauugugugauauuggcgaaucaagucccaacccgacuaucgaagaggguagaacccuaagaguacucaagaugguugaaccuuggcuuagagguaaccaauucuguauuaaaauccucaaccccuacaugccuucaguaguagaaacacuggaacaaaugcaacgaaaacacggcgguaugcuaguucgaaauccucugucaagaaauucgacucaugagauguauugggugucuugugguacaggaaacaucguaagugcuguaaacaugacgagcaggaugcuacuaaaucguuucaccauggcgcauaggaaaccaacauaugaacgcgauguagaccuaggggcuggaacgcgucauguggcaguagagccggagguugcaaaucuugacauaauagggcagcguaucgaaaacauaaaacacgaacauaaaucaacguggcacuaugaugaagauaaccccuacaagacaugggcauaccaugguaguuacgaaguaaaaccaucagguucagcaucaucaaugguaaauggaguagucaaacuuuuaacaaaaccuugggacgucauacccauggucacgcagaucgcgaugacagauacgaccccauuuggacaacaaagagucuucaaagaaaaaguagacacgcggacuccaaaagcgaaacgaggaacagcacaaauuauggaaguaacugcuaaauggcuuuggggauuuuuaucacgaaauaaaaagccaaggauauguacuagagaagaguucacaagaaaagugcguagcaacgcagccauaggcgcaguauuugucgacgaaaaucaauggaacucugccaaggaagcuguagaggacgaaagauuuugggaccucgugcaucgugagagagaguugcacaagcaaggcaaaugugcaacguguguauacaacaugauggguaaaagggagaagaaacugggagaguucgggaaggccaagggaagcagagcaauuugguauauguggcuuggugccagauuuuuagaauuugaggcuuuagguuuuaugaacgaagaucauugguucucgcgagaaaauagcuuaaguggagucgaaggagaggggcugcacaaacuugguuacauucugcgggauauaaguaaaauaccuggaggaaauauguaugcagaugacacagcuggaugggacacgcgaauuacugaagaugaccuucaaaacgaagcacgaauaacagauauuauggagccugaacaugcguuguuagcaaaaaguauauucaaauuaacauaccaaaauaaaguaguucgaguacaaaggccagcaaagaacgggacagucauggacguuauaucgaggagagaccagagaggaucaggacaaguugggacauaugguuuaaauacguucacaaauauggaggcucaacuaaucagacaaauggaaagugaagguaucuuuucaccaucggaauuagaaacaccuaaccuugcugaacggguauuagauugguuggaaaaguacggaguugaacgguuaaaacgcauggccauaucaggagaugauugcguggucaaaccaauagacgaccgcuuugccaccgcauugacggcgcuaaaugauaugggcaaaguacgaaaggauauuccgcaaugggagccgucaaagggcuggaaugauuggcaacaggugccguuuuguucgcaucacuuucaucaauugauaaugaaagaugguagggaaauaguuguuccaugccguaaucaagacgaguuaguagggagagcaagaguaagccagggcgcuggguggagcuuaagggagacagcaugccuagguaagaguuaugcgcagauguggcaacuaauguauuuucaucgaagggauuugcggcuagcugccaaugcaauuuguagugcgguaccaguagauuggauuccuacaucccgcacaacauggagcauacaugcucaucaucaauggaugacuaccgaggacaugcuaucaguuuggaaucgcguuuggauugaagaaaauccauggauggaagauaagacgcacauaagcucauggggugauguuccuuacuuagguaaaagagaagaucaaugguguggcucuuuaauaggucucaccgccagagcaacuugggccacuaauauacaaguggcaaucaaucagguucgccggcuuaucggaaaugagaauuaccuagacuauaugaccagcaugaaacgcuucaagaaugagagugacccugaaggagcacuaugguaa

SEQ ID NO: 21881 - RNA, 9879 nt, Artificial Sequence
  derived and/or modified CDS sequence (opt6) from DENV-1__JF937618__SS-prME
agugugaccaugcuuuuaaugcugaugccuacggcgcuugcuuuccaucuuaccacucggggaggagaaccucacaugauagugaguaaacaagaacgaggaaagucauuauuauucaaaacuagcgcaggagucaacauguguacauugauugcgauggaccuuggagaacuuugugaggauaccaugacuuacaaaugcccgaggauuaccgagaccgaaccugacgacguagacugcugguguaaugcaacagauacauggguaaccuacgguaccuguucucaaaccggcgagcaccgacgagauaaacgaucaguagcacuagcgccucauguaggacugggauuagaaacaagaaccgagacauggaugucaagcgaaggggcauggaaacaaauacaaagaguagaaacaugggcauuaagacacccggguuuuacaguuauagcuuuauuccuggcccaugccaucggaaccaguauuacgcagaaagguaucauuuucauacuuuuaaugcuugugacaccgagcauggcaaugagauguguagguaucgggucacgcgacuucgucgaaggacuuagcggcgcaacauggguagacgucguucuugagcaugguucuugcguuacuaccauggcuaaagauaaaccaaccuuagauauagagcuacuuaaaacugagguaacaaacccggcaauacuaagaaaacugugcaucgaagccaaaauaagcaauaccaccacagacucacgaugucccacacaaggcgaggcaacacucguugaggagcaagacgcaaauuuuguauguagaaggaccuuuguagacagaggaugggggaacggaugugggcucuuugguaaaggcuccuugauaacaugcgcaaaauucaaaugcgugacaaaauuagaggggaaaauaguacaauaugaaaaucuaaaauacucagucauaguuacaguucauacuggagaucaacaucaagucggaaaugaaucaacggagcauggaacuacagcuacaauaacgccucaggcgccaaccacagagauacaacuaacagacuauggugcguugacacuggacugcaguccgagaacaggauuagacuucaaugagaugguauugcuaaccaugaaagagaaaucauggcuaguccacaaacaaugguuuuuagaucuaccacuuccuuggacaagcggcgccucuacaucacaggaaacuuggaacaggcaagauuuauuggucacauuuaaaacugcacacgcuaagaaacaagaggucguaguacucggaucgcaagagggugcuaugcacaccgcucuaacuggggcaacggaaauucagacgaguggaacuacaaccauuuuugcaggacauuuaaaaugccggcugaaaauggauaaauuaacacucaaaggaaugucauauguuauguguacgggaaguuuuaaauuggagaaagagguugcugaaacacaacacgguaccguuuugguucagauaaaauacgaaggcacggaugccccuuguaaaauccccuuuucuacccaagacgaaaaaggaguaacacagaacgggcgccuaauaaccgcaaauccgauuguaacagauaaagaaaaacccgugaauauagaagcagagccuccuuucggagaaaguuacauaguaaucggagcaggggaaaaagcucuaaaauuaucaugguuuaagaaaggaucaucuauaggcaaaauguuugaagcuacugcucgcggagccagacguauggcaauacugggggauaccgcaugggacuucggcucaauaggaggaguuuucacgucagucgggaaacuugugcaucaaauauuugguacagccuacggcguacucuuuucagguguaucuuggacuaugaaaauuggaauuggcguacuacucacauggcucggauuaaauuccagguccacgucccugaguaugacuuguaucgcaguuggucuaguuacgcuuuaucuagguguuaugguacaagcagauagcggaugugucauaaacuggaaaggaagagaguuaaaaugcggaagugguauuuuugugacuaaugaaguacacacauggacugagcaauacaaauuucaggccgauucgccaaaacgccuuucagcggcaauaggcaaggcuugggaagagggugugugcgguauaaggucugcgacaaggcuggaaaauaucauguggaaacaaauuagcaaugaacugaaucauauacuccucgaaaaugacaugaaguucacuguugucguuggagauguggcggguaucuuagcacaaggaaagaaaaugaucaggccccaaccuauggaauacaaauacucauggaaaagcugggguaaagcaaaaauuauaggagcagacguacagaauacuacauucauaaucgauggaccgaacacaccggaauguccugacgaucaaagagcauggaauauaugggaaguggaagauuacggauucggcauuuuuaccacuaauauaugguuaaaauuaagagauucauauacacaggugugcgaccacagauugaugucagcugcaauaaaagacagcaaagcagugcacgcggauaugggauauuggauugaaucagaaaagaacgaaacuuggaagcuagcaagagcaucauucaucgaagugaaaacaugcaucuggccaaagucacacacauuaugguccaacggaguucuugaaucggaaaugauuauaccuaagaucuauggggguccgauuagucaacacaauuacagaccuggauacuuuacgcaaaccgcagguccuuggcacuuaggcaaacuagaauuggacuucgauuuaugugaagguacgacaguaguuguggacgagcauugcggaaaucguggcccuucauuaaggacaaccacaguaacagguaaaauaauacacgaguggugcugcagaucgugcacacucccaccuuugcgauuuagaggggaagacggcuguugguauggcauggaaauuaggccuguaaaagaaaaggaagaaaauuuggugaaaucaaugguaucagcuggcaguggcgagguugacagcuuuuccuuagggcuuuuauguauuaguauaaugauagaagaaguaaugcguuccagguggucucgcaaaauguuaaugacuggaacacuagcagucuuccuucuuuuaauuaugggacaguuaacguggaacgauuuaauucgacuguguauaauggucggagccaaugcaagugauaggauggguaugggaacaacguauuuagcucugauggccacuuuuaaaaugagaccgauguucgcggucggucugcuauuuagaagacuuacaagcagagagguauuauuauuaacaauaggacugucauuagucgcuaguguagaacuaccgaacaguuuagaagaguugggugacggucuggcuaugggaaucaugauacuuaaauuauuaacugacuuucaaucacaucaauuaugggcaacacuacuaaguuuaacauucauaaaaaccacauucagucuacacuacgccuggaaaacaauggcaauggucuugucuauaguaucauuauuuccacuauguuuaaguacgacaagucagaaaacuacuuggcucccagugcuccuaggaagccuaggaugcaaaccgcuaacaauguuccuaauugccgagaauaaaauuuggggaaggcguucauggccccuuaacgagggcauaauggccguuggcauaguaucgauacugcuaagcagcuuacucaaaaaugauguaccguuggcagggccccuaauagcaggcggaauguuaauagcaugcuaugugaucagcgguucaagugcagaccuaucacuagaaaaggcagccgaaguauccugggaagaggaagcugagcacuccggagcuucucacaauauuuugguggaaguacaagacgauggaacaaugaaaauuaaggaugaagaaagggaugacaccuuaacaauauuauugaaagcuacacuucuagcgguuuccggaguauacccucuuuccauaccugccacacuuuuugugugguacuucuggcaaaagaaaaagcaaagaucugggguuuuaugggauacaccaaguccaccugaaguagaaagagccguucuggaugaugggauauacaggauaaugcaacgaggacuacuaggccgaucucaaguuggagugggaguauuucaagaaaacguguuccauacuauguggcacgucacccgaggggccguuuuaauguaccaagguaaaagacuugagccgucuugggcuucaguuaagaaagauuuaauaucauaugguggugguuggagacuacagggaaguuggaauacgggggaggaaguacaaguaaucgcugucgagccaggcaaaaauccacguaauguacaaacuacuccgggaacguuuaaaaccccagaaggggaaguaggagcaauagcacucgacuucaaaccuggcacaagugggaguccaaucguaaauagggaaggaaaaauugucggacuauaugguaacgggguugucacuacaaguggaacauauguaucagcgauagcucaagccaaagcaucgcaggaaggaccacuaccugagaucgaagaugaaguauuucguaaaagaaaucuaacaauaauggaccuacauccggggucgggcaaaacacguagauaccuaccagcaauaguucgggaagcaaucaaaagaaaacuaaggacauuaauucuugccccaacaagaguuguugcaagugagauggccgaggcauugaaaggaaugccuauuagauaccagacgaccgcugucaagucugaacauacuggcaaagaaauuguggacuuaaugugucaugcgacuuucacaaugagauuguuauccccaguaagagucccgaauuacaacaugauaauuauggacgaagcacauuuuacagauccaaguucuauagcugcccgugguuacauuagcacuaggguaggaaugggagaggcggcagcaauuuucaugaccgcuacacccccuggaagcguagaagcauuuccgcaauccaaugcaguuauacaagacgaagaaagagacaucccugaacgauccuggaacucuggguaugaauggaucacagauuucccaggcaaaacuguaugguuugugccauccaucaaaucagguaaugauauugccaauuguuuaagaaagaauggaaaacgaguaauccaacucucgagaaaaacuuucgacacugaguaucagaaaaccaaaaacaaugacugggacuauguuguaacuacugacauaagcgaaaugggagcaaacuucagagcggacagggucauagauccaagaagaugucuuaaaccuguaauucuaaaagauggaccugaaagaguaauacuugcaggcccuaugccugugacaguagcuucagcagcacagagacggggaagaauaggcagaaaucauaauaaagaaggagaccaauacauuuauaugggacaaccacuaaacaaugaugaagaccacgcacacuggacagaagcuaaaaugcucuuagacaacauaaauaccccagaagguauuauaccagcguuauucgaaccugaacgagagaaaagugcugcgauagauggcgaguauagguuaagaggagaagcuagaaaaacauucguugaguugaugcgacgaggcgauuuacccguuuggcugucuuacaagguugcaagcgaagguuuucaguauuccgaccgucgauggugcuuugauggggaaagaaacaaucaaguauuagaagagaacauggacguugaaaucuggacaaaagagggugaacgaaagaaacuucguccacggugguuggacgcaagaacauauucugacccguuagcccuacgugaguucaaagaauuugcggcuggcagaagaucugugucaggcgacuuaauauuggaaauugggaaauuaccacaacauuugacucaacgugcacagaaugcauuagacaaucuuguaaugcuucacaauagcgaacaaggugggagggccuauagacaugcaauggaagaacuaccagauacaauugagacuuuaaugcuauuagcauugaucgcggugcuaacagguggcgucacucuuuucuuuuuaaguggacguggauuaggaaaaacaucaauuggccuuuuaugcguuauggcuucgucgguacucuuauggaccgcaucugucgaaccacauuggauugcugcaucuauuauauuagaauuuuuccucaugguauuacucauaccagaaccagaccgccagagaacaccucaagacaaccaauuggcuuaugucgugauaggauuauuauuuaugauucucacgguggccgccaaugaaaugggucugcuagaaaccacuaagaaagauuuggggauaggacacguugcaguaggaaaucaccaucaugccgccaugcucgacguagaccuucacccugccuccgcauggacuuuguacgcggucgcuaccacgauuauaacgccuaugaugagacauacuauagaaaacaccaccgcuaauauaagucucacagccauagcaaaucaagcagcuauuuuaauggguuuagauaaggguuggccaauaaguaaaauggacauugggguaccguuauuagcauuagguuguuauagucaaguuaauccauugaccuugacagcugcagugcuaauguuaguugcacauuacgcuauaauugguccggguuuacaagcuaaagcuacaagagaagcccagaaaagaacugccgcuggaauuaugaaaaauccgacugucgauggaaucguagcgauugaccuugauccgguaguuuaugaugcgaaauuugagaagcaauugggucaaaucauguuauugauacuaugcacuucgcaaauuuuacuaaugcguaccacuugggcauugugugagucaauuacacuagcaacuggcccguuaacuacccucugggagggaucaccagggaaauuuuggaauacaacgaucgccgugucaauggcuaauauauucagagggaguuaucuugcaggagcagggcuagcauucagcuugaugaaaagucuaggugggggccgaagggggacaggugcacagggagaaacauuaggugaaaaauggaagcgucaacuaaaucaauugaguaagucagaguucaauacguauaagaggucggggauaauggaaguagauagaucagaagccaaagaagggcucaaacguggagaaacgacaaaacacgcaguaucccguggaacugcgaaacugcguugguuuguggaacguaaucuuguaaaacccgaggguaaggugauagaucuugguuguggcagggguggauggucauacuacugcgcgggccuaaagaaaguaacagaggucaaaggauacaccaaggguggaccugggcaugaagaaccaauaccuauggcaacauaugguuggaacuuagugaaacuacauaguggcaaagauguuuucuuuauaccuccugaaaaaugcgacaccuuauugugcgauauaggugaaucaagcccgaauccaacaauugaagaaggcagaacacuuaggguucuuaagaugguagaaccgugguuaaggggcaaucaauucuguauuaaaauacuaaacccauauaugccuagcguggucgaaaccuuagaacaaaugcaaaggaaacaugguggaauguuaguacgcaacccguuaagcagaaauucgacacacgagauguauuggguuucauguggaacaggaaauauuguuagcgcaguaaauaugacauccagaaugcuauuaaaccgguucacuauggcucaucguaaacccacuuacgaaagagauguggauuugggagcggguacuagacacguggcgguugagccagaaguagcaaaucuugauaucauagggcagcgcaucgaaaacaucaaacacgaacauaagucgacauggcauuaugacgaggacaaucccuauaagacuugggcauaucaugguucguaugaaguuaaaccuucuggcuccgcaucgucaauggucaauggaguaguuaaguuauugacaaaacccugggaugugauuccaaugguaacacaaauagcgaugacagacacuacaccuuucggacaacaaagaguuuuuaaagaaaaaguugacacacgaacaccuaaagcaaagcgaggcacggcgcagaucauggaagugacagcuaaauggcuauggggguuuuuaucacgaaacaagaaaccacgaauuuguacuagagaagaguucacacguaaagugagaucuaaugcagcuauaggcgcaguuuucguugacgagaaccaauggaauagugcgaaagaagcaguagaggaugaaagguucugggaucuuguccaccgcgaaagagaauugcacaaacagggcaagugcgcaacauguguauauaacaugaugggcaaaagagagaagaaauugggagaauuuggaaaggccaaaggcucuagagcuaucugguauauguggcuaggggcccgcuuucucgaauuugaggcucuagguuucaugaaugaagaccauugguuuucaagggaaaauucacugucaggaguugaaggugaaggguuacacaagcuggguuacaucuugcgugauaucucaaagaucccaggagggaacauguaugcggacgacacagccgggugggauacgagaauuacagaagacgauuuacaaaacgaagcgaggauaacagacauaauggaaccagaacacgcguuauuagcuaaaaguauuuuuaaacuaaccuaucagaacaaaguuguuagaguacaacgccccgcuaaaaaugguaccguaauggacgugauaucucgccgcgaccaaaggggaucagggcaaguagguaccuacggccucaacacguuuacuaauauggaggcccaauuaauaagacaaauggaaagugaggguauauuuaguccaucugagcuagagacacccaaccuagcagagagaguucuugacugguuagaaaaauaugguguagaacgacugaaacguauggcaauauccggggacgauugcguaguaaagccaauagacgacagguucgccaccgcucuuacagcucuuaaugauauggguaagguacguaaagauauuccacagugggaacccaguaaagguuggaacgacuggcaacaagucccauuuugcucacaccauuuccaucaauuaauuaugaaagauggaagagaaauaguaguuccauguaggaaccaggacgaauugguuggcagagcaagggucagucaaggugcuggauggucguuaagagaaacagcuugucuaggaaaaucuuaugcacaaauguggcaguuaauguauuuccacaggcgcgauuuacgguuagccgccaacgcuauuuguucggcagucccaguggauuggauaccaaccucgagaacaaccuggagcauucaugcacaccaucaguggaugacaacggaggauauguuaagcgucuggaaccgcguauggauagaagaaaauccuuggauggaggauaaaacgcacauuucaagcuggggcgaugucccauauuuaggcaaacgagaagaccaauggugugguucucuuauugggcuuacggcucgcgcgacuugggcaacuaauauacaaguggcaauaaaccaaguaaggcgacuaauaggaaacgaaaacuaccuugauuauaugacaucuaugaagagguuuaaaaaugaaagugacccagaaggagcccugugguag

SEQ ID NO: 21882 - RNA, 9879 nt, Artificial Sequence
  derived and/or modified CDS sequence (opt6) from DENV-1__JF937619__SS-prME
agcgugaccaugcuccugauguuaaugccaacugcgcuugcauuucaccuaacuacuagagguggagaaccccauaugauuguguccaaacaagaaagaggaaaaagucuacucuucaaaacaucagcaggaguaaauaugugcacucugauagcuauggacuuaggagaacuaugcgaagauacuaugacauacaaauguccacggaucacggaagcagaaccugaugauguugauugcuggugcaaugcuacggauaccuggguuacguaugguacaugcagucaaaccggggaacauagacgugaaaaacguaguguugcuuuagcgccccacgucggccuaggucuugaaacaaggaccgaaacguggaugucaucagaaggggccuggaaacaaauucaaaggguugagacuugggcauugaggcauccagguuucaccguaauugcgcuguuucucgcacaugccauagguacaucuauaacucaaaaagguauaauauuuaucuuguugauguugguaacccccuccauggcaaugagaugcguaggaauuggaagccgugacuuuguugaaggauuaucaggcgcaacauggguagauguaguucucgaacacggaaguuguguaacaacuauggcaaaagacaaaccuacacucgacauagaauuacuaaaaacagagguaacuaauccggcuguguugcgaaaacucuguauugaagcaaaaauauccaauacgaccacugacucgagauguccaacgcaaggggaagcaacuuuggucgaagaacaggacgcuaauuucguuugcagacgaacauuuguagaucgagguuggggcaauggauguggacuuuuugguaaagguaguuuacuaacgugugccaaauuuaaauguguaacaaaacuagagggaaaaauaguucaauacgaaaaucuuaaauacagcguaauagucacaguacauacaggagaucaacaccaaguuggaaaugaaaguacagaacacggaaccacugcaacuauaacaccgcaggcucccacaacagagauucagcuaaccgacuauggagccuugacacucgauuguagcccuaggacagguuuagacuuuaaugaaaugguguugcuaacgaugaaagaaaaaucgugguuaguacauaaacaaugguuuuuggaucugccgcucccauggacuucuggagccuccacaucacaagaaacguggaaucggcaagacuuguuagucacauuuaaaacggcccacgccaagaaacaagagguaguaguucuggggagccaagaaggugcaaugcacacagcgcucacaggcgcaaccgaaauccaaacgucagggacuacuacgauuuuugcuggucauuuaaaaugcaggcucaaaauggacaaacugacacuaaaaggcauguccuacgugauguguacugguaguuucaaacuagaaaaagaagucgccgagacucaacauggaacaguccuuguucaaauaaaauaugaagggacggacgcuccauguaaaauaccauuuucaacgcaggaugaaaaaggaguaacccagaauggaagacugauaacggcgaacccaauaguuacagacaaagaaaaaccaguuaauauagaagcugaaccaccauuuggcgagucuuauauaguaauuggagcgggggaaaaagcgcugaaauuaucaugguuuaagaaagggucuucuauuggaaagauguucgaagcaaccgcucguggagcacgucgaauggcaauuuuaggagauacagcaugggacuuuggaucuauagguggugucuuuacaaguguaggaaaguuaguacaccaaauuuucgggacagcuuacgguguauuguuuaguggagugucauggaccaugaaaauaggcauaggcguauuauuaacguggcuaggucuaaauaguaggaguaccagcuugagcaugacgugcauagccgugggauuagugacucuauaucuuggaguaaugguucaggcggauucggggugcguaauaaauuggaaagggagagaacucaagugcggaucaggaauuuucgugacaaaugaaguccauaccuggacagaacaguauaaauuccaggcggacucgccaaaacgacuuucagcugcuauugguaaggcaugggaagaggguguuugugggauacguagugcgacucggcuagaaaacauaauguggaaacaaaucagcaacgaacugaaccauauacuauuggaaaacgacaugaaguuuacaguuguagugggggacguagcgggaauccuugugcaagggaagaaaaugauaaggccgcaaccuauggaauacaaauauagcuggaaaaguugggggaaggccaaaauaauuggagcagauguacaaaauuccacauucauaaucgacggucccaacacacccgaauguccugaugaccaaagagcauggaacauaugggaaguugaagauuauggcuucggcauauuuacaaccaauauauggcuuaaacuucgcgauuccuacacacaaguaugcgaucaccgguuaaugucugccgcaauaaaagacucaaaggcugugcaugcagauaugggauauuggauagaauccgaaaagaaugaaacauggaaacuagcccgggccaguuuuaucgagguaaaaacaugcaucuggccgaaaucgcauacauuauggucaaauggagucuuggaaagugaaaugauaauaccgaaaauacacggagguccgauaucgcaacauaauuauaggccagguuauuuuacccaaacggcugguccauggcaccuuggcaaguuggaauuagacuucgacuugugugaagggacuacaguaguuguggaugaacauugugggaacaggggaccaagccuucgaacuacaacgguaacgggaaagauaauacacgagugguguugcaggucauguacacugccaccauuaagauuucggggugaagauggauguugguacggaauggaaauacguccaguaaaagagaaagaggaaaaccuggugaaaaguauggugucagccggaaguggagagguugauaguuucucgcucggccuauugugcauaaguauuaugauugaggaaguaaugagauccagauggagucguaaaaugcuaaugacagggacguuagcugucuucuuuuuacugauaaugggucaacuuacuuggaacgaccuuauaagauugugcauaaugguaggggcuaaugcaagcgacagaauggguauggggaccacauacuuagcguuaauggugacauucaaaaugagacccauguuugccguuggguugcuauucagaagauuaacaucccgugagguauugcugcugaccauaggauuaucacuuguugcaaguguagaauuacccaauagcuuagaagaacuuggugauggauuagcaaugggcauaaugauccucaaguuguuaacagacuuucaaagcuaucaacuuugggcuacauuguugucgcuaacuuucauuaaaacuacauucaguuugcauuaugccuggaaaacaauggcaauggucuuaucgauugugucguuauuuccucuaugccuaucgacaacaagucagaaaacuacuugguuaccgguauuauuaggcucucuaggguguaaaccacuaaccauguuuuuaauagccgaaaauaaaauauggggcagaaaaaguuggccacucaaugaaggcauuauggcugucgggauugugaguauauugcuauccucguuauugaagaacgacguuccguuagcaggaccacugauagcgggcggaaugcuuauagcauguuacguaauuucaggaucgagcgcggaccuaucauuggaaaaagcagcugaagugucuugggaagaggaggcagaacacucaggagcaucacacaacauauuaguagaaguucaagaugacggaacaaugaaaauaaaagacgaggaaagagaugauacccugacuauuuugcuuaaagcuacccuucuugcaguauccgggguuuacccucuuucaauccccgcaacccuuuuuguauggcacuuuuggcaaaagaagaaacaaagaaguggcguacugugggauacaccaucaccucccgaaguagaaagggcagugcuggaugauggaauauacagaaucaugcaacgagguuuauuggggcguagccaaguuggcguaggaguauuucaagagaacguguuucauacaauguggcaugugacgaggggagcaguucugauguaucaagguaagagacuagaaccaucaugggcaaguguaaagaaagaucugaucucauauggcgguggauggagauuucagggauccuggaacaccggugaggaaguacaggucauagcgguagagcccgguaaaaauccuaagaacguucaaaccgcuccagguacauuuaaaacaccagaaggagaaguaggugcgaucgcacuugacuuuaaaccaggaacaucuggaaguccaauugucaaucgagaagggaaaauaguuggccuauacggaaauggagucguaaccacaucuggaacuuaugugucugcgauagcccaggccaaagccucacaagaggguccgcucccagaaaucgaagaugaaguauuuagaaagagaaaucuaacaauuauggaccuucaucccgggucuggaaaaacacgacgauaccuaccugccaucguucgagaagcuaucaaaaggaaauuaagaacucucauucucgcgccgacuagggucguugccucagaaauggcugaagccuugaaaggaaugccaauacgauaccagacaacagccguaaaaagugaacauacuggaaaagagauuguggacuugaugugccacgcgacguuuacaaugcgguuacuguccccaguuagaguaccgaauuauaauaugauuauuauggaugaagcucauuucacagaucccucaucaauugccgcccgugguuacauuuccaccagggucgggaugggagaagcugcggcaaucuucaugacugcuacgccuccuggcucgauggaagcauucccccaaucuaacgcggugauacaagacgaagagagggacauacccgaaagauccuggaacucaggauacgaguggauuacagauuucccaggaaagacugucugguucguaccaucuaucaaagcggguaaugauauagcaaauugcuuaaggaaaaauggcaagcgcgugauucaauuaucaagaaagacauucgacacagaguaccaaaagaagaaaaauaaugauugggauuauguugucacaacagacaucucggagaugggggcuaauuuuagggcggauagaguuauagacccuagacgauguuugaagcccguaauacuaaaggaugguccugaaagaguaauauuagcaggcccuaugccuguuacuguagcaucggcagcucagaggagggggcggaucgguagaaaccauaauaaagagggagaccaguauauuuauaugggacagccauugaauaaugaugaagaccacgcgcacuggacggaagcuaaaauguuauuagacaacauaaauacuccggagggcauuauuccggccuuauucgaaccugaaagagagaaaagugcugcuauagacggggaguauagacuucguggagaggcgcggaagacauuugucgaauugaugcggagaggagacuugccaguaugguuaucauauaaaguagcuagcgaaggcuuucaauauucagaucgaagaugguguuucgacggugaaagaaauaaccaaguccuagaagagaauauggacguggaaaucuggacgaaagagggugagcguaagaaauuaagaccuagguggcucgaugcuagaacguauucugauccacuugcauugagagaauuuaaagaguucgcagcugggaggaggaguguaucuggagaccugauauuagagauuggaaaacuaccgcaacaucuaacgcagagggcgcaaaaugcuuuagacaacuuaguaauguugcacaauuccgaacaaggaggacgagcauauagacaugccauggaagaguuaccggauacaauugaaacgcuaaugcucuuagcauugaucgcuguccuaacugguggaguaacacuuuucuuucuaucuggcaaaggcuuagggaaaaccaguauuggauuauuauguguuauggcuucaaguguucuacuuuggauggcauccguggaaccacacuggauagcagcaucaauaauacuagaguucuuuuugaugguacuccuuauaccagagcccgacagacaacgaacgccccaagauaaccaauuggcauacguuguaauugguuuauuauucaugauacuuacuguagcugccaacgaaauggguuuacuagaaaccacaaagaaagaucuaggaauuggacacguugcggucgaaaaucaccaccaugcugcaaugcuagacguugaucuccacccagcuagugccuggacauuauaugcaguagcgacaacaauuauaaccccaaugaugcgccauacaauagagaauacaacggccaauaucagcuuaacagcaauagcuaaccaagccgcaauacuaaugggacuggacaaaggcuggccaauuucaaaaauggauauagggguuccguuacuugcauuaggcuguuacucgcaaguaaacccccucacccugacagcggcgguacuaauguuaguugcacauuacgcgauaauuggaccaggcuuacaagcuaaagcaacucgugaggcgcagaaacgaacagccgcagggauuaugaaaaauccaacaaucgaugggaucguagcuauagaucucgauccagugauauaugacgcaaaauuugaaaagcaacuagggcaaauuauguuauugauauuguguacaagucaaauuuuauugaugcggacgacaugggcacugugugaaucuauaacccuagcaacagguccauugacgacucuaugggaggguucccccgguaaauuuuggaauacgacgauagcaguuaguauggcgaauauuuuucgcggaaguuaucuagcuggagcaggucuugcauucucauuaaugaagucacuuggaggaggcaggcguggaacaggagcacagggugaaacucuaggagaaaaauggaaacgucaauuaaaucaacucagcaaaucugaguuuaacacuuauaaacguaguggaauaauggaaguggacagaagcgaggcaaaagaaggucuaaagcgaggggaaacaacuaaacaugcaguaagccgagggacugcuaagcucagaugguucgucgagagaaauuuagugaagcccgaagguaagguaauagaccucggguguggaagagguggcuggucauacuacugcgcgggauugaagaaaguuacugagguuaaaggauacaccaaagguggcccgggacaugaagaaccuauccccauggcaacauauggauggaacuuagugaagcuacauucaggaaaggauguauucuuuauaccgccagaaaaaugcgauacacuacuaugugauauaggggaauccucuccgaauccuacgauagaggaaggacguacauugcguguacucaaaaugguggaaccuugguugcgcggaaaucaauuuuguauuaaaauccuuaauccuuacaugccguccguaguugagacacuggaacaaaugcaacgaaagcacggcgguaugcucguuaggaauccacuaucaagaaacaguacgcaugaaauguauuggguaaguuguggaacaggaaacauugucucggcaguaaauaugacgucacgcaugcugcugaaucguuuuacuauggcccaccggaaaccaacguacgaacgagaugucgauuuaggcgcagguacacggcacguggcgguugagccagaaguugcaaauuuagauauuauaggucaacguaucgagaauaucaaacacgagcacaaaucgaccuggcacuacgacgaagauaauccauacaaaaccugggccuaccacgguagcuacgaagugaaaccaucggggagcgcaaguucaaugguaaacggaguaguuaaacuauugacuaaacccugggacguuauucccaugguuacucagauagcaaugacagauacuacuccauuuggacaacaaagaguauuuaaagagaaagucgacacacgaacuccaaaggcuaagagaggaacugcgcaaauaauggaaguuacggcgagauggcuaugggguuuucuaucuagaaacaagaaaccaagaauauguacgagagaggaguucacaaggaaggugcguaguaaugcugccaucggagcaguguuuguagaugaaaaccaauggaacucugcaaaggaagcuguagaagaugaucgauucugggaucuuguacaccgagaaagagaauugcacaagcaagguaaaugcgcgacgugcguauauaacaugaugggaaaaagagagaagaaacuaggggaguuuggaaaggcaaaagggucaagggcaauaugguauaugugguugggugcuagauuucuagaauuugaagcguugggauucaugaaugaggaucacugguucaguagagagaauaguuuauccggaguagagggcgaaggacuucauaaauuaggauacauuuugagagauaucagcaaaauuccaggaggcaauauguaugcugaugauaccgccgggugggacacucguauuaccgaagacgauuugcaaaaugaagcuaaaauaaccgauauaauggagccagaacaugcuuuguuagcgaaaucgaucuuuaaauuaaccuaccagaauaaagucgucaggguucaacguccugcgaaaaacggaacaguuauggaugugauaucuagaagagaccaaagagguagcggacaggucgguacguaugggcuaaacaccuucacaaauauggaggcacaguugauacggcaaauggaaagugaaggaauauuuuuaccgaacgaacuugagacuccgaaucuugcuggucgaguccuagauuggcucgagaaauacggggucgagagacuuaaacgaauggcaauaucaggugaugacugcguaguaaagccuauugacgaccguuuugcuacugcacucaccgcccuuaaugacaugggaaagguuagaaaagauaucccucagugggaaccaagcaaaggauggaaugauuggcaacagguuccguuuugcucucaucauuuucaccaacuuauuaugaaagacgguagagaaauaguaguuccgugcaggaaccaagaugaacuggugggcagggcucgaguaagucaaggagccggauggaguuugagagagacugcuuguuuaggaaaaaguuaugcacaaauguggcaacuuauguacuuccauagacgugaucuccgccuagccgcaaaugcuauauguucggcaguuccaguagauuggguucccaccucaagaacgacauggaguauccaugcacaucaucaauggaugaccacggaagauaugcuuuccguauggaauagaguauggauagaagagaaccccuggauggaggauaagacaaggaucagcucuugggaagacguaccauaucuggguaagcgggaagaccaauggugcgguucccuaauuggucucacagcgagggcaacaugggcaaccaauauucaaguugcaauuaaucaaguuagacgauuaauugggaacgagaacuauuccgacuauaugacaaguaugaagagauuuaaaaaugagagugagcccgaaggagcgcugugguaa

SEQ ID NO: 21883 - RNA, 9879 nt, Artificial Sequence
  derived and/or modified CDS sequence (opt6) from DENV-1__GU131827__SS-prME
uccguaacgaugcuguugaugcucaugccaacagcauuggcauuccacuuaacaacccguggaggagaaccgcauaugaucguaucuaaacaggagcgggguaaaaguuugcuauuuaagacaagcgcaggcgucaauauguguacucugauugcaauggaucuaggggaauuaugugaagauacaaugacuuacaagugcccacgaauaacagaaacugaaccagacgacguugacugcugguguaacgcuacagacaccuggguuacuuaugggacaugcucacaaacaggagaacaccgucgcgauaagcguucgguagcacuugcuccgcacguugguuuaggacuagaaacuaggacggaaacauggaugaguuccgaaggagcuuggaaacaaauacagaggguagaaacgugggcacuaagacacccaggcuuuaccguuauagccuuguuucuugcacaugcaauagguaccucaauaacucaaaaaggcaucauauuuauacuccugauguuagucacgccaucaauggccaugcguugcguaggaauugggaguagagacuuuguggaagguuuaagcggcgcaacauggguugauguugugcuugaacacggaucguguguaacuacaauggcuaaagacaaaccaacacuggauaucgaauuauuaaaaacagagguuacuaaccccgcaguccuaagaaaauuguguauagaagcuaaaauaaguaauacaacaacagauagccgcuguccaacucaaggcgaagcuacacuuguagaggagcaagacgcgaauuucgucugcagaagaacauucguugacaggggcuggggaaacgggugcgggcuuuucggaaaagggucauuaauaacuugcgccaaauuuaaaugcguaaccaaacuagaagguaaaaucgugcaauaugaaaauuuaaaauauucugucaucguaacaguacauacuggcgaucaacaucaaguaggaaacgaaucuacggagcaugguacaacagcaacuaucacaccccaagcuccuacaacugaaauacaacuaacugacuacggagcacuaacacucgacugcucuccaaggacuggcuuggauuuuaacgagaugguucuacuaacuaugaaagagaagaguuggcuaguccauaaacaaugguuuuuggaccuuccacugccauggacauccggugcaucgacuucucaggagacauggaacagacaagauuuacuuguaaccuuuaaaacugcccaugcgaaaaaacaggaagugguagucuuaggaucucaagagggugcaaugcauaccgcacuaaccggugcgacagaaauccagacaagugggacgacgacuauuuuugcuggccacuuaaaguguagacuaaagauggacaaauuaacccuuaaagguaugucuuacgugaugugcacaggaagcuuuaagcucgaaaaggaaguggcugaaacacaacacggcacgguauugguccagauuaaauaugagggaacagacgcaccuugcaaaauccccuucuccacacaggaugaaaaggguguaacacagaacgggaggcuaaucacggcaaauccaaucguuacggacaaggaaaaaccugucaacauagaagccgaaccgccuuuuggagagagcuauaucgugauuggagcaggagagaaggcacucaaacucuccugguuccguaaagggagcucaauaggaaaaauguuugaggccacagcuaggggugcccggcggauggcaauacuuggagauacugcgugggauuuuggcucuaucggaggaguuuuuacgagcgucggcaaacuagugcaccagaucuucggcaccgcuuacgguguuuuguuuaguggggucucguggacaaugaaaauaggcaucgggguacuauuaacaugguugggucugaauucgcgcucaaccucucuaaguaugacuuguauagcgguaggccugguuacuuuguauuuagguguaaugguacaagccgacagcgggugugcaauaaacuggaaagguagagaacuaaaaugcgggucgggaauauucguaaccaacgaaguacacacauggacagaacaguauaaauuccaggcagauucuccgaaaaggcuuucagcagcaauaggaaaggccugggaagaagggguuuguggaauccguucugcaacgagacuugagaauauaauguggaaacaaauaagcaaugaguugaaucacauacuacucgagaacgacaugaaauuuacaguuguggugggagaugucgcgggaauucuggcucaaggaaaaaagaugauuagaccacaaccaauggaguacaaguauucuuggaaaaguuggggaaaagcaaagaucaucggcgcugauguacaaaacaccacauucauaaucgauggaccuaauacaccagaauguccugacgaucagagagcuuggaauauaugggaaguagaagauuacggauuuggcauauuuacaacuaauauauggcuaaaacugcgagauagcuauacacaagucugugaccauagauuaaugagcgcggccauaaaggacagcaaagccguucaugcugauaugggauauuggauagaaucagaaaagaaugagacuuggaaacuugcaagggcuucauuuauugaaguaaaaacauguauauggccgaaaagucauacucuauggucgaacgggguauuggaauccgaaaugauaaucccuaaaauauacgggggcccuaucagucagcacaauuaccgaccaggcuauuucacucaaaccgcaggaccauggcacuuaggaaaacuggaauuagacuuugaccuaugcgaaggaacgacugucguugucgacgaacauugcggcaacagagggccaucucuaagaacaacaacgguuacgggaaaaauaauacacgaguggugcugccguucguguacauuaccaccccugcgcuuuagaggggaagacgguugcugguauggaauggaaauacggccgguuaaagaaaaagaagaaaaucuugugaagucaaugguaagcgcggguucuggcgagguagauucauucuccuuaggguuacuaugcaucuccaucaugauugaagaggucaugcggucuagaugguccagaaaaauguuaaugacugguacauuggcaguauuuuuuuugcucauuaugggacaacugacauggaaugauuugauucguuuaugcauuauggugggagcaaaugcaagcgauagaauggggauggguacaacauauuuagcauugauggcuacuuucaaaaugaggccuauguucgcaguuggucuacucuucagacgauugacaucacgggaaguacugcucuuaacaauaggccuuaguuuaguagcgucaguagaacucccuaacucauuggaagaacuaggcgauggauuagcuaugggcauaaugauauuaaaacuuuuaacagacuuccaaagucaccaacucugggcgacacuacucucacuuaccuuuauaaaaacaacauuuucucuacauuaugccuggaaaacaauggcaaugguuuuaucaaucgugucguuguuuccucuuugucuuagcacaacgucccagaaaacaacaugguuacccguauugcuuggaaguuuagggugcaaaccacuaacuauguuccuuauagcggaaaacaaaauauggggucgaagaagcuggccccuaaacgaaggaauuauggcuguggguauagugucaauccuucuaucaaguuuauuaaaaaaugacgugccacuagcugguccuuuaauugccgggggcaugcucauagcaugcuacguaauaagugggucuagugcggaccuaucauuggaaaaagcugccgaaguuucaugggaggaggaagcagaacauucuggagcaucucauaacauuuuaguugaaguucaagaugauggaaccaugaaaaucaaagaugaagaaagagaugacacacuuacuauacucuuaaaagcgacccucuuagccgucucgggagucuacccccuaagcauuccagcuacccuguuugugugguauuuuuggcaaaagaagaaacaacgaucggggguauuaugggauacuccaucaccucccgaaguugaaagggccguucuagacgauggaauauaccgaauaaugcagaggggacuacuaggacguagucagguuggagugggcguuuuucaagagaauguuuuucauaccauguggcaugucacucgaggugcaguauuaauguaccagggaaagagauuagaaccuagcugggcgucaguaaaaaaggauuugaucucauacgguggaggauggagauuacaaggaaguuggaacacuggggaggaaguucaaguaauagcaguggagccaggcaagaauccuaaaaauguccaaaccgcgccgggaaccuuuaaaaccccugaaggugaaguaggugcaauugcucuagauuuuaagccgggaacuagcgguucuccaauaguuaaccgcgaaggaaaaauugucggucuauaugggaacggaguagucacaacuucgggaacauaugugucagcaauagcgcaagcaaaagcaucccaggagggaccucuaccagagauagaagaugaaguguuuaggaagcgaaauuugaccaucauggaucuucauccaggaucuggaaaaacccgaagauaucuuccagcuauaguaagggaagcgauuaaacguaaauuaagaacccuuauauuggcaccaacgagaguuguagcaucugagauggcagaagcccucaaagggaugcccaucagauaucaaaccacagcuguaaaaucggaacauacuggaaaagaaauuguagauuuaaugugccaugccaccuuuacaaugcgacuguugucaccaguucguguacccaauuacaacaugauuaucauggaugaggcccauuuuacagacccuagcucaauagcggcgagaggguauauuucaacaaggguggguaugggugaggcagcagcaauuuucaugacugcuaccccuccugggucaguagaagccuuuccacagaguaaugcggucauucaagaugaagagcgugauauaccagaaagaagcuggaacaguggauaugaauggauuaccgacuuuccugggaaaacagugugguuuguuccaucaauuaaaagcggaaaugacaucgcuaacugcuuaagaaagaaugguaaacgaguaauacagcuaagucggaaaacguuugauacagaguaccaaaaaacgaagaauaacgacugggacuauguugucacaacugacauuucugaaaugggcgcaaauuuuagagccgauagaguaauugauccgcgccgcugucuaaaaccaguuauccuaaaagacgguccugagaggguaauccuggcggguccuaugcccguaacuguagcaucagcagcgcaaaggcgggggcgcaucggcagaaaucauaauaaagaaggcgaccaauauauauauaugggucaaccacugaauaaugacgaagaccacgcacacuggacagaagcaaaaauguuauuagauaauauaaacacaccugaaggaauuguaccagcauuauuugaaccagaacgagaaaagagcgccgcaaucgacggagaauacaggcuacguggcgaagcaagaaaaacuuuugucgaacucaugaggcgcggagaucuaccuguaugguugagcuauaaagucgcgagcgaaggguuucaguacuccgacaggagauggugcuucgacggcgagagaaacaaucaaguauuggaagaaaacauggacgucgaaauauggacgaaagaaggugagaggaaaaaacugagaccaagguggcuagacgcgcgcaccuauucagacccuuuggcauuaagagaauucaaggaauucgcagccggucgaagaaguguaucaggggauuuaauauuagaaauugggaaauugccgcaacacuuaacacaacgagcgcagaaugcacuagauaaucuggugauguugcauaauucugaacaaggaggaagggcauauagacacgcaauggaagaacugccagauacaauagaaacauuaauguuacuagcauuaaucgcuguacuuacaggggggguaacacuauucuucuuauccggucgaggacucgguaaaacgaguauagggcuauuaugcgugauggcuaguucaguacuauuauggauggcuucaguagaaccucacuggauugccgccuccauuauucuagaguuuuuucuaaugguucucuuaauuccugaaccagaccggcaacggacgccucaagauaaucaauuagcguacguaguuauuggauuguuguucaugauacuaacaguagcugcgaaugagauggggcuucuagaaacaacaaaaaaggaucucgguauuggucauguagcgguagagaaccaucaucaugcggcuauguuggaugucgauuuacacccagcuucagcguggacgcuguaugcaguggcaacgacaauuauaacuccaaugaugagacacacgaucgagaauacaacugcuaauauaucgcuaacagccauugcaaaccaagcggccaucuuaaugggccuggauaaaggcuggccgauaaguaaaauggacauugguguaccccuucuagcuuuaggaugcuauucccagguuaauccucuaacucuuacagcagcaguucugaugcucguagcucauuaugcuauuauagggccgggacuacaagcgaaggcaacaagggaagcacagaaaagaacugcagcagguaucaugaaaaauccaacugucgauggaauaguagccauagaccuagauccagugguguaugaugcaaaauuugaaaaacaguuaggacaaauaaugcuacuuauauuaugcacaagucaaauauuguuaaugagaaccacaugggcuuuaugugagucuauuacacuagcaacugguccacuaacaacuuuaugggaggguaguccuggcaaguuuuggaacaccacaaucgcuguaagcauggcuaacauauuuagagggucauaccuugccggggcaggauuagcauucucacuaaugaaaucgcuaggcggagggcguagaggaacaggcgcucagggagaaacguuaggcgaaaaguggaagcggcaacuuaaccaacugagcaaaucggaauucaacacguauaaaaggagcggaauuauggaggucgacagaucugaggcuaaagaagguuuaaaacgaggggagaccacaaagcaugccguaucuagaggaaccgcuaaauuacguugguucguugaaagaaauuuaguuaaaccggagggaaaaguaauugaucugggauguggucgaggaggguggagcuauuauugcgccggccuaaaaaaaguuacagaaguuaaaggcuacacaaaaggcgguccaggccacgaagaaccaaucccuauggcaacauauggauggaauuuaguaaaacuacauuccggcaaagacgucuuuuuuauaccaccugaaaaaugugacacacuacucugugauaucggggagucuagcccuaauccgacgauugaagaaggaagaacuuuacgaguuuugaaaaugguagaacccugguuaaggggaaaccaauucugcauaaaaauccucaacccauauaugccaucaguaguagaaacacuugagcaaaugcaacguaaacauggcgguaugcuuguaagaaacccucuuucucgcaacucaacucaugaaauguauugggugaguugcgguacgggaaauauagugagugcgguaaacaugaccucccgaaugcuguuaaauagauucacaauggcgcacagaaaaccgacuuacgaacgugauguugauuuaggagcagguacaagacacguagccguugaaccugaaguagcaaauuuagacauaaucggccaacgaaucgaaaacauuaaacacgagcauaagagcacguggcauuaugaugaggauaauccauacaagacgugggcuuaccaugguaguuacgaaguuaaaccaagcgguagcgcuucaaguaugguaaauggaguuguuaaauuguugacaaaaccuugggaugucauaccaaugguaacacaaauugcaaugaccgacacuacaccguuuggucaacaaaggguauucaaagagaaaguugauacucgaacaccaaaagcgaaacgaggaaccgcucaaauuauggaaguuaccgccaaauggcuaugggguuucuugucacggaauaagaaaccacguauaugcacacgugaggaguuuacacguaagguuaggucaaacgccgcaauaggagccguguucguagacgaaaaccaauggaacuccgcgaaggaagcggucgaggaugaaagguuuugggauuuaguacauagggagagggaauuacauaagcaaggcaagugugcaacaugcguguauaacaugauggguaagcgagagaaaaagcuaggggaauuugguaaggcgaaagggagcagagcaaucugguauauguggcuaggugcgagauuccuugaauucgaagcauuaggauucaugaaugaagaucauugguucagcagagaaaauucccuauccgguguagaaggugaaggccuccacaaauuagguuauauauuaagagacaucucaaaaauuccaggugguaacauguacgcugaugacacagcgggcugggauacacgaauaaccgaggaugaucuacaaaacgaggcaaggauuacagauauuauggagccagaacacgcccuuuuggccaaaaguauauuuaaacucacuuaccaaaauaaaguaguacgaguacaaaggcccgcgaaaaauggaacaguaauggauguuauaagccgaagagaucagcgugggaguggacaaguaggcacuuacggacugaauacauucacuaauauggaagcucaacuaauaagacaaauggaaagcgaagggauuuuuaguccuucagaacucgaaaccccaaaccuggccgaacgaguccuugacuggcuagaaaaguacgggguagaaagguuaaagagaauggcgauaucuggcgacgauugcguagugaaacccauagacgacagguuugcaacagcacuaacggcauuaaaugauaugggcaaaguacgcaaagauauaccacaaugggaaccguccaagggauggaaugauuggcaacaaguaccauucuguucacaucacuuucaucaauuaaucaugaaggacggaagagaaauuguuguaccaugcagaaaucaagacgaacuuguagggagagcaagaguaucacaaggagcaggauggucacuaagggaaacggcaugucuagggaaaagcuaugcacaaauguggcaauuaauguacuuucaucgaagggaccuuagacucgccgccaacgcaaucuguagugcagugccgguugauuggauuccaacuucuagaaccacauggucaauucaugcgcaccaucaguggaugacaacagaagacauguuaaguguauggaauagagucuggauagaagaaaauccuuggauggaggacaaaacacauauaucuucauggggagauguaccuuacuugggaaaaagagaagaucaauggugcggaagccuuauaggcuuaacugcaagagccacaugggcuacuaauauacaagucgcaaucaaccaaguuagacgguuaauuggcaaugaaaacuauuuagacuacaugacaagcaugaaaagauucaagaacgaaagcgacccugaaggcgcccucugguga

SEQ ID NO: 21884 - RNA, 9879 nt, Artificial Sequence
  derived and/or modified CDS sequence (opt6) from DENV-1__GU131831__SS-prME
agcgucaccauguugcuaauguuaaugccaaccgcacuagcguuucauuuaacuacccgagguggugaaccccauaugauuguuaguaaacaagagcgagguaaaucacuguuauucaaaacaucagcaggaguuaacaugugcacacugauagcaauggaccuaggagaacuuugcgaagacaccaugacauauaaauguccaagaauaaccgaaacugaaccagaugauguugauuguugguguaacgcaacagacacgugggucacauauggcacuuguagucaaacuggagagcacagacgugauaaacggucuguagcccuagccccucaugucgggcuagguuuagaaacccggacugaaacguggaugucauccgaaggagccuggaagcaaauccaaagagucgagacaugggcacucaggcacccaggauucacaguuauagcauuauuccuagcacacgcgauaggcacuagcauuacgcaaaaaggcauaauauucauauuacuaaugcucguaacaccguccauggcaaugagguguguagggauuggaagucgcgauuuuguagaaggauuaucaggagccacauggguugacgucguccuugaacaugguaguuguguaaccaccauggccaaagacaagccaaccuuagacauugaauuauugaagacagaaguaacuaacccggccguauuaagaaaauugugcauagaagcuaagauaaguaauacaaccacagauaguagauguccaacucagggagaagcuacucuuguggaggaacaagaugcaaacuuugucugucggagaacauuuguggacagaggaugggggaacgguugcggucucuucggcaaaggaucacuuauuaccugcgcaaaauuuaaaugcguaacaaaacuugaaggaaagauuguacaguaugaaaacuuaaaauauaguguaauaguuacugugcacacgggagaucaacaucagguagguaacgagaguacugaacaugggacaacggccacuauaacuccccaagcucccacuaccgaaauacaauuaacagauuauggugcucuuacucuagauuguagucccaggaccggcuuagacuucaacgaaaugguauugcuaacuaugaaagaaaaaucguggcuaguacacaaacaaugguuucucgauuugccauuaccauggacgaguggagcgucgacuagccaagaaacauggaaccgucaggaccuauuggucacuuucaaaacugcucaugccaagaaacaagagguuguaguccugggaagucaggaaggugcuaugcauacugcacuuacgggagcaacugaaauacagacaucaggcacaacuacuaucuuugcgggucaucucaaguguagguugaaaauggauaagcugacacuuaaagggauuucauacgugaugugcacaggaaguuuuaaacuugaaaaagagcucgcagaaacacaacauggcacgguacuugugcagauaaaguaugaaggaacagaugcuccauguaagauaccuuucuccacacaagaugaaaaaggcguuacacagaacgguagauuaauaacagccaauccaauuguaacugacaaagaaaaaccagucaauaucgaggcagaaccucccuucggggaauccuauauuguuauuggagcuggggaaaaggcauuaaaguugucuugguuuaagaaaggauccagcauugguaagauguuugaagcuaccgccagaggagcaaggcggauggcgauuuugggagacacagcaugggacuuugguucgauaggcggcguuuucaccaguguugggaaacuggugcaccagauauuuggaacagcauauggcguacuauuuucaggagucucauggacaaugaagauagggaucgggguucuauuaaccuggcuaggucuaaacucaagaucaacgucacuuuccaugacaugcauagcggugggucugguaacucuauauuuaggaguuaugguacaagcagauucugguugcgugauaaauuggaagggacgagaguuaaaauguggcucaggaauuuuugugacaaacgaaguucauacuuggacagaacaguauaaauuccaggccgacaguccaaaaagauugagugcagcaauugggaaagcaugggaagagggagugugcgguauccgaucugcaacaagacuugaaaacaucauguggaaacaaauuuccaaugaacuuaaccacauucuccuggaaaaugauaugaaauucaccguuguaguaggagacguagcggguauacucgcucaagggaaaaagaugauacgcccacaaccuauggaauacaaauauucuuggaaaagcugggguaaagcaaaaauaauaggagcagaugugcaaaauacaacauuuauuaucgauggaccgaacacaccagaaugcccugacgaccagagagcauggaacaucugggaaguugaagacuauggauucggaauauucacuacaaauauauggcucaaauugagagacuccuacacucagguaugcgaucaccgccugaugucagccgccauaaaagauaguaaagcagugcaugccgacauggguuauuggauagaauccgaaaagaaugaaaccuggaaguuagcaagagcuucauucauagaagucaaaaccuguauuuggccuaaaucgcauacguuauggaguaaugggguauuagaaucagagaugaucauccccaaaauauaugguggcccaauaucucagcauaacuaucggccaggauacuuuacacagacggcugggccauggcacuuaggaaaacuggaauuagacuuugaucuuugugaaggaacgacuguggugguagaugagcauuguggaaaucguggaccaagucuucgcacaaccacuguaacaggaaaaauaauacaugaaugguguugucgcucgugcacauuaccuccccugagauuucgaggggaagaugguuguugguaugguauggagauacgaccuguuaaagagaaagaagagaauuuaguaaagucgaugguaagugccgguucaggggaaguagauucauuuucacugggccuacuuugcaucagcauaaugauugaagaaguuaugagaucuagauggucuagaaaaaugcugaugacuggaacacuagcaguauucuuucuucuaauuaugggacaauuaacuuggaacgauuuaauucgccuauguauaaugguuggugcgaacgcaagugauaggauggguauggggacuacauauuuagcucuuauggcaacguuuaaaaugcgaccaauguucgcgguaggauuguuguuuagaagauuaaccagccgagagguacuccuacuuaccauaggacuaucgcuuguagccaguguggagcucccaaacucauuggaagaguuaggagacggccuagcaaugggcauuaugauuuugaaguuauuaacggacuuucaaagucaccagcugugggcgacgcuauuaucauuaacauucaucaaaacaacauucagucuacacuaugcauggaagacaauggcaaugauacucucaauuguaucucuauuuccuuuaugucucuccacaacgucucagaaaacuacaugguuaccaguauuguuggguucucucggaugcaaaccgcuuacuauguuccuaauugccgagaauaaaaucuggggccgucgaucauggccacuaaaugaaggaauaauggccgucgggauaguuaguauacuuuugucuuccuuacuuaaaaaugacguaccgcuagcugggccgcuuaucgcaggggguauguuaauagcgugcuacguaauaucaggcucgucagcugacuuaaguuuagagaaagcggcagaaguaucaugggaagaagaggcggaacauucaggagcgucucacaauauucuaguagagguacaagaugauggaacaaugaaaauuaaagaugaagaaagggacgauacucuuaccauacuacuaaaagcuacacuucuugcaguaucaggagucuacccucucagcauaccagcuacauuguucgucugguauuuuuggcaaaagaagaaacaacgaaguggaguauuaugggacacgccgucaccgccggagguggaacgagccguauuggacgaugguauauauagaauaaugcaacggggacuucucgguagaucacagguuggcgucggaguguuucaagaaaaugucuuucacaccauguggcaugugacgagaggagccguguugauguaccaaggaaaacgacuagaaccaucaugggcuucaguaaagaaggaucuaaucucauauggagguggcuggcgcuuacaagguucauggaacacgggagaagaggugcagguuauugcuguagaaccgggcaaaaaucccaaaaauguacagaccgcuccugguacauucaaaacuccagaaggagaaguuggagcaauagcacucgauuuuaagccgggaacauccggaucuccgauagugaaucgagaaggaaaaauugucggauuauacggaaacggagugguaaccacuuccggcacauauguuucagccauugcacaggcgaaagccucgcaggaaggucccuugccggaaauugaagaugaaguauuccgaaagcggaaucuaacaauaauggaucugcauccagggaguggaaagacaagaagauauuuaccagcaauaguccgugaagcaauaaaaagaaaguuaagaacauuaauacuugcucccacgcgugugguugccucugagauggcggaagcgcuaaaaggcaugccuauuagauaccaaacgacagcaguaaaaucggaacacacgggaaaagagauaguagauuuaaugugucacgccacauuuacuaugagacuauuaucaccugucagaguuccaaacuauaauaugauaaucauggaugaggcacacuuuacagacccaagcucgauagcggcaagaggauauauaucaacgaggguagggaugggagaagcagcggcgauuuuuaugacugcaacaccaccuggcucugucgaagccuuuccccaaagcaaugcugucauacaagacgaagaacgugauauaccugaacggucuuggaacucagguuaugaauggauaacagauuucccaggcaagacuguuugguucgugccauccauaaagucuggcaacgacauugccaacugucugcguaaaaauggaaaacgagucauucaguuauccaggaaaacuuuugacaccgaauaccagaaaacgaaaaacaacgauugggauuacgucgugacaacugauaucagcgagaugggagcaaauuucagggcggauaggguuauagacccgcgaagaugucuaaaaccuguuauucucaaagaugguccugaaagaguaauccuagcugguccuaugccaguaaccguagcaucggcugcucaaagacguggucgaauaggucguaaucauaauaaagaaggagaucaauauauauacaugggacaaccuuugaacaacgaugaggaucacgcccauuggacagaagcgaaaauguugcuagacaauaucaauacuccugaaggaauuaucccggcgcuguuugaaccagagagagaaaaaucagcugcgauagauggagaauauagacuccgcggugaggcucgaaagacauucguugaguuaaugagaagaggagaucuaccugugugguuaucauacaaaguagccagcgaaggauuucaauacagugacagaagaugguguuucgacggggaacguaauaaucaagucuuggaagaaaauauggauguugaaauuuggacaaaggaaggagaacgcaagaaacuuagaccaagaugguuagaugcccgaaccuacagugaucccuuagcccuaagagaguuuaaagaguuugcugcggguagaagaagcguaucgggagauuuaauucuagaaauuggaaaguuaccacaacaccuaacucagcgggcccagaaugcauuggauaacuuaguaauguuacacaacucagaacaaggaggacgcgcuuaccggcaugcaauggaggagcugcccgacacgauagaaacauuaauguuauuggcuuuaaucgcaguauuaacuggaggcguuaccuuguucuuuuugagcgguagaggccuuggaaagacuucgauaggacuacuaugugugauggcuucuagcguacuucucuggauggccucagucgaaccacacuggauagcggcuucaaucauccuugaguucuuuuugaugguacuacuaauuccggaacccgacagacaaagaacgccacaagacaaucaauuggcuuaugugguaauaggcuuacuauuuaugauauuaaccguagcagcaaacgaaaugggcuuguuagaaacaacgaagaaggaccuuggaauaggacaugucgcaguugaaaaucaucaccacgcagcaaugcuagacguagaucuccauccugcauccgcuuggacauuauaugcaguagccacaacaauaauaacaccuaugaugagacacaccaucgaaaacacaacugcaaauauuagucuaacggcuaucgcaaaucaggcugccauucuaaugggacuggacaaggguuggccuauuucgaaaauggacauagguguuccacuguuagcccuaggcuguuauucgcaagucaacccccucacacuaacagcugcuguucucaugcuaguagcccacuacgcuauuauaggucccggucuucaggcuaaagcaacgcgagaagcccagaaaagaacugccgcagguaucaugaaaaauccaaccguugaugggauaguagcaaucgauuuagacccuguuguauacgacgcaaaauucgaaaaacaauuaggacaaaucaugcuacucauauuauguacgucucaaauacuauuaaugaggaccacaugggcuuugugugaaucaaucacuuuagcgacuggcccuuugacuacacuuugggaagguaguccagguaaguuuuggaauacgacaauagcaguguccauggcgaacauauuccgaggaagcuauuuggccggagcagguuuggcauucucauuaaugaaaucacuuggaggaggucggaggggaacaggggcucagggugaaacccuuggagaaaaguggaaaagacaacuuaaucagcucaguaaaucagaauuuaauacauacaaacgaucagggauuauggaaguugauagaucugaagcgaaagaggguuuaaaaaggggcgaaacaacgaagcacgcaguuucuagggguacagcaaagcuaaggugguuuguugaaagaaauuugguaaaaccugaaggaaaaguuauagacuugggguguggucgcggcggauggucguauuacugugcagggcucaagaaaguaacugaaguaaaaggauacacuaaaggaggacccgggcacgaagaaccaauuccaauggcgaccuaugguuggaauuugguaaaacuucauucuggcaaagauguauuuuucaucccacccgaaaaaugugauacguuacuaugcgauauuggugaaucuagucccaauccaacgaucgaagaagguagaacucuucguguuuugaaaaugguagaaccuuggcugcgaggaaaccaauuuuguauuaaaauacuaaauccuuacaugccaucaguuguugagacacuagaacaaaugcagaggaaacauggaggcauguuagugagaaacccuuuaaguaggaauagcacucacgagauguauuggguuagcugcggaacggguaauauuguaucagccgugaauaugacaagucggaugcugcuuaauagguucacuauggcgcaucguaaaccaacuuacgaacgagauguagaccuuggcgccggaaccagacacgucgcgguggaaccugaaguugccaaucuugauauaauagggcaaaggauugagaauauuaaacacgaacacaaaaguacuuggcauuacgacgaagauaauccauauaagaccugggcuuaucacgggucauaugaggugaagccaucagguagugcauccucgauggucaacggcgugguaaaacuauuaaccaaaccgugggacguaauuccgauggucacccaaauagccaugacugacacaacaccguucgggcaacagagaguguuuaaagaaaaggucgacacuaggacaccaaaagcuaaacgaggaacagcgcaaauuauggagguuacagcuaaauggcuauggggauuuuuaucaaggaauaagaaacccagaauaugcaccagagaggaguuuacuagaaaaguuagaucaaacgccgccaucggagccguuuuuguugaugaaaaccaauggaacucggcuaaggaagccguugaagacgaaagauuuugggaccuuguacacagagaacgugaauuacacaaacaaggaaagugcgcaacguguguauacaacaugaugggaaagcgugagaagaaacucggcgaauuugggaaagccaaaggaucacgagcuauaugguacaugugguugggcgcaagguuuuuagaauuugaggcauuaggcuuuaugaaugaagaucacugguuuucacgggaaaauagcuuauccggcguggagggagagggacugcacaaacucggcuauauacuaagagacauaaguaaaauaccugggggcaauauguaugccgacgauaccgcagggugggacacuagaaucacagaagaugauuugcagaacgaagcaagaauuacagauauaauggaacccgaacacgcacucuuagccaaaucuauauuuaaacuaacauaccaaaauaagguaguccgaguacaaagaccugcaaagaacgggacuguaauggauguaaucaguaggcgagaccaaagagguaguggucaaguagguaccuacggacuaaauacauuuacuaacauggaagcacaacuaauaagacaaauggaaucagagggcauauuuucuccaagugaacuugaaacaccaaaccuagcugaaagaguauuggauuggcuugaaaaguacgguguagaacgauuaaagcggauggcgauaagcggggacgauuguguuguaaaaccuauagaugaucgguuugcaacagcacuaacugcucuuaaugauauggguaaagugagaaaggacauuccacagugggaaccuucgaaaggauggaaugauuggcaacaaguaccauuuuguagccaccacuuucaucaauuaauaaugaaagacgguagagaaauaguggucccaugcaggaaccaagacgaacugguagggagagcgcgcguaucucaaggagcugguuggagucuacgagaaacggcuugucuaggcaaaucuuaugcacagauguggcaauugauguauuuccacaggcgagaccuaagacuugcggcaaacgcaauauguucagcaguacccguagacuggauucccacuuccagaaccacgugguccauccacgcacaccaccaguggaugacgacggaagacaugcuaaguguuuggaacaggguauggauugaggaaaauccguggauggaggauaaaacacauauuucgaguuggggagacguaccguauuuaggcaaaagagaagaucaauggugugggucacuaauaggauuaacugcuagagcaacgugggcgacaaauauucaggucgccauuaaucagguacgacguuugauuggaaaugagaauuaccuggauuauaugacaucgaugaaacgauuuaagaacgaaucggacccagaaggagcuuuaugguaa

SEQ ID NO: 21885 - RNA, 9879 nt, Artificial Sequence
  derived and/or modified CDS sequence (opt6) from DENV-1__EU482789__SS-prME
agugucacuauguuacugaugcucaugccuaccgcauuggcauuccaucuaacaacgcgcgggggcgaaccucauaugaucguaacgaaacaagaacgagggaaaaguuuauuauuuaaaaccagugcagggguaaauauguguacucuuauagcaauggaccuaggagaacuuugugaagacacaaugacauauaaauguccccggauaacagaagcugaaccagaugaugucgauugcugguguaaugcuacugacacguggguuaccuacggaacgugcagccagacaggagaacaccggagagacaaaagaucuguagcguuagcuccucacgucggccuaggucuugaaacgcgaacggaaacguggaugaguucugaaggggcauggaaacaaauacaaagaguagaaacaugggcguuaagacauccgggguucaccgugauagcucucuuuuuagcucaugcaauaggaacauccauuacgcaaaaaggaauaauauucauucucuuaaugcuugucacaccgagcauggccaugaggugcguugguauagggagucgagauuuuguagaaggauuaaguggcgcuacauggguugacguaguauuggaacauggaucauguguaacaacgauggcaaaagacaaaccuacauuagauauagaauuguuaaaaacagagguaaccaauccugcaguacuucgaaaacuauguaucgaagcuaaaauuucgaacacgacaacugacucucgcugcccaacgcaaggugaagccacguuaauggaagaacaagaugccaacuuuguguguagaaggacguuugucgaucgcggguggggaaaugguugcggacucuuugguaaagguucucuaauaacaugcgcaaaauucaaaugugugacuaaaauggaaggaaaaauaguucaauacgaaaacuuaaaauacagcguaauagugacaguucacacaggagaucaacaccaaguagguaaugaaaguaccgaacacgggacuacagcgacaauaacaccgcaagccccgaccagugaaauacaguuaaccgauuauggggcacucacacuugauuguucuccacgaacagggcuugauuuuaacgaaaugguacuauuaacaaugaaagagaaaucuugguuagugcacaaacaaugguuuuuggaucugccucuaccguggacaucgggcgcgaguacgucgcaggaaacuuggaaucgacaagaccuuuuggucacauuuaaaacagcacaugccaagaaacaagaaguugucguacuugguucgcaagaaggagcaaugcauaccgcccuaacuggcgcgacagaaauucagaccaguggcaccacaacgaucuuugcuggccauuugaaguguagacugaaaauggacaaacuuacccuaaaaggaaugagcuaugugauguguacaggaucauuuaaacuugaaaaagaaguggcagaaacucaacauggaacaguguugguacaaauaaaguaugagggaaccgaugccccgugcaaaauuccauuuuccacccaagaugaaaaaggcguaacacaaaauggucguuugauuacugccaauccaauuguuacagauaaggaaaagccaguaaauaucgaagcagaaccucccuucggugaaucguauauugugauuggggcuggcgagaaagccuuaaaauuaucgugguuuaagaaaggaucuucgauagguaagauguucgaagcaaccgcacgaggcgcaagaaggauggcaauucuaggagacacugcaugggacuucggaagcaucggaggaguuuuuacuucggugggcaaacuuguacaucagaucuucgggacugcauaugggguauuauucucgggaguuucauggacgaugaaaauaggaaucgguguguuacugacguggcucggauuaaacucgcgaagcacgagucuaaguaugacguguauugcggugggacucguuacauuguacuuaggaguaaugguacaagcugauucgggcuguguaaucaacuggaaaggacgagagcuaaagugugguuccgguauuuucguuacgaaugagguacauacauggacagagcaauauaaguuucaagcagacucaccaaaaagauugucugcagcaauagggaaagcaugggaagaaggugucugcgggauacgaagugcaacaagacuagaaaacauaauguggaaacagauaaguaaugagcuaaaucacauauuguuggaaaaugacaugaaauuuacugugguuguuggagauguuguuggaauacucgcucaagggaagaaaaugauaagaccucaacccauggaacacaaauauucauggaagucaugggguaaagcgaaaauaauaggagcagauguacagaauaccacuuuuaucauagacggcccgaauacuccugagugcccagaugaccagcgagccuggaauaucugggagguagaagacuauggauuuggaaucuuuacaacuaauauauggcuuaaauuaagagauagcuacacucaagucugcgaccaccgcuuaaugagcgcagccaucaaggacagcaaagcgguccaugcugacauggguuacuggauagaaagcgagaaaaaugagacguggaaauuggcucgagccagcuucauugaagugaaaacgugcauauggcccaaaucucauacccuauggagcaauggugugcucgaaucagagaugaucauaccaaaaaucuacggagggccaauuucgcaacacaacuauaggccaggcuacuucacacagacagcaggacccuggcaccucggaaaauuggaacuugauuuugaucuaugugaaggcacgacgguaguaguggacgagcacugcggaaaccggggaccgaguuuacgaaccacgacgguuaccgggaaaauaauacaugaauggugcuguagaaguugcacgcuacccccauuaagauuuaaaggggaggauggaugcugguaugguauggaaauucguccagucaaagaaaaagaggaaaacuuagucaaaaguauggugagcgcagggucaggugaggucgauucguucucacuaggccuacucugcauaucgauaaugauagaggaagucaugcguagucguuggucacguaaaauguuaaugacaggaacacuugcaguuuuucuccuacuuauuaugggccaauuaacuuggaacgauuugauaagguuaugcaucaugguuggagcaaacgcaagcgaccgaauggguaugggcacuacuuacuuagcacucauggcgaccuucaaaaugcgccccauguuugcgguuggucuccuauucaggcguuuaaccucacgagaaguacuacuccugacgauuggacugucacuggucgcuucaguagaauuaccaaacagccuggaagaauuaggagauggcuuagccauggguauuaugauucucaaacucuugacugacuuucaaagucaccaguuaugggcuacuuuguuaaguuuaacuuuuaucaagacaaccuuaucuuuacauuaugcauggaagacaauggccaugguucucucaaucgucaguuuauuuccgcuaugccuaucgaccacgucccagaagacuacauggcuucccguucuguuagggagcuuaggauguaagccacugacaauguuuuuaauagccgaaaacaagaucuggggaaggaagaguuggccacugaaugaggguauaauggcugucggaguaguaaguaucuugcucagcucacuucucaaaaaugacguaccacucgccggaccuuuaauagcaggcggcaugcuaauugcguguuacguuauaaguggaucaucagccgauuuaucccuagagaaagcagcugagguuuccugggaagaagaagcugagcauuccggagccucgcacaauauacuggucgaaguccaagaugacggaaccaugaaaauaaaagaugaagaacgugaugauacccugacaauacuucucaaagcgacauuauuagcuguaagugguguauauccauugagcauuccagccacgcuguuuguuugguacuuuuggcagaagaagaaacaacggucaggagugcugugggauacaccaagcccaccggaaguagaaagggccguacuugaugauggaaucuauaggauuaugcaacgaggacuauuaggacgaagccaagugggaguaggcguguuucaagaaaacgucuuccauacaauguggcauguaacacgaggagcaguucuaauguaccaaggaaagagguuggaaccaucaugggccagugucaaaaaggauuugauaucguauggagggggauggagacuucaagguaguuggaauacuggagaggaaguucaaguaaucgcaguggagccggggaagaacccuaaaaauguacagacggcacccggcaccuucaaaacaccagaaggugaaguaggcgcgauugcauuagacuuuaaacccgggacaucaggaucaccuauuguuaauagagagggcaaaauuguuggguuguauggaaauggcguagucaccacaagugggacauauguauccgcgauagcacaagcaaaagcaucucaagaaggcccgcugccggaaauagaggacgaaguauucaggaaaagaaaucuaacaauaauggaucugcauccagguucggggaagacucgucgguaccuaccagcuauugugagggaagcaauaaaaaggaaacuaagaacacucauacuggcaccaacacgaguaguugcgagcgaaauggccgaagcauuaaaggggaugccgauuagauaucagacaacugcaguuaaaagcgagcauacaggcaaagaaauaguagaucugaugugccacgccacuuuuacaaugagauuguuauccccaguaagaguccccaacuauaauaugauuauaauggaugaagcacacuucacggaccccucaagcaucgcugcaagaggauauaucucuacuagagucgggaugggagaagcggcggcaauauuuaugacggcaacaccaccaggaagcgucgaggcauuuccgcaaucaaacgccgucauacaagacgaggaacgagauauaccggaaagaaguuggaacucgggcuaugaauggauuacggauuuuccaggaaaaacugucugguucgucccuucgaucaaaagcgggaaugacauugcaaacugucuacguaagaacggcaaacgcguaauccaacugucuagaaaaacauucgauacugaauaucagaaaaccaagaacaacgauugggauuacgucguaacuacugauaucuccgaaaugggggccaacuuuagggcggaucgcguaauagacccaaggcgaugccuuaagccaguaauacugaaagauggaccggagaggguaauauuagcugggccaaugccagucacgguagccagugcagcucaaaggcgaggccgaauugggagaaaucauaauaaagaaggagaccaauacauuuacaugggacaaccuuuaaauaacgacgaagaucacgcucacuggacagaagcuaagauguuacuugacaauaucaacacuccagaaggaaucauuccugcacucuuugagccggaaagagagaaaagugcagcuauugacggugaguauaggcuucgaggugaagcaagaaaaacauuuguagaacuuaugagaagaggggaucuaccaguuugguuaagcuacaaaguagcuagcgaggguuuucaauacucugaucgacgcugguguuucgauggcgaacgaaauaaucaaguacucgaagagaauauggauguagaaauuuggacaaaagagggggaacggaagaaacuacggcccagaugguuagaugcgcgaacuuacagugacccauuagccuuaagagaauuuaaagaauuugccgcagguagacgaucuguaucaggggauuuaauuuuagagaucgguaaguugccacaacaucuuacucaaagagcacagaaugcuuuagacaaucuagugaugcugcauaauagugaacaaggggguagggcuuauagacaugcuauggaagaauuaccggauacaauagagaccuuaaugcuucuggcucucauagcaguccuuacuggaggaguaacucuauucuuucuguccgggaggggucuuggaaaaacaucuauaggucuucuauguguaauggcaaguagcguccuacucuggauggcaucugucgaaccgcacuggauugcugccagcauuauauuggaauuuuuccuaaugguucuguuaaucccagaaccagaccgacaaagaacuccacaggacaaucaacuugcuuauguuguuauaggucuauuguucaugaucuugacaguagcagcuaaugaaaugggucuguuagaaacaacuaagaaagauuuaggaauaggccauguagcaguagaaaaccaccaucaugcaacaaugcucgauguagacuuacaccccgcaagugcauggacccuauacgcuguagcgacuacaauuauuacgcccaugaugcgacauacuauugagaacaccacugcaaacaucagcuugacugcaauagcgaaccaagcagcaauauuaauggguuuggacaaggguuggccaauaaguaaaauggacauagggguuccauuguuagcgcuagguugcuauucacagguuaacccacuaacacugaccgcagccgugcuaauguuaguggcucauuaugcgauaauaggaccuggauugcaggcuaaggcaacaagagaggcacaaaagagaacagcagccggcaucaugaaaaauccuaccguugacggaauugucgcaauagaucuggauccgguaguauacgaugccaaauuugaaaaacaacucggucaaauuauguugcuaauucuuugcacgucacaaauacuacuuaugaggacuacaugggcauuaugcgagagcauaacauuggcuaccggaccccucacgacuuuaugggagggaucaccagguaaauucuggaacacuacaaucgcagugagcauggcgaacaucuuucgagguucauacuuagcgggugcgggacucgcguucagccuuaugaaaucccuuggucgagguaggagaggcacuggugcucaaggggagacacucggugaaaaauggaaaagacaauuaaaucagcuaucaaaauccgaguuuaauauauauaaacguagcggcaucauggaagucgauagauccgaagccaaagagggacuuaagaggggagagacuacacgacacgcuguaucacgugggacagcuaaauuaagaugguucguagaacgaaauuuaguaaaaccugaaggaaaaguuauugaccucgguugugguagaggcgguuggaguuacuauugugcugggcucaagaaaguaacagaaguaaaaggauauaccaagggcggaccagggcacgaagaaccaauuccgauggcaaccuauggauggaaccuaguaaaacuucauucaggaaaggacguuuucuucaccccaccagaaaaaugcgauacuuugcuaugugauauaggugaauccaguccgaauccaacuauagaagaggguagaacauugagaguucugaaaaugguggaaccuuggcugcgaggaaaccaauuuugcauuaagauacugaacccauauaugccuagugugguggaaacauuagaacaaaugcaacgaaagcauggagggauguuaguaagaaauccccugucaagaaacagcacacacgaaauguauuggguaaguugugguacaggaaacauagucagugccguuaauaugacuucucgaaugcuauuaaaccgguuuaccauggcgcaucgaaaaccaacauaugaaagggaugucgaucugggcgcuggaacacgucacguagcaguggaaccagaaguugcuaauuuagauauuauugggcaacguauagaaaacauaaaacaugaacauaaaagcacuuggcauuacgacgaagauaaccccuauaagaccugggccuaccauggaaguuacgaagugaagccuaguggaucugcaaguucaauggugaacggcgugguaaaguuacuaacgaaaccaugggaugucauuccuaugguuacgcaaauugcaaugacagauacuacaccuuucggucagcagagggucuuuaaagaaaaagucgauacuaggacgccaaaggcaaaacgagggacagcacaaauuauggagguaacugcucguugguuauggggcuucuuaaguagaaacaagaaaccgcgaaucuguacucgggaagaguucacacguaaagucagaucaaacgcggcuauaggagcgguauuugucgaugaaaaccaauggaacucagcaaaagaagcagucgaggacgaacgauucugggaucuuguccaaaaggaaagggaauuacacaagcaggguaagugcgccaccuguguauauaauaugaugggaaaaagagagaagaaacuuggagaguucggcaaggcuaaaggcucuagagcaauaugguacauguggcugggagcucgauuccuagaauuugaagccuuaggguuuaugaacgaagaccauugguuuucucgagaaaauucauugucaggcgucgaaggagagggauuacacaaacugggcuauauccuuagagauauaaguaaaauacccggugguaacauguacgcggaugacacagcggguugggauacuagaaucacagaggaugaucuucaaaaugaggcaaaaauuacagauauaauggagccagagcacgcgcuucuagcuacaaguauauucaaacuaaccuaucaaaacaaaguaguaagaguacagcgaccagcuaaauccggaaccguuauggacgugauaucuaggagagaccaaagagguaguggacaaguaggaacuuauggauuaaauacauucacaaacauggaagcgcaacuuauuagacagauggaaucugaaggaauauuucugccuucagaacuugagacgccaaaucuagcggagcgcguucuagauugguuagaaaaauauggcguugaacgcuuaaagagaauggcaauaucaggggaugauugcguuguuaaaccuauugacgauagauucgcgacugcacuuacagcacugaaugacauggguaaagugagaaaagacauaccacaaugggaaccaaguaagggauggaacgacuggcaacaaguuccauucuguucucaucacuuucaccaauuaaucaugaaagacggucgagaaauagucguaccuugucgcaaucaagaugagcuaguuggacgagcacguguaagucagggagcaggguggucgcuccgagaaacggcguguuuagguaagucauaugcccaaauguggcaauuaauguauuuucacagacgagaucuuaggcuugcugcaaacgcaauaugcagcgcaguuccugucgacugggugcccacaagcagaacgacauggucgauacaugcucaucaucaauggaugacaacagaagacauguugagcguguggaauagaguauggauugaggaaaauccauggauggaagacaagacucaugugaguucauggggagacguuccauaucuuggaaaaagggaagaccagugguguggaagucuuauuggguuaacugcaagggcaacaugggccaguaauauacaaguagccauuaaccagguaagaagacugaucggcaacgaaaauuaccuggauuacaugacaucaaugaaaagauuuaaaaaugagggggauccggaaggagcuuuaugguag

SEQ ID NO: 21886 - RNA, 9879 nt, Artificial Sequence
  derived and/or modified CDS sequence (opt6) from DENV-1__EU482790__SS-prME
agcguaacuauguuacuaaugcugaugccaacugcacuagcguuucauuuaacuacucgagggggugaaccgcacaugauaguaucuaaacaagaaagggguaaaucacuacuauuuaaaacguccgcaggggugaacauguguacucuaauugcuauggauuuaggggaauuuugugaagauacuaugacuuauaaauguccaaggaucaccgaagcggaaccagacgacguugauugcuggugcaaugcgacugacacuuggguuacauauggaacauguagucaaacaggagaacacaggcgagauaaacgaucuguggcauuagcuccucaugucggucuuggucucgaaacacgaacugaaacauggaugagcagcgaaggagccuggaaacaaauacaaagaguagaaacaugggcauuaaggcauccagguuucacggucauugccuuguuucuagcacaugccauaggaaccagcauaacucagaaagguauaauuuucauacuauugaugcuaguaaccccuagcauggcaaugagauguguaggaauaggaucaagagacuuuguugaaggucuaucgggagcgaccugggucgacguugugcuggaacacgguucaugcgugacaaccauggcuaaagacaaaccaacauuggauauagaauuauuaaaaacggaagugacaaauccugccguauuaagaaaacuauguauugaagcuaaaauuaguaacacaacaaccgauucgagaugcccuacacaaggagaagcuacauuaguagaagaacaagacgccaauuuugucuguagaagaacauuuguagauaggggauggggaaaugguugcggcuuguuugggaaagggucauuaauaaccugcgcaaaauucaaaugugucacgaaauuagaaggaaaaauagugcaguacgaaaaccuaaaauauagcgugauagucacuguccacacaggcgaucagcaucaaguaggcaacgaauccacagaacaugguacaacagcaacaauuacuccccaagcucccuccacugaaauacaauugacugacuauggugcacuaacucuggauuguucaccgcggaccggcuuagauuuuaacgaaaugguauuacuaacgaugaaagaaaaaucaugguugguacauaaacaaugguuuuuagaucuaccguugcccuggacaagugggaguuccacaagccaagaaacauggaauagacaagauuuacugguaacguucaaaaccgcucaugccaagaaacaagaaguaguggucuugggaucucaagagggggcuaugcauacagcccugacaggagcuacagagauccaaaccucgggaacaacaacaaucuuugcaggccaccuaaaaugucgacucaaaauggacaaacucacauuaaaaggcaugagcuaugugauguguaccgguucauucaaguuagagaaagaaguugcagagacgcaacacggaacaguucuuguacaaauuaaauaugaagguacagacguuccuugcaaaauaccguuuaguacucaagaugagaaggguguaacccaaaauggaagauuaauuacagcuaauccaaucgucacugauaaagaaaaaccggugaacauagaggcagagccacccuuuggagagucauauaucgucaucggagcgggugaaaaggcuuuaaaacuaaguugguuuaagaaagggucuagcauaggcaaaauguucgaagcaacggcgagaggcgcucgaaggauggcgauauugggagauacugcaugggauuuugguaguauaggcgguguauuuacuuccguugggaaguuaguccaucagaucuucggcacugcauauggaguauuauucucuggugugucguggacgaugaaaauaggcauuggaguguuacuuacaugguuaggauuaaauucuagaaguacaagucugucaaugacuuguauagcaguaggauuagucacucuguacuuaggcguaauggugcaggcugauagugguuguguaauaaauuggaaaggaagagagcuaaaauguggcucagggauuuucguuacgaaugagguucacacauggaccgaacaauauaaauuucaggcugacagcccaaaacgauuauccgccgcuauaggaaaagccugggaggagggagucugcgggauaagauccgcuacacgauuagaaaauauaauguggaaacaaauaagcaaugagcuuaaccacaucuuauuagaaaaugacaugaaauuaacaguugugguuggagauguugcuggcauauuagcacagggcaagaaaaugauucgaccacaaccuauggaguauaaguauucuuggaaaucguggggcaaagcaaaaaucauuggggcagauguucagaacacaaccuucauuauugaugggccgaacacaccagaaugcccagaugaccaaagggccuggaacauaugggagguagaagauuacggauucggaaucuucacuacuaacauauggcuaaaacuuagggauucguauacgcagguuugcgaccaucgacuaaugucggcugcaauuaaagauaguaaggccgugcaugcagauauggguuauuggauagaaagcgagaaaaacgaaaccuggaaacuugcaagagcaucguuuauagaagucaaaacaugcauauggccaaagagccacacccuuuggagcaacggaguguuagaaagugaaaugauaauuccuaaaauauauggcggacccaucucucaacauaauuauagacccggguauuucacucaaacagcuggaccuuggcaucuagguaagcuggaauuagacuuugaucuuugugaaggaacgaccguuguagucgaugaacauugugggaaccgcggaccaucauuacgaaccacuaccguaacagguaagauaauccacgaaugguguugcagauccuguacguuaccaccccugagauuuaagggagaagacggauguugguauggcauggaaauaaggccaguaaaagaaaaagaggagaaucuugugaaaucuaugguaucugcaggauccggugagguagauaguuuuucauugggccuacuaugcauuaguauaaugauugaggagguaaugcgguccagaugguccagaaaaauguuaaugacagggacguuggcgguauucuuucuccuaauaaugggccaauugacuuggaaugaucuaauuagauuauguauuauggucggagcaaaugcgagugaucgaaugggcauggguacaaccuauuuggcccucauggccacauucaagaugcggccuauguucgcgguagguuuacucuucagaagauuaacaagucgugaagucuuauuacugacaauaggacuaaguuuaguagccucagucgagcucccuaacucccuggaagaauugggugauggccuagcuauggguauaaugauccuuaaacucuugacugacuuucaaagccaccaacuaugggcaacauuguuaagccuaacguucauuaagacgacauuuucucugcauuacgcguggaaaacuauggcaaugguauuaucaauaguaucucuguucccacucugucucaguacgacaucccagaaaaccacaugguuaccgguccuacuugguucuuuagguuguaagccccugacaauguuuuugauugccgaaaauaaaauuugggggcgcaaaucguggccauuaaaugaagguauaauggccguaggaaucguuucaauucuccuuaguucccuccuuaaaaaugaugucccguuagccggccccuuaauagcuggaggaauguugauugccuguuauguuauuucugguucuucggcggaccucagcuuggagaaagcagcagaaguaucuugggaagaagaagcagaacauuccggugccagucacaauauuuugguugaaguccaggaugauggcacuaugaaaauuaaggacgaagaacgagaugacaccuuaacuauuuuacugaaggccacccuguuagcaguuucaggaguguauccacuauccauuccagcgacauuauuugucugguauuucuggcaaaagaagaagcaacguucaggugucuuaugggacacuccgaguccacccgaaguagagcgugcuguguuagacgacgguauauacagaauuaugcaaagaggucuguugggcagaucgcaaguugggguaggggucuuucaagaaaacguauuucauacaauguggcauguaacacgaggagcuguguuaauguaucaagguaaacgacuagaacccucuugggcaucugucaagaaagaccuaauaucguauggaggcggauggagauuacaaggaucauggaacacgggagaagaaguccaaguaauagcggucgagccagggaaaaaucccaaaaacguucagacugcccccgguacuuuuaaaaccucagaaggagaaguuggugcaaucgcucuugacuucaaaccugggacaagcggaucuccgauaguaaacagagaagguaaaauagugggacucuaugguaacgggguugugacgaccucaggcacauauguaagcgcgaucgcgcaggcgaaagcaucucaagaaggaccguugccugaaauagaagaugaaguauuccguaagagaaacuuaacaaucauggacuuacauccugguaguggaaaaacuaggagauacuuacccgcuauaguuagggaagcaaucaaacguaaacuucguacauuaauacucgcaccaacucgaguaguagcuucugaaauggcagaagcauuaaaagggaugccgauaagauaucagaccacagcugucaagucagaacacacugguaaggagauagucgaccuaaugugucacgcaacauuuacgaugcgauuacuuuccccagugcgaguuccaaauuauaacaugaucauaauggaugaggcucacuuuacggacccaagcaguauugcggcaagaggauauauuaguaccaggguaggcaugggugaagcagccgcuauauucaugacggcaacgcccccggguucgguagaagcauuuccccaaucaaacgcagucauccaagaugaagaaagggauauccccgaacgcucuuggaauagcggauaugaguggauaacagauuuuccagguaaaacuguuugguucguaccuucaauaaaaucgggaaacgauauugcuaauuguuuacgcaaaaacgguaagcguguaauucaacugagcagaaagacauuugacaccgaauaccagaaaaccaaaaacaaugauugggacuaugucguaacaacagauauaucagaaaugggagcaaauuucagagcagauagaguaauagauccccgccguuguuuaaaacccguaaucuugaaagacggcccugagagaguaauucucgcaggaccaaugccgguaacgguugccagugcugcacagcggagaggaagaaucggucggaaucacaauaaagaaggggaccaauauauauauauggggcaaccccugaauaaugaugaagaccaugcacauuggacagaggcuaaaauguuacucgacaauauuaauacaccagagggcauaauccccgcucucuuugagccagagagggaaaaaucugcggccauagauggagaauauagacuacguggggaggcgagaaaaacuuuuguugaacuuaugagacguggggauuugccagugugguugucguacaaaguagcauccgaaggguuucaauacucugaucgcagauggugcuuugacggagagagaaauaaucagguucuagaggagaacauggauguggaaauuuggacaaaagagggggaaagaaagaaacucagaccgcguugguuagacgcacguacauauagcgaccccuuggcucugcgagaauuuaaagaauuugcagcuggacggaggagugucaguggugaucuaauauuagagauagggaaacuaccacaacauuugacgcaaagggcucaaaacgcuuuagauaauuuaguuaugcuucacaauucagaacaaggaggacgugcguacagacaugccauggaagaacuccccgauacuauagaaacacuuaugcuacuagcauuaauagccguucuuacaggcggagugacuuuauucuuuuuaaguggccgagggcuugguaaaacuucaauaggucuucucugcguaauggcgucaucaguacuucuauggauggcaucaguggaaccucacuggauugcggcuagcauuauacuagaguucuuucuuaugguguuacucauaccagaaccggacagacaacgaacaccacaagauaaucaauuagcguacguugucaucggcuuauuguuuaugauccuaacagucgcagccaaugaaaugggucuacuagagacgacgaagaaagaccuaggcauaggucauguagcaguugaaaaucaccaccaugcagcaauguuagacguggacuuacauccagcaagcgcguggacacuauaugccgucgcaacuaccauuauuacuccaaugaugagacacacgauugaaaacacuacagcaaacauuagcuuaacugcaauagcaaaucaagcagcaauccuaaugggacucgauaaaggauggccaauaucaaagauggauauaggcguaccauuacuagcccuagggugcuauucucaaguaaaucccuuaacauuaaccgcagcaguauuaaugcuggucgcgcauuacgcuauaauugggccgggccuacaagcaaaagcuacaagagaagcccaaaaacgaaccgcagcaggaauaaugaaaaaccccacaguagauggaauaguagcgauagaucucgaucccguaguguacgacgcgaaauuugagaagcaauuaggucaaauuaugcuacuaauacucugcacuucacaaauacuccuaaugcgaacaacaugggcucugugcgaaucuauaacccuugcaacuggcccucuuacuacguuaugggagggcucuccaggcaaguuuuggaacacaacaauugcaguaucaauggcuaauauauuucguggaagcuauuuagcgggcgcaggguuagcauuuucgcuuaugaagucguuagggggaggacguagaggcacaggugcucaaggggagacguugggagaaaaauggaaacggcaacuuaaucaacuaucuaaaagugaauuuaacacguauaaacgcucaggaauaauggaaguggaccgcuccgaggcaaaggaagguuugaaaagaggagagacaacgaaacaugccguaucucgaggaacagcaaaacuacgcugguucguagaaagaaaccuaguaaaaccagaaggaaaggucauagaccuaggauguggacgagggggauggaguuacuauugcgcgggacuaaagaaaguaacugaaguuaagggcuacacaaagggcgggccgggucaugaggaaccaauaccaauggcuacguauggguggaauuuagugaaacucuauagcggaaaagacguauuuuucauuccaccggagaaaugcgacacgcuauuaugugauauaggagaaaguucgcccaacccgacaauagaagaaggacgaacucuacguguuuuaaaaaugguagaaccuugguuacgagguaaucaauucuguauaaaaauucuaaauccauauaugcccucagugguagaaacacuugaacaaaugcaaaggaaacacggcggaaugcuaguaagaaauccacuaagcaggaacaguacucacgaaauguauuggguaucauguggaacagguaauaucguaucagcagucaacaugacaucccgaaugcuauuaaauagauuuacaauggcucauagaaagccgaccuaugagagagauguggauuuaggcgccgguacucgccauguagcagucgaacccgaaguaccgaaucuugauauaauugggcaaaggauagaaaauauaaaacacgagcacaagucgacauggcacuaugaugaagacaauccauauaaaaccugggcauaccauggaaguuacgaagugaaaccuagcggauccgcaucuagcaugguaaauggagugguaaaauuacuuacuaagccaugggauguaauuccuaugguuacccaaauagcaaugacagauaccacgccuuuuggccagcaacguguguuuaaagaaaaaguggauacgcgcacaccaaaggcuaaacgggguacagcacaaauuauggaggugacagcaaaaugguuauggggcuucuuaucgcgaaauaagaaaccaaggauuugcaccagggaggaguucaccagaaaaguacguucuaaugcugcaauaggagccguuuuuguggaugagaaucaguggaauagcgccaaagaagcaguugaagaugaacgcuuuugggauuugguacaccgggaacgcgaauugcauaaacaaggaaagugugcuacauguguauauaacaugauggguaaacgggaaaagaaacuuggggaguucggaaaagcaaaaggaucgagagcaauaugguauaugugguuaggagcgagauuucuagaguucgaagcacucggauuuaugaaugaagaucauugguuuucacgcgaaaacagucugaguggaguagaaggugagggacuccacaagcuggguuacauacuuagagauauuaguaaaauaccuggaggcaacauguaugcagaugacacagcaggaugggauacaagaaucacagaagacgacuugcaaaaugaagcuaaaauuacagacauaauggaaccagaacacgcacuuuuagcaaaaucgauauuuaaacucacuuaccaaaacaagguuguccgaguacaaagacccgcuaaaaaugguacaguaauggacguuauaagcagacgagaccaacguggcucagggcaagucgguaccuacggacuuaauaccuucacaaauauggaggcacaacucauacgccaaauggaaucugaaggaauuuucucaccuucugaacuugaaacuccuaacuuagcaggccgagucuuggacuggcuagagaaacacggcguagaaagacuuaaaaggauggcgaucagcggagaugacugcgugguuaaaccaauagaugaccguuucgcuacagcauuaacagccuugaacgacaugggaaaagugcgaaaagacauuccgcaaugggaacccucgaaaggguggaaugauuggcagcagguuccauucuguagccaccauuuccaccaacuuauuaugaaggacggcagagagauaguggucccuugccgaaaccaagaugaguuaguaggcagagcgagaguuagucagggagcuggcuggucgcuuagagaaaccgcaugccucggaaaaucauacgcccaaauguggcaauuaauguacuuucaucguagggaucuuaggcucgcggcaaaugcgaucugcuccgcaguuccaguggacuggguaccaacgaguaggacaacauggaguauccacgcgcaccaucaauggaugacuacugaagacaugcucucaguauggaaucgggucuggauagaagaaaacccauggauggaggauaaaacacauauauccagcuggggagauguaccauaccuaggcaagagagaagaucaauggugcgguagcuugauuggauugacggcacgugcgacgugggcaacaaacauacaaguugcuaucaaccaaguucgcagauugauuggaaaugagaauuauuuagauuacaugaccucaaugaaacgauuuaaaaacgagagcgacccagaaggggcucuaugguag

SEQ ID NO: 21887 - RNA, 9879 nt, Artificial Sequence
  derived and/or modified CDS sequence (opt6) from DENV-1__EU482791__SS-prME
aguguaacgaugcugcugauguuaaugccaacugcuuuggccuuucacuuaacuaccagggguggagaaccgcauaugauagucacuaaacaagaacgggggaaaucgcuucuguucaaaacuucugccggcgucaacaugugcaccuuaauagcaauggaccugggagaacucugcgaagacacgaugacguacaagugcccgagaauaacugaagcugaaccggacgauguugauuguugguguaaugcuacggauacauggguaaccuacggcacuugcagucaaacaggagaacacaggagagauaagagaaguguugcccuggcaccgcauguuggacucgggcuagaaacacgaacagagacauggauguccagcgaaggugcauggaagcaaauacaaagaguagaaaccugggcuuugcgucauccuggauucacaguaauagcauuauuccuggcacacgcaauaggaacuagcauaacacaaaagggaauaauuuucauacuccuuaugcucgugacuccauccauggccaugagguguguuggaauuggaucccgagauuuuguugaaggacuuagcggagcaacauggguugacguaguuuuagaacacgggucgugcguaacaacuauggcgaaggacaaaccaacccuugacauagaacuucucaaaacggaaguuacaaacccugcaguauuaaggaaacuuuguauagaagcuaagaucaguaacacaacuacagacucuagaugucccacacaaggagaagcaacacuaauggaggagcaagacgcuaacuucgugugucgucgaacauuuguugacagaggguggggaaaugguuguggucuuuuuggcaaagguagccuaauuacaugcgcaaaguucaaaugugugaccaaacuagaaggaaaaauuguacaauaugaaaacuuaaaauauuccguaauagucaccguucacacaggagaucaacaccaaguaggaaaugaaucaacugaacaugggacaacagcuacaauaacuccacaagcaccaaccucagagauucaguuaacagauuacggugccuuaacccuugacuguuccccacgaacgggccuagauuucaacgaaaugguccuucuuacgaugaaagaaaaaucaugguuaguacauaaacagugguuuuuagauuuaccauugcccuggacaaguggagcaucuacaucacaagaaacauggaauagacaggaucuauuagucacguuuaagaccgcccaugcuaagaaacaggagguagugguauuagggagccaggaaggugcuaugcauacugcauuaaccggcgcaacugaaauucaaacaucaggaacaacaacuauauucgccgggcacuuaaagugcagguuaaaaauggacaaguuaacgcugaagggaaugaguuauguaaugugcacuggaucguuuaaauuagaaaaagaagucgcagaaacacaacaugguacaguauugguacagauaaaguacgaaggcacugacgcuccguguaaaauuccguuuucaacccaagacgaaaaaggugucacgcaaaauggaagacuaauaacggcuaauccuauaguuacggacaaagagaaaccgguaaacauagaagcugaaccuccauucggcgagucauauaucgugauaggcgcaggggaaaaagcucuaaaacugagcugguucaagaaaggcucuaguauaggaaaaauguucgaagcaacugcaaggggagcgagaaggauggccauauuaggcgauaccgccugggacuucgggucuaucgguggaguauuuacgucugucggaaaguugguacaucaaaucuuuggaaccgcauacgguguuuuguuuagcggagucucauggacaaugaaaaucgggauaggaguucuccuaacaugguuaggucuaaauucacgaucgacguccuuauccaugaccugcauagcggucggauuaguaacccuguaccuggguguaaugguacaagcagacucgggaugcgucauaaauuggaaagggagagaauugaaguguggauccggaauauuuguuaccaaugaaguccauaccuggaccgaacaauauaaguuucaggcugacucaccaaaaagguuaagcgcugcaauagggaaggccugggaagaagggguaugcgguauacgaagugcuacuagacuugaaaauaucauguggaaacagauaucgaaugagcuaaaccauauucuacuagaaaacggaaugaaauuuacuguuguaguuggagauguaguaggcauauuggcucaaggaaagaaaaugauuagaccacagccaauggaacauaaauauagcuggaaauccuggggcaaggcaaaaauuaucggagccgacguucaaaacacaacauucauuauagauggaccuaauacuccagaaugcccugaugaucaacgagccuggaauaucugggaaguggaagauuauggcuuugggauauuuacaaccaauauaugguuaaaacuucgggauucauacacgcaggucugcgaccaucgcuuaaugucugcagcuauuaaagauucaaaagcugugcacgcugauaugggauauuggauagagucugagaaaaaugaaacauggaaacuagcgagagcuagcuuuauagaagucaaaacauguaucuggccaaagucacauacacuguggaguaacgguguucuagaaucugaaaugauaauaccuaaaauauacgggggucccauaucccagcauaauuauaggccagguuauuuuacacagacagccggaccauggcaucugggcaaauuagagcuggauuucgacuuaugugaaggaacuacagugguaguagaugaacacuguggaaaucgcggaccgucgcuuagaacuaccacgguuacggggaagauaauucacgaaugguguugccggucaugcacacuaccaccccuuagguuuaaaggcgaagacggauguugguauggcauggaaauaagaccaguaaaagaaaaagaagaaaacuugguaaaaucuaugguaagugccgggucaggagaaguugacucguuuucauuagguuuauuauguacaaguauaaugaucgaagaagucaugcgcucgcgaugguccagaaaaaugcuuaugacaggaacuuuagccguauuuuuacucuugauuauggggcaauuaacguggaacgaccucauucgauuaugcauaaugguuggcgcuaaugccucagauagaaugggcauggggacgaccuauuuggcauuaauggccacauuuaaaaugcggccaauguucgcagucggacugcuauucaggagauugaccucucgugagguucuacuucugacaauaggccuuuccuuggucgcuaguguagaauuaccaaauucacucgaagaacugggugacggauuggcuauggggaucaugauccuaaaauuacugaccgauuuucaaagccaccaauuaugggcaaccuuguugagucugacguuuauaaagaccacacuauccuuacacuaugccuggaaaacaauggcaaugguccucuccaucguaucucuuuucccgcuaugccuaagcacaacaagccaaaagaccacuuggcuaccagugcuccuuggaaguuuaggcuguaaaccuuuaacaauguuccuaauugcggagaauaaaauaugggguagaaagaguuggccacugaacgaaggcauaauggcagucggugucguaaguaucuuauuaucuucauugcuaaagaacgacgugccuuuagccgguccguuaauugcaggaggaaugcucauagcuuguuauguuaucagugguagcagcgccgauuugagucuagagaaagcggcugaaguaucgugggaagaagaagcggaacauucuggugcaucgcauaauauacugguagaagugcaagacgacgguacaaugaaaauuaaagaugaagaaagagacgauacccucacaauucuacuaaaagcuacucuauuagccguuucagggguuuauccacuuaguauaccagcgacccuauucguaugguauuuuuggcagaagaagaaacaaaggucuggcguacuaugggauaccccgagcccacccgagguggaaagagcaguccucgaugauggaauauaucgaaucaugcaacgggggcuacuuggacggagucaaguaggaguaggcguguuucaagagaaugucuuccauacgauguggcacguuacuagaggggcaguccuaauguaucaagguaaacgauuagagccgucaugggcuagugucaagaaagaucuaauuagcuauggcgggggauggcgacuacaaggauccuggaauacaggugaagaaguucaagugaucgcaguagagccaggcaaaaaucccaaaaauguucaaacugcaccuggaacguuuaaaacacccgaaggugagguaggugcaaucgcauuggacuuuaaacccggcacgucgggaagcccgauaguaaaucgcgaagggaaaauagucggauuauaugguaacgggguaguaaccaccucaggaacuuacguaucagcgauugcucaagcuaaagcgucucaggaggggccgcugccagagaucgaggacgaaguuuuccgaaaacgcaaucuaacuauaauggacuuacacccaggaagugguaaaacgaggagauaucuaccggccauugugcgcgaagcuauaaagcgcaaacuucggacuuuaauucuugcccccacacgggucguggccucugaaauggcugaagcacucaaaggcaugccgaucagauaucaaacuacagcaguuaaaagugaacacaccgggaaagaaauagucgaccucaugugccaugcgacuuuuacuaugagacuuuuaucaccaguacgaguuccuaauuacaauaugauuauaauggacgaggcacauuucacugauccguccaguauagcagcuagagguuacauaaguacucgaguagguaugggugaagcagccgcuauuuucaugacggccaccccaccuggaucaguugaagcauuuccccaaagcaacgcugucauacaagacgaagaaagagauaucccagagcggucguggaauagcggcuaugaauggauaacagauuuuccaggaaaaacagucugguuuguacccucgaucaaaucugguaaugacauagccaauugucuuaggaagaauggcaaacggguuauucaacuuagcagaaagacuuuugauacagaauaucagaaaacuaaaaauaaugacugggauuauguuguuacgacugacauaucugaaaugggagcaaacuucagagcagaccgaguaauagauccgagaagaugcuuaaaacccguuauauugaaagauggccccgagagggugauuuuggccggaccaaugccugucacuguagccagcgcagcacaacgaagagggagaauaggcaggaaccauaauaaagaaggagaucaauauauuuacaugggccaaccauuaaauaacgaugaagaucacgcucauuggacagaagcaaagaugcuauuggauaauauaaauacgccugaagggauaauaccagcccuguucgaaccagaaagggaaaaaucugcugccauugauggggaauauagacuacggggugaagcacguaaaacauuuguagaauugaugaggaggggcgaucuacccguuuggcucaguuacaaaguagcuagcgaggguuuccaauauucagaucgacgauggugcuucgauggugaaagaaacaaucaaguucuggaggaaaauauggacguagagauuuggacaaaagaaggagaacgcaagaagcugagaccccguuggcucgaugcacggacguauuccgauccuuuagcacuacgagaauuuaaagaauuugccgccggccgacggaguguuucgggcgaucucauacuggaaauaggaaaacugccgcaacacuuaacacaaagggcccagaaugcauuggacaacuugguuaugcuccacaacucugaacaagggggucgagcauauaggcaugcaauggaagaauuaccugacacuauagaaacacuaaugcucuuagcgcuuauagccguuuugacgggagguguuacacuauuuuucuuaucaggcagaggccuagggaagacaaguauaggauugcugugcguaauggcuaguucaguguuacuguggauggcguccguugaaccucacuggaucgcugccaguaucauacucgaauuuuuccuuaugguauuauuaaucccggaaccugacaggcaaagaacgccacaagacaaucaauuagcauacguaguuauaggucuuuuguuuaugauacuuacuguagccgcgaacgaaaugggccuacuugaaacuacuaagaaagaucugggaaucggccacguagcuguagagaaucaucaccacgcuacaaugcuugacgucgaccuacacccagcaucagcauggacucuauacgcgguagcuaccacuauuauaacaccaaugaugagacauacaauagaaaauacuacggcaaacauaagucuaacagcuauugcuaaucaggcagccauacuaaugggacucgauaagggguggccuauaaguaagauggauaucggaguaccauuacuugcucuuggaugcuacucucaaguaaacccauuaacguuaacagcagccguccuaauguuaguagcgcacuacgccaucauaggaccugggcuucaggcaaaagccaccagagaagcucagaaaaggacggcagcuggaauaaugaaaaaccccacaguagauggcaucguugcaauugaucuggauccgguaguauacgacgccaaauucgaaaaacaguuaggccaaauuaugcuuuuaauauuaugcaccucacaaauacuucuaaugcgaacgacgugggcuuuaugugaaaguauuacgcuagcaacuggcccguuaacuacauugugggagggauccccaggaaaauuuuggaauacaacaauugccgucucuauggcuaauauauuccgcggaucauacuuagcaggggcaggacuugcguucucauugaugaagucauuaggaggcggaagaagggguacuggggcacagggagaaacgcugggagagaaauggaaacgucaauuaaaccaacuaaguaaaagugaguucaauauauauaaacgaucugguaucauggagguugauagaagugaagcaaaggaagguuuaaaaagaggggaaacgacaagacaugcgguaaguaggggcacagcaaaguuaagaugguuuguagaaagaaaucuagugaaaccagaaggaaaaguaaucgacuuaggcugcggucgagggggcuggaguuacuauugugcaggccuaaagaaaguaacugagguaaaaggguauacaaagggugguccaggccacgaagaacccauuccaauggcuacauauggauggaauuuaguuaaauugcacaguggcaaagacguuuucuuuacgccaccagaaaaaugcgacacacuuuuaugcgauauuggugagucaucuccaaauccaacaauagaggaagggcgaacguuaagaguauugaagauggucgaaccuuggcuaagaggaaaccaauucugcauaaaaauccuaaauccauauaugccaaguguaguagaaacucuagaacaaaugcaaagaaaacacgguggaaugcuaguaagaaauccacuaucaagaaauucaacccacgaaauguauuggguaaguugcggcaccgguaacauuguaucugcgguaaauaugaccucaagaaugcuccuuaaccgcuucacuauggcccaccguaagccaacguaugaacgagauguagaucuuggugccggaacccgucauguugcgguagaaccugagguagcuaaccuggauauuauaggccagaggauugaaaauauaaaacaugaacauaaaucaacuuggcacuacgaugaagauaacccauacaaaacaugggcauaucauggaaguuacgaagugaaaccaucagguucggcaucauccaugguuaacggggucgucaaauuacuaacuaaaccgugggacguuauaccaauggugacacagauagcuaugacagauacaacccccuuuggucaacaacgaguuuucaaagagaagguagauacacguacaccgaaggcaaagcgaggaacagcccaaauaauggaggugacagcuagaugguuauggggcuuccuuucucgaaacaagaaaccgcgcauaugcacgagggaagaauuuacaagaaaagugagaagcaacgcagcaaucggagcgguauucgucgaugagaaucaauggaacuccgcuaaagaagccguugaagacgaaagauuuugggaucuaguacagaaagaaagggaacuucacaagcaagguaagugcgccaccuguguuuacaacaugaugggaaaaagagagaagaaauuaggagaguuugguaaagcgaaaggcagccgagccauaugguacauguggcuaggagcgagguuuuuagaauuugaagcgcuaggauucaugaacgaagaucauugguucucacgcgaaaauucacuuucggggguagaaggggaaggguuacauaaauuaggauacauuuuacgagacauaucuaagauaccaggcggcaauauguaugcagacgauaccgcaggaugggacacgagaauuacugaagaugauuugcaaaaugaggccaaaaucacagacauaauggaaccagaacacgcacuccuagcgaccucuauuuuuaaauuaacguaucaaaauaaaguaguuaggguccaaagaccagcuaaaaacgggacuguaauggauguuauaagucgccgugaucagcgcggauccggucaagugggaaccuauggacuaaauacauuuacaaauauggaagcacagcucauacgacaaauggaauccgaagguaucuuucuuccgucggaauuagaaacaccgaauuuagcugaaagaguucuagacugguuggaaaaguacgguguggaacgacuuaagcguauggcgauuuccggcgaugacuguguugugaagccaauagacgauagauuugcaacugcgcucacagccuugaaugauaugggaaaggugcgaaaagacauuccucaaugggagccgucuaaaggauggaaugauuggcagcaaguaccguuuuguagccaccauuuucaccaauuaauaaugaaggacggacgugaaaucguagucccuugcaggaaucaagacgaauuaguaggaagggcacgaguaucucagggggcugguugguccuuacgggagacagcuugccuugguaaaagcuacgcccagauguggcagcugauguacuuccacagaagagauuugaggcucgcagcuaacgcaauaugcucagcaguccccguugauugggucccuacaaguagaaccacauggagcauucacgcacaucaccaauggaugaccacugaggauaugcuuucuguauggaaccgcguuuggauugaggaaaacccauggauggaagauaaaacccacgugaguucauggggugacguuccuuaccuaggaaaaagggaggaucaauggugcggaagccuaauaggacucacagccagagcaacaugggccucaaacauucaaguagcuauaaaucagguucgaagacuaauaggaaaugagaauuaucucgauuacaugaccaguaugaaaagauuuaagaacgaaggggacccugaaggagcauuaugguga

SEQ ID NO: 21888 - RNA, 9879 nt, Artificial Sequence
  derived and/or modified CDS sequence (opt6) from DENV-1__EU482792__SS-prME
aguguaaccauguuguuaauguuaaugccgacugcacuagccuuucaccugacaacacgaggaggggaaccucacaugauagucacaaaacaagaaagaggaaaaucacuauuauucaaaacaucagcaggagucaauauguguacacucauagcaauggaucugggugaauugugugaagauacuaugacauauaaauguccucgcauuacagaaacagaaccagaugaugucgacugcuggugcaacgcaacagauacaugggucacauauggcacuugcucacaaaccggugaacaccgacgagauaaaagaagcguagcucuugcaccgcacguaggacuuggccuugaaacucguacggaaacauggaugagcucugaaggggcuuggaaacaaauccaacguguggaaaccugggcuuuaagacauccgggauuuacgguaauugcacuauuuuuagcacaugcaauaggcacuucaauaacccaaaaaggaauaauauuuauuuuauuaauguuaguuacuccaucaauggcuaugagauguguuggaauuggaucaagggacuucguagaagggcuuuccggcgcaacauggguagauguagucuuagaacaugguucuugcguaaccacgauggcgaaagauaaaccuacuuuagauauagaacuucuuaaaaccgaaguaacuaauccugcuguauuaagaaaauuauguauugaggccaaaaucaguaacaccaccaccgauucacgauguccaacacaaggugaggcuacuuuaauggaggaacaagacgcaaauuucguaugcagacguacauuuguagaucgaggaugggguaacggcuguggcuuguuuggcaaaggaucuuugaucacaugugcaaaauucaaauguguuacgaaacuagaagggaaaauaguucaauaugaaaacuuaaaauauagcguaaucgugaccgugcacacaggagaccaacaccaaguagggaaugaaaguaccgaacaugguaccacugcuacuauaacuccacaagcuccgacaucugaaauucagcuaacagauuacggcgcucuaacucuagauuguucaccucgaacuggucucgauuuuaacgaaaugguacuauuaacaaugaaagaaaaaucgugguuagugcauaagcaaugguuccuggacuuaccccuuccauggaccuccggugcuagcacuucacaagagacauggaacaggcaagaccuauuagugacauucaagacugcgcaugcuaaaaagcaggaaguagugguccuaggcagccaagagggugccaugcacacugccuuaacaggugcgacugaaauacagacaagcggaacaacuacaauauuugcuggccauuugaagugcaggcuaaaaauggacaaauuaacgcucaaaggaaugucuuauguaauguguacggguaguuuuaaacuugaaaaagaagucgcagaaacccaacacggaacaguuuuaguucaaauaaaauaugaagguacagacgccccaugcaaaauaccauucaguacacaggaugaaaaaggaguaacccaaaacggccggcuuauuacugccaacccaaucguaacugacaaagaaaaaccgguaaacauugaggcagaaccgccguuuggugaaucguacauugugaucggcgcuggugaaaaagcgcucaaguuaucaugguuuaagaaaggaaguucuaucggaaaaauguucgaagcgacagcacggggugcuagacgcauggccauucugggggauaccgcaugggauuuugguagcaucggaggaguuuucacauccguaggaaaauuaguucaccaaauauuugguacagcauauggaguguuauucucagguguaucauggaccaugaaaauuggaauaggugugcuucuaacuuggcuaggucuuaauucgcgaucaacaagccuaucaaugacauguauugccgucgggcuuguuacauuauaucuaggcguuaugguccaggcggauucagggugcguaaucaacuggaaaggaagggaacuaaaaugcggcaguggaauuuucgucacgaacgaaguucauacauggaccgaacaauauaaauuucaggcagacagcccaaagcguuuaucagcagcaaucggcaaagccugggaagaaggagugugugggauaagguccgccacacguuuagaaaacaucauguggaaacaaaucagcaacgaacucaaccacauucuacuggaaaaugacaugaaguuuacuguugugguaggugauguaguugguauucucgcgcaaggaaagaaaaugaucagaccucaacccauggaacacaaguacaguuggaaaagcugggggaaagcuaaaauaauuggcgcugacguacaaaauacuacauuuauaauugaugguccuaauacaccagaauguccggacgaucaaagagcauggaacauaugggagguagaagauuacgguuuugguaucuucacuacaaacauuuggcuaaaguuaagggauaguuacacacaggucugugaucauaggcucaugagugcugcuauaaaggacaguaaagcagugcaugcagacaugggauauuggauugaaagcgagaaaaaugaaacuuggaagcuggcuagagcaucauuuauugaaguuaaaacauguaucuggccgaaaucacauacacuaugguccaaugguguacucgaaagcgaaaugaucauuccaaaaauauaugguggucccauaucucagcacaauuaccgacccggauauuucacccaaacggcagguccauggcaccuugguaaacuagaauuagauuucgaccuaugugaagguacgacaguggugguagacgaacauuguggaaauagaggaccaucucugagaacgaccacgguaacaggaaagaucauucaugaaugguguuguaggucauguacacucccuccauuacgauucaaaggagaagaugguuguugguauggaauggaaauacgaccuguuaaagagaaagaagaaaauuuaguuaaaucaaugguaucagcaggcucgggggaggucgacucauuuucccuaggguuacuaugcaucucuauuaugauagaagaaguaaugagaucacgcuggagucgcaaaaugcuuaugaccggcacucuagcgguuuuucuacucuuaauaaugggucaacuaacuuggaaugacuugauccggcuuugcauuaugguaggagcaaaugcuagugauaggaugggaauggguaccaccuaucucgcuuuaauggcgacguucaaaaugagaccuauguucgcugugggguuacucuuucgaagacuuacuagcagagaagucuuauuacuaaccauaggacuaagucuaguagcaaguguagaacuccccaauucucuugaagaauuaggagauggauuggcuauggggauaaugauauuaaaacuccuaacagauuuucaaucacaucaguuaugggcuacgcuacuuucuuuaacauuuauaaaaacuacccuuucguuacacuaugcauggaaaacgauggccaugguccucucgauagucagucucuucccguuaugccuaaguacaaccucccagaagacgacauggcuaccgguacuucucgguaguuuaggaugcaagccacugaccauguuucuaauagcugaaaauaaaauuuggggaagaaagucauggccccuaaacgaagguauaauggcaguaggggucguauccaucuuacuguccucacuccucaaaaaugaugugccuuuagcggguccacucauagcgggagggaugcuaauugcguguuacguuaucucugguucuucugcugaucuuagcuuagaaaaagcugcagaagucaguugggaagaagaggcagaacauucuggagccagucauaacauuuugguugagguucaagacgacggcacgaugaaaauuaaagacgaagaacgggaugacacuuuaacuauucuauuaaaagcuacuuugcuugcagugagcgguguguauccucuuaguauuccagcuacccuuuuuguuugguacuucuggcagaagaagaaacaaaggaguggugugcuaugggauacaccgucuccuccggagguagaacgugcaguuuuagaugauggaauuuaucgaauuaugcaacguggucuccuaggcagaucgcagguaggcgucggggucuuucaagaaaauguauuccacaccauguggcacgucacgcgaggagcagugcuuauguaucaagguaaaagguuagaacccucgugggcuaguguuaagaaagaccuaauuucauacgggggcggauggaggcuucaggguaguuggaauacaggggaagagguacaaguuauagcgguagaaccaggaaagaaccccaaaaaugugcaaacugccccuggaacauucaaaacaccagaaggggaggugggugcaaucgcguuagauuuuaaaccagggacuucugggagccccauagucaauagagaaggcaagauuguaggacuguauggaaauggaguaguaaccaccucaggaacauauguaucugccauagcacaagcgaaagcaucgcaagaagggccauuacccgaaaucgaagacgaagucuuuagaaaaagaaacuuaacaauuauggaucuacauccaggaucugggaaaacgagacguuauuuaccagcaaucguuagagaagcgauaaagaggaaacuccgcacacuaauacucgcaccaacuagaguugucgcuucugaaauggcggaggcuuuaaagggaaugcccauucgauaucaaacuacggcugugaaguccgaacauacugguaaagaaaucguugaucuaaugugccacgccaccuuuacuaugagguuacuaaguccagugcgcgucccaaauuauaacaugauaaucauggacgaagcccauuucacugacccaagcuccauugcugcucgaggauacauuaguacacggguugguaugggugaggcugcggcaauuuuuaugaccgccacuccacccggcagcgucgaggccuucccucagaguaaugcgguuauucaagacgaagagagagacauaccugagagaaguuggaacucaggguacgaauggauaacugauuuucccgguaaaacuguuugguucguaccuucaauaaaaagcggcaaugauaucgccaauugucucaggaaaaaugggaaaaggguuauacagcuaagccgaaagacauucgauacugaguaucagaaaacuaagaacaaugauugggauuauguugugaccacagauauaagugaaaugggagcaaauuucagagcugauaggguuauagauccacgaaggugucuuaaaccugucauacuaaaagauggaccagagaggguaauacuugcugggccuaugccuguuacaguugcaagugcugcccaaagacgagguaggaucgguaggaaccacaacaaagaaggagaccaauacauuuacaugggacaaccacuuaauaaugaugaagaucaugcacacuggacagaagccaagaugcuauuagacaauauuaacacaccagaagggaucauaccagcucuauucgagcccgagcgcgagaaaagugcagcaaucgauggugaauacagacuaagaggggaagcaagaaaaacauuuguugaguuaaugaggagaggagauuugccaguauggcuaucauacaaaguugcgagugaggguuuucaauauucugauagaagaugguguuuugacggagaaagaaacaaucaaguacuggaagaaaacauggacguugaaauuuggacaaaggaaggugagaggaagaaacuaagacccagaugguuggacgcaagaaccuacucagauccguuagcuuuaagagaauuuaaagaguuugccgcgggacgccguagcgucucuggagaccugaucuuagaaaucgguaaauuaccacaacacuugacacaaagggcgcaaaacgcccuugauaacuuaguaaugcuacacaacucagagcagggcggccgagcuuacagacacgcuauggaggaacuacccgauaccauagaaacccuaauguuauuagcacugauugcgguuuugacuggaggagucacgcuauuuuuccucagcggucguggucuagguaaaacauccauagguuugcuauguguaauggcuuccucugugcuacuauggauggcuucagucgaaccgcauuggauagccgcgucaauuauauuggaguucuuuuuaauggugcuacuuauaccugaaccagauagacaaagaacaccacaggacaaucaguuagcauacguagucauaggauuguuauuuaugauuuuaacaguggcggcgaacgaaaugggacuguuagaaacaacaaagaaggaucuaggcauaggucauguugcagucgaaaaccaccaucacgcuacuaugcuagacguagaucugcauccugcgucggcauggacucuauacgccguugcgaccacaaucauaaccccaaugaugcgacauacgauugagaauacaacagcgaauaucucauuaacugccauagccaaucaagcagcuauacugauggguuuggauaaagguuggccaaucucaaagauggacauuggcguaccauuacuagcccucggaugcuacucccaaguaaacccgcugacacuaacggcagcuguuuuaauguuggucgcucauuaugcaauaauuggcccgggauugcaagcgaaagcaacaagggaagcacagaaaagaacagcagcgggaauaaugaaaaauccaaccgucgauggaauuguagcuauagauuuagacccaguaguauacgaugcaaaauuugagaagcaauugggccaaauaaugcuguuaauacuuuguacuucgcagauucucuuaaugagaacaacaugggcauuaugugagucaaucacucuggcaacaggaccgcuuacuacguuaugggaagguucaccagguaaguuuuggaacacuacaaucgcggucucgauggcgaacauauuuagagguagcuaucuagcgggcgcuggucuugcauuuagccuaaugaagucuuuaggagggggaaggagaggaaccggugcccaaggagaaaccuuaggagagaaguggaaaagacagcucaaucaacuaagcaaaagcgaauuuaauaucuacaaacgaaguggaaucauggaggucgacagaucagaagcaaaggagggacucaaacggggagaaacaacucggcacgccgugucacggggaacggcaaagcucagaugguucgucgaaagaaaccucgucaagccagaagguaaaguuaucgauuuaggaugcggaaggggcggcugguccuacuacugugcagggcuaaagaaaguaacugaagucaaaggguacacgaaaggaggacccggacacgaagaaccgauaccgauggccacguacgguuggaaucuugucaaauuacauuccgguaaagacguauucuucaccccaccugaaaaaugcgacacuuuacuuugcgacaucggcgaauccucaccuaaucccacaauugaggaagggcguacucuucgaguauuaaaaaugguagagccaugguuacgaggcaaccaauucuguaucaagauauuaaauccauacaugccuaguguuguagagacuuuagaacaaaugcagaggaaauaugggggaaugcuaguaagaaaucccuuaucuagaaacaguacacaugaaauguacuggguauccugugguacuggaaauaucguuuccgcagucaauaugacaagucgaaugcuuuuaaacagauuuacaauggcccaucgaaaaccgaccuacgaaagggacguagauuuaggcgcugguacucgacauguagcuguagaaccagaaguugcuaauuuagacauaauaggucaaagaauagaaaauauaaaacacgaacauaaaucgacauggcauuaugacgaagauaacccauacaaaacaugggcuuaccacggaaguuaugaaguaaaaccgaguggcucggcaucgucuaugguaaacggaguaguaaaauugcucacaaagccaugggauguaauacccaugguaacgcaaauugcaaugacagacacaacaccauucggacagcagagagucuuuaaagaaaaaguugacacaagaacacccaaggcaaagcgcggcacugcucagauaauggaagucacggcaagauggcuauggggcuuucuaagccgcaauaaaaagccgcgaauuuguacacgagaggaguucacuagaaaaguucgaaguaacgcugcaauaggcgcuguuuuuguagaugaaaaccaauggaacucagcaaaagaagccguggaggaugaaagauuuugggauuugguacaaaaagagcgugaguugcauaaacagggaaagugugcaaccuguguauauaauaugauggggaaaagggagaagaaacuuggugaauuugggaaagcgaaagggagccgggcgaucugguacaugugguugggagcgcgauuccuagaguucgaagcacuaggauuuaugaaugaagaucauugguuuucuagagaaaauucacugaguggcguagaaggcgagggacugcacaaauuaggguacauccuucgagauauaucuaaaaucccagggggaaauauguaugcagaugauacugcgggaugggauacaagaauuacagaagacgauuugcaaaaugaagcaaaaaucacugauauaauggaaccagaacacgcacucuuagccacaaguauuuuuaaacuaaccuaucaaaauaaaguuguuagaguucaacgaccagccaaaaaugguacgguuauggaugucaucagucguagggaucaacggggcagugggcagguaggaaccuacggccuuaauacauuuacaaauauggaagcccaacuuaucaggcaaauggaaucggaagguauauuuuuaccuagugaacucgaaacacccaaccuagcagaaaggguccuggacugguuagagaaauauggcgucgaaaggcucaaacguauggcgauuucaggagacgacuguguaguaaagccuauagacgauagauucgccacagcacugacagccuuaaaugauaugggcaaaguacgaaaggauauaccgcaaugggaaccuucaaaaggcuggaaugacuggcaacaaguaccauuuuguucgcaucauuuucaucaacuaauuaugaaagacgggcgagaaauaguuguccccuguagaaaccaagaugaguuagugggcagagcccguguaucacaaggugcuggauggucuuuaagggaaacggcaugucuaggcaaaucauacgcacaaauguggcaacuuauguauuuccauagacgugauuuaagauuagccgcuaaugcgauauguagcgccguacccguggacugggugccaaccagccgcacuacauggucaauacacgcccaccaucaauggaugacgacugaggacaugcuaaguguuuggaauaggguauggauagaagaaaacccauggauggaagacaaaacacauguuaguucauggggagaugugccguaucuuggaaaacgcgaagaccaaugguguggcucucuaaucggacugacugcgagagccacuugggccucaaauauacaagucgcgauaaaucaaguucgaagauuaauaggcaaugagaauuaccuugacuauaugacaucuaugaaaagauuuaaaaacgagggcgauccagaaggggcacuaugguaa

SEQ ID NO: 21889 - RNA, 9879 nt, Artificial Sequence
  derived and/or modified CDS sequence (opt6) from DENV-1__EU482707__SS-prME
agcguaacaauguuauuaaugcugaugccuacugcgcuggccuuucaucugacgacccgagggggagaaccacacaugauaguaucaaaacaagaaagaggcaaaucucuauuauuuaaaacuagcgccggcgugaacaugugcaccuugaucgcaauggaucuuggcgaacugugcgaagauacaaugacguacaaaugcccgcgaauaacggaagcagaacccgaugauguagauugcugguguaaugccacagacacgugggucacguaugggacaugcucccaaacaggagaacaucggagagacaagagaucaguugcauuagcgccacauguaggucugggucuagaaacaaggacagaaaccuggaugucaucagaaggggcauggaaacaaauucagagaguggaaaccugggcucuaagacaucccgguuuuacugucauagcguuauuccuagcucaugcaauugguacaucuauaacacaaaaagguaucauuuuuauacuacugauguuaguaacaccgucaauggccaugcguugugucggcauugggucaagagauuucguagaggguuugucgggagccacuuggguagacgugguauuagaacacggaaguuguguaacaacuauggcaaaagacaaaccaacgcuggacauagaauugcuaaaaacagagguuacuaauccggcgguuuuaagaaagcugugcauugaagcaaaaauaaguaauaccacaacagacagccgguguccgacccaaggugaagcgacgcuaguagaagaacaagacgccaauuuuguuuguaggaggacauucguugauagaggguggggcaacggaugcggauuguuuggaaaaggcucauugauaaccugugcaaaauuuaaaugugucacaaaacuagaaggaaaaauaguucaguaugaaaauuuaaaauacucuguaauugugacaguacacaccggcgaucaacaucagguuggaaaugagagcacugaacaugggacaaccgcgacuauaacuccucaagcaccuacgacagagauccaacuaacggauuacggcgcacuuacauuggacuguagcccacgaacuggacuggacuucaaugaaauggucuugcuuacaaugaaagaaaaaucuugguugguacacaagcaaugguucuuagacuuaccacuaccauggacaucaggggcaaguacaucccaagaaaccuggaacaggcaagauuuauuaguaacauuuaaaacagcccacgcaaaaaaacaagaaguuguuguacuugggagccaagaaggugcaaugcauacggcauugacaggagcaacugagauacaaacaagcggcacaacaaccauauuugccgggcaccuuaaaugucguuugaaaauggacaagcuaacguuaaaaggaaugaguuauguuaugugcacggggucauucaaguuagaaaaagaaguagcggaaacacagcauggaacagugcuuguacaaauaaaauacgaaggaacagacgcgccauguaaaauaccuuucaguacucaggacgaaaagggcguaacacagaauggacgccugauaacggcaaaccccaucguuaccgacaaagaaaaaccugugaauauagaggccgaaccuccauucggcgaaucauacauagugaucggugcuggggaaaaggcacucaaauuaucaugguucaaaaaggggagcaguaucgggaagauguucgaagcaacagcccgcggcgcgaggcgaauggcaauacuaggcgauacugcgugggauuuuggaaguauaggagggguauucaccucaguugggaaacuuguacaccaaauauuuggaacggcuuacgggguauuguuuucaggaguaagcuggacgaugaagauaggaauuggcguacuguuaacauggcuuggacucaauaguagaucuacaucgcuaagcaugacauguauagcuguuggauuagucacucuguaccuuggcguaaugguacaggcagacuccggauguguuauuaauuggaaaggcagagaauugaaaugcgggucaggaauauuugucacaaaugagguacacacuuggacggaacaauauaaguuccaagcggauaguccaaaacgacuguccgcggccauaggaaaagccugggaggaaggaguuugcgggaucagaagcgccacacgguuagaaaauaucauguggaaacaaauaucaaaugagcugaaccacauauuacuggaaaacgauaugaaacucaccguagucguuggagauguggcuggaauucucggccaaggaaaaaagaugauaagaccucaacccauggaguacaaguacaguuggaagucguggggaaaagcuaagaucauuggagcugaugcacaaaacacaacuuuuaucauugauggaccaaauaccccagaauguccggaugaucaacgugcauggaacauaugggaagucgaggauuacggguuugguauauucacaaccaauaucuggcuuaaauuacgggauucauauacucaaguuugugaucauagacuaaugucugcggcgaucaaagacaguaaggcuguccaugcagauaugggauauuggauugaaagcgaaaaaaacgagaccuggaaacucgcacgagcuucauuuauugagguaaaaacuuguauauggccgaaaagucacacuuuauggucgaauggcgucuuggaaucggagaugauuauaccuaaaauuuaugguggccccauuucucaacacaacuacagaccaggauauuucacgcaaacugcaggucccuggcauuuagguaaguuggagcuagacuucgacuuaugcgaagggacaacgguuguuguggacgaacauuguggaaaccgggguccaucucucaggacgacaacagucacaggaaaaauuauacacgaguggugcugcagaaguuguaccuugccaccacuccguuuucgaggugaagacggaugcugguauggaauggaaauacgaccuguaaaggaaaaggaagaaaaucugguaaaaaguaugguuagcgcuggaucaggagagguagauucauuuucacuaggccuccuaugcaucagcaucaugauugaagaagugaugaggucuagauggaguagaaaaauguugaugacagguacuuuggcuguguuuuuccuuuuaauaaugggucaacuuacuuggaaugacuuaauuaggcucuguauaauggucggcgcuaaugccagugauagaaugggaauggggacuacauaccucgcacuaauggcaacuuucaaaaugcgaccgauguuugcugucggauuguuguuucggagauugacaagucgggaaguguuauuauuaacuauuggacucucgcuaguugcaagcguagaauugccaaacagccuugaagaacuaggagaugggcuagcaaugggaauuaugauacuuaagcuccuaacagauuuccaaucucaucaacucugggccacacugcuaucuuugacauuuauaaagacaaccuuuagucuccauuaugcauggaagacuauggcaaugguucugucuauugugucgcuauuuccccuaugcuuaaguaccacaucucaaaaaacaacuugguuaccuguacuccuagggucguuaggauguaagcccuuaacaauguucuugauagcagagaauaaaaucugggguaggaaaagcuggccuuuaaacgaaggaauaauggcggugggaauagugaguaucuuacuaagcagucuuuuaaaaaaugauguaccgcucgcagguccauugauugcgggagguauguuaauagccugcuauguaaucucuggaagcuccgcagaccugaguuuggaaaaggcugcagaaguaucaugggaggaggaagcugagcauucaggagcaagucauaauauauuaguggaaguacaagaugaugguacuaugaaaauaaaagaugaggaacgcgaugacacacuaacaauuuuauuaaaagcaacgcuucuugccgucucagguguuuacccauuaucuauaccugccacucucuuugucugguauuucuggcaaaaaaaaaagcaaaggucaggugugcucugggacaccccuagcccgccggaaguugagagagccguauuagaugacggaauuuacagaauaaugcaacgaggacuuuuaggucgaucucaaguaggugugggaguauuucaagaaaacgucuuucauacaauguggcauguuacacgaggugcagugcuaauguaccaaggcaaaagauuagagcccaguugggccaguguuaaaaaggaccuuauaagcuauggcgggggauggcgauuacguggaucauggaauaccggcgaagaagugcaaguaaucgcaguggagccuggaaagaacccaaagaauguucaaacugccccaggaacuuuuaaaacaccagaaggggaaguuggagcgauagcuuuagacuuuaaaccagguacgucgggaucaccaauaguaaauagagaaggaaaaauaguugguuuauauggaaauggaguagugacaacauccggcaccuauguaucggcaauugcccaagcaaaagcuagucaagaagggccauuaccggagaucgaagacgagguauucaggaaacgaaaucugaccauuauggaucuucacccgggaagcgguaagacccggcgcuaccucccggcaaucguuagagaggcuauaaaaagaaaacuaagaacgcuaauucuagcgccaaccaggguuguugcaagcgaaauggcagaggcuuuaaaaggcaugccuauacgcuaucaaacuacggcaguuaaaagcgaacacacagggaaagaaauaguagauuuaaugugccaugcaaccuuuacaaugcgacuuuugucaccaguacgcguuccuaauuauaacaugaucauaauggaugaagcacauuucacggauccaucgucgauagcugcccggggcuauaucaguacacgaguuggcaugggagaagcagccgccaucuucaugacagcaacaccacccgggucggucgaagccuucccucaaaguaacgcuguuauacaagacgaagaaagagauaucccagagcguaguuggaauucaggcuaugaauggauaacagacuucccaggaaaaacggucugguucguuccaucaauaaaaucaggcaaugacaucgccaauugccuucgaaaaaaugggaaaagagugauucaacugagcagaaaaacauuugauacggaauaucaaaaaacaaaaaauaacgauugggauuaugucguuacaacugauaucagcgaaaugggagccaacuuucgagcagaccguguaauugacccacgaagaugucuaaaacccguaaucuuaaaagacggaccagaaaggguuauucucgcaggcccuaugccaguaaccguggcuuccgcggcacagcgacgcggccguauagguagaaaccauaauaaagaaggagaccaauauauauauaugggacaaccauuaaacaaugaugaagaucacgcccauuggacugaagcaaaaaugcuacuggacaauauaaauacaccagaaggaauaauuccggcgcuuuuugagccugagagagagaaaagcgcagcgguugauggugaguauagguugaggggugaagcuagaaaaacuuuuguagagcuuaugagacggggggaucuaccuguuuggcugucuuauaaaguagcauccgagggauuucaauacagugauaggcgguggugcuuugauggggagaggaauaaccaaguucuagaggaaaauauggauguagaaauauggacaaaagaaggggaaagaaaaaaauugcguccccguugguuggacgcaaggacuuauagugacccgcuugcacuuagagaauuuaaagaauuugccgcggguaggaggucaguaaguggagaucuaauccuagaaaucggaaaacuuccgcaacaucuaacacaaagggcacagaaugcauuagauaaccuugugaugcuucauaauucggaacaggggggaagagcauaucgccaugcaauggaagaacuaccugauacaauagaaacacuuauguuacuugccuugauagcuguauugacggggggaguuacauuauuuuucuuaagcggaaggggacuaggcaaaacuucuauaggucuacuuugcgucauggccucguccguccuauuauggauggccuccguagagccccacuggauagcugccucaauaauauuggaauuuuuccuaaugguacuacuaauuccugaaccagaucggcaaagaacaccacaagacaaccaacuugccuauguaguaaucggacuccucuucaugauccucacaguugcagcgaacgaaaugggacuacuugaaacgaccaaaaaggaucuagguauaggacacgucgcaguggaaaaucaccaccacgcagcaauguuagacguagaccuucauccagcaucagcauggacucucuaugcuguagcuaccacaaucauaacgccaaugaugcggcacacuaucgaaaacacaacagcuaauauuuccuuaacugcaauugcaaaccaagcggccauacuaaugggccuugauaagggauggcccauaaguaaaauggacauuggugugccccucuuggcgcuugguuguuauagucagguaaacccuuuaacgcuaacugccgcuguuuuaauguuaguggcgcauuacgcgauaauuggaccaggauugcaggcaaaggcuaccagggaagcacagaagcguacggcugccggaauuaugaagaauccaacgguagauggaauuguagcaauugacuuggacccuguaguuuaugaugcaaaauucgaaaaacaacuaggucaaauuaugcuauuaauucuaugcacaucacaaauauuacucaugagaacgacaugggccuuaugugaaucaaucacauuagcuacaggaccuuugacaacauuaugggaaggaucgccaggcaaauuuuggaauacaacaauagcuguaucaauggcgaacauauuucguggaucauauuuggcuggggcaggucuagccuuuagccucaugaaaagcuuaggaggaggaaggagaggaaccggagcucaaggagaaacauugggcgaaaaauggaaaagacagcuaaaucagcuaucaaaaucagaauuuaacacuuauaaaaggucgggaauaauggaaguugacagaucagaagcuaaggagggacuaaaacguggcgaaacgacaaaacaugccguuaguagggggaccgcaaaauuacgaugguuuguggagagaaauuuagugaagccugaaggaaaaguaauagauuuaggaugcggucgagggggauggucauauuauugugcaggucugaaaaaagugacagaagugaaaggauauacuaagggaggccccggccaugaagagccgauuccaauggcaacauacggauggaaccuggugaagcuacacucagggaaggacgucuuuuuuauuccucccgaaaaaugugacacucuauuaugcgauauaggugaaaguagccccaacccgacgauugaggaagggcgaacauuaaggguucucaaaaugguugaaccuugguuacgaggaaaccaauucugcaucaaaauucuuaauccauacaugcccagugucguagaagccuuagagcagaugcaaagaaaacauggcgggaugcuuguuagaaacccucuaucgcguaauaguacucaugaaauguauuggguuucuugcggaacagguaacaucguaagcgcgguaaacaugacaucuagaaugcuacuaaaccgauuuacgauggcacaucgaaagccaacguacgaacgagaugucgaucuaggaacuggaacucgacauguggcuguagagcccgaaguggcuaauuuagacauaaucggacagcggauagagaauauuaaacacgaacauaagucgacauggcacuacgacgaagauaacccauacaaaacaugggcuuaccauggcucuuacgaaguuaagccaucagguucagcaucuaguaugguaaauggagucguaaaacugcuaacaaaaccaugggacgugauaccaaugguaacacaaauagcaaugacugauacaacccccuucgggcaacagagaguguucaaagagaaggucgacacgagaacaccgaaagcgaaaagaggaacggcacaaauaauggaagucacagcacgaugguuguggggauucuuaucucgaaacaaaaaaccucgaauaugcacaagggaggaauuuacuaggaaaguucguaguaacgcugcaauaggugcgguauucgucgaugaaaaccaguggaauucugcaaaggaagccguagaagacgaaagauuuugggauuuagugcaccgcgagagggagcuucacaaacaagggaaaugcgcaacuugugucuacaauaugaugggaaaacgugagaagaaacugggagaauuuggcaaagcaaagggcucaagggcaauaugguauauguggcuaggcgcacgcuuccucgaauuugaagcccuaggguuuaugaaugaagaccacugguuuaguagggagaauaguuuaagugguguagaaggagaaggacuacacaaguuaggauauauacuuagggacauaagcaaaauaccaggugggaacauguacgcggacgacacugcaggaugggauacaagaauaaccgaagacgaccuccagaacgaggcaaaaauaaccgacauaauggaaccggaacacgcauuacuagcuaaggcaauuuuuaaacucacauaccaaaauaaaguuguuaggguucaacgaccagcuaaaaauggcacaguaauggacguuauaucucgucgcgaucaaagagggaguggacaaguaggaacauauggacucaacaccuucacgaacauggaagcgcaacuaauucgucaaauggaaagugaggggaucuuuucaccuagugaacucgaaacuccuaaucuugcggagagggcuuuggacuggcuugaaaaauaugguguugaacgucuuaaaagaauggcaauaaguggagaugacuguguuguaaaaccaaucgacgaucgcuuugcaacagccuuaacggcacucaaugauauggggaaaguccgaaaagacaucccgcaaugggaaccaagcaaggguuggaaugauuggcaacaaguaccuuuuuguucgcaccauuuucaucaacucauaaugaaggaugggcgagagaucguuguuccuugcagaaaucaagaugagcuuguaggaagagcccgggugucccaaggagcaggguggucacugcgagaaacugcaugccuaggcaaaucauaugcccagauguggcaauuaauguacuuccaccgucgggaucuaagauuagcggcaaacgcaauaugcucugcaguuccuguagacuggguuccaacaucacgaacuacauggaguauacaugcacaccaccaauggaugaccacagaagauaugcuaucuguauggaacagaguuuggauugaagagaauccuuggauggaagauaaaacacacauuagcagcugggaagauguuccauauuugggaaagagagaggaccaauggugcggaucacucauuggacugacggcaagggcaacgugggcaaccaacauacaaguugccauaaaucagguuagacgucuuauuggaaacgaaaacuauuuagacuacaugacgaguaugaagagauucaagaacgagagugacccagaaggugcauugugguag

SEQ ID NO: 21890 - RNA, 9879 nt, Artificial Sequence
  derived and/or modified CDS sequence (opt6) from DENV-1__EU482708__SS-prME
ucugugacuauguuacuuaugcuaaugcccacugcacucgcauuucacuuaacuacuagaggaggggaaccucauaugauaguuagcaaacaagaacgugguaaauccuuauuauucaaaacaucagcugggguaaauauguguacacuaauugcuauggaccuuggagaacugugcgaagauacaaugacauauaaauguccacgaauaacagaaacagaaccagacgauguagauugcugguguaacgcuacugacacauggguuacauacgggacuuguucacaaacuggcgaacacaggagagacaaaagaaguguagcacuagcuccccauguaggguugggucuggagacaagaaccgaaacauggaugucuucugaaggggcauggaaacaaauucaacguguggaaacuugggcacuucgucauccaggguuuacaguaauagcacucuuccucgcacaugcuauuggaacaagcaucacgcaaaagggcaucauauuuauacuacuuaugcuaguuacuccaucaauggcuaugcgaugugucggcauaggauccagagauuuuguagaaggauugagcggagcaacgugggucgauguaguacuagaacauggaucuugcguaacaacaauggcuaaagacaagccgaccuuagacauugaacuauuaaagacugaaguaacaaacccugcgguauuaagaaagcuguguaucgaagcaaaaaucaguaauacaacaacagacucgcguugccccacucaaggagaggcaacccuugucgaggaacaagacgcuaauuucgugugcagacggacauuuguugacagagggugggguaacggauguggacuuuucggcaaagguuccuuaauuacaugcgcaaaauucaaaugcguaacaaagcuagaaggaaaaauuguucaauaugaaaacuugaaauauucgguuauaguaacagugcacacgggugaucagcaucaaguaggaaacgagaguacggagcaugggacuaccgccaccaucacuccacaagcacccacgacagaaauacaauugacugacuacggcgcgcugacuuuggacuguagcccucguacugguuuagauuuuaaugaaaugguccuccucaccaugaaggaaaaauccugguuaguacacaaacaaugguucuuggaucuaccucuaccauggacuucaggugcaucgacaucacaggagacguggaauagacaagacuuauugguaacuuuuaaaacggcgcacgcuaaaaagcaggaagucguaguacuaggaucacaggagggggcaaugcauaccgcauugacgggagcaacugaaauacaaacuucaggaacuacaacaauauuugcuggucaccuaaaauguagauuaaaaauggauaaguuaacauuaaaagguaugaguuauguuauguguacuggcucauuuaaauuggagaaagaggucgccgaaacacaacacggaacuguucuuguacaaauaaaauacgaagguacagacgcaccauguaagauaccuuuuucaacccaggaugaaaaaggaguuacucaaaacggccgacucauaacugccaacccaauagugacugacaaagagaaaccagucaauaucgaagcugaaccaccuuucggugaaaguuauauaguaauaggcgcuggagaaaaggcuuuaaaauuaucuugguucaagaagggaaguuccauugguaagauguuugaagcaacugcacgaggugcgagaagaauggcaauccuuggagauacugcaugggauuucggaucaaucgguggaguauuuacaagcguaggaaaauuaguccaucaaauauucggaaccgcguauggagugcuuuucuccggagucagcuggacaaugaagauuggaaucgguguauuacuuacauggcuaggacuuaacucacgaucaacaucauuaucaaugacgugcauagcaguuggcuuaguuacuuuguacuuaggcgugaugguacaagcugacaguggaugcgugauaaacuggaaaggcagggaauuaaaauguggaucgggaauauuugugacgaaugaaguucacaccuggaccgaacaguauaaauuucaagcagacucaccgaaacggcuaagugcagcuauaggaaaggcaugggaagaaggaguuugcggaauacgaagcgccacaagauuggaaaacauaauguggaagcaaaucagcaaugaauuaaaucacauacuacucgaaaaugauaugaaauuuacuguagugguuggcgacguugcagguauuuuagcacaaggaaagaaaaugaucagaccgcaacccauggaauacaaauauagcuggaagaguugggguaaagcgaagauaauaggggcugacguacaaaacacaacauuuauaaucgacggacccaauacuccagaauguccagaugaucaacgugcuuggaacauaugggagguugaggauuauggauucggaaucuuuacaaccaacaucugguugaaacuaagagacucuuacacgcagguuugugaccaccgguugaugucagcagcgauaaaagauaguaaggcagugcacgccgauauggguuacuggauagaaucagagaaaaacgaaaccuggaaacuugcacgugcuaguuucaucgaagucaaaacuuguauuuggccgaaaucacauacauugugguccaaugggguuuuggaaagugaaaugauuaucccgaaaauuuacgguggcccuauaagccaacacaauuaccgcccuggauacuuuacacaaacugcuggucccuggcauuugggaaaacuugaauuagauuucgauuuaugugaggguacuacugugguuguugaugaacauuguggaaaucgaggaccuucacuuagaacaacuacaguaacagggaaaaucauccaugaauggugcugcagaucuuguacauuacccccgcugagauucagaggggaggacgguuguugguaugggauggagauaagaccaguuaaagaaaaagaagaaaauuugguuaagagcauggucucagcugguucuggagaaguggauaguuucucgcuugguuuauuauguauuaguauuaugauagaggaaguaaugcguucccguuggucaagaaaaaugcuaaugacggguacccuagcuguauucuuucuacugaucaugggacaacucacauggaaugacuuaauuagacuaugcauaaugguuggcgcuaacgcuuccgauagaaugggcauggguacaaccuacuuagcauuaauggcgacguuuaaaaugcgcccuauguucgcgguaggccucuuauuucgaagacuaacgucacgagaaguccuacugcuuacaauaggacuuucuuuggucgcaucaguagaacucccaaacaguuuagaagaguugggugauggguuagcaauggguauuaugauacucaaacuacugacugacuuucaaagucaucaacugugggcaacacugcuuagucucaccuuuaucaagacuacguucagucuucauuacgcauggaaaacuauggcaaugguacugucuauaguuagcuuauuuccucuuugccuuuccacaacaagucagaaaacuacgugguuaccgguuuugcuaggaucauuagguuguaagccuuuaacaauguucuugauugccgaaaacaagauauggggccgaaggaguuggccuuuaaaugaaggaauuauggcaguuggaauugucucaauuuuacuguccucguuacucaaaaaugauguaccacuugcggggccuuuaauugccgggggaauguuaaucgcauguuacguuauaucagggaguagcgcagacuuaaguuuagaaaaagcugcugaaguauccugggaggaagaagcagagcacucaggagcgucacauaauauacuugucgaaguucaagacgauggaaccaugaaaauuaaggaugaagaacgagaugauacucuuacaauauuacucaaagcuacauuacucgcaguaagugguguuuacccgcucucgauuccagcuacuuuauucguaugguauuucuggcagaaaaagaaacaaagaagugguguguuaugggauacaccaaguccacccgaggucgaacgagccguucuugacgauggaauauauagaauaaugcaacgggggcuuuugggccguagccaagucggaguuggugucuuucaagagaaugucuuccacacgauguggcauguaaccagaggugcugugcuuauguaucaaggaaaaagacuagagcccucuugggcuagugugaagaaagacuugaucagcuacgggggaggcuggagauuacaaggcucuuggaauacaggugaagaagugcaaguaauagcuguggagccgggcaaaaauccuaaaaauguucagaccgccccugguacauucaaaacacccgaaggggagguaggcgccauugccuuggacuucaaaccuggaacaaguggcagcccaauagugaacagagaagggaaaauagucggccuauauggaaaugguguuguaacgacaucagggacauacguaagcgcaaucgcgcaagccaaagcgagucaagaagguccucuaccggaaaucgaggacgaagucuucaggaaacggaaccuuaccauaauggaucugcauccagguagugguaaaacaagaagauaccugccagcaauaguuagggaagccauuaaacgcaaacugcgaacauuaaucuuagcuccuacgcgggugguugcgagugaaauggcagaagcucuuaaggguaugccaauucgauaucaaacgacugcaguuaagucagagcauacaggcaaagaaauaguagaccuuaugugucacgcuacauuuacaaugaggcuuuuaucaccugucagaguaccuaauuauaauaugauaauaauggacgaagcgcauuucacagauccgaguaguauagcagcgcgcggcuacauuaguaccagaguagggaugggcgaagccgccgccauuuuuaugacagccacaccaccgggaagcgucgaggcuuuuccacagucuaacgcgguaauacaagaugaggaaagggacauucccgagcguaguuggaauagcggauaugaauggauaacagauuuucccggcaagacaguaugguuuguucccucgauaaaauccgguaacgacauagcaaauuguuuaagaaagaacggaaaaagagugauucaauugucaagaaaaacauucgauaccgaauaucagaaaacgaaaaacaaugauugggacuacguaguuacgaccgauauaucagagaugggagcuaacuuucgagccgacagaguaauagacccacggagaugcuuaaaacccguuauccuaaaggauggcccggaaagaguaauauuggcagggccaaugccagucacagucgcaucggcggcacaaagacgggguagaauaggaaggaaccacaacaaggaaggggaccaauauauauacaugggccaaccgcuaaacaacgacgaagaucacgcucauuggacugaagcaaaaaugcugcucgauaauauaaacacacccgaaggcauaauaccugcuuuauuugaaccugagcgagaaaagagugcugcaauagauggcgaauauagacuucggggugaagcacgaaaaacauucguugaacuaaugcgaagaggugaccugcccgucuggcuaaguuacaaaguagcaagcgaaggauuucaauacucugacaggaggugguguuucgauggggaaagaaauaaccaggugcuagaggaaaauauggaugucgaaauauggacuaaggaaggugaacggaagaaacuacguccaagguggcucgacgccagaaccuauuccgacccauuggcccuaagagaauuuaaagaauuugccgcaggaaggcguagcguuagcggagauuugauauccgaaauuggaaaacucccccagcaucuaacgcaacgagcucaaaaugcuuuagauaaucuugugauguuacauaacucggaacaagggggccgcgcauaccgacacgcuauggaagaacugccagauacaauagaaaccuuaauguuauuagcacuaauagcuguuuuaaccgguggaguuacgcuauucuuucuaucaggacggggauuggggaaaacaucgauugguuuacuaugcgugauggcaagcucaguucucuuauggauggccucaguugaaccccauuggauagccgccaguauaauauuggaguucuuucuaaugguuuuguuaauuccugaaccggaucgacagagaacaccgcaagauaaccagcuagcuuacguaguuaucgggcucuuauuuaugaucuuaacuguugcagcaaacgaaauggggcuacuugagaccacgaagaaagaccuaggcauagggcauguugcgguagaaaaucaucaucaugcugcaaugcucgauguggacuuacaucccgcauccgcguggacguuauaugcugucgcaacuacaauuauaacuccuaugaugagacauacaauagaaaauacaacugcgaacauuucucucacagcuauagcuaaccaagccgcgauauuaauggggcuagacaaaggauggccaauaucaaaaauggauauagggguaccccuuuuagcuuugggauguuacucacagguaaauccauugacacucacagcugccguacucaugcuaguugcacauuaugcaaucauaggaccggggcuucaggcgaaagcuaccagagaagcgcaaaaacgaacagccgccggcauaaugaagaauccgacaguugaugguauaguggccauagaccuugaccccguaguauacgaugccaaauuugaaaaacaguuaggccaaaucaugcuucucauuuuaugcacgagccaaauccuauugaugagaacuacaugggcucuaugugaaucuaucacucuagccacagggccacugaccacacuaugggagggaaguccaggaaaguuuuggaacacgaccauagcggugucgauggcgaacauauucagaggcagcuauuuagccggugcaggccuagccuucaguuuaaugaaaagccuagguggaggucgacgugggaccggagcacagggcgaaacauuaggcgaaaaauggaaaagacaacuaaaccaauuaucaaaguccgaauuuaacacuuacaagagaucugguauaauggaaguagaucguucagaagcuaaggaaggccugaaacguggagaaacuacaaaacaugcuguaucuagagggacggcuaaacucaggugguucguagaacgcaaccugguaaaaccggaaggcaagguuauugacuugggaugcggaagaggaggguggucuuacuacugcgcaggacugaagaaaguuacagaaguuaaaggcuacacaaaaggagguccuggucacgaggagccuauucccauggcaaccuaugguuggaaccuaguaaaacuacacucugguaaagauguuuucuuuauaccuccagaaaaaugugacacccuucuaugcgacauuggagaaaguucaccaaacccaacuauagaagaaggccgaacauuaagagucuuaaaaaugguugagccauggcuaagggggaaucaauuuugcauuaaaauauugaaucccuauaugcccucuguuguugagacauuagaacaaaugcaaaggaaacauggaggaaugcucguaaggaacccucuaaguagaaauucuacacacgaaauguauuggguuaguuguggaacaggaaauauagucucagccgugaacaugacaaguaggaugcuucucaauagauucacaauggcgcauaggaagccaacuuaugaacgugacguggauuugggugcaggcacgagacauguggcgguugaacccgaaguugcuaacuuagauauaaucggacaacgcaucgagaacaucaagcaugagcacaaaucaaccuggcauuacgaugaagauaacccuuauaaaacaugggcauaucaugguuccuacgaagugaaacccagcggcucugcgagcagcaugguaaacggaguaguuaaguuacuaaccaagccuugggauguuaucccuaugguuacucaaauagcgaugacugauacaacacccuuuggacaacaaagaguuuuuaaggaaaagguggauacaagaacaccaaaagcaaagagagguacagcacaaauuauggagguaacagcaaaaugguuauggggauuuuugagcagaaauaagaaaccaagaauauguacaagagaagaauuuacgagaaagguacggucgaacgcagcgauaggggcaguauucguugaugaaaaucaauggaacucugccaaagaagcagucgaggaugaaagauuuugggaucuagugcaucgcgagcgagaauuacacaaacagggaaagugugcaacuugcgucuauaauaugauggggaaacgugagaagaaauuaggcgaauuuggcaaagcuaagggaaguagagcaauuugguauauguggcuaggugcaagauuuuuggaauuugaagcauuaggauucaugaacgaagaucacugguuuagucgcgaaaauucccugucuggugucgaaggugaagggcuucacaaguuaggauauauacuuagggacauuucuaaaauaccgggcggaaacauguaugcagaugauacugcaggaugggacaccagaauuaccgaagacgaucuacaaaaugaagcacgcauuacagacauuauggaacccgaacaugcccuucuagcuaggagcauuuucaagcuaacguaucaaaacaaaguuguucgaguccaacggccugcaaagaauggaacaguaauggaugugauaagcagaagagaucaaagaggaucaggacaaguagggacauacggucuaaauacuuuuaccaauauggaagcacaacuaauaagacaaauggaaucugaaggcauuuuuagcccgucugaauuagagaccccaaauuuagccgagcguguacuagauuggcuugaaaaauacggagucgaaagauugaaaaggauggcuauuagcggagaugacugugugguaaagccaauagaugauagguuugcuacugccuuaacugcauuaaaugacauggguaaaguucguaaggauauuccucaaugggaaccauccaaagguuggaaugacuggcagcaaguuccauuuuguagucaccacuuccaccaauuaauaaugaaggauggucgggaaauuguaguuccuuguagaaaucaagaugaauuagucgggagagcgcgaguuucccaaggcgcuggauggagccuaagagagacagcuugucuaggcaaaucuuacgcacaaauguggcaacuaauguauuuccauaggagggaucuucgauuggccgcuaaugcgauuuguucagcugugccuguggauuggauaccgaccagcagaacuacauggucgauccaugcccaccaccaguggaugacgacugaagacauguuaagcguauggaauagaguauggauagaagaaaacccauggauggaggauaaaacacacaucaguucguggggagauguaccauacuuaggcaaacgugaggaucaauggugugguucacuuaucggacuaacagccagagcaaccugggcaacaaauauacagguagcuauaaaccaggugcguagacugauagggaacgaaaauuacuuagacuauaugacauccaugaaacguuuuaaaaaugaaucagacccagagggagcgcucugguag

SEQ ID NO: 21891 - RNA, 9879 nt, Artificial Sequence
  derived and/or modified CDS sequence (opt6) from DENV-1__EU482709__SS-prME
ucaguaacaauguuguugauguugguaccaacagcauuagcauuccacuuaacaacccgcgguggagaaccgcauaugauuguaagcaaacaagagaggggaaaaucuuuacuuuucaaaacuucggcuggagucaauauguguacacucauagcuauggaccuaggcgaguuaugugaagauacaaugacguauaaauguccccguauaacugaaacagaaccagacgauguagauuguugguguaacgccacugacacauggguuacuuauggcacuuguagccaaacuggugaacaucgucgugauaaaagaucaguagcuuuagcaccacacgugggauugggcuuagaaacacgcacggaaacuuggaugaguagugaaggagcauggaaacaaauccagcggguagaaacuugggcguuaaggcauccaggcuucacaguaauugcucuauuuuuggcacaugcaauaggaaccucaauuacucagaaaggaauuauauuuauauuguugaugcuaguaaccccaaguauggccaugagauguguaggaauuggaagucgagauuuuguagaaggucuuagcggagcaacauggguggaugugguucucgaacaugggucauguguaacaacgauggcuaaggauaaaccaacuuuggacauugaauugcuaaagacagaaguaaccaauccggcaguucuaaggaaauuaugcauagaagcgaaaaucuccaauacaaccacggacaguaggugucccacacaaggugaggcaaccuuaguagaagaacaagaugcaaauuuuguuugccguaggacuuuuguagaccgaggcuggggaaauggcugcgggcuauuuggcaaggguagccugauaacgugcgcuaaauuuaagugcguaaccaaacuugaagggaaaauuguucaauaugaaaauuuaaaauauaguguuauuguaacuguucauacaggggaucaacaccaaguaggcaaugaauccacugagcacggcacaaccgcgacuaucacaccacaggcgccaacuaccgagauacaacuaacagacuauggcgcacuuacgcuagauuguagcccaagaacaggucuggauuuuaacgaaauggugcuucuaaccaugaaagagaaaagcugguugguacauaaacaaugguuucuugaucuaccacucccuuggacgucgggagcuucgaccagucaagagacuuggaauagacaagaccuucuuguaacauuuaaaaccgcacacgcgaaaaaacaagagguggucguauuagggucccaagaaggagcaaugcacacagcauuaacaggggcuaccgagauacaaacaaguggaacgacaacgauauucgcuggucauuuaaaaugcagacugaagauggauaaacuaacacucaaagggaugucauacguuauguguacaggcucauuuaaacuagaaaaagaagucgcugagacccaacaugguacaguccuugugcagaucaaguacgagggcacagaugcaccuugcaaaauuccguucuccacucaagacgaaaaagguguaacucagaaugguagacuuaucacugccaacccaauaguuacugacaaagaaaaaccaguaaacauugaagcggaaccuccauucggagaguccuauaucguuauaggugcgggggaaaaagcauuaaagcuuucgugguuuaagaagggaucgagcauaggaaaaauguucgaagcaacagcuagaggagcuaggcgaauggcaauuuugggggacacugcaugggauuucgguagcauaggaggaguauucaccucgguaggaaaacuaguucaucaaauauuuggaacagcuuauggagugcucuuuagcgguguaucuuggaccaugaaaauugguauuggagugcugcuaacauggcuagguuuaaacucaagaagcacuagccugucgaugacuuguauugcaguaggccuggucacauuauaccuugguguaaugguccaagccgacagugguugcgucauuaauuggaagggacgagaacuaaaaugcggcucgggaaucuucguuaccaaugaaguccacaccuggaccgagcaauauaaauuccaggcggauuccccuaaacgacuaucggcggcuauaggaaaagcuugggaggagggaguuuguggaauucggucugcaacaagauuggaaaauauuauguggaaacagaucagcaacgaauuaaaccacauacucuuagaaaacgauaugaaauuuacagucguggucggagacguugcagguauucucgcgcaggguaagaaaaugauaaggccacagccaauggaguacaaguacucauggaaaucaugggggaaagccaaaauuauuggcgccgaugugcaaaauacgacguucauuauugauggacccaauacuccugaguguccugacgaucaacgugccuggaacauuugggaaguagaggacuacggcuuuggaauuuucacuacgaauaucuggcuaaaacucagagauucuuauacucaaguuugugaccacagacucaugagcgcugcaauuaaagacagcaaagccguucaugccgacaugggauacuggauagagucggagaaaaaugaaaccuggaaacuagcaagagcaucauuuauugagguaaagacaugcauauggccuaaaucgcacacacucuggagcaauggaguccuagagucagagaugauaaucccaaaaaucuacggggguccuaucagucaacacaacuaucgacccggguauuucacgcaaacagcuggaccauggcaucuggguaaauuagaacuagacuucgauuuaugugaaggcaccacaguaguuguagaugagcauugcggcaacagaggaccaagcuuacguacaaccacaguuacugguaaaauaauccaugaaugguguuguagaucauguacauuaccaccacugagauuccgaggggaagacggaugcugguauggaauggagauacggccaguuaaggaaaaagaggaaaaccuagugaaaucaaugguuuccgcuggaucaggugaaguagauucuuuuagucuggguuuguugugcauaucaaucaugauugaagaaguaaugaggucuagauggucucggaagaugcucaugacugggacuuuagcaguauuuuuccuacucaucaugggacagcugacauggaaugaucucauacgacuauguaucauggugggcgcaaaugcuucugacagaauggggaugggcacaacauacuuggccuugauggcuacauuuaaaaugcgaccgauguuugccgucgguuuacucuuucguagacuuacgucuagggaaguauugcuacuaacuauagguuugagcuuagucgccuccguugaacuuccaaacucacuagaagaacuuggggauggcuuagcuaugggaauaaugauucuaaaacuauuaacagacuuucaaucccaucaacucugggccacacuacuaucccuaacauucauuaaaaccacauuuaguuuacacuaugcauggaaaacaauggcuaugguacuauccauaguuaguuuauuuccccugugcuuaaguaccacaucacaaaagacaacaugguuaccaguauuacuuggaucacuaggguguaaaccacuaacaauguuuuuaauugcggaaaacaaaaucuggggaagacguaguuggccgcucaaugaagggauuauggcuguuggcauaguuaguauacuuuuaaguaguuuguugaaaaacgauguaccauuagcuggaccauuaauagcugggggcaugcuaauagccuguuauguaauuuccgguagcucagcagauuuauccuuggagaaagcagcagaaguuucgugggaagaagaagcagagcauaguggggcaucacauaacaucuuagucgaagugcaagaugaugguacaaugaaaauaaaagaugaagaacgugaugauacccuaacgauuuuguuaaaggcaacauugcuggcaguaucaggaguauacccccuuucaauacccgcgacgcucuuuguuugguauuucuggcaaaagaaaaaacaaagaucuggcgucuuaugggacacaccaucuccaccugaaguugaaagggcgguucuagaugaugggaucuaucgaauuaugcagcgaggucucuuaggacguucgcaagugggaguagguguauuccaagagaauguauuucauacaauguggcauguaacacguggagcuguguuaauguaucaagguaagcgauuggaaccaagcugggcuagcguuaaaaaggaccuaauuagcuauggcggcggauggagacugcagggaucauggaauacaggugaagaaguccaagugauugcaguugagccagguaaaaaucccaagaacguacaaacugcuccggguaccuucaagacaccugaaggcgaaguaggggcuaucgcauuagacuuuaagccugggacgucagguuccccgauaguaaaucgugaaggcaaaauagucggacuuuauggaaaugguguagugacgacuucuggaacguacguaucagcaauugcucaagcuaaagccucucaagaagguccacuacccgaaauugaagacgaaguguuucggaaaagaaaccuaacuauaauggacuuacaucccggaucagguaaaacaagaagauacuuaccagcuauaguuagagaagcuaucaaaaggaaauuacgcacacucauccuggcaccgacaagaguaguagcauccgagauggcggaagcacucaaggggaugccuauaagauaccaaacgacagcugucaaaucugagcauaccggaaaggaaaucgucgaccuuaugugccacgcgaccuuuacgaugcgacuucuaucuccuguuagaguacccaacuacaacaugaucauaauggacgaagcgcacuuuacugauccgucuucaauagcugcaagaggauauauaucuaccagggucggcaugggcgaagcagcagcaauauuuaugacagcuacgccaccugguucggucgaggcauuuccacaaucuaacgcaguuauacaagaugaggagagagauauuccagaaaggucauggaacucaggauacgaauggaucaccgauuuuccagggaagacaguuugguuuguuccaaguauaaagaguggaaaugacauagcuaacugcuugcggaaaaauggcaagagagugauucaacuuagucgaaaaacauuugauacagaguaucaaaaaacgaaaaacaacgacugggacuauguaguaacuacggauauuagugaaaugggagcgaauuuuagagcagaucgaguaaucgauccuagaagaugucucaagccaguaauuuuaaaagacggaccugagcggguaauucuagcgggcccaaugccaguaaccguugcuagugcugcccaaagacggggucgaauugguagaaaucauaacaaagaaggagaucaauauauauauaugggacagcccuuaaacaacgacgaagaccaugcacacuggaccgaggccaaaaugcugcuagauaauauuaauacaccugagggcauaauaccggcucuuuucgaaccugaaagagagaaaucagcugcgauagacggagaauauagauuaagaggagaagcccgaaagacuuuugucgaacuuaugcgacgaggagauuuaccaguauggcuuucuuauaaaguugcauccgaagguuuucaguauagugauagacguuggugcuuugacggugagaggaauaaucaaguacuagaagaaaauauggauguggaaaucuggacaaaagaaggggaacgaaagaaacugagaccaagaugguuagaugcccgaacuuauucagauccacuagcgcuucgugaauuuaaagaauucgcggccgguagacguagugugaguggagaucuaauauuggagauagguaagcuaccccagcacuuaacccaaagggcacagaacgcucuagacaaccuuguuaugcuacauaacucagaacagggaggaagagcauauaggcaugcuauggaagaacuucccgauacuauagagacauuaaugcuauuagcacuuauagccguccucacuggagguguuacucucuuuuuccugagcggacgaggccucgguaagacaucuauaggccuacuauguguaauggcaagcagcguacugcuauggauggcgucgguagaaccccauuggaucgcugcaaguauaauacuggaauuuuuccugaugguuuuacuuauacccgaaccugacagacagcguacuccgcaagacaaccaacuagcuuacguggucauaggacuacuauuuaugauauuaacgguggcagcaaacgaaaugggacuacuugaaacaacuaaaaaagacuuagguauuggacauguagccguagaaaaccaccaucaugcagccaugcuagauguggacuuacacccagccucagcguggacucuauaugcaguggcaacaacaauaaucacgccaaugaugagacauaccauugaaaacacaacagcuaauauuucuuuaaccgcgauugccaaccaagcggcaauacucauggguuuagacaaaggauggccaauuaguaaaauggacauaggcgugccacuacuagcacuuggcuguuauucacagguaaacccacugacauuaaccgcggcuguguugauguuaguagcacacuacgcuauuauaggcccuggccuucaagcaaaagcaacgagagaggcacaaaaaaggacugccgcaggcaucaugaaaaauccgacaguggauggaauuguugcaauagacuuagacccagucguuuacgacgcaaaauuugaaaaacaguugggacaaauuaugcuccuaaucuuauguaccagccaaaucuuacuuaugaggacaacaugggcccuaugugaaucgauaacauuggcaacagguccgcuuaccacauuaugggaaggaaguccaggaaaguuuuggaauacaaccaucgcagugucaauggcaaacaucuuucgcgguucauauuuagcaggugcuggacucgcauuuagccuaaugaagucauuaggagguggcagacgugguacaggcgcacaaggagaaacgcucggagagaaauggaagcgacaauugaaccagcuuucaaaaagcgaauuuaacacuuauaaacgguccgguauuauggagguugaccgaagugaggccaaggaaggccuaaagagaggugagacaacgaagcacgcgguaaguagaggcaccgccaaguuaaggugguuuguagaacgcaaucuuguaaaaccugaaggaaaaguaaucgaccuaggauguggacgaggcggauggagcuauuacugugcuggauugaagaaaguuacugaagucaagggcuauacaaagggcggaccaggccacgaagaaccuauaccuauggcaacauacggguggaauuuagucaaauuacacucaggaaaagauguauuuuucauaccuccugaaaaaugcgacacauugcucugcgauauaggagagucuuccccuaacccaacuauugaagaaggaagaacacucaggguccuaaaaaugguagaaccauggcuacgagguaaucaauucuguauuaaaauccuuaauccguacaugccaucuguaguagaaacguuagaacaaaugcagagaaaacauggcgggaugcuuguaagaaauccccugucgagaaauucaacacacgagauguacuggguaaguugcggaacaggaaauauagugucggccguaaacaugacgagcaggauguuacucaaucgauucaccauggcgcacaggaaaccuacguaugagagggauguagaucuaggcgcaggaacuagacauguagccguagaaccagaaguugcgaacuuggacauaauaggacagagaauagaaaacauaaaacaugaacauaaaucuacuuggcacuaugaugaagauaauccuuacaaaacaugggcauaccacggaagcuaugaaguaaaaccaucaggcagugccuccagcauggugaauggaguaguuaaauuauuaaccaaaccuugggaugucauuccaaugguaacucagauagcaaugacugauaccacacccuucggccaacaacgaguuuuuaaagagaaagucgacacucggaccccaaaagccaagagggguacagcucaaauuauggaaguaacagcaaaaugguuguggggguuuuugucgcgcaacaagaagccgaggauuugcacacgcgaagaguuuacuagaaagguaagaucaaaugccgcuauaggcgcuguauuuguagaugaaaaccaauggaauagcgcuaaggaagcaguggaagaugagagguuuugggaucuuguccacagagaaagggaauuacacaagcaagguaagugcgcgacaugcguauauaacaugaugggaaagagggaaaaaaaauuaggugaauuuggaaaagcuaaagguagucgugcaauaugguauaugugguugggagcccgcuuuuuagaguuugaagcacuaggauuuaugaacgaagaucauugguucagucgagagaauagcuuaucuggaguagaaggagaaggacuacacaaauuagguuacauuuuaagagacauuaguaaaaucccaggcggaaauauguacgcagaugauacugcagggugggauacucgaauaacagaggacgacuuacagaaugaagcacggauaacagauaucauggaacccgaacaugcgcuguuagcaaaaucuaucuuuaagcuuaccuaccaaaacaaggucgugcgaguacaaagaccugcaaaaaaugguacaguuauggaugugauaagccggagggaccaacgagguucaggccagguugguacuuauggucugaauaccuuuacuaauauggaagcucaacuaaucaggcaaauggaaagugaaggcaucuuuucgccaucugaguuagagacaccuaacuuggcagaaagaguacuugauugguuggaaaaauacggcguugaacgucuuaaaagaauggcuauuagcggugacgauugcgucguaaagccuauugacgaccgguuugcaacagcacuuaccgcuuugaacgacaugggcaagguacgaaaagauauaccacaaugggaaccuucuaaagguuggaaugauuggcaacaagugccuuucugcucgcaccauuuccaccaacuaauaaugaaggaugguagagaaauuguaguaccaugucguaaucaagacgaauuaguagggagggcacgagugucgcagggagcuggauggucguuacgagaaacugcgugucuugggaaaagcuaugcccaaauguggcaauuaauguacuuucaucggcgugacuugcguuuagccgcgaacgcaauauguucagcuguacccguggauuggauuccaacaucuaggacaaccugguccauacaugcccaccaucaauggaugaccacugaagauaugcuaucgguuuggaauagaguauggaucgaggaaaauccauggauggaagauaaaacucacauuucaagcuggggugauguuccuuacuugggaaaaagggaagaccaauggugugguaguuuaauagggcuaaccgcucgcgcaacaugggcaaccaauauacaaguugcgauaaaccagguacggagauuaaucgguaacgaaaacuaucuagacuauaugacuaguaugaaaagauuuaaaaacgagagugauccagagggggcucuaugguga

SEQ ID NO: 21892 - RNA, 9879 nt, Artificial Sequence
  derived and/or modified CDS sequence (opt6) from DENV-1__EU482710__SS-prME
ucaguaacaaugcucuuaauguuaaugccaacagcauuagcguuccacuugaccacaagagggggagaaccgcacaugauugucacgaaacaagaacgcgggaaaucacuacuauuuaaaacaagcgccgguguaaauaugugcacauuaauugcaauggaucucggagaacucugugaagacacuaugacuuacaaauguccucguauaacagaggcugaaccggaugauguagacuguugguguaacgcaacagauaccuggguaacuuauggaacaugcucacaaacgggugagcauagacgcgacaaacguagcguagcuuuggcuccgcauguuggacuaggauuggaaacucgaacugagacuuggaugucgucugaaggcgcauggaaacaaauucaaagaguugagacgugggcauugaggcauccuggauuuacgguuauugccuuauuuuuagcacaugcuauagggacaaguauuacacaaaaagggauuaucuuuauacuauuaaugcuugugacgccaaguauggccaugagaugcguugguauaggcaguagagacuucguggagggacuaaguggugcgacauggguagauguaguacuagaacaugguaguugugugaccacuauggcgaaagacaaaccaacacucgauauagaacucuuaaaaaccgaagugacuaaccccgccguacuaagaaaauuaugcauugaggccaaaauuaguaauacaacaacugauucgcguugcccuacccaaggagaggccacgcugauggaggaacaagacgcgaauuuuguuugcaggcgcacuuuuguugaucgaggauggggaaacggauguggauuauuugggaaagguucacuaauaacaugcgcuaaauuuaaaugugugacaaaauuagaagggaaaauaguacaauacgaaaaucuaaaauauagugugauaguaaccgugcauacuggggaucaacaccaaguggguaaugaaaguacugaacauggcacuaccgcaacaauuacuccgcaggcaccuacuagcgaaauccaacugacugauuauggugcauugacucuagauugcuccccucgaacgggauuagacuucaaugaaauggucuuauuaaccaugaaagagaaaucauggcucgugcacaaacaaugguuucuugaucucccgcuuccauggacuuccggagcaucaacuucccaggaaacuuggaauagacaagacuuauuaguaacauuuaagacugcacacgcuaaaaagcaagaaguaguaguguuaggcucucaggaaggagccaugcauacagcuuuaaccggugcuacagagauucaaacgagugguaccaccaccauauuugcuggacaucuuaagugccgucugaaaauggauaaauuaaccuugaaaggaaugucguacguaaugugcacaggcagcuuuaaacuggaaaaggaaguugccgaaacgcaacauggcacggucuuaguacaaauuaaauacgagggaaccgacgcaccguguaagauuccauuuaguacacaggaugagaagggcguuacacaaaauggaagguugauaacagcaaauccaauaguaacugauaaagagaagccaguaaauauagaggcagaaccacccuuuggagaauccuauauaguaauaggagcuggugagaaagcacuaaaacuuucgugguucaagaaagggucuaguauuggaaaaauguuugaggcgacagcuaggggugcucggcgaauggcuauauuaggggauacagcaugggauuuuggaagugucggagggguauuuacgaguguuggcaaacuuguacaucaaaucuuuggaacugccuaugggguuuuauuuuccggggucucauggaccaugaaaaucgguauugguguacuuuuaacaugguugggacuaaauaguagaucaaccucuuugucaaugacauguauagcuguagggcuaguuacuuuguauuugggggugaugguacaggcugauucaggcuguguuauaaauuggaagggaagggaauuaaaaugugggucuggaauuuuuguuacaaaugaaguacauacuuggacggaacaauauaaauuccaagcagauuccccaaagcgccuauccgcggcuauagguaaagcaugggaggaggggguauguggaauaagaucugccacucgucuggaaaacauuauguggaagcagaucucuaacgaacuaaaccauauuuuauuggaaaaugacaugaaauuuacgguaguaguaggugauguaguaggcaucuuagcacaaggcaagaaaaugauucgaccucagcccauggagcauaaacacuccuggaaaucuugggguaaagcaaagauuauuggagcugaugugcaaaauacuaccuuuauaauugacggcccuaauacacccgaauguccagacgaucaacgugcuuggaacauaugggagguugaagauuauggguuuggcauauucacaacaaacauauggcuaaaauuaagagacagcuauacucaaguaugugaucaccgccuaaugagugcggcgauuaaggacuccaaagcaguccacgcagacauggguuauuggauagaaucugagaaaaaugaaacauggaaauuagccagggcaucauucaucgaaguaaaaacuugcauauggccgaagucgcauacauugugguccaaugggguguuagaauccgaaaugaucauuccuaaaauauauggagguccaauuucacagcacaaccacaggccuggauacuuuacccaaacagcagguccguggcauuugggcaaacuugaguuagauuuugacuuaugugaaggaacuacaguugugguagacgaacauuguggaaauaggggaccaucacugagaacaacuaccgugacaggaaagaucauucaugaaugguguugcagaagcuguacucuaccaccauuacgauuuaaaggagaagacggcugcugguauggcauggaaauaaggccgguuaaggagaaggaggaaaauuuaguaaaaucuaugguaagcgcaggcucuggggaaguagauagcuucagccuaggauuacuauguauaucuaucaugauugaggaagugaugcgaucucgcuggagcagaaaaaugcuuaugacagggacauuggccguauuucuauuacuaauaaugggccaauugaccuggaaugaccuuaucagauuguguauaaugguaggugcuaacgcuucagaccguauggguaugggaacaaccuauuuagcucuaauggcgaccuuuaagaugagacccauguuugccguaggauuacuauuucgcagacucacgucgcgugaaguucuacucuuaacuauagggcuaagccucguagcaucuguggaacuaccaaacucccuggaagaacuaggagauggauuggccaugggaaucaugauauugaaacuacuaaccgauuuucagucccaucaguugugggcaacccuguugucacuaacauucauaaaaacgacacuaagucugcauuaugcguggaagaccauggcaaugguucuaucaauagucucacuauucccuuuauguuugucgaccacgucacagaaaacuacaugguuacccguucucuugggaagucuaggauguaaaccauuaacaauguuuuuaauuacugaaaacaaaauaugggggaggaaaagcuggccucuuaacgagggcauuauggcgguaggaguagucucaauccuacuuucaucuuugcuuaaaaacgacguuccccuagcaggcccuuuaauugcagggggaaugcuaaucgcauguuauguuauaagcggaaguucugcugacuuauccuuagagaaagcagccgaaguaagcugggaagaggaagcggaacauucuggugcaucucacaacauucucguagagguccaagaugauggaaccaugaaaauuaaggacgaggaaagagaugacacauugacaauuuuacugaaagcaacgcuauuagcuguaagugggguuuauccauuaucaaucccagcuacacuguucguaugguauuuuuggcagaagaagaaacaaagaucuggaguccuaugggacacuccgaguccaccagaaguagaaagggcgguauuggacgaugguaucuacagaauaaugcagagggguuuacuugggcgcagucaagucgggguugguguguuccaagagaacguuuuucacaccauguggcauguaacaagaggagcaguacucauguaucaaggaaaacgauuagaaccuucaugggcaagcguaaagaaagaccuuauuaguuaugguggcggauggagauuacaaggaucauggaacacaggcgaagaaguacaaguaaucgccguugaaccaggcaaaaaccccaaaaacguucaaacagcaccaggaacauucaaaacgccagagggcgagguaggagcaauagccuuagacuuuaaaccagguacgucaggaucaccgauaguaaaucgugaaggaaaaauaguaggucuauauggaaauggaguugugacgacuucaggcaccuacguuagugccauugcacaagcaaaggcaucacaagagggaccucucccagagauugaagacgaaguauucaggaaaagaaacuuaaccauaauggauuuacaucccgguagcggcaaaacuagacgguaccuuccagccauuguucgugaagcuauaaaaagaaaguuacgaacauuaauucucgcuccgaccagaguugucgcgucugaaauggcagaggcucuaaaaggaaugccuauccgguaccaaacuacagcugucaaaagugaacacacugguaaagaaauuguagauuuaaugugucaugcaacauucacaaugagauuguuaaguccaguucgaguaccaaauuauaacaugauuauuauggaugaagcccauuuuacugaccccuccagcauugcugcccgaggauacauuaguacacgaguugguaugggagaggccgcugcaauuuucaugacagcuacgccgccaggcagugucgaagcauuuccucaaagcaacgccgucauucaggaugaagaacgggauauaccagagagaaguuggaacuccggauacgaauggauaacugacuucccaggcaaaaccgugugguuuguacccagcaucaaaucugggaaugauauugcuaauugccuaaggaaaaacggaaagaggguaauucaacuuagucgcaaaacuuucgauaccgaguaucagaaaacgaaaaauaaugauugggauuacgucgucacuaccgauaucuccgaaaugggcgcuaauuuucgugcugacagaguuauagauccccgaagguguuugaaaccaguuaucuuaaaagacgguccggaacgcguaaucuuagcaggaccuaugccuguaacaguugcgucagcagcccaaaggaggggaagaauaggcagaaaucauaauaaagagggagaucaauauauauauaugggccaaccauuaaacaaugaugaagaucaugcgcacuggacugaggcgaaaauguuacuugacaauauuaauacuccagaaggaauuauacccgcucuguucgaaccagaaagagaaaaauccgccgcaaucgauggugaauauaggcugcgaggagaggcacgcaaaacauucgucgaacuuaugcgaagaggggauuuacccgucuggcuaaguuacaaaguugcaagugagggcuuccaauauagugacagacgaugguguuuugauggagagagaaacaaccagguauuagaagaaaauauggacguugagauauggacaaaagaaggagaaaggaagaaguugagaccacgaugguuagaugccagaacuuacucugacccacuugcuuuaagagaauuuaaagaguuugcagcaggucgaaggagcgugagcggugaccucauuucagaaauuggaaagcugccucagcauuugacacagcgcgcucagaaugcccuagauaaccuaguuauguuacacaacucagaacaagguggaagggcuuauaggcacgcuauggaagaauuaccggauacaaucgaaacacuaauguuacucgcuuuaaucgcaguacuaacuggugguguuacuuuguuuuuccuuucgggaagaggccuuggcaaaacuagcauuggauuauuguguguaauggcuaguaguguuuugcuguggauggcaagugucgaaccacauuggauagccgcuucaaucauucuugaauuuuuccuaauggucuuauuaauaccagaacccgauaggcagaggacuccacaggacaaucagcuugcauacgucgugauaggccuacucuucaugauauuaacaguugcugcuaacgagaugggucuucuagagacaacuaagaaagaccuagguauaggccacgucgcuguagaaaaucaccaucaugccacaaugcuugauguagauuuacacccggcaucagcauggaccuuguaugcaguagcuaccacaauaauaacuccgaugaugcgacauacuauugaaaauacaacugcuaauauuucgcuaacugcuauugccaaucaagccgcgauacuaaugggacuugauaagggauggccaauuagcaaaauggacaucgguguaccucugcuugcuuuaggcugcuauucacaaguuaauccuuuaacccuuacagcugcaguguugauguuggucgcccauuaugcgauaaucggccccggacuccaagcaaaagcuacaagagaggcgcaaaaacgaacagcggcagguauaaugaagaauccaacuguggacggcauaauugcgauagacuuggauccaguuguauacgacgcaaaguuugaaaaacaguuagggcaaauaauguugcuuauucuauguacuucucaaauauuguuaaugagaacaacuugggcccuaugugaaaguauuacgcuagcuacuggaccuuuaacgacacuaugggaaggauccccaggaaaguucuggaauacgaccauagcaguuucaauggcgaacaucuuccgaggguccuaccuugcuggcgcgggccuagcauuuucauuaaugaaaucucuaggagggggaagaagaggcacgggagcacagggcgaaacucuaggagaaaaauggaaaagacaauuaaaucaauuaucaaaaucagaauuuaacauuuauaaaagaaguggaaucauggaaguggaucgaagcgaagcaaaagaaggcuuaaaaagaggggagacaacucgucacgcggucucaagaggaacugccaaauuacgcugguuuguagagcgaaauuugguuaagccugaggguaaaguuauagauuuaggcugugggcgugguggcuggaguuauuacugugccggacuaaagaaaguaacggaaguuaagggcuauacaaaagguggacccggucacgaagaaccuauaccgauggcaacguauggcuggaaucugguaaaauuacacaguggaaaagauguauucuuuaccccuccggaaaagugcgauaccuugcugugugacauaggugagaguagccccaauccuacgauagaagaagggcgaacuuuaagaguauuaaaaaugguggagcccuggcuccggggcaaccaguuuuguauaaaaauuuugaauccuuacaugccuaguguuguagaaacacuggaacagaugcaaagaaaacauggcggcauguuaguacggaauccucuuagucgcaauucaacgcaugaaauguacuggguuucuugcggcacagguaauaucgucucugcgguuaauaugacaagccgaaugcuacuuaauagauuuacuauggcucaucguaaaccuaccuaugagagagacguugaucuuggagccggaacacgccauguggcaguagagccugagguagcgaaucuugauauuauaggccaaagaauagaaaacauuaaacacgaacauaaaaguacauggcacuaugaugaagacaauccauauaaaacuugggcauaucacgggucauaugaaguaaaaccuucuggaucugcuaguagcauggucaaugguguagucaaauuauuaacaaaaccuugggacguuauaccgauggucacucaaauagcgaugaccgauacuacacccuucggucaacagagaguauucaaagaaaagguggauacccgaacucccaaagccaaacgaggcaccgcacaaauaauggaaguuaccgcacgauggcuuuggggcuuucuauccagaaauaagaaaccaaggauauguacuagagaggaauuuacucguaagguacguuccaaugccgccauaggagcuguauuuguagaugagaaucaguggaacagcgcuaaagaagcaguugaagacgaaagauuuugggauuuaguacaaaaggaacgagaauuacauaaacaaggaaagugugcuacaugcguuuauaauaugauggguaaaagggagaagaaauugggugaauuuggaaaagcgaagggaucuagagcaaucugguauauguggcuaggagccagauuuuuagaguucgaagcacuagguuucaugaaugaggaccauugguuuucaagagaaaacaguuuaagcggaguggaaggggaaggauuacauaaacuugguuacauucugagggauaucucaaagauuccgggcggaaauauguaugcggaugauacugcagggugggauacacguauaacugaagacgauuuacagaacgaggccaaaauaacggauauuauggaaccugaacacgcauuauuggcuacaucgauuuuuaaauuaaccuaucaaaauaaagucguaagaguucaacgcccagcuaaaaauggaacuguuauggauguuauuagcagacgggaccaacgcggaagcggacaggugggaaccuauggacuaaauacauuuacgaacauggaagcccagcucauaaggcaaauggagucagaaggaauauuuuugccgagugaguuagaaacaccuaacuuggcagaacgagucuuagauugguuggaaaaguauggcguagaacgacugaaaagaauggcuaucucaggugaugauugcguaguaaaaccuaucgaugacagauucgcaacagcccugacugcacuaaacgacaugggcaaggucagaaaagacauaccacaaugggaaccaucuaagggauggaaugauuggcaacaaguuccauuuuguucucaucacuuucaucagcuaauaaugaaagacggucgagaaauugucguuccgugcagaaaccaggacgagcuagucggaagggcccggguaucgcagggugccgguuggucgcucagagaaaccgcgugcuuaggaaaaucauaugcucaaauguggcaacuuauguacuuucaucgaagggaucuccgcuuggcugcaaaugcaauuuguucagcgguuccaguagacuggguaccaacaucgcgcacaacuuggaguauccaugcacaccaucaauggaugacgacagaagacaugcuuuccguguggaauagaguuuggauugaagaaaauccauggauggaggacaaaacacacguguccucuuggggcgauguuccauauuuaggaaaacgugaagaucaauggugcggaaguuuaauaggucuuacagcacgggcaacaugggccagcaauauucaaguagcaaucaaccaaguacgaagauuaauuggaaaugaaaauuaucuagauuauaugacgucgaugaaacgguuuaaaaacgagggggacccggaaggcgcauuaugguaa

SEQ ID NO: 21893 - RNA, 9879 nt, Artificial Sequence
  derived and/or modified CDS sequence (opt6) from DENV-1__EU482712__SS-prME
aguguuacuaugcuucuaauguugaugccgacggcuuuggcuuuccaucuaacgacaagaggaggggaaccccauaugauagucucaaaacaagaaagagguaaaucucuuuuauucaaaacaucagcuggcguuaauauguguacauuaauagcuauggaucugggugaguuuugugaagacacuaugacauauaaaugcccccgaauaacagaagcggaaccugacgauguugauuguuggugcaaugcaaccgauacuugggucacuuauggaacaugcagccaaacaggggaacaucgucgggacaaacggucuguugcuuuggcuccacaugucgggcuugggcuggaaacaagaacugaaacguggaugucaagugaaggggcguggaaacagauucagagaguugaaacaugggcauuaagacaucccggguuuacugucauugcucuguucuuggcacaugcgaucggaaccaguauaacccaaaaaggcauaauuuucauauugcucaugcuuguuaccccaaguauggcuaugaggugcguuggaauuggaagucgagauuucguugaaggacucucuggugcaaccugggucgauguaguauuggaacacgguucgugcgugacaacuauggcuaaagauaaaccaacgcuagauauagaauugcucaaaacagagguaacgaauccggcaguauuacggaaauuauguauagaagcgaaaauaucaaauaccacaacagacucgagaugcccaacacagggcgaagcuacacuuguagaagaacaagacgcuaauuuuguaugucggagaacauucguagaucgaggauggggcaauggauguggccuuuuuggcaaagggucacugauaaccugugcaaaauucaaaugcguuacuaagcuagagggaaaaaccguccaauaugaaaaccuaaaauacucuguuaucguaaccgugcauacuggggaucaacaucaagucgguaacgaaucuacggaacacggcacgacagcaacaauaacuccgcaagcaccauccacugaaauacaacuuacagauuauggagccuuaacacuagauugcagcccaagaacggguuuagauuuuaaugaaaugguguuacuaacaaugaaagagaaaaguugguuaguucacaaacaaugguuccuagauuuaccauugccguggacauccggugcaagcacaucgcaagagaccuggaauagaaaagaucuacugguuacguucaagaccgcgcacgccaagaaacaagaagugguaguauuaggcagucaagaaggagcaaugcacacagcgcuaacgggugcaaccgagauacaaacgucugguacaacgacaaucuuugcgggacaucuaaagugccgauugaagauggauaaacuaacucuaaaaggaaugucuuauguaaugugcacugguucauuuaaacucgaaaaagagguagcagagacccaacaugguacaguucuaguucaaaucaaguaugagggaaccgaugccccauguaaaauaccguuuucaacucaagacgaaaaaggcguaacacaaaacggaaggcuuauaacugccaacccuauagugacugacaaggagaaaccuguaaacauagaagcagaacccccauuuggagaaucuuauauaguaauuggcgccggugagaaagcacuaaaacuaaguugguuuaaaaagggaucuucaauagggaaaauguuugaggcaaccgcgaggggcgccagaaggauggcuauauugggcgauacagcuugggauuucgguagcauugguggagucuucacaaguguuggaaaguuagugcaucagauuuuuggaacggcuuauggaguguuguucaguggaguaucuuggacaaugaaaauaggaauugguguuuuauuaacguggcugggacuuaacagcaggucgacaagucucucuaugaccuguaucgcgguaggcuuggugacccuguaccuagguguuaugguccaggcggauucggguuguguuauaaacuggaaaggucgugaacucaaauguggcagcggcauauucgucacgaaugaaguucauacguggacugaacaauacaaauuucaggcagacucuccaaagcgacuuucagcagcuauaggaaaagcaugggaagaagguguaugcggaauuaggagugcuacccggcucgaaaauauuauguggaaacaaauaaguaacgaauugaaucacauacuucucgaaaacgauaugaaguuuacuguaguaguaggcgauguggcaggaauauuagcccagggaaagaagaugauucggccacaaccuauggaguauaaguauucguggaaaagcuggggaaaggcaaaaaucaucggugcagauguucaaaauaccacuuucauuauagacggaccuaacaccccagaaugcccagaugaucaaagagcuuggaauauaugggaagucgaagauuauggguuugggauuuucacuacuaauauuuggcuaaaauuaagagacaguuacacccagguaugcgaucaccggcuaaugagugcggcaauuaaggauuccaaagcgguacaugcggacaugggcuauuggaucgaguccgagaaaaaugagacauggaaacuagcaagagcaucauuuauagaaguuaagacguguauauggccuaaaagucacacauuauggaguaauggcguacuagaaucugaaaugauuauuccuaaaaauuauggcgguccuauaagccagcacaauuaccguccagguuacuucacacaaacagcaggaccauggcauuuagguaaacuagaacucgauuuugaucuaugugagggaacaacaguagucguugaugaacauuguggcaauagagguccuuccuuaagaacaacuacuguuacagggaaaauaauccaugagugguguuguagguccuguacccucccaccuuuaagauucaaaggggaagauggauguugguacgggauggaaauacggccaguaaaggaaaaagaggaaaaccucguuaaaagcaugguuagugcgggaucuggcgaaguugauagcuuuucccuaggucuauuaugcauaaguauaaugauagaagaaguuaugaggucuagauggucccggaaaaugcuaaugacaggaacucuggcgguguuauuuuuguugauaaugggacaacuaacuuggaaugaucugauccgcuuaugcauaaugguaggggcgaaugcgucugaucgaauggguaugggcacaacuuacuuagcacucauggcuacauucaaaaugcgacccauguuugcuguugguuuacuauuuagaaggcuaacaucuagagagguuuuauugcugacgauaggacuaucgcuuguagcaagcgucgaacuaccuaauucacuggaagaacuuggggauggacuugcgauggggaucaugauuuugaagcuacuaacagacuuccagucacaucaauugugggcaacguuauuaagucuuacguucauaaagacaacuuuuucacuucauuaugcauggaagacaauggcaaugguucucagcauuguuuccuuauuuccccugugucucucuacaaccucacagaaaacaacaugguuaccgguauuacuaggaucacuagggugcaaaccauuaaccauguuccuuauagcugagaauaaaaucugggggagaaaaucauggccacuuaacgaagggauaauggcaguuggaaucgucaguauacuucucucaagccuucucaaaaaugauguaccauuggcugguccucuaauagcuggcgguaugcucauagcaugcuauguaauaaguggaucaucagcugaucucucauuggaaaaagcagcggaagucagcugggaggaggaagcagaacauagcggggcaagucauaacauucugguagaaguucaggacgauggcacuaugaaaauuaaagacgaggaaagggaugauaccuuaacaauauuacugaaggccacuuuguuagcaguaucaggcguguacccuuugaguauuccagcaacacuauuuguuugguacuucuggcaaaagaagaaacaaagaagcggagugcuaugggacaccccaucuccaccagagguugaacgagcaguauuagaugacggcauauauagaauuaugcagagaggccuucuagggcgaagucaaguuggugugggaguauuucaagaaaacguuuuucacacaauguggcauguuacaagaggggcuguuuuaauguaucagggaaagcgccuagagcccucaugggcuagugucaaaaaggauuugauuaguuauggaggaggauggagguugcaagguaguuggaacacuggugaagaaguacaagugauugcagucgaaccagguaaaaauccgaaaaacguacaaaccgcuccaggaacauucaaaacaagcgagggagaagucggugcuauagcacuagacuucaaaccagguacgaguggaucuccaauaguuaaccgagagggaaaaauaguggguuuauacgggaacggcguaguuacaacaucagggacauacguaagugcuauagcacaggcaaaagcaucccaggaggguccacuaccggaaauugaagacgaaguuuuuaggaaaaggaacuuaacaauaauggaccuacauccgggcucggggaagacccgaagauaccuuccggccaucguaagagaagcuaucaaaaggaaauuaaggacgcuuauacuggccccaacuaggguaguagccagcgaaauggcagaagcauugaaagguaugccgauacgauaucaaacaacagcaguaaaaagugaacacaccggcaaagaaauaguagaccuaaugugucacgcuacuuuuacuaugcgacugcucucaccuguuagggucccuaauuacaauaugauaauuauggaugaagcacacuuuacagauccuagcucaauagccgccagagguuacauuucuacacgaguuggcaugggagaagccgcugcaauuuuuaugaccgcaaccccuccagguuccguagaagcauuuccccaauccaaugcuguaauacaagacgaggaacgugacaucccagaaagaagcuggaacuccgguuacgaauggauaacagauuuuccugguaagacuguaugguucguuccaucuauaaaaucaggaaaugacauagcgaacugucuuaggaaaaaugggaaaagaguuauucaacuuagcagaaaaaccuuugacacugaguaccagaaaaccaaaaacaacgauugggacuauguaguaacgaccgacauaucagaaaugggugccaauuuuagagcagauaggguaauagauccccgcagaugcuuaaagccugucauccuaaaggauggaccugaaagaguaauauuggcgggcccuaugccaguaaccguggcuucagcugcacaaagaaggggucggauugguagaaaccacaauaaggaaggagaucaauacauuuauaugggacaacccuuaaauaaugacgaagaccaugcacauuggacagaagcuaagauguuguuagauaacauuaauacaccugaagggauaauacccgcauuguuugaaccugaaagagagaaguccgccgcuaucgauggcgaguacagacugagaggcgaggcucgaaaaacauuuguagaauugaugagacgaggagaccuuccgguaugguugucuuauaaagucgcaagugaaggauuucaauauagcgauagaagaugguguuuugacggcgaacgaaacaaccaggucuuagaagaaaauauggacgucgagauuuggacuaaggaaggagaaagaaagaaacucagaccgagguggcuagaugccagaacguacagugauccuuuagcucuaagagaauuuaaagaauuugccgcaggacggagaaguguuuccggggacuugaucuuagaaauagggaaauuaccacaacauuuaacgcaaagggcacaaaacgcacuugauaaucuggucauguugcacaauucagaacaagggggacgcgcauauagacaugcgauggaggaacuaccugacacaauagaaacauuaauguuacucgcuuuaauagcaguacuaacagggggugucacgcuuuucuuuuuaucuggccgggguuuggguaaaacaagcauuggucugcuuugcguaauggcuucgagcguacuucuauggauggcuucaguagaaccucauuggaucgccgcaagcauuauucuagaauuuuuccuuauggugcuucuuauaccugaaccugauaggcaaagaacgccgcaagauaaccaacuagcauacguuguaauaggacuacuauucaugauacuuacagucgcugcaaacgaaauggguuuacuagagaccacuaagaaagauuuagguauuggucacgucgcgguagaaaaucaucaccaugcugccaugcuagauguagauuuacauccagcgagugcauggaccuuauacgcuguggcaacaaccauuauaacucccaugaugagacauacgauagagaauacgacugcaaacauaucgcuaacagcaauugcuaaucaggcugcgauucuuaugggacuugauaaaggauggccuaucucaaagauggauauaggcguuccgcuucuugcuuugggcuguuacagccaaguaaacccacuaacauugacugccgcgguacuuaugcuaguagcacauuaugcuauaauuggaccgggacuccaggcuaaagcgacucgagaggcccagaaaaggacagcggcugggauaaugaaaaaucccacgguagacggcauaguagcaauagaccuugauccuguagucuacgacgcaaaauuugagaaacaacuuggacagauaauguuacuaauauuaugcacgucucaaauucuacuaaugagaacaacuugggcauuaugugaaucaauuacacucgcaacaggacccuugacaacucuuugggaaggcucacccgggaaauuuuggaauacaacaauugcaguauccauggcgaauaucuuuagaggaucauaccuagccggugcaggucuagcuuucagucuaaugaaaagucugggaggaggaagacguggaacuggcgcacagggggaaacguuaggcgaaaaguggaaacgacaacucaaucaauugagcaaaucagaauuuaacacauacaaacgaucggguaucauggaaguagauagaagcgaagcgaaagagggacuaaagagaggagaaacaacgaaacaugcugugucccguggcacugcaaaacuucgaugguucguagaaagaaaccuuguaaaaccagaaggcaaaguaauugauuuagguuguggaagggguggauggucuuauuauugcgcagggcuuaagaaaguuacugaaguaaaaggauacacaaaaggagggccaggacaugaagaaccaauaccaauggcuacguacggguggaaccuaguaaagcuacauucuggcaaagauguauucuucauaccuccagaaaaaugugauacauuguuaugugauauaggcgaaucuucuccaaauccuacaaucgaggaagggagaacuuuaagaguccuaaaaaugguggaaccgugguugagagguaaucaauuuugcauuaagaucuugaauccauauaugccaagcguagucgagacccuagaacaaaugcaacggaaacaugguggaaugcucguccgaaaucccuuaagcaggaauaguacucaugagauguacuggguaaguuguggaacggggaacauaguuucagcugugaacaugacaagucguaugcuauuaaacagauuuacuauggcccauagaaagccuacuuaugagagagacguugauuuaggagcagguacgaggcauguagccguagaaccggagguagcaaauuuagauauaauaggacaacguauagagaauaucaaacacgaacacaagagcaccuggcauuacgacgaagauaacccauacaaaaccugggcauaccacggguccuaugagguaaaaccaaguggaucggcgaguaguaugguaaacggugugguuaaauuauuaaccaagccaugggauguuaucccaaugguuacacaaauagcaaugacugauacuacgccuuuuggccaacaaagaguuuuuaaggagaaaguggauacucgcacaccaaaagcaaagcguggaaccgcacaaauuauggagguaacagcaaagugguuauggggguucuuaucuagaaacaaaaagccgaggauuugcacaagagaagaguucacucggaaaguucgaucaaacgccgcgaucggugcuguauucgucgaugaaaaccaauggaacucggcgaaagaagcaguagaagaugagcgcuucugggaccuuguacaccgagaacgagaacuacauaaacaagguaaaugcgcaacuuguguuuacaauaugauggguaaaagagagaagaaacuuggagaguucgggaaagcaaagggaucacgagcgaucugguacaugugguuaggcgcacgguuuuuagaauuugaagcauuagguuucaugaaugaagaccacugguuuucacgagaaaacagucugucagguguagaaggugaaggauuacauaaacuuggguacaucuugagagacauuaguaagaucccaggugguaauauguaugccgaugauacugcagggugggauacaagaaucacagaagaugaccuucagaaugaagcuaaaauaacagacauuauggagccugaacaugcacuucuugccaaaucgauauuuaaguugacauaccagaauaaaguuguucggguacaacguccagccaaaaauggaacaguaauggauguuauuucaagacgagaccaaagagguuccggccaaguggggacauaugggcucaauacauucacaaauauggaagcccaauuaauaagacaaauggaauccgaaggaauuuuuaguccgucggaguuggaaacaccuaauuuagcgggaagaguuuuagauugguuagagaagcauggcguugaacggcugaagcguauggccaucucuggggaugacugcguaguuaaaccuauagacgaccgauuugccacugcacuaacugcacuaaaugauauggguaaagucagaaaagauauaccacaaugggaaccaucaaagggcuggaacgacuggcagcaaguacccuuuuguucacaccauuuucaccaauuaauaaugaaggauggaagagagaucgucguaccaugcaggaaccaggacgaauuaguagggcgggcuagagucagccaaggcgcaggauggucauugcgggagacagcuugucuaggaaaaaguuacgcacagauguggcaauuaauguacuuucauagaagagaucucagacuagccgcaaaugcaauaugcagugcggucccaguagauuggguacccacaagucggacgacauggucaauacacgcccaccaucaauggaugacaaccgaagauauguuaaguguuuggaaucgaguuuggauagaagaaaaccccuggauggaagauaagacacauaucaguagcuggggugacgugccauauuuaggaaaacgagaagaccaauggugugggucauuaaucggacugacggcaagagccacgugggcaacuaauauccaagucgcaauaaaucagguaaggagacuuauuggcaacgaaaauuaucuagacuacaugacaaguaugaaacgcuucaaaaaugagagcgaucccgagggggcacuuugguag

SEQ ID NO: 21894 - RNA, 9879 nt, Artificial Sequence
  derived and/or modified CDS sequence (opt6) from DENV-1__EU249490__SS-prME
agcguaacuaugcuuuuaauguuaaugccaacugcacuugccuuucaccugacuacucgagggggagaaccacacaugauuguaucaaaacaagaaagaggaaagaguuugcucuuuaaaacaucagcggguguaaauaugugcacccugauagcuauggacuuaggggaauuuugcgaagauacgaugacauacaagugcccucgcauaacugaagcggaaccagaugacguagauuguuggugcaaugcgacggauacauggguaacguacggaacuugcagucaaacgggcgaacauagaagagauaaaagaucuguagcacuugcuccacacgugggacucgguuuagaaaccagaacggaaacuuggauguccagugaaggcgcguggaaacaaauacaacgaguugaaacuugggcucuccgccauccuggauucaccguaaucgcgcuauuuuuagcucaugccauugguacuuccauuacucaaaaggguauaauauuuauauuacuuauguuggugacaccaagcauggcuaugagauguguaggaauaggcucaagagauuuugucgaaggucugucaggcgcuaccuggguagauguugugcuugagcauggaagcuguguaacuacgauggcuaaggacaagccgacguuggauaucgaacuauugaaaacagaaguuaccaacccugcuguacugagaaaacuuuguauugaagcaaaaaucucaaauacuacaacugacucucgaugucccacucaaggggaagccacacugguagaagaacaggacgcuaacuuuguaugccguagaacauucgucgaucgaggaugggguaacggaugcggucuuuuuggcaagggcucauugauuacuugugcaaaauuuaaauguguuacgaagcucgaaggaaaaacaguccaauaugagaauuuaaaauacuccguaauaguaacuguacacacuggugaucaacaucaaguugguaacgaaaguacggaacacggcacaacagccacuauuacaccacaagcaccaucuacagaaauacaacuuaccgauuacggcgcacugacacuggacuguaguccacgcacaggauuagauuucaaugaaaugguccuucugacaaugaaagaaaagucuugguuagugcacaagcaaugguuucuagaccuaccauugccauggacaaguggagcuucgacuucacaagagacauggaauagaaaagacuuguuaguaacauuuaaaacagcucaugccaagaaacaagagguagugguguuaggaucacaagagggagcuaugcauaccgcacucacgggugccacugagauccaaaccagcggaacaacaacaauauucgcuggucaucuaaaaugucgguugaaaauggacaaacuuacacugaaaggaaugucauauguaauguguacagguucguucaaauuagaaaaagaaguagcggaaacacagcauggaacggucuuaguacaaauuaaauacgagggaacagacgcaccguguaaaaucccguucucuacacaagacgaaaaagggguuacacaaaacgguaggcuaauaaccgcgaacccaaucgucacggacaaagagaaacccgucaauauugaagccgaacccccguuuggugaaaguuauaucguaaucggagccggggaaaaagcauugaaauuaucaugguucaagaaagggagcaguaucgguaagauguucgaggcuacugcucguggagcucgaagaauggcgaucuuaggugacacagcaugggacuucgguagcauaggaggaguuuuuacauccguagguaaauugguacaucaaaucuuuggaacugcuuacggaguauuauucucaggcguaucguggaccaugaaaauaggcaucgggguacuauugacuuggcuaggucuaaauucuagaucaacaucgcucaguaugacuuguauagcgguuggacuggucaccuuauaucuagggguaaugguacaagccgauucugguugcguuauaaauuggaaaggacgggaauugaaguguggcuccggaauuuuuguuacgaaugaaguacauacuuggacugagcaguauaaauuucaagccgauuccccaaaaagauuaucggcagcaauaggaaaggcaugggaagaaggaguuugcgguauucggucggcaacgcggcuugagaacauuauguggaagcagauaucaaacgaauuaaaccauauucugcucgagaacgauaugaaauuuacaguugucguaggggaugucgcaggaaucuuagcccaaggcaagaaaaugauccgaccgcaaccuauggaauauaaauacaguuggaaaucaugggggaaagcaaagauaauuggggcagacgugcaaaauacuacauucaucauagauggaccaaauacuccagagugucccgaugaucagagagcauggaacauuugggagguugaagacuacggauuuggaauuuucacaacaaauauauggcucaaauuacgagacucauauacccaaguuugugaucaccgccuaaugucagcagcaauaaaagacaguaaagcgguucaugcagauaugggcuauuggauagagagugagaaaaaugagaccuggaaauuagcgcgagcauccuuuaucgaagugaaaacuugcaucuggccaaaaucgcauacacucuggagcaacggcguuuuagaaucagaaaugaucauacccaaaaucuacggaggaccuauaucacagcauaauuauaggccgggauauuuuacacaaacugccggaccuuggcaucuaggaaaguuagaauuagauuucgauuugugugaggggacuaccgugguaguugacgaacacugugguaacagaggaccgagccugagaacaacaacagucacaggaaaaauaauacaugaguggugcugucggagcuguacacucccuccguuacgauuuaaaggagaagacggguguugguaugguauggaaauacguccaguaaaagagaaagaagagaaucucgucaaaucaaugguuucugcugguagcggugaaguagauagcuucagccucggauuacucugcaucuccauuaugauugaggaggucaugcgcucucgauggucgagaaaaauguugaugacagguaccuuagcgguguucuuucuucuaauuauggggcaguuaacuuggaaugaucuaauuaggcuguguauuaugguaggugcaaacgccagugaucgaauggguauggguacgacguaucuggcacuuauggcaacuuuuaaaaugcguccuauguuugccguuggacucuuauuucguagauuaacaagccgugaaguauuacuauuaaccauuggacuaucacuuguagcauccgucgaacuaccuaacuccuuagaagaacuuggagacggguuagcaaugggaauaaugaucuuaaaacucuugacagacuuccaaucgcaccaacuaugggcuacacuucuaucgcugacauuuaucaaaacuaccuuuagccuacauuaugcauggaaaacaauggcuauggugcuaucgauuguuuccuuauucccauugugccuauccaccaccagucagaaaaccacguggcugccagugcuacuaggguccuuaggauguaagccguuaacaauguuucucauagccgaaaacaaaauuugggggagaaaaucauggccuuuaaacgaagggauaauggcuguuggaaucguaaguauacuuuuaucgagccuguuaaagaaugauguaccuuuagcaggcccucucauagccggagguauguugaucgccugcuauguaauuaguggguccagcgcagauuugagccuagaaaaagcugcggagguuaguugggaagaagaggcugaacacucaggcgccagccauaauauauuaguugaaguccaagaugaugguaccaugaaaauuaaagaugaagagagggaugacaccuugacaauacugcuuaaagcuacacuacuugcaguguccgggguuuacccucuuucuauaccagccacccuauuuguaugguauuuuuggcagaagaagaaacaacgaucaggcguccucugggauacaccgaguccucccgagguggaaagagcuguucuggacgacggaauuuacagaauuaugcaaaggggauuacuuggaagaucccagguagguguagguguguuucaagaaaauguauuccauacuauguggcacguuacuagaggcgcuguuuuaauguaccaagguaaacgacucgaaccaucgugggcaucaguaaagaaagauuugauaucuuacgggggagguuggagacuucaagggagcuggaauacuggagaagaagugcaaguaauugcagucgaacccggcaaaaacccgaagaauguacaaacggcacccggaacauucaaaacaucagagggagaaguuggagccauagcauuagacuucaaaccaggaacuagcggaaguccuauaguaaauagggagggaaagauagugggauuguacgggaacggaguaguuacaacuucaggaacuuacguaagugcaauugcucaagccaaagcgagccaagaagguccuuugccugaaauagaggaugagguauuccgcaaacgaaaucuaacuauuauggacuuacacccagguucugguaaaacaaggagguauuuaccagcaaucguaagagaagcaauuaagagaaagcuacgaacgcuaauccucgcaccuacaagaguuguagcaagcgaaauggcagaggcguuaaagggaaugccgauaagauaccaaacaacagcagugaaaucagaacacacaggcaaagagauaguagaucuaaugugucaugccacguucacgaugagacuacuaaguccgguaaggguaccuaauuacaacaugaucaucauggaugaagcgcauuucacugauccaucaucaauagcagcaagagguuacauuuccacacgaguugggaugggcgaggcggcagcaaucuuuaugacugcuacgccgccggguucaguagaagcauucccccaaucuaaugccguaauccaagaugaagaaagagauauaccggaacguucuuggaacuccgguuacgaguggauuacagacuuuccugguaaaacaguuugguucguaccuucuauuaaaucagggaacgauauugcuaacugccuaaggaaaaaugguaagagaguaauacaauuaucgagacgaacauuugacacggaauaucagaaaacgaaaaacaaugauugggacuaugucguaacgacagacauuagcgaaaugggcgcgaacuuccgcgcggaucgagucaucgacccacgacggugccuaaagcccgucauucugaaagauggaccggagaggguaauccuagcaggaccuaugcccguaaccguagcaagugccgcccagagaagaggaagaauaggaagaaaccacaacaaagaaggagaucaauacaucuauaugggccaaccgcucaacaaugaugaagaucaugcacauuggaccgaagcaaaaauguuauuagacaauauaaacacaccagaagggauaaucccagcauuguuugaaccugagagggagaaaagugcagccauagauggagaauauagauuaagaggagaagcacgaaagacguucguagaacuuaugagacgaggugacuuaccugucuggcucucauacaaaguagcaagcgaaggcuuucaauauagcgauagaagaugguguuuugauggagaaaggaauaaccaaguacuugaagagaacauggacguagaaaucuggacaaaagaaggggaacguaagaaacuaagaccuagguggcuugaugcgagaacuuauucagacccuuuagcuuugagagaauuuaaagaauuugcggcgggaaggagauccguaucaggagacuuaauacuagaaauaggaaaauuaccacaacaucucacacaaagagcccaaaaugcucuagacaauuugguaaugcuacacaacucugaacaagggggcagagcguaucgucaugccauggaagaauugcccgacaccauagaaacgcucaugcuauuggcauuaauugcuguccuaacugggggaguaacacuauuuuucuuaagcgggagagguuuaggaaaaacaaguauaggacuucuaugcgucauggcgaguagugcacugcuauggauggccucgguugagccacauuggaucgcagccaguauaauauuagaguucuuuuuaaugguucuacucauaccggaaccugacaggcaacggacaccacaagauaaccagcuagccuauguaguuauuggauuauuauuuaugauauugaccguugcagcaaaugaaauggggcuacuugaaaccacgaagaaagaucucgguaucggucauguagcgguagaaaaucaccaucaugccgcuaugcuugacguagauuuacauccggcuagcgcuuggacuuuauaugccguagcaaccacgauaauaacaccuaugaugcgacacacaaucgagaacacuacugcgaacauaucacuuacugcaaucgccaaucaagcugcuauauugaugggacuagacaaaggguggcccauaaguaaaauggauauagguguuccgcugcuagcuuuaggaugcuauagucagguuaauccacuaacucuaacggcagcaguuuugauguuaguggcacacuacgcaauuaucggcccaggacuucaagcuaaagcaacacgcgaggcgcaaaaacgcacugcagcugggauaaugaaaaauccuaccguagacggaauaguggcaaucgaucuagaucccguaguuuacgacgcgaaauucgaaaaacaacuaggacagauuaugcuuuuaauauuaugcacuucucagauauuauuaaugagaacuacaugggcacuaugcgaaaguauuacccucgcaacaggaccgcuaacaacauugugggaggguucaccggguaaguuuuggaauacuacaauugcaguaucuauggcgaacauauuucguggcagcuauuuagcuggagccggccuugcauucucauuaaugaagaguuuaggaggaggaagacgaggcacgggagcucagggagagacccuaggugaaaaguggaagcgucaguugaaucaacugaguaaaucagaguucaauacauacaagaggucaggaauaauggaagucgauagaagugaagccaaagaagguuuaaaaagaggagaaacgaccaaacacgcugucucaagaggaacugcaaaacuucguugguucguugaaagaaaucugguuaaaccagaggggaaaguuauagacuuaggaugcgguagaggcgguuggucuuauuacugugcuggucucaagaaagucacagagguuaaaggcuauaccaagggagggccuggacaugaggaaccuauaccgauggcaacauauggcuggaacuuaguaaaauuacauucuggaaaagauguauuuuucauaccuccagaaaaaugugacacgcuuuugugcgacaucggagagucaucaccaaauccaaccaucgaggagggaaggacgcuucgggucuugaagaugguggaaccuugguugagagguaaccaauuuuguauaaaaauacuaaacccguacaugccaucagucguggagacacucgaacagaugcaaagaaaacauggggguauguugguacgcaauccgcuaaguaggaacucaacucaugagauguauuggguuucaugcgggacaggcaacauaguaagugcugucaauaugacaaguagaaugcuuuugaacagauuuacgauggcacacagaaagccuacuuacgaacgagauguugaucuuggagcaggaacaagacauguugcgguugaaccagaaguagccaaucuugauauaauagggcaaagaauagagaauauaaaacaugaacauaagucuacuuggcauuaugacgaagauaaucccuauaagacuugggccuaucauggcaguuaugaggucaagccuucaggcagugcaucaaguauggucaaugguguaguuaaguuacuuacuaagccaugggauguaauuccgaugguuacccagauugcaaugacggacacuacaccauuuggacaacaaagagucuuuaaagaaaaaguagauacacggacaccgaaagcaaaaagagggaccgcucaaauaauggaaguuacagcaaagugguuaugggguuuucugagcagaaacaaaaagccucguauauguacaagagaagaguuuacuagaaagguuagaaguaaugcggcaauaggagccgucuuuguagaugaaaaucaauggaacagcgccaaagaagcaguagaagaugagagguuuugggaucugguacauagagaacgagaauuacacaaacaagggaaaugcgcaacuuguguuuauaauaugaugggaaaacgggagaagaaacuaggagaguuuggaaaagccaaaggaucgcgagcgauaugguacaugugguuaggagcacgguuucuugaguucgaggcacucggcuuuaugaacgaagaccauugguuuagcagagaaaauucauuauccggagucgaaggcgagggacuacauaaacuuggauauauacuucgagauauaaguaaaauucccggagguaauauguaugcagaugauacagcagggugggauacacgaauaacagaagaugacuuacaaaaugaagcaaaaauuacggacaucauggaaccugaacacgcauuauuagcaaaaucgauauucaaauuaacguaucagaauaaaguagugagaguacaacguccagccaaaaauggcacagucauggauguaauaaguagaagggaucagagaggcucaggucaggucggaaccuacggucuaaauacauucaccaacauggaagcccaauugauaagacaaauggaaagcgaaggcauauuuucuccaucggaauuagaaacaccaaaucuagcugguagaguucuagauuggcuggaaaagcaugguguggaacguuuaaagagaauggccauaaguggagacgacugcguugucaaaccaauagaugacagauucgcaacugcguuaacagcauuaaacgacauggggaaggucaggaaagacaucccacaaugggaaccaucaaaaggguggaaugauuggcaacaaguaccguuuuguucacaucauuuucaucagcuuauaaugaaagaugguagagaaaucguggucccguguagaaaccaggacgaacucguuggcagagcuagaguuucccagggggcuggauggucuuuaagagaaaccgcgugcuugggcaaauccuacgcccaaauguggcagcuuauguauuuucauagacgugauuugagacuagcagcuaaugccauaugcucugccguaccgguagacuggguacccacguccaggaccacguggucuauucaugcccaucaccaauggaugacgaccgaagauaugcucagcguguggaauagaguauggauagaagaaaauccuuggauggaagauaagacacauauaaguagcuggggagauguacccuaucuaggcaaaagagaggaucaaugguguggaaguuuaaucggauuaacugcucgagccaccugggccaccaauauucaggucgcuauuaaucagguaagacgacuuaucgguaaugaaaauuacuuagacuacaugacaucaaugaaacgauuuaaaaacgaaucagauccugaaggggcuuuaugguag

SEQ ID NO: 21895 - RNA, 9879 nt, Artificial Sequence
  derived and/or modified CDS sequence (opt6) from DENV-1__EU249491__SS-prME
ucagugacaaugcuguuaaugcugaugcccacagcacuagcauuucacuuaacgacccguggcggugaaccucacaugauaguaaguaaacaagaaagagggaaauccuuauuauuuaaaacaucggcugguguuaauaugugcacucuaauagcaauggaccuaggagaauuaugugaagacacaaugacauauaaaugcccuaggauaacagaagcugagcccgacgauguagacugcugguguaacgcaacagacacuuggguaacguauggaacauguucacaaaccggugaacauagacgggauaaacgauccguggcauuagcaccacacguuggacuagguuuagaaaccagaacugaaaccuggaugagcagcgaaggugcuuggaaacaaauucaaagaguagaaacgugggcccugaggcauccaggauuuaccguaauagcccuauuucucgcccacgcuauaggaacuucuaucacucaaaaagguauaauauucauauuauuaauguuaguaacaccuaguauggccaugcgguguguuggaaucggaagccgcgauuuugucgaaggauuaagcggugcuacauggguugacguuguacuagagcaugggucuugcguuacaacaauggcaaaagacaaaccuaccuuagauauagaacuucugaaaaccgaagugacuaauccagcuguauuaagaaaauuauguauugaagccaaaauuucaaauacaacaacugauucaagauguccaacucaaggagaggcuaccuuaguugaggaacaggaugcaaauuuugucugucguagaacauuuguagaucgaggaugggguaacggcugcggauuauuuggcaaaggaucacucauuacuugugcaaaauucaagugcguuacuaagcuagaagggaagauaguacaguacgaaaaucuaaaauauuccguaaucguaacuguccacacuggugaccaacaucagguggggaacgaaucuaccgaacacggaacaacagccaccaucaccccucaagcgccgacaacagaaauccaauuaacugacuacggcgcucuaacgcuagauugcagcccccggacagguuuagauuuuaaugaaauggugcuauuaacuaugaaagaaaaaucgugguugguucauaaacaaugguucuuagaucuaccauuaccuuggaccucuggugcuuccacgagccaagaaacauggaauaggcaagaucuauuaguuacauucaaaacggcccacgccaagaaacaggagguaguaguacuaggaucucaagaaggcgcgaugcauacagcacuaacaggugcaacagaaauacagaccaguggcacaacuacuaucuuugcuggccaucuaaaaugucgacuuaaaauggacaaacucacacuaaaagguaugagcuaugugauguguacugggaguuuuaaguuggaaaaagaaguagccgaaacacagcauggaacgguccuaguacaaauaaaauacgaagggacagacgcacccugcaaaauaccguucuccacgcaagacgagaaagggguaacucagaacgggcggcugauaaccgccaauccaaucguuacagacaaggaaaaaccuguuaauauugaagcugagccacccuucggagaaaguuauaucgugaucggagccggcgaaaaagccuuaaaacucaguugguuuaagaaaggaaguaguauaggcaaaauguucgaggcaaccgcucgaggcgcgaggcgaauggcgauuuuaggagauaccgcgugggacuuuggaucaauagggggugucuucacaucuguuggaaaacuuguacaucagauuuuuggaacggcuuauggaguccuauucagcggaguaucuuggacuaugaaaauaggaauagguguccuacuuacauggcuggggcuaaauucccgaucaacaagucugucaaugacguguauugcaguuggauugguaacucuuuaucugggagcaauggugcaggcugauucugguugugucauaaauuggaaaggacgagaauugaaaugcggcuccggaauuuuuguaacuaacgaaguacauacauggacagaacaauacaaauuucaagcugauaguccaaaacgucuuuccgccgcgauagggaaagcgugggaagaaggugucugugggauacguucugcaacccgucuugaaaauaucauguggaaacagauuaguaacgaacucaaccauauuuugcuagagaaugauaugaaauugacaguaguagucggagacguagcagggauucuuggacaagggaagaaaaugauaagaccgcagcccauggaauacaaauacaguuggaaaucuuggggaaaagccaaaauaauaggagcagaugcacaaaacacgacauuuauuauagacggaccuaacacucccgagugcccugacgaucaacgcgcuuggaacauaugggaagucgaagauuacggcuuugguauuuuuacaacuaauauuugguugaaauuaagggauaguuauacucaaguaugcgaucaucgauuaaugucugcagcuauuaaggauucuaaagccguucaugcagacaugggauacuggauagagucagagaaaaaugaaacauggaaauuagcacgagcaucguucauugaggucaagacuuguauauggccaaaaucacauacauuaugguccaaugguguuuuggaguccgagaugauuauacccaaaauuuacgguggaccaauaucacaacacaauuaucgaccuggcuacuucacacaaacagcaggaccauggcacuuagggaaacuugaacuugacuuugaccuaugugaagggacaacuguagucguugaugaacauuguggaaauagggguccaucacuaagaacaacuacaguuacuggaaaaaucauucacgaaugguguugucggaguuguacccuaccaccgcuuagguuucguggagaagacggcugcugguaugguauggaaauacgacccgugaaagaaaaggaggaaaaccuuguaaaaaguaugguuuccgcagggagcggugagguugauuccuuuagucuaggucugcugugcauaucaauuaugauagaagaaguuaugcgaucgcgauggucacggaaaaugcugaugaccggcacuuuagcaguauucuuucuacuaauaaugggacaauuaacauggaacgaucucauccgcuuauguauuaugguaggggcaaacgcaucagacagaauggguauggguaccacauauuuagcucugauggcaacauuuaaaaugagaccuauguucgcagugggacuccucuuucgccgucuuacuucaagagaaguucuucuacuaacgauaggauuaucauuaguagcguccgucgaauuaccuaauucauuagaagaacuuggugacggucuugccauggguauaaugauucuuaaauuauuaacggauuuucaaagccaucaguuaugggccacauuauugagccuuacauuuaucaagacgacguuuucuuuacauuaugccuggaaaacgauggcaauggugcucaguauagucaguuuauucccacuaugucuuucaaccacaagccagaaaacgacguggcuuccuguucuacucgguagucuaggauguaaaccauuaacaauguuuuuaauagccgaaaauaaaaucuggggaagaaaaucguggcccuuaaacgaaggaauuauggcaguugguauagucucaauauuauugaguucucugcuuaaaaacgacguuccacuagcaggaccacucauugcuggaggaaugcucauugcuuguuacgugauuagcgguucaucugcggauuuaagccucgagaaggccgcagaagucaguugggaagaggaggcggaacauucaggagcaucgcauaacauauugguggagguccaagacgauggaacuaugaaaaucaaagacgaagaacgugacgacacauuaacgauacugcucaaggcaacacuccuggcugugaguggaguguacccacuaaguauaccugccacccuguucguuugguauuuuuggcaaaagaagaaacagcgaucugguguccuaugggacaccccuucuccaccagagguugaacgggcaguuuuagaugacggaauuuaucguaucaugcagagagguuuauuaggccguagccaagugggagugggagucuuccaagaaaacgucuuucacacaauguggcaugugacacguggggcgguauuaauguaucaaggaaagagacuagaaccuagcugggccaguguuaagaaagaccucauaagcuauggugguggauggagauuaagagguucuuggaacaccggugaagaaguacaaguaaucgcgguagaaccgggcaagaaucccaaaaauguucaaaccgcuccggggacauuuaaaacuccugaaggcgaagugggagcaaucgcucucgauuucaaaccuggaaccagugguaguccuauaguuaaucgagaagggaaaauuguaggauuauacgggaacggagugguuacaaccaguggcacauaugugucagccaucgcacaagcaaaagcgucacaagagggaccuuuaccagaaauugaagaugaaguuuuccggaagagaaaccuuacaauuauggauuuacauccaggcagcggcaaaacccggagauauuuaccagccaucguuagagaagccauuaaaagaaaauugcguacacuaauauuagcacccacaagggugguagccucggagauggccgaagcauuaaagggaaugccaauaagauaucaaacaaccgcgguaaagagcgaacacacgggcaaagaaaucguugacuuaaugugccacgccacauuuaccaugcgcuugcuuagccccguuagggugccaaauuauaacaugauaauuauggaugaagcucauuuuacagaccccucaucuaucgcagcacgaggauauauaaguacgcgugucgguaugggagaagcagcagcuaucuucaugacagcuacacccccuggcagcgucgaggcuuuuccacaaaguaaugcuguuauucaagaugaagaaagagauauaccugaaaggucauggaauagcggauaugaauggauaacggauuuuccagggaagacaguaugguuuguuccuaguauuaagaguggcaacgauauagcuaauugccuaaggaaaaaugguaaaagaguaauacaauugucuagaaaaacguuugauacagaauaccagaaaacgaaaaacaacgauugggacuacguaguaacaaccgauauuagugaaaugggagcaaacuucagagcggaucguguuauagauccuaggaggugucugaaaccagucauauugaaagacggaccagaaagaguaauucuggcaggcccaaugccugugacagucgcgagugcggcacaaagaagaggucguauuggaagaaaccauaauaaagaaggagaucaauacauauacaugggacagccuuuaaauaaugaugaagaucaugcacauuggacagaagcgaaaaugcuccuagacaacauaaacacaccagaaggcauuauaccggcauuguuugagccggagcgagaaaagucagcugcugucgacggugaauacagacuuagaggagaggcaagaaagacauuugucgaauuaaugagacgcggagacuugcccguuuggcucagcuacaaaguagcuuccgaaggcuuccaauauucugaucgacgguggugcuuugacggggaacgcaauaaucaaguucuagaggagaauauggauguggaaauauggacuaaagaaggggaaaggaagaaacuuaggccaagaugguuagacgcuagaacauacucugauccguuggcacucagagaauuuaaggaauuugcagcgggucgaagguccguaucgggagaucucauuuuagaaauugguaaauugccucaacacuuaacccaaagagcucaaaaugcuuuagacaauuuggucauguuacacaauucggagcaaggugggagagcauauagacacgcaauggaagaacuaccagacacaauagaaacguugaugcuucuugcacucaucgcaguacuaaccggaggagugacccuguucuuucuaucaggacguggucuaggaaaaacaucgaucgguuuacuuuguguuauggcuucauccgugcuucuauggauggcaaguguugagccacauuggauagcagccucgauuauuuuggaguucuuucuaaugguccuauuaauaccugaaccagauagacaacgaaccccucaagacaaucaauuagccuaugucguuauaggucuccucuuuaugauacucacaguagcggccaaugaaaugggauuacuagagacaacaaagaaagaucucgguaucggccauguagccguagaaaaccaucaucaugccgcgaugcuagauguagaucuacacccagcaagcgcuuggacccucuaugcaguagcaacaacuauuaucacgcccaugaugagacauacuauagaaaacacaacugcaaauaucaguuuaaccgccauugcgaaccaagcggcgauacuuaugggcuuggacaaaggguggcccauaucuaaaauggacauagguguucccuuauuagcucuaggcugcuauagccaagucaacccucucacgcucacggcugcaguguugaugcugguagcgcauuaugcaauaauaggaccuggauuacaagcuaaagcuacccgagaagcacagaaaagaacugccgcagggaucaugaaaaacccaacaguagaugggauuguagccaucgaccuggauccggucguauacgaugcaaaauuugaaaagcagcuaggccaaauuaugcuucuaauacucuguacuucgcaaauauuacuaaugcggacuacaugggcucuuugugagucaaucacuuuagcuacgggaccccugacaaccuuaugggagggaucuccaggaaaauucuggaauacaacaaucgcugugucuauggcaaacauauucagaggauccuaccucgccggagccggucuugccuucagucucaugaagucuuuaggaggagggagacggggaacaggggcacaaggugagacacuuggugaaaaauggaaaagacaauuaaaucaacugagcaaauccgaauuuaacacauauaaacgauccgggauaauggaagucgauagguccgaagcuaaggaaggucuaaaacguggagaaacaacaaaacacgccguaagcagaggcacggcuaaauugcguugguuuguagagagaaaucugguuaaaccagaaggaaagguaauagaucugggguguggaagaggaggauggaguuacuauugcgccgguuuaaagaaggucacugaaguaaagggauauacuaaaggaggccccggucacgaagaaccaauccccauggcuaccuacgguuggaauuugguuaaacuucacucagguaaggacguauucuuuauucccccggaaaaaugcgauacacuuuuaugcgacauaggagagagcaguccuaauccaaccauagaggagggcagaacauuaagaguucuaaaaaugguagaaccaugguuacgugggaaucaauucuguauaaaaauucugaauccuuauaugcccucuguaguagagacucucgaacaaaugcaacggaaacacggagguaugcuagugaggaauccucuuaguagaaauucgacucaugagauguauuggguuucuugugguacaggaaauaucguuucagcuguaaacaugacaucaagaauguuguuaaauagauucaccauggcacaccgaaaaccaacauacgaacgagauguugaucugggaacuggaacuagacauguagcuguagaaccagaaguagcaaacuuagauaucauuggccaaagaauugaaaacauaaaacacgagcacaaaagcacguggcauuacgacgaagacaaccccuauaaaacaugggcuuaucaugguucuuaugaaguuaaaccauccgguucggcaagcagcauggugaacggcguuguuaaauuauugaccaaaccuugggauguaauuccaauggucacccagaucgcaaugacggacaccacaccauucgggcaacaacgugucuucaaggaaaagguagauacuaggacaccaaaggccaaaagagguacggcucaaauuauggagguuacagcuagaugguuguggggauuuuuaagcaggaacaaaaagccacguaucuguacgagagaagaauuuacuagaaaagucaggucuaaugcagccauuggagcuguauucgucgaugaaaaucaauggaacucugcaaaagaggcggucgaagacgagagauuuugggacuugguccaccgcgaacgagaacuucauaaacaaggaaaaugugcuacauguguauacaacaugaugggaaaacgagaaaagaaauuaggugaguucggaaaggcaaaagggagccgcgcgauuugguauaugugguuaggagcuagauuccuggaguuugaagcgcuaggauucaugaacgaagaucauugguucucccgagaaaacucucuguccggaguagagggggaaggauuacauaaacuuggguauauauuacgugauauaucuaaaauacccggagggaauauguacgccgacgauacggcaggaugggauacacgcauuacugaagaugauuuacagaacgaagcgaaaauuacggacauaauggaaccagagcacgcacuucuagcuaaagcaauauucaaacuuaccuaccaaaacaaggucguaagaguucaaagacccgccaaaaauggaacuguuauggauguaaucucuagacgagaccagaggggcaguggacaaguuggcacuuacggauuaaacacguucacuaauauggaggcucaacuuaucaggcaaauggagagcgagggcauuuucagucccagugaacuagaaacacccaaucuagcagagagagcacuagauuggcuugaaaaauauggaguugaacgucucaaaaggauggcaaucucgggugacgauugcguagucaaaccaauagacgauagauucgcuacugcgcuaacugccuuaaaugacaugggcaaagugaggaaagauauuccacagugggaaccaaguaaagguuggaaugacuggcaacaggugccauuuuguagccaccauuuccaucaguuaauaaugaaagauggaagggaaauuguaguaccauguagaaaucaagacgagcuaguuggacgagcacgaguaucgcagggggccggauggucuuugagggagacggcuuguuuaggaaaaagcuacgcccagauguggcaauuaauguauuuucaucggagagaucugagacuggcugcaaacgccauauguagugcgguaccaguagacugggucccaaccucgaggacgacauggucuauacacgcucaucaucaauggaugaccacagaagacaugcuaucaguguggaauagaguguggauugaagaaaauccauggauggaggacaaaacgcacauuagcagcugggaagauguaccuuaucuaggaaaaagggaagaccaauggugcggguccuuaauuggguugacggcucgugcaaccugggcuacaaacauacagguggcuauuaaucagguaagaagauugauaggaaacgaaaauuaucucgacuacaugacgaguaugaagagguucaaaaacgagagugacccagagggggcacuuugguaa

SEQ ID NO: 21896 - RNA, 9879 nt, Artificial Sequence
  derived and/or modified CDS sequence (opt6) from DENV-1__EU249492__SS-prME
ucugugacaauguuacuaaugcuaaugccaacggcauuagcuuuccauuuaacaacaagagggggcgaaccacacaugauuguaucgaaacaagaaagagguaaauccuuauuauucaaaacaagugccgguguaaauaugugcacuuuaaucgcuauggaucucggggaauuuugugaagauacuaugacuuauaaauguccucguauuacagaagcagaaccugaugacguagauuguuggugcaaugcuacggauacguggguuacauaugguacgugcucgcaaaccggagaacaccgucgagacaaacguagcguggcacuagcaccgcacguaggucucggauuagaaacgcguacagagaccuggaugaguagcgaaggagcauggaaacagauccaaaggguagaaacgugggcacugaggcacccgggguucacagugauagcacucuuucuagcucaugcaauugguacgucaauuacucaaaaagguauaaucuucauucuucuuaugcugguuacaccaaguauggcgaugagauguguaggcaucggaucuagagacuuuguagaaggacugucaggcgcaacuuggguagauguggugcuagagcacggcucuugcguaaccacaauggccaaagauaaaccaacauuggacaucgaacuacucaaaaccgaaguaacuaacccagcaguacuuagaaaacuuugcaucgaagcaaaaauuucuaacacaacaacagauaguagguguccgacccaaggagaagcaacccuaguagaagaacaggaugcaaacuucguaugucguaggacuuucguagacaggggguggggaaauggaugcggucuuuuuggaaagggaucacuaauaacaugcgcaaaauucaaaugcguaacaaaacuugaaggcaaaauugugcaauacgaaaauuuaaaauauagugucaucguuacaguacauacuggagaucaacaucaaguuggaaacgaaucgacggaacauggaaccacagcgacaauuacaccacaagccccaagcacagagauucaacuaaccgauuacggagcacuaacacucgacugcuccccuagaacuggauuagauuucaacgagaugguacuacuuacuaugaaagaaaaaucauggcuaguucacaaacagugguuucuagaccuaccucuaccauggaccagcggcgccucgacaagccaagaaacauggaauaggcaagaccuccugguaacuuucaaaacagcacacgcaaagaaacaggaagucguuguacucgguucgcaggagggagcgaugcauacagcucuuacaggggcuacugaaauucaaacaucuggaacuacuacaauuuuugcggggcaccuaaaaugucgacugaaaauggacaaacucacccuaaaggguaugagcuacgugaugugcacaggaucuuuuaaauuagaaaaagaaguagccgaaacucaacaugguacuguucuaguucagauaaaauacgaggggacagaugcuccuuguaaaauuccauuuucgacucaagaugagaaaggcgucacccaaaacggaagacuaaucacugcaaauccaauaguaacagauaaggaaaaaccugucaauaucgaagcagaaccgccauuuggggaaaguuacaucgucauaggagcuggagagaaagcgcuaaaacuuuccugguucaagaaaggaagcucuauagguaagauguuugaggcaacagcucgcggcgcuagaagaauggcgauauuaggcgauacggcaugggauuuuggaucaauuggaggagucuucacaaguguuggcaaacugguacaucagauuuucggaacggccuauggugugcuauuuucuggugugaguuggacaaugaagauaggaauaggaguuuuacuaacauggcuaggacuuaauucgcgaucaacgucacuaaguaugacuuguauagcgguaggauuaguaacacuguacuuaggaguaaugguacaggcggacagcggcugcguaauaaauuggaagggccgugaauugaaaugcgguucuggcauuuuugugacaaaugaaguacacacguggacugaacaguauaaguuccaggcagauaguccaaaaagacuaagcgcagcgauuggaaaggcuugggaagagggugucugcgggauaagaucugcaacacgucuugaaaauaucauguggaaacaaaucagcaacgaauuaaaccauaucuuauuagaaaacgacaugaagcuaacuguagucguaggugauguagcgggcauauuggcacaaggaaagaaaaugauaagaccccaacccauggaauacaaauacaguuggaaaucuugggguaaagcaaaaauaaucggagcugauguacaaaauacaacauuuauaauugaugguccaaauacaccagaaugucccgacgaucaacgagcauggaacaucugggaagucgaagacuauggauucggcauauucaccacaaauauauggcucaaauugcgugauucauauacucagaugugugaucaccgucuuaugagugcggcgauuaaagauucaaaagcgguacaugcugacaugggauauuggauagagagcgagaaaaaugagacuuggaaguuagccagggcuaguuucauagaaguaaagacauguauauggccaaaaucacacacgcucuggucaaacggaguuuuagaaucagaaaugauaauaccaaaaaucuacggaggacccauaucucagcauaauuacagacccgguuauuuuacacaaacagcagggccuuggcacuuggguaaauuggaguuagacuucgaucucugugaaggaaccacaguugucgucgacgaacacuguggcaaucgaggacccagcuugcggacaacuacgguaacuggcaagaucauacaugagugguguugcagguccugcacacucccuccguugagauucaaaggagaagacggcuguugguacgguauggaaaucaggccuguaaaggagaaagaagaaaaucuuguaaaaucuaugguaucagcagguucaggagaaguggacucguucucuuuaggccuccuauguauuagcauuaugauugaggaaguaaugcgaagccgauggucaagaaaaaugcuuaugacaggaacacuagcuguguucuuuuugcucaucaugggccaauugacguggaacgaccuuauacgacuauguauuauggugggggccaaugccagcgaucguaugggaaugggaacuacauaucucgcguuaauggcgacuuucaaaaugcggccuauguuugcaguuggacuucuauuuaggcgguuaacgagucgugaaguauuauuacuaacuauuggccucucguuggucgcuuccguagaacuaccaaauucgcuagaagaacugggcgauggucucgcgaugggaaucaugauccuuaaauuauuaacagauuuccaaagucaucagcuaugggcuacacuuuuaucuaugaccuuuauucgaacuacauuuucuuuacauuaugcauggaaaaccauggcaaugguucuaagcauaguuagucuguuuccacuauguuugucuaccacaucgcagaaaacuacaugguuaccagugcugcuaggcucuuuaggcugcaaaccauuaacuauguuuuuaauugcggagaauaaaaucugggggagaaagaguuggccucuuaaugaagggauaauggcagucggaauuguuucuauacuacuuucaucauugcuuaaaaaugauguuccgcuagcggggccauuaauugcgggugguauguuaauugcauguuauguuaucagcggaucaucugcagacuugucuuuagagaaggccgccgaagugaguugggaagaagaagcugagcacuccggcgccucacauaacauuuuggucgaaguacaagaugacggcacaaugaaaauuaaagaugaagagagagaugauacauuaaccauccuauuaaaagcuacccuuuuagcagucucaggaguguacccgcugucaauaccagcaacacuguucgucugguauuuuuggcaaaagaagaaacaaagaagcggaguccuaugggauacaccuucaccuccagaaguacaaagagcuguuuuagacgacggaauuuaucgcauaaugcagagaggguuacuggguagaagccaaguaggaguaggaguauuccaagagaacguauuccauacaauguggcacgugacaagaggcgcaguguuaauguaucaaggaaagcguuuagaaccaucaugggcaagugucaagaaagaucuaaucagcuauggaggaggcuggagauugcaaggcucauggaacacuggcgaagagguacaaguaaucgcgguagaacccgguaaaaaucccaaaaauguacaaacagcaccaggaacauuuaaaacgagugaaggggaggugggagcaauugcacuugacuuuaaaccaggaacuagcggcucgcccauaguuaaucgcgaaggaaagauagugggguuguacggcaacggagucgucacaacauccgggacuuaugugagugcuauagcacaagcuaaggcuucacaagaaggaccacucccggagauagaagaugagguguuuagaaaacggaauuuaacaaucauggauuuacacccggggaguggcaagacacguagauauuugccugccauugugagagaggccaucaaaagaaaacugagaacuuuaauauuagcucccacgaggguaguagcuagcgaaauggcggaagccuuaaagggcaugcccauacgauaccaaacaacggcagucaagagugaacauacaggcaaagaaaucguggaucuaaugugucaugcaacauucacuaugcgacuucugucgccaguacgaguaccuaacuauaauaugauaauaauggacgaagcacacuuuacggaccccucuucaauugcagcgaggggauacauaaguacacgaguuggaaugggcgaagcugcagcaauuuuuaugacagcuacaccuccgggcaguguugaggcuuuuccucaaaguaacgcggugauacaggaugaagaaagggacauaccagaaagauccuggaacaguggcuaugaauggauaaccgauuuuccaggaaaaacggucugguuuguacccucuauaaagagcgggaacgauauugcuaacugucuaaggaaaaauggaaaacgaguaauacaauuguccagaaaaaccuuugacacagaauaccaaaagacuaaaaacaaugauugggauuaugugguaacuacugacauuagugagaugggugcaaauuuccgugccgauagaguuauugauccaagaagaugucuaaagccgguuauucuaaaggauggacccgagcgcguaauauuagcaggacccaugccuguaacaguagcaagugcagcacaacgcagaggacggauugggcgaaaucacaauaaagaaggggaucaauauauauauaugggacagccuuuaaauaaugaugaagaucacgcgcauuggacagaagcgaaaauguuacuagauaauauaaauacacccgaaggaauuauuccagcuuuauucgaacccgaacgugagaaaagugcagcuauugauggugaauauagguugagaggcgaagcucguaaaacuuuuguugagcuuaugaggaggggagauuuacccguauggcuaaguuauaaaguagccucugaaggguuucaauauuccgauaggcggugguguuucgacggcgaacgaaauaaucaaguccuugaagaaaacauggauguagaaauuuggacgaaagagggagagcguaagaagcucagaccccgauggcuagacgcacgcacguacucagauccguuagcauugagagaguucaaggaauuugcagcagggagaaggucggucagcggagaccuaaucuuggaaaucggcaaauuaccccaacauuuaacccaacgugcacagaaugcccuugacaaucucguuaugcuucacaauucugagcaaggggguagagccuaccggcacgcaauggaagaguuaccagauacgauagagacuuuaauguuauuagccuuaauagcaguucuuacaggcggagugacgcuguucuucuugagugguaggggacuaggaaagacaucgaucggacuguuaugcgucauggcuucaaguguacuucuuuggauggccucuguagaaccgcacuggauagccgcuaguauuaucuuagaguucuucuugaugguauuacuaauaccggaaccugaccgucaaaggacgccucaggacaaucaacuagcauauguagugauaggacuguuauucaugauucuaacaguugcugcuaacgaaauggguuuauuagaaaccaccaagaaagauuuagggauugggcaugucgccguagaaaaccaucaucaugcagcuaugcuugauguagaccuacacccggcgucagcauggacucuuuaugcgguagcgacaacaauuauaacuccaaugaugagacauacaauagaaaacacaacggcaaauaucagccuuacagcuauagcgaaucaagcugcaauucugauggggcuagacaaaggcuggccgauaucuaaaauggacauuggaguaccucuauuggcccuaggauguuauucccaggugaacccuuugacauugacggccgcaguacuuaugcucguggcacauuacgcgaucauaggaccaggauuacaagcgaaagcaacucgggaggcccagaaaaggacagcagccgguauaaugaaaaacccaacuguggauggaauaguagcuauagacuuagaccccguuguauacgaugcaaaauucgaaaaacaacucggccaaauaauguuacuaauauuauguacaucacaaauuuuauuaaugaggacgacaugggcuuuaugugaaucuauuacacuagcgacuggaccgcuaacaacacuaugggaagguucccccggaaaauucuggaacaccacgaucgccguauccauggcuaauauauucagaggaucauaccuggcaggagcaggcuuagcauuuucauugaugaaaaguuuaggaggaucgcgucgagguaccggugcacaaggagaaacucucggagaaaaguggaaacgacaacucaaccaacuaagcaagucggaauuuaacacauauaaacgcagcggaauaauggaaguugaucgaagcgaagcaaaggaaggacucaaaaggggagagacaacuaaacacgcaguuagccgagguacagcgaaacuaagaugguuuguugaaaggaaucuagucaagccggagggaaaaguaauagaucugggcuguggaagaggaggguggaguuauuauugugcaggacucaagaaaguaaccgaaguuaaagguuauacgaaagguggcccuggacaugaagaaccaauaccaauggcaacauauggguggaauuuagucaaacugcacagugggaaagauguuuucuuuaucccacccgaaaaaugugacacccucuugugugauauaggagagucuagcccuaauccaacgauugaagaaggucggacacuucgaguauuaaaaaugguagagccuuggcuaagaggaaaucaauuuuguauuaagauacuuaauccauacaugccaucaguuguagaaacucuugagcagaugcaacgaaaacaugggggaauguuagugaggaacccacuuucuagaaauucgacccaugaaauguacuggguuucuugcggaacagggaacauuguuucugccguaaacaugaccagcaggaugcuauuaaaccguuucacaauggcgcauaggaagccuacguaugaaagggacguugacuuaggcgcaggaaccaggcacguagcaguagaaccagaagucgccaaccuugacauuaucggucaacggauagaaaauauaaagcacgaacauaaaaguacuuggcacuacgacgaagauaauccauauaaaacaugggcauaucacggaucuuaugaggugaaaccgagcggaagugcuucgaguaugguuaauggagucgucaagcuacuaacaaaaccuugggaugugaucccuaugguuacgcagauagcuaugacagauacgacaccguucggacagcagagaguauuuaaagaaaagguugacaccagaacuccaaaagcaaagagaggaaccgcgcagaucauggaaguaacggcuaaauggcuuuggggcuuucuuucaaggaacaagaaaccaagaauaugcacacgggaagaauuuacgcgaaagguaaggagcaacgccgcuauaggagcaguuuucguagaugaaaaccaguggaauagugcaaaagaagcaguagaagacgaaagguuuugggacuugguacaccgagaaagggaacuacauaaacaagguaaaugcgcuacgugcguauauaacaugaugggaaaacgagagaagaaauuaggagaguucggaaaggcuaagggaaguagagcaauaugguacauguggcucggugcuagauuucucgaauuugaagcucuuggcuuuaugaacgaagaucacugguuuagcagggaaaauucccuaucuggaguugaaggggaaggcuuacauaagcuaggauauaucuuaagagauauauccaaaauuccugggggaaauauguaugcggaugauacugcugguugggacacccgcauaacagaagaugacuuacaaaaugaagcaaagauaacugauauaauggaaccugaacaugcacugcuugcuaaaaguauuuuuaaguuaacauaccaaaacaaaguaguacgaguacaaagaccagcaaagaauggaacaguuauggacguuaucaguagaagggaucaaagaggaagcggucaaguaggaacuuauggacuaaauaccuuuacaaauauggaagcacagcucauucggcaaauggaaucugaaggaaucuucaguccuagcgagcuugauacaccaaauuuagccggaaggguauuagauuggcuggaaaaacauggaguugaacgccuaaaaagaauggcaauuucuggcgacgauuguguuguaaaaccaauugaugaccgauuugccaccgcacugaccgcccuaaaugauauggguaaagugagaaaggacauaccucaaugggaaccuaguaaagguuggaaugacuggcagcaaguaccauuuuguucacaccacuuucaucaacuuauuaugaaagacgggagagagauaguugugccuugucggaaccaggacgaacugguugggagagcucgugugucgcaaggagcgggauggucccucagagaaacagcaugucugggcaaaucauaugcccaaauguggcaguuaauguauuuucacaggagagacuugcgguuagcggccaaugcaauauguucggccgugccaguagauuggguaccuacaagcagaacuaccuggagcauacacgcucaucaucaauggaugacaacagaagauaugcuaaguguauggaaucgaguauggauugaagaaaacccauggauggaagacaagacccauauaucaucguggggagacguacccuaucuagguaagcgagaagaucaguggugcgguucacucauagggcuuacagcaagagcgacuugggcaaccaacauacaagucgcaauuaaccaaguucgacgccuccuggguaaugaaaauuaucuagacuauaugacaucaaugaaacgcuuuaagaaugaaagcgguccggaaggagcucugugguga

SEQ ID NO: 21897 - RNA, 9879 nt, Artificial Sequence
  derived and/or modified CDS sequence (opt6) from DENV-1__EU249493__SS-prME
agcguuacaaugcuccuuaugcuuaugccaacagcucuugcauuucaucuaacuacgcgaggaggugaaccccauaugauagucucaaaacaagaacgcggaaagucauuacuauucaaaacaagcgcgggaguuaauaugugcacacuuaucgcaauggaccucggugaauuuugcgaagacacaaugacauauaaauguccaagaauuacagaagcagagccugacgaugucgauugcugguguaaugcgacagacacaugggucacauauggaaccuguucacaaacaggggaacaucguagagacaaaagaucggucgcccucgcgccgcaugucggacuuggacuagaaaccagaacagaaacauggaugucuagugagggagccuggaaacaaauucaacguguugagaccugggcgcuucgacauccuggauucacaguaauugcucuauuucuagcgcaugcaauaggaaccaguauuacgcagaaaggaauaaucuucauacucuuaauguuggugacaccaagcauggcgaugcgauguguagguauugggagcagggauuuuguagaaggacucucaggagcaacguggguagauguggucuuagaacacgggaguuguguaacuacaauggcgaaagacaaaccaacauuagauauagaauuguugaaaacugagguaacuaacccagcuguauuaaggaaacuauguauugaagcaaagaucagcaauacaacuaccgacagccgauguccaacucagggagaagccacucuagucgaggaacaagacgccaacuuuguaugucgcaggacuuuugucgauagagggugggguaacggaugcgggcuauuuggaaaaggaucccuuauuacaugugcaaaguuuaaguguguuacaaaauuagaaggaaaaacaguucaauaugagaacuugaaguauuccguuauuguaacaguacauacgggcgaccaacaccaaguugggaacgaaucaacugaacauggaacgacagcuacuauaacaccucaagcucccuccaccgaaauacagcuaacggauuauggcgcgcuaacacuugauuguucuccgcgaacaggacuagauuucaaugaaaugguacuucuuacaaugaaggaaaaaucauggcuugugcacaagcagugguuuuuagaccuaccauuaccauggacuagcggggcuagcacgucacaagagacuuggaaucguaaagacuuauuagucacauuuaaaacagcccaugccaagaagcaggaaguagucguauuaggcucccaagaaggagcgaugcauacagccuuaacgggagcuacagaaauacaaacuucugguacaacuacuauuuuugcuggucauuuaaaaugucggcugaaaauggauaaauuaaccuuaaaagggaugucauaugugaugugcacaggaucuuuuaaacuugaaaaggagguagcggagacccaacaugguacaguucuaguacaaauaaaauaugaaggaaccgaugccccguguaaaauaccauuuagcacacaggacgagaaaggagugacgcagaacggaagauuaaucacagcuaauccaauaguuacagacaaagaaaaacccguaaacauugaagcugagccacccuucggugaaucuuauauuguaaucggugcuggagaaaaagcauuaaaauugucgugguucaagaaagggucuuccauagguaaaauguuugaggcaacagcgcggggagcgcgccgcauggcaauacuaggugauacagccugggauuuuggaucgauugggggcgucuuuacgagcguuggaaagcucguccaccagaucuuuggcacagcauacggaguacuauuuucagguguguccuggacgaugaagaucggaauagggguguuauugacaugguuaggacuuaauagcagaaguacgucacuauccaugacuuguauugcaguuggcuuagugacuuuauaccuuggagucaugguucaagcagacucuggcugcguaaucaauuggaagggaagagaauuaaaauguggauccgggauauucguuacgaaugaaguccacacauggaccgagcaauauaaguuccaagcugauagcccgaaaagacuaucugcagcaauaggaaaggccugggaggaaggagugugcggaauacgaagugcuacuagacuggaaaauauuauguggaaacaaauuagcaacgaguuaaaucauauauuauuggaaaaugauaugaaauuuacaguagucguuggugauguggcagggauccuagcacaaggcaagaaaaugauaagaccucaaccaauggaauauaaguauagcuggaaaaguugggggaaggcaaagauaauuggcgccgacguccagaauacuacauuuaucaucgauggcccaaacacaccggaaugcccagacgaucaacgagcauggaauauuugggagguugaagauuauggauucggaauuuuuacaacuaauauauggcucaaacugagggacucauacacccaaguuugcgaucauagauugaugucagcggcgauuaaagacucgaaagccguacaugcggauaugggguacuggauugaaagugagaaaaaugaaacauggaagcuggcuagagcaucguuuauugagguuaaaaccugcaucuggcccaaaucacauacuuuauggucgaacgguguccuugaaucagaaaugauuauaccgaaaauauauggagggccaauuucacaacacaacuaucgccccgguuauuucacgcagaccgccggaccuuggcaucuuggcaaacuagagcuagauuuugacuuaugcgaaggcacaacaguaguuguugacgaacauugugguaaucgaggucccucucucaggacaacgaccgugaccggaaaaauaauccacgaauggugcuguagaucuuguaccuugccuccucuuagguucaaaggagaagauggcuguugguaugggauggaaauuaggccuguaaaagaaaaagaagaaaauuuaguaaaaucuaugguaucggcagguucaggggaaguggacagcuucucacuagguuuacuuugcauaaguauaaugauugaagaaguaaugcgaaguagauggucaagaaagauguuaaugacagggacacuagcagucuuuuuccuucucaucaugggacaacucacauggaacgacuuaauuaggcuuugcauaaugguaggagcaaacgcuagcgauagaaugggaaugggaacuaccuauuuagcacuuauggcuacuuuuaaaaugagaccaauguuugcgguuggccuacuguuuaggaggcuuacgaguagggaaguccuauuacucacaaucggacuaucgcuggucgcaucaguagagcuucccaacucauuagaagaacugggugacgguuuagcgaugggcauaaugauauugaaacuauuaacagacuuucaaucacaccaauuaugggcgacuuuauuaucacuuacguuuauaaagacaacguuuuccuugcacuaugccuggaaaacaauggcuaugguacugucgauaguaaguuuguuucccuuauguuuaucaacuacaucacagaaaacuacaugguuaccgguccuucuggguuccuuaggcuguaaaccuuugacaauguuccuaauugcagaaaauaagauauggggaagaaagucauggccguuaaaugaggggaucauggcaguuggcauaguaaguauucuguuaaguagccuucuuaaaaaugauguaccacuagcgggcccauuaaucgcgggaggcaugcuaauugcuugcuacgugauuucaggaucuagcgcggauuuaucucuagaaaaagcagcagaaguuucaugggaggaggaagcagaacacaguggagcaucccacaauauccuuguagaaguucaagaugacggaaccaugaaaauaaaggaugaagaacgagacgauacucuuacgauacuccuaaaagcaacguugcuugcagucaguggaguauauccguuauccauuccugcuacacuuuuuguuugguauuuuuggcagaagaagaaacagaggucuggagugcugugggauaccccaucuccaccagaggucgagagagcaguucuagaugacgggauauauaggaucaugcaacgcgguuuauuggggcgcucccaaguaggaguaggagucuuccaagaaaacguauuccacacaauguggcacguuacucguggcgccguacuuauguaucagggcaaaaggcuagagccaucuugggcuaguguaaagaaagaucuaaucucauauggaggaggguggcguuuacaagguagcuggaauacaggcgaggagguacaagugauugcgguugagccuggcaaaaaucccaaaaacgugcaaacagcacccggaacauuuaaaacaagcgagggggaagucggggcgauagcguuagauuucaaaccaggcacaucaggcucuccaauuguaaaucgugagggcaagauagucggacuuuauggcaaugguguagugacgacaaguggaacuuacgugagugcgauugcgcaagcgaaggccagccaagaaggaccguugccagaaauagaggaugaaguuuuccgaaagagaaacuuaaccauaauggacuuacauccagguucggggaaaacaagacguuauuuaccggcuaucguaagagaagcuauuaaacgaaaacuaagaacacuaauacuagcaccgacaagggugguagcaucagaaauggccgaagcucuuaaaggaaugccgauaagauaccaaacuacugcagugaaauccgagcauacggguaaggagaucgucgaucugaugugucaugccaccuuuaccaugagauuauuaaguccgguccgcgugccuaauuauaauaugauaauaauggaugaggcacacuuuacugacccaucaucuauagcagcaaggggauauaucucaacaagaguagguaugggugaggcggcugccauauuuaugacagcaacacccccaggaagcgucgaggcauuuccacaauccaacgcaguaauacaagacgaggagcgcgauauaccagagaggucuuggaacucaggauacgaauggauaacugauuucccugguaaaacaguaugguucgugccuagcauaaaaagugguaaugacauugcuaauuguuuacgcaaaaauggaaaaagaguuauucaacuuagcaggaaaacguuugauacugaauaucagaaaacuaaaaauaaugauugggauuauguugugacaacagacaucagcgagaugggugcaaauuuucgcgcagaucgagugauugauccacgacgaugccuaaagccgguaauuuuaaaagacggaccggaaaggguaauucuggcuggcccaaugccaguaacaguggcuagcgcggcacaaagacguggcaggauaggcagaaaucacaauaaagaaggcgaucaauacauuuauaugggccaaccacugaacaaugacgaagaccaugcacauuggacggaagcuaaaaugcuacuagacaacaucaauacuccggaaggcauaauaccugcacucuuugaaccagaaagagagaaaagugcagcgauagacggagaauacagauuacgaggcgaggcuagaaagacauuuguagaacuuaugagacggggagacuugccgguguggcuuucauauaagguagccagcgaagguuuccaauauagugaucgucgcugguguuucgauggugaacgcaauaaucaaguccuagaagaaaacauggauguugaaaucuggaccaaagagggagagagaaagaaauuacgcccuaggugguuagaugcgagaaccuacagugauccucuagcacuuagggaguucaaagaauuugcagcagggcguagaaguguaucaggcgaccuaauacuugaaauagguaaauugccgcagcaucucacgcaacgagcucaaaaugccuuggacaauuuaguuauguuacacaauuccgaacagggagggagagcguauagacaugcaauggaagaauugccggauacgauagaaacccugauguuacucgcuuuaauagcagucuugacaggaggaguuacccuauucuucuuaagcggaagaggccuaggaaaaacuuccauaggucuguuaugcguaauggcaucaucgguacugcuauggauggcaucugucgaaccccauuggauagcugcaucaauaauacuagaguucuuuuugauggugcuacuuauaccagaaccugaucgucaacggacuccacaagauaaccagcuugcauauguuguaauuggguuacuguuuaugauauuaaccguggcugcaaacgaaaugggacuacucgaaacaacaaagaaagaucuaggcauaggccacguagccguagaaaaucaucaccaugcagcaaugcuagauguagaucuacaccccgcuagugcguggacgcuuuacgcaguugcaacuacaauaaucacccccaugaugagacacaccauagagaauacgacagcaaacauaucacuaaccgcgaucgcaaaucaagcagcaauuuuaaugggccucgacaaaggguggccaauuucgaaaauggauauugguguaccgcuauuagcguugggauguuacucucaaguaaacccgcuuaccuuaacagcagcgguauugaugcuaguggcacacuacgcaauaaucggacccgguuugcaagcaaaagcaacacgagaagcacaaaagcggacugcggcuggaaucaugaagaacccaaccguagauggcauaguagcuauagaccuagaucccguaguauacgaugcaaaauuugaaaaacaacuaggacaaauaaugcuauuaauacuauguacuucgcaaauucuucuaaugcggacuacuugggcauuaugcgaaucgauuacucuggcaacuggaccacuuacuacguuaugggaaggaagccccgguaaauucuggaauacuacgauagcgguuuccauggccaacauuuuuagaggaucguaucuagcaggagcuggacucgcauucucacucaugaagucauugggugggggacgaagagguacgggugcgcagggugaaacacuaggcgagaaguggaagaggcaauuaaaccaauuaaguaagucagaguucaauacauauaaacgaucggggaucauggaaguagauaggagcgaggcaaaggaggggcugaagcgcggcgagacaacaaaacaugcagucagucgagguacagcaaaauuaagaugguucguugagcgaaaucuugucaaaccagaaggcaaagugauugaccuagguuguggcagagguggauggaguuauuauugugcaggacucaagaaaguaacugaagugaaggguuauacgaaagguggcccuggacaugaggaaccuaucccaauggcuacuuauggauggaaucuuguaaagcuacacucagguaaagacguuuucuuuauuccgccagaaaaaugugacacacuuuuaugugacaucggcgagagcagcccaaacccaacaaucgaggaaggucgaacauugaggguacuaaaaaugguagagccuugguuacgaggaaaccaguucugcauaaaaauacuuaacccguauaugccaucaguagucgaaacauuggaacaaaugcaaagaaaacauggaggcauguugguacgaaacccauugagccgaaacuccacacacgagauguacuggguaucauguggaacaggaaauauuguguccgcagugaauaugacaucaagaauguuacuuaacagauuuacaauggcccauagaaagcccacauacgaaagagaugucgacuugggagcgggaacccggcauguagcgguagagccugaaguggcuaaucuugauauuauagggcaaagaaucgaaaauauuaaacaugaacauaagucuaccuggcacuaugacgaagauaacccauauaaaacuugggcuuaccauggcucuuacgagguaaaaccuucugguagcgcaaguagcauggucaacggaguagucaaauugcuaacuaaaccaugggaugucaucccaaugguuacacaaauugcaaugacugauacuacuccauucggucaacaacgcguuuucaaggaaaagguggauacaaggacacccaaagcgaaacggggaacagcccaaauuauggagguuacugccaagugguugugggguuuucuaucccgaaauaaaaagccgaggaucuguacacgcgaagaguuuacuagaaaagugcgaagcaacgcugcaauuggcgcuguauucguagaugagaaccaauggaacuccgcuaaagaagcgguagaggacgaaagauucugggauuugguucacagagagcgagaacuacauaagcaagggaaaugcgcaacaugcguguacaacaugaugggaaaacgagagaagaaacuaggagaguucggaaaagccaaaggaaguagagccaucugguauauguggcuuggagccagauuuuuagaauuugaagcucuaggcuuuaugaaugaggaccauugguucaguagagaaaacuccuuaucgggaguggaaggggaaggauuacauaaacuuggauacauacugagggacauaaguaaaauuccugguggcaacauguacgcugacgauacugcgggaugggauacacguauaacagaagacgacuugcaaaaugaagcaaaaauaaccgacauaauggaacccgaacaugcgcuauuggcuaagaguauauucaaacuuacguaucaaaacaagguggugagaguccaacggccugcuaaaaacggcacuguuauggauguuauaucuaggagggaucaaagagggaguggacaagugggaaccuacggucucaauacauuuacaaauauggaagcacaguuaauucgacagauggaguccgaaggaauuuucagucccucagaacuagaaacuccuaaucuugcuggcagaguuuuggauuggcuugaaaaacacggaguugaaaggcucaaacgaauggcaauuaguggugaugauugcgucgugaaaccaauugacgaucgcuuugcgacagcauuaacagccuuaaaugauauggggaaggucagaaaggacauaccucaaugggaaccaaguaaagguuggaaugauuggcagcaaguaccguuuuguucucaccauuuucaccagcugauuaugaaagacggccgcgaaauuguuguuccuuguagaaaucaagaugaguuaguugggagagcaagaguuucacaaggugcgggcuggucauugagggacacugcaugucuugguaaaaguuacgcccaaauguggcaguuaauguacuuccaucgcagagauuugagguuagcagcgaaugcaauuuguuccgcuguaccgguagacuggguuccaacaucaaggacaacuuggucuauacaugcccaucaccaguggaugacaacagaggacaugcuaucuguguggaauaggguuuggauagaagaaaaccccuggauggaagauaaaacccauaucucuaguuggggcgauguaccauauuuagggaaaagagaagaccaaugguguggaucucuaauuggucuaaccgcucgagcaaccugggcaacuaauauucagguugcaauuaaccaaguucgacguuuaauugguaaugaaaacuaccuagacuacaugacguccaugaagcguuuuaaaaaugaaagugaucccgaaggagcauuaugguaa

SEQ ID NO: 21898 - RNA, 9879 nt, Artificial Sequence
  derived and/or modified CDS sequence (opt6) from DENV-1__EU249494__SS-prME
uccguuacuauguugcugaugcuuaugccaacugcucuugcauuccauuuaacaacacguggaggugaaccacacaugauuguaacgaaacaagaaagagguaaaucucugcuguucaaaacaagcgccgguguaaauaugugcacacuuauugcaauggacuugggagaauugugugaagauacaaugaccuacaaauguccucguauaacagaagcagagcccgacgauguugauugcuggugcaaugcgacagacacaugggucaccuauggaacaugcucacaaacuggagagcauagacgugauaaaagauccguagcacuagcuccgcauguaggccuaggucuagaaacacgaacagaaacauggaugucaucagaaggggcauggaaacagauccaaagaguagagacaugggcuuuacgacauccagguuuuacuguaauagcccucuuucuugcucacgcaauuggaacguccauuacucaaaaaggaauaauuuuuauuuuacuuaugcuagucacucccucaauggccaugagguguguagguauaggaucucgagacuuugucgagggucuaucgggagcaacgugggucgauguaguauuggaacacgggagcuguguuacaacuauggccaaagacaaaccaacucuagacauagaauuacuaaaaacagaaguaacaaaucccgcaguucugaggaaacucugcauagaggcaaaaauuuccaacacuacgacagacagcagauguccaacacaaggugaagccacacuaauggaggagcaagaugcuaauuuuguuugccggagaacauuuguagacaggggaugggguaaugguuguggcuuauucgggaaagggagucuaauaaccugugcaaaauucaaaugugucacaaaacuagaagguaaaauaguacaauaugaaaacuuaaaauauucugucauaguaacaguccauacaggugaucaacaccaagugggaaaugaaaguacggagcacggcacaacagccacaauuacaccccaagcaccaacaagcgaaauucaacuuacugauuauggugcacuuacacucgauugcuccccucggacugguuuagauuuuaaugaaaugguucuauugacaaugaaagaaaaaucguggcuuguccacaagcaaugguuucucgauuugccacugccguggacgagcggugcaaguacgucgcaggaaacuuggaacagacaagaccuauuaguuacuuuuaaaacagcccacgccaagaaacaagaaguugugguacucggaagccaggaaggugcaaugcacacggcucucacaggagcaaccgaaauacagacauccgggaccaccaccauauuugcugggcacuugaaguguaggcucaaaauggauaaacugacauuaaaaggcaugucauauguuauguguacagguagcuuuaaacucgaaaaggaggucgccgaaacucaacaugggacaguuuugguccaaauuaaauaugaaggaacagaugcucccugcaagauuccauuuucuacgcaggaugaaaagggagugacacaaaauggacgauuaauaacggcgaauccaaucguaacagauaaagagaaaccuguaaacauugaggccgagccgccauucggugaaucuuacauagucauuggagccggcgaaaaagcgcuaaagcucucaugguuuaagaaaggaagcucgauuggcaaaauguuugaagccacggcaaggggagcgagaaggauggcuauccugggagauacagcuugggauuuuggauccauaggcggaguauucacuucugugggaaaguuagugcaucaaauauuuggaaccgcauaugggguucuuuuuaguggaguaucauggacaaugaaaauagguauagggguauuacuaacuugguuaggacuaaauagucguucaacaagucuuaguaugacuugcauagcgguagggcuaguaacucuguacuuaggugcgaugguacaggccgacucggggugugucauuaauuggaaagguagagaauugaaauguggaucuggaauuuucguaacaaacgaagugcacacauggacggagcaguacaaauuucaagccgauuccccaaaaagacucagugcagcaauugguaaagcaugggaagaagggguaugcgguauccguucagcuacgagacuggaaaauauuauguggaaacaaaucaguaaugaacuaaaucacauuuuauuggaaaacgauaugaaauuuacuguuguagugggugaugugguuggaauauuggcucaaggcaagaaaaugauaagaccgcaaccuauggagcauaaauauucuuggaaaaguuggggaaaagcaaaaauaauaggugccgauguacaaaauaccaccuuuauaaucgacgguccaaacacuccugagugcccugacgaccaacgagcauggaauauuugggaaguagaagauuauggauuugguauauuuacuacuaauaucugguuaaaacuucgagauucuuauacucaggucugugaccauagacugaugucggcugcaauaaaggacucuaaggcaguccacgcagauaugggauacuggauagaaagugagaaaaaugaaacauggaaacucgcaagagcaucguuuauugagguuaagacaugcauauggccaaaaagccauacucuuuggucuaauggagugcuagaaagcgaaaugauuauuccaaaaaucuaugggggaccaauaagucaacauaauuaccgcccaggauauuucacccaaacggcagguccguggcaccucggaaaacuugaacuugacuuugauuuaugcgaaggaacuacuguaguaguugacgaacauugugguaacagaggaccaucgcuccgaaccaccaccgucacuggaaaaauaauccacgaaugguguugccguucuuguacauuaccuccacuacguuucaaaggcgaagaugguuguugguacggcauggaaauuagaccuguuaaagaaaaggaggaaaauuuaguaaaaucaauggugucggcagguagcggcgaagucgacaguuuuucucuagguuuguuguguauaucgauaaugauagaagaggucaugagaaguaggugguccaggaaaauguugaugacgggaacucucgcagucuuuuuacuguuaauaaugggucaguuaacuuggaaugauuuaauacgucugugcauuaugguaggggcuaaugcaagcgaccggauggguauggguacuacauacuuagcauuaauggcaaccuuuaagaugcggccuauguucgccguaggguuauuauuucggagauuaacaucaagagaaguguuauuacuuacuauaggacuaagccucguagcaaguguagaguuaccuaacaguuuagaggaauuaggugauggauuagccauggggauaaugauucuaaaacuuuugacagauuuccaaucacaucagcuuugggcuacucuucugagucuaacauucauuaaaacaacccugucauuacauuaugcuuggaagacaauggcuaugguuuuaagcauagugucuuuauuuccguuguguuuaaguacaacaagccagaaaacuacauggcugccaguacuguuaggcagucuagguugcaaaccacucaccauguucuuaauugcagaaaauaagauauggggaagaaaaaguuggccuuuaaaugagggcauuauggcgguugggguaguaaguauauuguuaucaucccuacucaaaaaugauguuccauuggcugguccacuuauagcuggaggaauguuaaucgcuuguuauguaaucucaggaucaagcgcagaccuaucuuuagaaaaagcagccgaagucucaugggaagaagaagcagaacauaguggggccucccacaacauacugguugagguucaagaugacgguacaaugaaaauaaaagacgaggaaagagacgacaccuuaacgauacugcuuaaagcuacauuacuagcaguuucagguguuuacccauugucgauuccagcuacacuuuucguaugguauuuuuggcagaagaagaaacaaagaucuggagucuugugggacacaccaagucccccagaagucgaacgagccguauuagaugacggaauuuaucgaaucaugcagagaggauuacuagggagaagucagguagguguuggaguuuuucaagaaaauguauuccacacaauguggcauguuacuaggggagcugugcuaauguaccaaggaaaaaggcuagaaccaucuugggcgaguguuaaaaaggaucuuauauccuauggaggggguuggagauuacagggaaguuggaacacuggggaagaaguucaaguaauugcagucgaaccggguaaaaaccccaaaaauguccaaaccgcuccgggaacauuuaaaacucccgagggagaaguaggagcaauugcuuuagauuuuaagccaggaacauccggaucuccaaucguaaaucgagagggaaagauugucggacuuuacggcaaugggguaguaacuacuucgggaacuuacgugagcgcaauagcacaggcuaaggcaagccaagaaggaccgcuaccagaaauagaagaugaaguauucagaaaaagaaaucuaacaaucauggauuuacaucccgggucaggaaaaacuagacgguacuuaccugccauaguacgagaagccaucaagagaaaauugagaaccuuaauacuagcacccacuagaguuguagcuucagaaauggcugaggcuuuaaaaggaaugccuauuagauaucagacaacugcaguuaagucugaacauacagguaaggagauaguagaucuuaugugucaugcaacauuuacaaugagguuacuuaguccaguacggguucccaacuacaauaugauuauaauggaugaggcccauuuuaccgacccaaguagcauugcagccagaggauauauaaguacaagaguggggaugggagaagcggcagcuaucuucaugaccgcuacacccccuggaagcguagaggcauuuccacaaagcaaugcggugauccaagaugaagaaagagacaucccugaacgaucauggaacuccgguuaugaguggauaacggauuucccgggaaaaacaguaugguuuguaccgaguauuaaauccggaaaugacauugcuaauugucuaagaaagaaugguaaaagaguaauacaauuauccagaaaaaccuuugacacugaauaucagaaaacgaaaaacaacgacugggauuacguugucacaaccgacaucuccgaaaugggagcaaacuuuagagcagauagaguuauugauccaaggcggugucugaaaccggugauuuuaaaagacggucccgagcgaguuauacuugccggacccaugccuguaacaguagcuucggcagcacagcgucgaggaaggauaggacgaaaccauaacaaggaaggagaucaauauauuuauaugggccaaccacuuaacaacgacgaggaucacgcgcauuggacagaagcuaagaugcuccucgauaauauaaauaccccggaggggauaauccccgcgcuuuucgaaccagaaagagagaaaucugccgcuauugauggagaguacagacuaagaggggaggcaagaaagacauucguagaacuaaugcguaggggagaucuaccgguaugguuaaguuacaaggucgcaagugagggcuuucaguauucagaccgacguuggugcuuugauggcgaaagaaacaaccaaguacuugaagaaaacauggacguagaaauuuggacuaaagaaggugaacguaaaaagcuacguccgcgauggcuagacgccaggaccuauucagauccguuagcucuaagagaauuuaaagaauuugcugccggacgacgcuccgucagcggagaucuaauuuuggaaauuggcaaauugccucagcacuugacacaaagagcucaaaacgccuuagacaauuuggucaugcugcacaauuccgagcaagguggacgggcguauagacacgcuauggaagaauugccggauaccaucgaaaccuugaugcuuuuagcacucauagcaguacuaacaggcggugugaccuuauucuuucugucaggacgagggcuagguaaaacgaguauaggccuucuuugcgugauggcaaguucuguacuacuuuggauggcaaguguggaaccacacuggauagcagcaaguaucauucuagaguucuuuuuaauggucuuguugauaccagaaccagauaggcaacgaacgccacaagauaaccaauuagcuuacguagugauugguuuauuauuuaugauacucacaguagcagcaaaugaaaugggucuguuggaaacaacuaagaaagaucucgguauuggucauguugcaguagagaaucaucaccacgcuacgaugcucgauguugaucugcaucccgcgagcgcuuggacccuauacgcgguugccacuacaaucaucacgccuaugaugcgccacacaauugaaaauacaacagcgaauauaagccuaacugcgauagcgaaccaggcagcuauacugauggguuuggacaaaggauggccuauaagcaaaauggacauuggaguaccgcuacuagcauugggguguuacagccaaguaaauccuuugacacuaacugcugcaguguuaauguugguggcgcacuacgcaaucauugguccgggacuacaagcuaaagcaacaagggaagcacagaagcguacagcagcggguauuaugaaaaauccgacaguugacggaaucguggcgauagaucuugaucccguaguuuacgacgcuaaauucgaaaaacaauugggacaaauuaugcuauugauucuaugcacgucucaaauacucuugaugcggacgacaugggcgcuuugugagagcaucacauuggcaacggguccccuuacuacgcuaugggaggguuccccagggaaauuuuggaauacaaccauugcuguaucuauggcaaacauauuuagaggaagcuacuuagcaggagcaggccuagccuuuagucuuaugaagucguuggguggugggcgacgaggcacgggcgcucaaggugagacgcuaggggaaaaguggaaacgacaauuaaaucaauuaucuaaaucggaauuuaacaucuauaaaagaagcgguaucauggaagucgaucgaucagaggcuaaggagggguugaagagaggagaaacgacacgccaugccgugucgagaggaacagcaaaacuaagaugguuugucgaacguaauuuaguuaagccagagggaaaggucauagauuugggcugcggaagaggcggauggucuuacuauugcgcaggacuaaagaaaguaacagagguaaagggauauaccaaaggaggacccggccaugaagaacccauuccgauggccacauauggguggaaucucgugaaauugcacucgggaaaggauguuuucuuuacuccacccgaaaaaugugauacuuuacucugcgacaucggagaauccaguccuaacccaacgauagaagaaggcaggacacuuagaguuuuaaaaauggucgaaccauggcuaagaggaaaccaauucuguauuaagauucuuaauccauacaugccuuccgugguagaaacccucgaacaaaugcaaagaaagcacggcggaaugcuaguaagaaauccacuaucucgcaacaguacccaugaaauguauuggguaucauguggcaccggaaauauuguuagugcagucaauaugacaucucgaaugcuucucaauagguuuacuauggcgcaucgaaaaccuacuuaugaaagagauguggacuuaggugcuggcacgcgucacguagcuguugaacccgaaguagccaauuuagauauaauagggcaaagaaucgagaacauuaaacaugagcacaaaucaacuuggcauuacgacgaagauaacccguacaaaacaugggccuaccacgguucguacgaaguuaagccuucagguuccgcgucaucaaugguaaauggagucguuaaauuauugaccaaaccaugggauguuauaccaaugguuacgcaaauagccaugacagauacuacaccauucggucaacaaagggucuuuaaagaaaaaguggauacgagaacuccaaaagcaaagagaggaacggcccagauuauggaaguaacagccagauggcuuuggggguuuuugaguaggaacaaaaagccgcggaucuguacaagagaagaguucaccagaaaaguaagaucgaacgcugccauuggagcuguguuuguagacgaaaaucaauggaauagcgcaaaagaagcggucgaagaugaaagauuuugggaccuuguucaaaaagaaagagaacuucacaaacaagguaaaugcgcgacaugugucuauaauaugaugggaaaaagagagaagaagcugggagaauuuggaaaagcgaaagguucccgggcgauuugguacaugugguugggcgccagauuuuuagaguuugaagccuugggauucaugaaugaagaccacugguucucaagagaaaauucucuuaguggaguagaaggagaggguuuacacaaacuugguuauaucuuaagagauaucucuaaaauacccgguggaaacauguaugcagacgauaccgcuggaugggauacaagaauaacugaggacgaccuucaaaaugaagcaaaaauaaccgauauaauggaaccugaacaugcguugcucgcgacaucgauuuucaaauuaacuuaccagaauaaaguaguacggguacaacggccagcaaagaauggaacggugauggauguuaucagcagaagagaccaaagggggucgggucaaguuggaacauauggcuuaaauaccuuuacgaacauggaagcacaauuaauccggcaaauggagagcgaagggaucuucucaccuucagaauuagaaauaccaaauuuagccgaaagaguacuugauugguuagagaaguacggaguggaacgacuuaaacgaauggcaaucagcggagaugauuguguagucaaaccaauugaugacagguucgcaacagcccugacugcccuaaaugacauggguaaggugagaaaagauguuccacaaugggaaccgucuaaaggauggaaugauuggcaacaaguuccauucuguagccaucacuuucaccaauuaauaaugaaagauggccgugaaaucgucguaccguguagaaaucaagaugaacuugugggucgagcuagagucagucaaggggcgggguggagccuacgggaaacggcgugucuuggaaagucuuaugcgcaaauguggcaacugauguacuuccacaggagagacuuacgauuggcagcuaacgccauuugcucagcagucccaguagacuggguacccacaucgcggacaacguggaguauacaugcgcaucaucaauggaugacaacggaggauauguuaaguguauggaauagaguauggaucgaagaaaauccauggauggaagacaaaacacacguaaguucuuggggagacguaccguaccuagguaaaagggaagaucaaugguguggcagccuaauaggauuaacagcacgggcaacaugggcaucaaauauacagguggcuaucaaccaaguaagaagacuuaucggcaacgaaaauuaucuagauugcaugacaucaaugaagagauuuaagaacgagggugacccagagggggcacuaugguaa

SEQ ID NO: 21899 - RNA, 9879 nt, Artificial Sequence
  derived and/or modified CDS sequence (opt6) from DENV-1__EU249495__SS-prME
aguguuacgauguuacuuaugcuuaugccuacagcacuugcuuuccaccuaacaacuagagggggagaaccacauaugaucgugacaaaacaagaaagaggcaaaucguuacucuucaaaacgacagccggugugaauauguguacccuaauagcaauggaucuaggugaacuaugugaagauaccaugacauauaaaugcccccguauuacagaagcggaaccggacgaugucgacuguugguguaaugcuacugauacauggguaacauacggaaccuguucucaaaccggagaacauagacgagacaaaagauccguugcacuugcaccccacguaggucuggggcuugaaacuagaacagaaacauggaugagcucugaaggugcuuggaaacaaauucaacgugucgaaacuugggcgcuacgucacccuggguuuacggugaucgcacucuuucucgcucaugcaauuggcacaaguauaacucaaaaagggauuaucuucauauugcuuaugcuuguaacucccucaauggcaaugcgaugugucggcauaggaucacgggauuuuguggaaggccuaaguggagcaacauggguugacgucgugcuagaacauggcaguugcguaacuacuauggccaaagauaaacccacucucgauauagaauugcuaaaaacagaaguuaccaauccagcaguccuaagaaaacuuuguauugaagcaaaaaucuccaacacaaccaccgauucaagaugccccacccaaggagaagcaacuuuaauggaggagcaggacgcaaauuuugugugccgaaggaccuuuguagaucgagguugggggaauggauguggucuuuuuggcaaaggaucgcuaaucacuugugcuaaauuuaaaugugugaccaaguuagaaggaaagauagugcaauaugaaaaucucaaauauagcguaauuguaacuguacauacaggagaccaacaucagguuggcaacgaaaguaccgaacaugguacaacagcuacuauuacuccacaagcacccacaucugagauacaacuaaccgacuacggugcauuaacucuggacuguucuccucgaacuggcuuagauuuuaaugaaaugguauugcuuaccaugaaggagaaaucauggcuaguccacaaacaaugguuucuagaccugccccuaccguggaccucaggugcuaguacaucacaagaaaccuggaaucgucaggauuuauugguaacguucaaaacagcucacgcuaagaaacaggagguuguugugcuuggcagucaagaaggcgcuaugcauacugcauuaacaggugcaacagaaauucagacaucgggaacuacgacaauauuugcagggcacuuaaaauguagacuaaagauggauaaacuuacguugaaaggaaugagcuauguaauguguaccggauccuuuaaacuagaaaaagaaguagcggaaacucagcaugguacgguauuaguccaaauaaaauaugagggaaccgaugcaccuuguaaaauacccuuuucuacacaggacgagaaaggcguaauucagaacgguaggcuaauaacagcgaauccuauuguaacagauaaagaaaagcccgucaacauugaagcugaaccgccuuuuggggaguccuacauaguuaucggaguuggagaaaaagcucuaaagcuaagcugguuuaaaaagggauccaguauagguaagauguuugaagcuacagcaaggggagcucgcagaauggcaauuuuaggugacacagcgugggauuuugggucaauaggcggagucuucacuucggugggaaaguuaguccaccagauauucgggacagcauacggaguauuauuuagcgggguaucguggacgaugaaaaucggaauagguguauuacuaacuuggcucggauuaaauagccggaguacaagccuaaguaugacuuguauugccgucgggcuuguuacguuguaucuuggggucaugguucaagcagauucuggauguguuauuaauuggaaaggaagagagcuaaagugcggaucagguauuuuugugacuaaugagguacauacuuggacugaacaauauaaauuccaggcagauaguccuaaaaggcucagcgcugccauagggaaggcaugggaagaagguguaugcggaauaagaucagcaacacgacuggaaaauauuauguggaagcaaauuucaaaugaacuaaaucauauuuuacuagaaaaugauaugaaauuuaccguaguugugggagauguuguaggaauccuagcacaaggaaagaaaaugaucagaccacaaccaauggaacacaaauacucauggaaaagcugggguaaagcgaaaauuaucggugccgacguacaaaauacuacuuuuaucauugauggaccuaauacuccugaaugcccagaugaucaaagggcuuggaacauuugggagguagaagauuacggcuuugguaucuuuaccacuaacauuuggcuaaaauugcgagacagcuauacgcaagcgugcgaccacaggcuuaugagugccgcaauaaaggacucaaaagccguucaugcagacaugggcuauuggauagaaagugagaaaaaugagacuuggaaacuagcacgcgcaaguuuuauagaagugaagacuuguauauggccgaaaagccauacguuauggagcaacgggguccuugagucugaaaugguaauucccaaaauuuacgggggacccaucucccaacauaacuacaggccaggauacuucacacaaacagcaggccccuggcacuuaggaaaacuggaacuagacuuugaccuuugcgaaggcacuacgguugucguugaugaacacugugguaacagaggaccaucacuaagaacuacaacuguuaccgggaaaauuauccaugaguggugcugucgaucgugcacucuuccaccccuacgauucaaaggagaagaugguuguugguaugggauggaaaucagaccggucaaggaaaaagaagaaaaucuuguuaaaaguaugguuucagccggcucuggagaaguagauuccuucagcuuagguuuauuaugcauaucaauuaugauugaagaaguaaugagaucacgauggucgagaaaaaugcuaaugacaggaacacucgcgguauuucuauuauuaauaaugggccaguuaacauggaaugauuuaauaagauuaugcauuaugguaggagcaaaugcaucagaccggaugggaaugggaaccaccuaccuugcacuuauggccacauuuaaaaugagaccuauguuugcuguuggccuuuuguuuagaagacuaacaaguagggagguucucuuguuaacuauugguuuaaguuuaguagcaucuguggaauugccaaauucccuagaagaacuaggagauggacucgcuaugggaaucaugaucuugaaacuucucacugauuuccaaucacaccaguugugggcaacccuccucucuuuaacauucauuaaaacuacauuaagccuccacuaugccuggaaaacuauggcaaugguuuugucaauugugucacuguuuccuuuaugccuaucaacaacaagccagaaaacaacaugguugccagucuuacuaggaucguugggauguaagccauuaacuauguuucuaauagccgaaaauaagaucuggggccgcaaaaguuggccgcugaaugaaggaauaauggcugugggcguaguuucuauucuccugaguucccuuuugaaaaacgauguuccucuagcgggaccucuuauugcuggggguaugcucauagcguguuauguaauaagcggaucgagugccgaucuuagucuagaaaaggcugcugagguaagcugggaggaggaagcagagcauucaggagcgucccauaauauacuuguagaaguacaagaugauggaacaaugaaaaucaaagacgaggagagagaugauacauuaaccauccugcuuaaagcaaccuuauuagcagugagcggcguguauccgcuuaguauaccagcuacgcuuuuuguuugguauuuuuggcagaagaagaaacaaagaucugggguauugugggauacucccagcccaccagagguagaaagagcaguucuugaugacgggauauauaggauuaugcaacggggucuucuaggucguucacaagucggggucggcguuuuccaagaaaauguguuccauacuauguggcauguaacaagaggagcagugcugauguaucaagguaaaagacuagaaccuucgugggcuucuguuaagaaagauuuaauauccuauggaggaggguggcgucuccaaggaucauggaauacuggagaagaagugcagguaauagcaguagaaccuggcaaaaauccuaaaaacguucaaacugcaccaggaacauuuaaaacaccggagggagaaguuggggccauagcuuuagacuuuaaaccaggcacgucgggcucacccauaguaaauagggagggaaaaauaguuggucuauacgguaacggaguaguaacaacauccgguacguacguaagugcuauagcgcaagcuaaagcaucucaagaagguccucuaccagaaauagaggacgagguauuuaggaaacguaaucuaacaauaauggauuuacauccaggcagugguaaaacgcgaagauaucuuccagcuauuguccgggaagccaucaagcgaaaacucagaacccuaauuuuagcaccgacacggguaguagccuccgagauggccgaagcauugaaagguaugcccauaagauaccaaacaacagccgucaagucagaacacaccggaaaggaaauugucgaucuaaugugccaugccacauuuacaaugcgauugcugagcccaguacgcguaccuaauuacaauaugauaaucauggaugaagcacacuuuaccgauccgucgucaauugcggcucguggcuacauaucuacgcggguagggaugggagaggcagcugcgauauucaugacugcaaccccaccuggaagcguagaagccuucccacaaucaaaugccguuauccaagacgaagaaagagauauaccugaacgguccuggaacucaggauacgaauggaucacagacuuuccagguaagacagucugguuugucccaucaauuaaaagugggaacgauaucgcgaacugccuacgcaagaacgguaaaagagugauccaauugagucguaaaacguuugauacugaauaucagaaaacgaaaaauaacgacugggauuaugucgucacaacugacauuagcgaaaugggggccaauuuccgggcugaccgaguaauagauccaagacguugucuaaaaccuguaauccuuaaagauggaccugagcguguaaucuuagcagguccaaugccgguaacaguggcaucggccgcucaacgccgaggaagaauagggcgaaaucacaauaaagagggugaccaguauaucuauauggggcaaccucuuaacaaugacgaggaccaugcacauuggacagaagcaaaaaugcuccuugacaacauuaauacuccagaaggaaucaucccugcguuauuugaaccugaaagagaaaaaucagcagcuauugacggagaauaucgccuaagaggugaagcacguaaaaccuuuguagaauuaaugcgacguggcgauuuaccagucugguuauccuauaaagucgcaucagaaggauuucaguauucugacagacgcuggugcuucgauggggaacgaaacaaccagguauuagaggaaaauauggacguggaaauuuggacaaaagagggagaaaggaagaaauuacgaccgcgauggcuagaugcgaggacauauucggacccucuugcgcuaagagaauuuaaagaguuugcugcgggccgaagaagcguaucaggggaccuaauucuugagaucggaaaauuaccucaacaucugacucaaagggcucagaaugcauuagacaacuuagugaugcuucacaauagcgaacaaggaggccgagccuacagacacgccauggaagaacugccugacaccauagaaacacuaaugcuccuugcgcuaaucgcagugcuuacuggcggagugacauuauuuuuccucucaggacgcggcuuagggaagacaagcauugggcuauuaugugucauggcgucaucuguauuauuauggauggcaagcguagagccccauuggaucgcugcaucgauaauucuugaguucuuccuaaugguucuucucauaccugaacccgaucgucaacguacaccacaggauaaucaacuugccuacguaguaauaggguuguuauuuaugauccucacaguugcagcaaacgaaaugggacuauuagaaacgaccaagaaagaucugggaauaggucauguggcaguagagaaucaucaccacgcaaccaugcuagauguagacuuacaccccgcaagugcguggacccuauacgcaguugcuacaacaauaauuacucccaugaugagacacacaauugaaaauacuacugccaauauaagccuuacagcaauagcuaaucaggcagccauccuuaugggacuugauaaaggauggccaauuucaaaaauggacauaggaguaccauuguuagcacucgguuguuauagccaaguuaacccacuaacauuaacagcugcaguccuaaugcuagucgcacacuaugcgauaauuggcccugggcugcaggcgaaagccacgcgcgaggcgcagaaacggacugcagcuggaauaaugaaaaauccaacaguggaugguauaguagcaauagaucuugauccgguagucuacgaugcaaaauuugaaaaacaguugggacaaaucaugcuacuaauucuauguacuucucaaauccuacuaaugcguaccacaugggcgcugugcgaauccauaacauuagcuacuggaccccuaacgacauuaugggaagguagcccaggaaaguucuggaauacgacgauagcgguuagcauggcuaacauauuucgaggcaguuaccuugcuggugccgggcuugccuucagucuuaugaaaagccuagggggaggacgcagaggcacaggugcacaaggagaaacacuaggagagaaauggaagagacaacucaaccagcuguccaaaagugaguucaacauauauaaacguucaggaaucauggaggucgaccgaagugaagcgaaagaaggcuuaaagagaggggaaacgacucggcaugcaguaucacgugguacagcuaaacugagaugguuuguugaacguaaucuaguaaaaccugaagguaaaguuauagaucuaggauguggccguggaggguggucuuacuacugugcgggcuuaaagaaagucacugaagugaagggguauacuaaaggaggaccaggacacgaggagccaauaccaauggcgacauaugguuggaacuuagugaaacuucacagcgguaaagauguauucuuuacaccaccggaaaagugcgacacguuguuaugugauaucggggagaguaguccgaauccgacuauugaggaaggcagaacacuaagagugcuaaaaaugguggaaccuuggcuuagaggaaaucaauuuugcauuaagauccuaaaucccuauaugccauccgucguugagacucuagagcaaaugcagaggaaacacggcgguauguuaguacgcaauccauugucuaggaacaguacacaugaaauguacugggucuccuguggaaccggcaauauuguaagugcgguuaauaugacuagcagaaugcuauuaaauagauuuacgauggcgcauaggaaaccaaccuaugaacgagauguugaucucggcgccgguaccagacauguagcuguggaaccugaggucgcaaaccuugauauaauaggacagcgcauagaaaauauaaaacaugagcauaagaguaccuggcacuaugaugaagacaauccauauaaaacaugggccuaucauggaaguuacgagguuaaaccaagugggagugcuucaucaaugguaaauggugucguaaaauuauuaacuaaaccaugggauguuaucccaauggucacacaaaucgcaaugacagacaccacuccuuuuggccaacaaagaguauucaaagaaaaggucgacaccaggacaccuaaagcaaagaggggaacugcgcaaauaauggaagugacugcuagauggcucuggggguuuuuauccagaaacaagaaaccacguaucuguacacgcgaagaguucacaagaaaaguuaggucaaaugcugccaucggugcgguguuuguagacgaaaaccaauggaacucggcuaaggaggcuguggaggaugagagauuuugggauuuaguacagaaagaaagagaauugcauaaacaagguaaaugugcaacgugcguguacaacaugaugggaaaaagggagaagaaacuaggugaauuugguaaagcaaagggaucgagagcuauuugguauaugugguuaggggcuagauuucucgaauuugaagcauuaggcuuuaugaacgaagaucauugguucucacgugaaaauucacucucuggcguggaaggugaagggcuucacaaauuagguuacaucuuaagagacauuucuaaaauaccagguggaaacauguaugccgacgauacagcuggaugggacacaagaauaacagaagacgaucuccagaaugaggcaaagaucacagacaucauggaaccagaacaugcuuugcuagcaacuucaaucuuuaaacuaacauaccaaaacaaagucgugagaguacaaagaccggcuaaaaauggaacuguuauggauguuaucucuaggagagaccaaagggggucaggacaagugggcacauacggguuaaauacauuuacuaacauggaagcgcaacuaauacgacagauggagagcgaagggauauuucuucccucagaauuagagacaccaaauuuggcugaacgaguauuagacuggcuugaaaaacacggcgucgaacgucuaaaacgaauggcuauuaguggggacgauuguguaguaaaaccaauagaugaucgguuugcuacagcgcucacagcuuuaaaugauaugggaaaaguuagaaaagacauuccccaaugggaaccaucaaagggauggaacgauuggcaacaagugccuuucugcucacaccauuuucaccaguuaauuaugaaagauggaagagaaauugucguaccuugccguaaucaagaugagcuaguagggagagcaaggguaucacaaggugcugguuggucucuacgugagacagcguguuuagguaagucuuacgcucaaauguggcaauugauguauuuccaccgccgagacuugagauuagcggcuaaugccauauguagugcaguuccgguggacugggugcccacgaguagaacaacauggagcauccaugcucaccaucaauggaugacaacggaagauaugcuuagcguuuggaaccgcguauggauagaggagaacccauggauggaagauaagacacauguaagcucauggggagauguaccuuauuuagggaagagagaagaccaguggugugggagccuaauaggacuaacagcgagagcaacaugggcaucaaacauucaaguagccauaaaucaagugagaagauugauaggaaaugaaaauuacuuagauuauaugaccagcaugaaacguuuuaagaaugagggcgaucccgagggagcucuuugguag

SEQ ID NO: 21900 - RNA, 9879 nt, Artificial Sequence
  derived and/or modified CDS sequence (opt6) from DENV-1__EU482794__SS-prME
ucgguaacuaugcuuuuaaugcuuaugccgacagcauuagcauuccauuuaacuacaagagguggagaaccacacaugauaguaacuaaacaagagagagguaaaucauuguuauuuaaaacaagugcggguguaaauaugugcacauuaauagcaauggacuugggagaacugugcgaggauacgaugacuuacaaaugccccagaauaacggaagcggaaccugaugauguagacuguugguguaacgcgaccgacacauggguaaccuaugguacuuguagccaaaccggggagcacagacgcgauaaaaggagugucgcccuagcaccccauguuggauuagguuuagaaacaagaacagaaaccuggaugaguagugaaggugcuuggaaacaaauucaacgaguagagacgugggcuuuaagacauccgggauuuacgguaauagcauuguucuuggcccaugcgauagguacaucuauaacucaaaaagguauuaucuuuauacugcuuaugcucguuacgcccucaauggcuaugagaugcgucggaaucgguaguagagauuucguugaagggcuaucuggagcuacauggguugauguggucuuggaacaugguuccugcguaacuacgauggcgaaagacaaaccuacccuagacaucgaauuauugaaaacugaagucacaaacccugccguauugagaaaauuaugcauagaagccaagaucucaaacacuacgacugauaguagauguccuacacaaggggaagcaacacuuauggaggagcaagacgcaaacuucguaugccgaaggacauuugucgauagagguuggggaaacggcuguggauuguuuggaaaaggauccuuaaucacaugugcaaaauucaaauguguaacaaaauuggaaggaaaaauaguccaauacgaaaaucuaaaguauucgguaauaguuacaguucacacaggagaccaacaccaaguaggaaaugaaucaaccgaacauggaacaacagccacuauuacaccacaagcucccacgucugagauucaauuaacagauuauggcgcauugacguuggauugcucaccgcgcacaggucuugauuuuaaugaaaugguguuacuuacgaugaaagaaaagucuuggcuaguacacaaacaaugguuuuuggaucugccucuuccuuggacaaguggcgccaguaccucacaagaaacuuggaacagacaggaucuguuagucaccuuuaagacagcucacgcaaagaaacaggaggugguaguccucggcucccaagaaggagcaaugcauacagcacuuacgggugcaaccgagauucagaccucagguacgacuacgauauucgccggccacuuaaaaugcaggcuaaagauggauaagcuaacccuaaaagggaugaguuauguuauguguacagggaguuucaaguuagagaaggagguagccgaaacgcaacauggaacagucuugguucaaauuaaauaugaagguacugacgcccccuguaaaauucccuucagcacgcaagacgaaaaaggggucacacaaaacggccgucuuauuacugcaaauccaauagugacugauaaggaaaaaccuguuaauaucgaagcagaaccaccauuuggagagagcuauaucgucaucggugcuggagaaaaggcuuuaaaacugucgugguucaagaaagggaguuccaucgguaagauguucgaagcuacggcuagaggagcgagaagaauggcuaucuugggagauacugccugggacuuugguucaguaggaggcguauuuacgucaguggguaaguuaguacaucagauuuuuggaaccgcauaugggguacuauuuuccggaguuucguggacuaugaaaauuggaauaggcgucuuauuaaccuggcuuggcuuaaauucucgguccacaagucuaaguaugacuuguauagcagugggacuuguaacgcucuauuuggggguaaugguacaagcagauaguggaugcguaaucaauuggaaagguagagaacuaaaguguggauccggaaucuucgugacaaaugagguacauacuuggacagaacaauauaaauuucaagccgauucaccaaagcguuuaagcgcggcuauagggaaagcaugggaagaagguguuugcgggaucaggucagcaacacgguuagaaaauauaauguggaaacagaucucgaacgaacugaaccauauauuauuggaaaacgacaugaaauucacagucgugguaggagauguuguaggaauacuagcacaaggcaaaaagaugauucgaccacagccuauggaacauaaauauuccuggaaauccugggguaaagcgaaaauaauuggagcugauguacaaaauacuacauucaucauagacggaccgaauaccccugaauguccugacgaucaacgagcuuggaauauuugggaaguagaagauuacgguuuuggcaucuucacaacuaacauauggcucaaauuaagagauaguuauacucaaguuugcgaccacagacuaaugagugcagcuauuaaggacucaaaggcuguacacgcggacauggguuauuggauagaaucggagaaaaacgaaacguggaaacuugcgagagcaucauucauagaaguaaagacaugcauauggccuaaaucucauacccucuggaguaacggugugcuagaaagcgagaugauaauacccaaaauauauggagguccuauuucucagcauaauuaucggcccggguacuuuacacaaacugccggaccauggcaucuagggaaauuagaauuagauuuugaucuuugcgagggaacuacaguaguuguugacgaacauugugggaaucgaggacccagcuuacgaacaacaacagucacaggcaaaauaauacaugaaugguguuguagaucauguacccucccacccuuacguuuuaaaggcgaggacggaugcugguacggaauggaaauuagacccgugaaagagaaggaagagaauuuaguaaaaucaaugguuagugcagggucgggugaagucgauuccuuuagccuaggcuuacugugcauuucaauaaugauugaagaaguuaugcgaucccgauggaguagaaaaauguuaaugacugguacccuagcaguauucuuauuguugauuaugggacaacuaacguggaacgacuuaauacgacuuugcauuaugguaggcgcgaacgcuucagaucgcauggguaugggaacaaccuaucuagcgcuaauggcaacauucaaaaugcguccuauguucgccgugggccuacuuuuuagaaggcuaacaucacgagagguacuucuauuaacgaucggcuuaucguuaguagccagcguagaauuaccaaacagucuugaggaacugggagauggccuugcgaugggcaucaugaucuuaaaauuauuaacggacuuucaaagucaucagcucugggcuacguuacuuucacuaacguucauuaaaacaacucuuagucuacauuaugcguggaagacgauggcaaugguguugaguauugcaucacucuuuccguuaugucuuucgacuacaucacagaaaacuacauggcuuccgguucugcuagguagcuugggauguaaaccauuaacaauguuuuuaaucacggaaacaaaaauuuggggucgcaaaaguuggccucuaaaugaagguauaauggcaguuggcguuguuucaauucuauugaguucacuucucaaaaacgauguaccacuagcuggaccguugauagcaggcggaaugcuaauagcauguuaugugauaaguggaaguucagcagaucuuucgcuagaaaaggcugcugaaguaaguugggaagaggaggcggaacauaguggcgcaagucacaacauacuuguaguaguccaagacgacggaacuaugaagauaaaagacgaggaacgagaugacacacucaccauuuuacucaaagcaacucuucucgcaguaucuggaguauacccauuaaguauuccagcaacacuauucguaugguauuucuggcagaaaaagaaacaacguagcgguguuuuaugggauacaccuucgccaccagaaguugaacgcgcggugcuagacgauggcaucuaucgaauaaugcaaaggggucuacuagguaggagccaggugggaguaggaguguuucaagagaauguauuucauaccauguggcacguaacgagaggagcgguuuugauguaccagggaaaaagauuagaacccuccugggcaagugucaagaaagaucuuauaucauaugguggcgguuggcgacuucagggaucauggaacacgggcgaggaaguucagguuaucgcuguagaaccaggcaaaaacccuaaaaauguacaaacagcgccuggcacuuuuaaaacacccgaaggcgaaguuggggcaauagcguuagacuuuaaaccgggaacuucagguucuccaauagugaauagagaaggaaaaauaguugggcuauacggaaauggaguugugaccacuucuggaacauauguaagugcgaucgcacaagcgaaagcaucucaagaaggaccgcugccagaaauagaggaugagguuuuccgcaaaagaaauuuaacuauaauggaccuacaucccggauccggaaaaacgaggcguuacuuaccagcgauagugagagaagccauaaagcguaaacuaagaacuuuaauucuagcaccaacgaggguuguggcaucggaaauggcggaagcacuaaaaggaaugcccaucagauaucaaacuacagccguaaaaucagaacauacggguaaggaaauuguagaucuuaugugccacgcgacuuuuaccaugcgccuuuuauccccaguacggguaccaaauuacaauaugauaauaauggaugaggcacacuuuacagauccgucuuccaucgccgcuagaggcuacauuagcacucgcguagggaugggcgaagcagcagcaauauucaugacagccacuccuccaggauccguugaagcauucccacagaguaacgcagugauacaggacgaagaaagggauauaccagaaagaucauggaacucgggauaugaauggaucaccgauuucccgggcaaaacuguuugguucgucccuagcauuaaaagcggaaaugauaucgcgaacugcuuaaggaaaaaugggaagagagugauacagcuaucaagaaaaacguuugacacggaauaucaaaagaccaaaaauaacgauugggauuauguuguaacaacagauauaagcgaaaugggugcuaacuuuagggcugaccgagugaucgacccaagacgauguuuaaaaccagucauucugaaagauggcccugaacgugugauccucgcugggccaaugccgguaacgguagcuuccgccgcacaacgccgaggacgaauaggccgcaacuacaacaaagagggcgaucaauacaucuauauggggcaaccauuaaacaaugaugaagaccaugcacacuggacagaggcaaaaaugcugcuagauaacauaaauacaccagaagggauuauaccggcacuguuugaaccagaaagagagaaaucagcugcaaucgauggggaauauaggcuacgcggggaagccagaaagacguuugucgaacuaaugaggcgaggagaucuuccagucugguuaucauauaaaguugcuagcgaaggguuccaauacucagaucguagaugguguuucgauggugaaagaaauaaucaaguccucgaagagaacauggauguggaaaucuggacaaaagaaggagaaaggaagaaauuaagaccuagaugguuagacgcuagaacuuacucagauccccuagcacuuagagaauuuaaggaauuugccgcuggccgcaggagugucagcggugaccuaauucuagaaauagggaaacuuccacagcaucugacccaaagagcucaaaacgcuuuggacaacuuaguaauguugcauaacagcgagcaagggggucgggcuuaccgccacgcaauggaagaacugcccgacacaauagagacccuuaugcuacuugcguuaauagccguccucacaggaggggucacacuauucuuuuuaucaggcagaggcuugggcaaaacaagcauaggucuacuauguguaauggcaaguucaguccuucuauggauggcaagcguggagccccauuggauagccgcgagcauaauauuagaguucuuuuugaugguauuauuaauaccagagcccgacaggcaaagaacaccgcaagauaaucaacuggcauaugugguuaucggacuguuauuuaugauacucacaguagcagcaaaugaaaugggucuccuagaaacaaccaagaaagacuugggaauaggacacguugccguugagaaccaucaccacgcuacuauguuggacguagaccuucauccggcuagcgcuuggacgcuuuaugcgguagcuacaacaauaauuacaccuaugaugcgacauacgauugaaaauacgaccgcuaauauaagccuuacagcaauagcgaaccaagcggccauauuaaugggucuggauaaaggauggccgauuucgaagauggacaucggcguaccacuacuggccuuagggugcuauucucaaguaaaucccuugacacuaacagccgccguacugaugcuaguagcacauuacgcaauuaucggcccagggcuacaagccaaggcgaccagagaagcucaaaaacguaccgcagccggaaucaugaaaaauccuacgguggacgguauuguagcaaucgacuuagauccaguaguauacgaugcuaaauuugaaaagcaauuagggcaaauaauguuacugaucuuaugcacuagccaaauuuuacuaaugagaacaacaugggcauuaugugaaucaauaacgcuagcaacaggaccauuaaccacacuaugggaaggaucgccugguaaauuuuggaacacaacaauagccguaagcauggcaaauauauuuagaggaucuuaucucgccggugcaggacuggccuuuuccuuaaugaaaucauugggaggcggucgacgaggcacuggugcccagggagaaacacuaggggaaaaauggaaacgacaacuaaaccaauuaucaaaaucagaauuuaauauauacaagagaagcgggauaauggaaguagauaggagugaagccaaagaaggauuaaaaagaggcgaaacaacaaggcaugcuguuagucgagggacggcuaaauuacggugguuuguugaaagaaacuuggucaaaccagagggaaaagucauagauuuagguuguggacggggagguugguccuauuacugugcaggacucaagaaaguaacagaagucaaaggcuacaccaagggagggccaggacacgaagaaccuauaccaauggcaacuuacggauggaauuuagucaaauuacauucugggaaggauguuuucuucacgccuccagagaaaugugauacgcuauuaugcgacauuggagaaaguaguccaaaucccacaauugaagaaggacguacucuaagaguuuuaaaaaugguagaaccuugguuaagaggaaaucaauuuuguauaaaaauccuaaauccauauaugccguccgucguagagacacuugaacaaaugcagcgcaaacacggcggcaugcugguucguaauccguuaucgcgaaacucgacacacgagauguacuggguaagcugugguacggguaauauaguaagugcgguaaauaugacgucuaggauguugcuuaauagauuuacaauggcucaucgaaagcccacuuaugaaagggacguagauuugggagccggaaccagacauguggccguggagccagagguagcuaauuuagacauaauaggacaacgaauagagaauaucaaacaugagcacaaauccacuuggcauuacgaugaggauaauccauacaaaacgugggcauaccaugguucauaugaaguuaagcccagugggagugcaucauccauggucaacggaguagucaagcuccuuaccaagccaugggaugucauaccuaugguuacccaaauugcuaugacugauacgaccccauucggacagcaacguguguucaaagaaaagguugacacuagaaccccaaaagcuaaaagagggacagcucagauaauggaagucacagcuaggugguuauggggguucuuaagcagaaauaaaaagccccguauauguacaagggaggaguucacgcguaagguccguagcaaugccgcaaucggugcaguauuugucgaugaaaaucaauggaauagugccaaagaggcuguagaggaugaacgauuuugggauuuaguacagaaagagagggagcuucauaagcaaggaaaaugugcuacaugcguuuauaauaugauggggaaaagagagaagaaacuuggugaauuuggaaaagcgaagggaagucgagcaaucugguauauguggcucggcgcgagguuucuagaguucgaggcgcuugguuucaugaaugaagaccauugguuuagcagggaaaacucacuuaguggugucgaaggcgagggccuccauaagcuagguuacauccuaagagauauaucgaaaauaccaggagggaacauguaugccgaugacacggcuggaugggauacuagaauaacugaagaugaucuacaaaacgaagcgaaaauaaccgauauaauggagccggaacacgccuuauuggcuacaucgauauuuaaauugacuuaccagaacaaaguaguuagaguccagcgcccagcgaaaaauggaaccguaauggaugugauuucacgacgagaccaacggggaucggggcaagucgguacuuacggacuaaauacguuuacuaacauggaagcucagcuaauaagacaaauggagagcgaaggcaucuucuuaccauccgaacuagaaacaccaaauuuagcagaacgcguacuggauugguuagaaaaguauggagucgaacgccuaaaaagaauggcaauuaguggcgaugauugcguagugaagccaauugacgauagauuugcuacagcccuaaccgcauuaaacgacaugggaaaaguuaggaaagauauuccacagugggaaccgaguaagggauggaaugauuggcaacagguaccguuuuguucucaucacuuccaccaauuaauaaugaaagacgguagagaaauagucguuccgugucgaaaccaagaugaguuagucgggcgggcgcggguuagucaaggagcaggauggagucuacgugaaacugcuugucuuggaaaaagcuaugcacaaauguggcaacuuauguauuuccaucgcagagaucuacgacuugcagcaaaugcgauaugcucugcagucccaguugauuggguacccacgucgcguaccacuuggaguauacaugcacaccaucaauggaugacuacggaagacaugcuaagcguuuggaauagaguguggauagaagaaaauccauggauggaggauaaaacgcauguaucaucauggggugauguaccauaucuaggcaaaagggaagaucaauggugcgguagcuuaauaggguuaacggcucgugcgacuugggccucuaauauacagguggcaauuaaucaaguuagacgcuugauuggaaaugaaaauuacuuagauuauaugaccucgaugaaaagauucaaaaaugaaggagauccugaaggagcucuaugguga
